United States Patent 9,567,581 (SELECTIVE REACTIVATION OF GENES ON THE INACTIVE X CHROMOSOME) - sequence listing, part 21

SEQ ID NO: 3026 - DNA, 528157 bp, human
ggctgggctgcgaatagcgtgttcctctccggcggaacacacacacccggccttggggctgtctcctgagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggccgcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccactgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgaggtagggaccagcgctgcgcgtcccacggcccaaggaggaggcccccaggcagtttcaggagaccgcctttaattccattacatttacagagcaaggcacccactaaggggtttccgtggtgtgggttttcctcttctacttgctaaatggtgcctggaaatgggatgtccctagtggccacccgcttgtgcgtcttgtaggacttgttggctctactttggagcagtcgtgggagctggagaaagagatggtgttctggttttctgttagtgctgcaggcaatttcaaagggtcaccttatcccttcacccaatgttgatattttttccaactcaaatatctattgctaagctgtttgtaacgattggatgaaatatattttgaaatatgtctgccatcttgttctgtagagaattcagaaacattattttggagggtgtcattgactgtatgagtgagtgtgtgtgtgtgtttgggtggcaggggggacaagaattctctagttttcaccttttctttccctgaaggggcaatttcagaaatctatggtactgagtattagtttaacctaggagaagaagaaaatctctgtgtaggggtgtgaaagatcatggaaatatgctgatgcctaaattccatttagaacaattagtagtttagtgaagaatcaacaatacataggggactcagagggagctatcagatacccttaaaatatttgctgtccagttaagaaaaatagtgaattgacctattgggaaactgtcactgatgggcgctttgaaaataacacactttcagagaatagtaattgttttaaaaatgaacagcccctatccccttcggtccacaaactctataggtttgccttggatctgtttccataagggaagggagattccatcagttgtaatttaatattttaaagtacagttagcattacagaaatgaaatgaaataccatgtaattgctggagatttaggctaaatacacaaccaaggaaaaccgtttgaaaatagcatctgagatcatactcagctgtgttaatgtgagataactgttagactttggctttagtaaaccgccttagaaaaataagcatcatttatcagaattattagcatcacatattattaatgttagttactgtgtcaaagtaactgaggctgttaggtgttgggggtgcagattacaaaaaactaacaaattttgctaggtcttttgcccattttcttgagaaagataggcagtagaaaggaaagtcgaggcagagggcaagatgttacctccaaaccagggaactcaagattagaaagagcatcaaaaattgaaatgttgaatttctcttggtctttaggaggggctggattctcattgtatttcagaagcacacattatcagattaatctgtacaagttgagagaaagagaaatacaaaagcaagccagcattttggattagctagctaacattcgtgcttaaaactaattgcatcattaagaacatttctgcttttcttagcaaccatatacatacttggaatatagtatacagatgctgctcattactgttatgaccaaaaggcatgtggctgtagatgatttcacttgttgcaaattatcttcttatccattagcatctcataattaatggacaaggatctgaactgcagtgatactgggtggcttctattccatacagtgggcagtctgcacaaaactcatctaccatgatttttaccttttcatggtggttaaaactaaggatgtagccatctagcaaaaagccagaattttctcatagaatatgtgtgtatgtgtgtgtgtgtgtgttggaaattcctttatgcttgaggcaggcatggagtgattggatagaactctagcatgtagctccaaccctggttttgtttaataaaggccaagatatcctaacataacccttggatctctaatttaatggcctggattacctttcaaaggtttaacgccctggaaccctctgaaaaaccaagaaaatgtatcctattgggcactgcctgtccttttcacttgcaggcaagctgagtctttggtccttaaaggagagtctttactaatgacatcaaaatgtcagccaatgagcatcttgcaaggctgcttagaggccctggagggaatatctggttcatatagatttggttcttgaacttttctggttgctctggctcagggtttctcagccttggcactattgacatttgaagctgaatgattctttgctacagagctgtcctgggtattgcggggtatttagcagcacccctggcctcttcccactagatgcgagtagcactcctccagaccagtgtgacaacaaacaatgtctctagacactgctgaatatcctctggggatcaaaatcgccctaactgagaactgctgcgttagtgaggttgcccatagtaccccatgctggccatcaagagagtgcccacagaagtgtttacagctggcctaaactttgttggcgccttcgtttgattccaaaaccacgaggatccctctggagtcatgtaccccttacagtctgttcaaattttctatttctcttccattgaatccatatgaaatcctaagaattcaccttcaggtttagccattgatggatctcatccatttcccactttgttctttcagaatcttgtctgcttttaacgtaaattgtccatacaacagcccctgctcccaagactctcacaaatgcctgcagctttgttacttgtgctcgttcaaagcttacaaatgaccattttatggcctaaacctgggaagtgttaggcaaagtcagctacgatcttgttagcatttcctcactacgtgtttcaggattgctttaacaaaatctgattcctggacatgctgggtagatcatctattgagtagaaacatggaggagacaaagggtaaatggtacgtggtaacacagttggaacgtgtttctcaacttgtgttcttagcagccaagctctgcccctgactctgatcacaggcaaaggaataaagtctcatttcaatcctgagcttctcctaattcttgtggatcagagctgggattatgtccatagctaacctggagtttgccaacttttgcaacccataattaaaatgatttctatatatcactggcgtctatacttttcttcattcatggcacaagcatttcttgagcatacgcatttctgtaggtactaggaatgcagagaggctaaagagctcatagtctaatgaggggacaggtgagttaactgatagggggaatacagaagatcagcagaatgagggaacagagaggggcgggtgatgattcactgtgctttggggggccttgaaaggcttcactgtccagagaacatttaaacttgatcttcaaagatgactgccatttctaaggagaagaaggaaagtgatgccttcatgaggcagaaaagagtggacaggcaaaggcgcagaggtgttggtgattctacagctcccaaaaaagaagacttagagggccctaagcgcaataatttgtttggaggagcaggttagggcacctgcagtttgatacacgtacaaccacatggcttttcatgtaataaaagcctgaccgaataaagtcagaaatcagacctgttgggttttttttttttttttttttttttttttttttttttttttttttttttgagagagagagagtctcaccctgttgcccaggctagagtgcggtggcacgatctcagctcaatgcaacctcccatgttcaagcgattctcctgcctcagcctccccagtagctgcgactacaggcatgcaccagtagagactgggtttcactatgttggccaggctggtcttgaactcctggcctcaagccatctgcctgcctcaccctcccaaagtgctaggattacaggcatgagccaccacacccagcctctactggggggataattatgggtatgaacaaaaatgagagactggtcaaagcacattactctccaaggagcccctgggcatcacaactgcagagagtgaaggcatattgagtgttgcccaagtgaagtttggggtgcctggagaagaggatgtatcttgctgtgtgcaggataatagtgttcaacaggtaggatagtggtaattacgaagcgtctcactgtgctcatctcaggagtttggacttgtgtagagcagtgattcttaacctggaggtgactttgtccccaggggacatttggcagtgtctgaagacacaactggaagtggtggtgtattaatttcctatcactgctgtaatgaccacaaacttagtggcttcaagcaacacaaatttattgtcttacagttctggacctcagaaatcccaacaggtttcactgggctaacttcaaggtgttggcctgactgtgttccttctgaaggctctaggatctgttgtggttccttttccagtggcccccttccttcattttcaaagccagccaagttgcatctcatccactcttcttgtgtggtcatttctctctctcgctcttttcgggactcttgtgattacattgggctcacctggataatccaggataatctcattattttaatgtcagctgattagtgacttttaattccacctgaaaccttaagttccctttgctatgaggtattcacatgttttagggattggggcgtgggcatttttggtggtatattattctgtctaccacaggggagttcctaccggcatctagtgggaggccagggatgcttcttttaaataccctgcagtgcacagccccacaaggaataatcatctggcagtcaatgttaggagtgtggagactgagaaactctgctgtagagagtgggagaaattggtgatttttaagcatgaggtgtaacatgatcagatgtgttttagaggtaaactggtgtctgggggagcatgggttagaagcataaaacaagtggaggacagatcctcagaggaggtgggcatggggaaatcatgccaagcatgcatcctataaataactgggagttggcatataaacataatacttttatatttcccacttctctgttttagtaaagtttttcttgctctgttgaactccttgaaagcagaactgttactcatctttgaattcttaaaatctggcccctgtactctgggggttttagagagatcatcataaagaccagtggttctcaaccaggagaaagtttgtaccacagtgtacttttggcaatgcctggcagcatttttgattgccagaactggggcaggagtgtgctactggcgtctagtgggtataggccaaaggtactggtaaacatcccacaacacacacaacagcccccacaaacaaatacttatcttacataaaatgtcaatagtgctgaggttgagacgccctgtatacaagaaactgaattccaggttttgcttttcagtaccattttctctcatgcttgtggctttactctttgtcattttcctcttcttatctagtatatgtcaaccaaggctttgaaattcaaaaaaatgactttctatgggtattgagcatatgaaaaaaaataagggatttctaaatatatctatagggaagaagtgaatggtaaatatataatgatggaaactggaattaaattttaaaatgcagcagagaaaaatattgtgtttaaaaatagaggctcattcatgtcaccaaagagaaagtaattagaataagacagcttcaaaaagaaattgacaaaaagtgttttacaaggatttttgtctgaaatcagtataatgccttaaggtttttttaagttaggaaaaagagttattcaactttcacacatacactctctctcaggctatctctctgctagaattccttctgaaggcaatttttaattttaatggagaatactgtgaagatagcttctcagatgacttagaattgagttttcaccaacattttgagatttgagggttgggaagagcaaagtttagactcagaaagaaccttgggtagcatctagctccaaattgcttattttacagttgaagagagggactgtaaagcttaagccactcaaactcaggcaaagagccaagggcagaaccaccctgaaatccttcttgactctctatataaactgccaagcttctggaaaaagtaagtgaccacgactgcttttattctctggtgagcaccttaaaccttggcaatcagtttttatcctgattacgtactgaaactattctctcaaagttccctaagttccaagaatcttcttagactcctttggctagacttctgggcaaaactgagagtaccacgtcccctccctgctcctcctatccccatcacacacagagaatcttggtttcctccttacctttcttcccactcctctgactctgggattgtcttggccaaccctacagttctgtgtttttccttcaggtcattgtccctcctattgtctcattcacttttgtgacttcaaccatcatccctctgggggagactcctcactctgtgcctacctggaatcttgtagttgagctcccaatatatattttctgatttcttcctagatatctgctcatggatgcccaatggactcaaattctacatgtttgaaacagaacaaatcacctcccatttcctctgaacatgtttcattttatgtattccttattttggttggtatcgctcttcttctgcttgcctaggtttaccaggccagaatgcctttactcctcccttttttgtttcctcctttattcttccataagttttcgaacgctgcagtgtgtacttcccatttgctccactctagaaaggatttgaagtggagtgtgtctgagttcttacatctctctccagctgttcattcacaatgtcactgcctagtttgggttctcatttgctgtgacccccttcttggtcaccctgccttcagtttctccttgttgccatcttggacttatcctcaaaagatgcaattgtaatcatgttaacccctgattgaaaacctttgatgggtctcagagtgtacagaataaaatccaaactacttagctagtcatttcaatgccttttacaacatcatctcagcctgccttctcccaggaactctagtccagcaaagccaagctggccactcacacagatagtcatcaaatatttatcgcatgccagctatgcaatggacactaggaatgtaggtggagcaaataggtatggctctgcaaggtgcttccagtttatgaaagcagtaacttcaaatcaattaatctctatagttttttcagagtgttaattgcattttgacgagaggactgtggtagacagaacaatgtcccccaaagatgttcatgtcctaatatctagaacctgtgaatatgccactttacatggcaaaagaggattttgcagatgcgagattatcgtggattgtctgggtggggccaatgtcatcacaaggatccttataagagggaggcaggaaggtcagagtcagataaggagatatgaggatgaaagtaggcagagagagagaaagagggagagcggaaaggagggagggatagggcaatgagagagattttgaagatgctacacttctggctttgaagatggaggaagcagccacagcccttggctgtagcagcccctagaagctggaaaaggcaaagaaatggattcttagaaccttcaggaggaatatagctctactgacatcttgatcctagctcagtgagacttctgaccttgaggactgtaagagaatatgtcagttgttttatgctacaaaatttgtggtaatttcgagcagcgataggaaactgatacaaggcataaacaggtctgggatgtctcagctgaaatcattggatgaggaggcatttgccaaacaaaaagaaagggcacagagctcctgcgagaaggaatggcgtgtatttaagagggaacatagcatgcttcaagaatttagagaaatccaactagaatggattatgggattgggaagatggtgaagaataagtctcgctggactttgggcttaatgatatggattttaccatttaatgtaaagattccccacatagattttgtttcctctccttctcactttacttttgataacttggtcccatatctacctgagaaggctccatttgtactttatggctcagccaggtgcctccaaataaatgagcttgactctggtacatgtcatgacacattcaggatttgcagaaacagaagctcatgttttcatagtgagattcacattcttccaatctggtgcttgaaaaagagaaagtgtgtttcatatcaaaatctagtcaatgactgagggagtctgcatgcagatagcagttctcccagattcccagaggcttgcctttggggcgtgacatcttgttctaaaatttactgcatcctctctgagccattacttagataaagagagtgagactgtgattgtaactatgttacgacatggcagaaaaacccttggaatgtaatgtgtgaaaaaatgaaattagttgtgttatctggtaaagaacgatgttttcattagctattagggaaacgtgaatcaaaactacaatgagatatcatttatacccactaagatggccataataaaaaaagatagataataacaagtgttgacaagatgtagaaaaatcggaactctcatacactgctggtgagaatgtaacatgacgcagcagctttgggaaacagtttggcaattcctcaaaaataaaacagttactccagagctcagcaattctacttctgggtatatacctaagagaaatgaagatgtatgtccacaccaaaacatgtatatgaatgttatagcagcagtattcataatagccaaatggtagaaacaattaaatattcatcaacggatagatgaatggttaaacaaaatgtgattaatgaaaaattactcaacaataaaaaggaatgaagtactgatgaatgctatgccttggatgaattttgaaaacattatgctaagtgaaagaagctagtcacaaaggtccacatattgtataattctatttatatgaaatgtctagaataggcaaatccatagagacaaaaagattacttgttgtcagaggctggtagggagggatgtggagcgacagctaatgggtataaggtttcttcttagggtaatgaaaatgttctggaattagatacaggtgatggttgcacaatcttgtgaatatatttaaaaaatcactgaattgtatactttaaaagggtgaattatatggtctgtgaattttacctaaaaatgatatttataattttcagaaaatatgttgttgccacatcttgttttcaataaaacataaatataaatgtagaagagtagttatatagtcagttgaagcttcatgtattcaacatgaaactagggaggtagtaacggctctgggagattgaacagagtcgtcggcagccagccatgggattttctgagattggttactgtggaaattcgatgtcctgattattgcactttgaaagcaagcacagagaagctattaaaagattgctttttcagagaggcagagattttaaaaactacttacaatcttgaaaaattgcctggccttatctcacctgaactattaaaaagcctaagattttcaggagccgttagaagtaacagtaattctagaaaccacctatcgaatgatatgctgatggatccaagaggagaatgctgagcctgagaagctctcctcatctttagagaaattggaagtgaattgaattatgtggcttgatggaccaagaaaataacatgttttcatttctgtagaagtggacagctcatggaaataggtgaattaataccacctataggagctgaagtgtcaataagcattggatcagttctcagcttgtattgctcataacttcatctctcaggggtttgaaaaacaattgggcaagctggtactttgaggcccagatatagatggagtaggggaaagagaagccttaggcaacaatagccatgctgcctcagcgtttaatataacaagggctttgatatagctagtaattttgtccagggaaatcctggactgggccagcagactttctgagcaaagtgtaattctgctcaaattagaacctccaggtgatttcttgttcacttatttcagtcaaataatcgttgatgggtgaggatgatgatgatggtgacaaacaaaataacaattagtatttgtagaatgcacgccagtttagtgttcttagaacaactctgtggggtgatagtatcaaccttcattttatgagtgaggacactgagactcagattcagaggtaggcagatttagctgcagagaaaatgaagtgaatcggttcagctagactctgaaccagactgcctaggtttaaatcccagctctgttttgtgacattaaacaaattattaagccccttttttgccttagtttcttcatctatcaaatgagaatgatgaaagtgcctacctcaaagagtttttgtgaggatttcatgtcataattacctggaaagtgcccagcacgtaggaagtactaaaagatgcataggagtgcaaggctaaataacattagagatgtggtcacacactaggaagcaacaaaggtaagacctaagctaaagaattactttagtcaaaaatagttatcgtgcacctactatgtgtgccagaaactttggtcagtgagttaagcccagctgcatgagacaacagcaggaaacaagtggaactttattttgcgagctgttaaataaggtatagttttcatggtaggcattggagtgacagcaggctgtcactccaggcattttggcctagtgacttggaacacaggaatttgtcagacttgtattgtggatttggtgtaacccaagacatgccaataggccaaggggctgccttcattccagtacatggtaacttcattgcatttagacactttttagtagaatatttagaatgttggaaactgaaaagttcttagtcgagccctgttctttaactggtaaatggcagtgtgcttctcatttcaagccaggtgtgtttttatttccacatactacagtgattacatgagaccaagttgactgcttttcaaggcccatctcattcaacatctttccagggtaaaaacgcagcagcactaagttaagacaatcctatctacaatcagattctctttttgctcaaaatctaaatgtaaactccattagcatttctagactgattttagcattctacgagcaaatagaatattaggaagaaaaagtccttgaaggtcttctgtctattccaaacatccatgtcgtgcttaaatcccatctatgacacccccagtctatgcctagctatcacccacaaacagagaccttcatggttctgcctttagattataatagacataaaaattctccatggaactgtgttcacaaccagtctccctgaaactttcatcatgttacagacaaattctgcctctctggttttccagaaaatcactaatactgaattattattgttgctagggaagtacgggttggcctagcttgctttctgagcatcaacacaaaagtttgggtcatattttctttctggcagatgagaattgtgaatatatccaactacaactggaaaatattttaaacgaaagttaaactcttgcccccaaaggtattttgcaaactgcttatagaaactaggtttaggcagggaatcctttacccattgcttgtttttgttgggtttgttgaaggattccctattcagtaaatggtgctaggataactggctagtcaatatgcagaagattgcaactggaccctttcctttcaccatatacaaaaattaacttgggatggattaaagacttaaatgtaaaaccgaacactgtaaaaaccgtggaggacaactgaagcaataccattcagaacataggcatgggcaaagatttcatgacaaagacaaaaccaattgcaacaaaagcaaaaattgacaaatgggatctaattaaactaatgagctgcacagcaaaagaaactatcaacacagtaaacagcctacagaataggagaaaatttttgcaatatatgcatctgacaaagttctaatattcagcatctataaggaacttaaacacatttacaagataagaagcaacgctattaaaaagtgggcaaaggatatgaacagacacttttcaaaagaaggcataaatgtggccaacaatcctatgaaaaaagctcaacatcactgatgattagagaaatgcaaatcaaaaccacaatgagataccatctcatactagtcagaatggctactattaaaaagtaaaaaaataacagatgctggcgaggttgtggagaaaaaggaatgcttatacactgctggtgggagtgtaaattagttgaaccactgtggaagacagtggggtgattcaaagacctaaagacagaattaccatctaaccccagcaatcccattactcggtatatacccaaaggagtataagtctttcttttataaagatacatgcacatccctgttcattgcagcaccattcacaatagcaaagacatggaatcaacctaaacgactgtcaatgatagactggataaagaaaatgtggtacatacacaccatggaatactctgcagtcataaaagagaatgagatcatgtcctttgcaggaacatggatagagctggagaccattatccttagcaaactcacacaggaacagaaaaccaaataccatcatgttctcacttataagtgggagccaaattatgggaactcatggacacaaagaagggaacaacagacactggggcctacctgagggtgagcagtgggaggagggagaggatcaggaaaaataactaatgagtactaggcttaatacctgggtgatgaaataatctgtatagctaaacccccgtgacacaagtttacccatgtaacaaacttgcacatgtaccccaaacctaaaataaaagttaaagaacctaggattagtactcacagtctctagattcccgctgctgatgcaatgagtcaggtttctgcatttcatgatttataagagagctcaaagacagatacagttttcatatcatatcagagtgttactctagatatttcagcaagtcctcaaggaggtgtgttgaatctggcttctaatgttttaatatattgtcaataaatgatattgtcagaatgtgtcaaaatgctgagaaagtaaacatgaaaggtgatatgaagattatccacaggcttgaaggtcacaaagtgtgatatgaatcccagaccagctccagacactccaaggcatgagctcagcaaatatattgttgttctgctgcaatggcaatattttaatcttctaatttatgattgaattgtaaatatattactttttctcatgtagctgaaagtgtatggtgaaagataggtatagtgttatggaagtaatcaaatatttaggtttttgttcagggttctttagctgaaattagttattcagagttacaagtttaaaaaatgtgaaatagttcattttctttgagctattctgttttggtgctccctggggagagccggatgcaggagagtcaatggatcttgattgtctagtttgcctttcctcatcaagaaatagccttttttacagaaaatgtttaaaatcctactgtgtattttactctccttatgaggttatcatttctaatttatataaagatatagtagatgctgcttatataaatgttcattgactgaatctaaaaccaatctaaaaataaagttattttttaaaaagttcattgaataagaaagttgaatgattgggccaggtgcagtgactcacacctgtaatccccttgaaagcaggctgaggcaggaagatcacttgaggccagaagtttgagaccagcctgggtaacatagtgagaccccatatctacaaaggaattttaaaaattaaccaggtgtggtggtgggtgcttatagtcccagctacttgggaggctgaggcaagaggattgcataggcccaggagttcaaggttgcagtgaaccatgatcgtgccattgcactccagcctgggcaacagagtgtgactctgtcttaggaaaaaaaaaaaaaaaaaagaaaagaaagttgaatggtcaagaagaaaattaacaatatatttgcaaagattccttccaattaattaattaaatgtttctatgcaatatttttataatgcagaaagttgattttttcattttatttaaaaagacttcttacagagttttagatcacactctattagtataatttccctgtctatatgtacatacatgtaacttttaacttaataactgctttataataaaaaatgaaaggttggctattaccatatataattggagcaatgtggttacattatttttatgaaaatacaagtttttaaaactttgtgaagaaaagataagagtggcaaaagctctgtttcttagtctgagttttcccaaaggcaggatctgggtgaaagcagtttatttgggaggtgctctcaggaaggagtaatgaagaaaaagggataatgaaatggggaaggaggggaagtaaagctgtatcttggaagttgtaattgtggaaaaagggatgattcaagttccaccaggactgctggaaaatgtgtagaatgtctatcgagatgatctacccatgttttagttctctattgctgcataacaaaccacctccaaacttagtggcatgattctgtgggtcaggaattagatcacagctcagctgggtagttctttggctctgcatggcattggctgggctcgctcacttggctgcttccagctggtgtctgggatgcctggaaagttcaaggtgtcttcattcacatgtgtggtgcctcagtgatcctccatgtggcccttctctctccaactgactagtttgggcttcttcactgaatgttggtctaatggtatttgatcagagtgagtcacagggccagcccagattctagggcaagggaaaaagagtctaccccttgatggaagaagtgacaaagaatttgtggtcttctttaatctgccacgagctaaaggaagggaagctggagaatgtctctgttggtttccatcttccattttttaagattgcttctggggttttaacttccacatgcttcttacatatgatgaggtgtgcactagagatgaatcactagcagcacacaacgtcagtccgagcttgcacagaactgcccagcacagttgtagcagaactcaaaaactttagcacaggctcatgggaagtagcatttagaatcagtcacccacaatcttagctactcaaaaacataactgaaggacaatatgatcttagacaagcctaggatcaaatctcagtgccactatttattaggtgtgaatttcagttttctcagttgtttaaggggagtataacagtatgtactttgtaggagcttgtgaaatgaattggttgagggtacacaagctataaggggtcatgtagaagtatttattgtttattactttaattcgttctcaaatgttataggaaggtgtacatcaattttataatgcttcagcgggaagaggaaaggcaacaatactatggtaaatgtaaagagcaattgtaagatgcaactttaggttttttaaactgtagggaaaataagtagtagttgaagaattatgatacaatgtagtttatcctctacattcatgggaactaagaaacaaactttggcaacaggtttattactggggcaatcttggtaatgtttttaattaatactttaacaaaacttataattgatacataacagttgtacatatttatggggtacagtgtgatatttcaatgcatgtatacattgtataatgatcaaatcagggtaattactctgtctaccactgtagacatttattatttgtggagataacattctataccttctagctatcttgaaatgtacactttattgttattaggtatagttaccctactgtacaatagaacatcagaacttatttttcctgtctaactgtaactttgaaatacttttaactgaaatatagaacttacttggatttttatcagtttttccgctaatatccttttcctgcttcaggacctgattgatgcagaatctcacattacatcaggttggcaaggcttcttggtctcctccaatctgtctttatttatttttcgtgagcttgccacttttgaaaagtattggtcaggtattttgtagaatgtccctcggtttcagtttgtctgattttgcatgattagaatgggatacttggaagaatacataaaacatcatttgaacaccaagtgtcactgtttatctatgttagtaaaatacaatgtttcttttattgatgatgcttttcacccaatcagcccacattctcctgtcctgtctgcctggtagcatggccatatgcgtgttgataagatgcaatactgaaggctgtgctgagggactgaagaaagccaccttataacagtgacctcattagcagccaactgacttcattggcccttcagctggattctctttctctgtaatttggattcgcctgcccttttttttccattacatgggaagctctctggcaggctattgctttgtctgtccttattgccgcctcggggcatcaacagcatgtctttgggtgctgcatttgttaatgtgggaggctaagagaaatccaagatgaaaatactccttgtcattcccctgtcagaagggggaggaagagctaagctttgagtacatattcatttacatcagcagcattcttctgtgctcattggttgcttacttctctcttattaacagtgctagaataaacacacaaatctaccaaaatattagcagtgtgtgctgttttctttcacttgccaggattgttttataataaataccattggaaaaaataccactggcaagcatcctcagcaattacgttaacatctctagagaacaaagtatggtatcggaaggtgctttgcaaagaggagcagaacgtgtctggtttatactgcattccttgaatatactgatcttgttacctatgagtttgattttaacttaggtatttctcttgattgacaaaaattgatgccatcattttgtatgatattcactaattaaatatattttggaagacaaatataaaggttcctttaaaatgaagtgacactaaaacagatgttcataatgtgctttcatggtaggaatttgtagattaaatcagatattcatgtttgtcaaaatattttagtcaaatggaagaaatgagttttctcaacaattttgtttgtttggcttatgtcatgtcttagtttatttcaactatcatttctatcctttagaggtaaaaattgttatttctctccccagttgaaccctagttccatatttctgtttgcaaacaaaatgtttctacttgttgattccaccatcacttcaaactctaaatatttaaaataattaccaaccctttcccccaacaaaggaaaagtaaatacatgaatatacaaaccgcaaccagttctttctctaaaccttcctgttttcttctgtgataaccatttttgtaaccttggaatcttgaacacatttcttattgttcctcagcgtttatattctgtattgaaatgacccccaagacttgtctcctgttctaggcaatgttcctatttagccttttctctctgttccaccgggcatggcccttgtctctcatgctgggtgatatggtttggctctgtgtctccatttacatctcattttgatttttaatcctcatgtgtcgagggagggagagacctgtaatacccatgggtattacatggagagaggtggttggatcatggaggtgatttcccctatgctgttctcatgttagcgagtgagttttcaagagacctgatggttttataagtgtgtggaagttcctccttcgcttttctctttcctgccaccatgcaaagaaggtccttgcttcccctttgccttccaccatgattgttagtttcctgaggcctcccagccatgtggaactgtgagtcaaacctcacagcaatgtgaaaacagtttaatacactggaccttctaactactttcctggatgatgggttaaccttgttttaatccatgctttcctcttccttaagcattaataacatcatttaataataattaacaacatcatttaatttcgttatgaagtccctgttacaatcaagacaaaatctcatctgtcatatagacccttcctaccatcatcagccccttgcccatccttttctagtaggtcttctttgttcctactcctctccttctcctctttcctaattccaagcttcttctttgcagtcttcaacaaccttattcaaatttcacagtcatctctttggctctaaaagccaacgagggagagcacccaaggactttatttgaaagtttagagacaaataactttatttgaaactttatttgaaagtttagagacaaataaaatacgtatgtttgtctaatttctgagacaatgacttaaaataaaaccattttccatgtaaactgtgatagcatctttggggttgggcaatcatgaattgctgagaaccttggtagccacttcatattgttgaattatagtttctcttttttagaaatgaagtaacgtttcccccagaagctactgtggatgagatgtttggagcattgagtagtccatattaatataagggatagcaaaaaaaatgattttttttcttttggagtataattctatggattttagtacatgcataaatttgtgtagccactgccacaatcagaatacagaacagtttcagtgtccccaaaaaactgtcttgaatgattgctttatcattcctaacctgcccctactggcaaccactgatctgttctccatcactatagtcttgtctgtttaagaatttcatagaaattgaattgtacagtatttagccttttgagactggcttcttttgctcaatataatgtctttgtgatttgtccaacttgttgcattatcaatagtttgttcttttttattgctgagtagtaagttccatgatatggatgtccaagtttgtttttccattcacccgtcaaagtaaatttggcttgttttcaatttgagggcaattagtatggctataaatgtttatttacaagtttttatgtagatacaagttttaatttctctagagtaaattccaggagtaggattgctgtgtcatatagtgagtgtatggttaactttatgagaaactatcaaactattttccagggtggttgtaccattttcattcccatcaacaatatatgagagtttcagttgctctgcatccttaccagcacttggtattattagtagtttctatttttttcactttaataggtggtatctttaatgagtggtatcttgtcatggttctgcttggaatttccctaacagttgatgatgctgaccatattttcatgtacttattggccatccttatatcctctttggtgaagggtctgttcaagacctttgcccattttttaaaaatcaggtagatttaatttttgtaagaaaattcttcctagatttctctaggtaagaacataatgaaggcatctattttctagcaagggtggctagaagcagaagtttttagcttttacaggcagcagtggcagcaaagttgagtttctgatgagagtggcatccatctggtaacagtgtggttgtagtaacatttaggtttgggaggcaacataaattatagcatctggagcttgaagatggccaaattcagttaaattaccagatcagctccattatgtggttttgaaaatttttctcggaagcttggttctgggcctctccatgatccccttagctagctgcccaatatcttcacaactccatttttcattaggtggagttagcttctaagaacctaaagtacaacattgaattacctactgcaccagttatctatgaccacgataaagttgtataacagacaaccacaacacttggtttcatgcaacaatggatagttaattttgcacatggatctgtaggtttgtgtagtctggttgatgtggaaagagtgtggcggatctctactgggtttgctcatgcatatgcggtcagctagcatgttgttggggataattcatgctgatccctatggcctcattctccagcaggctagctcagatttgtactcatggtggaagcagagttgtaagagaggaagaagatgctccaagcctcttgaggcataggctagaaactatgcactgtcacttgtgctatcttctattggtcaggctacatggcagcccaaattcaagggattgggccatagactctatctattaatggaaatttcttccacaatgtaagggattgattctgtaatcaatctcctttatatataaatggtttggaattttgaaatgagtgcagtataaaaagagaacccagaaaaatacatcaaaatattataatatctctgagtgaatttaaatcctcttttgcatttttgtactttaggttttctaaaataaacagatattacttggtgtaagttaaacaatagttgtaaaaaatttataaagtgttttggaaacaaagaagagggagtgattaattctggcgttagaaaggtgctaacattttttcccaaattgcaagaattgtaaatagtagtccttcagggagtaaacttgtccagaatttttttggcataaaatattaaatacactatttgtagatgggaacctctgacttttaccaaacctttggatattttagacttatttttttacaatagctttgtgctaagaagaaagactgtagaagggaagacaaggctctggtgttatcctcttaaatttggaagactggaatcatgcaggggaaaggactctatagtatgaacttttgtgtgtgtttgatgttgagtagacagcttggtggtggatctatggatggggcaatggctatagaaaacagcttttcttcctcaatgccttctgacaaatctcaaatgagttgttcacaaaaacaaaagcagggaaatgctacaggagaacccatattaagtagatttcagttatacccattatttcctttattgttttaaaaaaaacagctttattgagatttaattcacctaacatataattcacccatttaattttaggacatttttatcacccccaagaagaaaccttgtgcccattaagcagtcattctccactgttccttgccctcagtttctgtctaatctactttctatctctgtggatcttccagttgtggatatttcataaaatggaattatacaatatgtgaccttttgtgtctagtttattttacttagcaaaatgttttcaagattcatccatgttcatgttatagtatgtatctgaacttcattcctttgtatgactgaatgatattccattgtgtggatagaccacatcttattgatccattcatcagttaatggatagttaggttgtttccactttttggttattatgaataatactgctatgaacattcttgtgcaagtctttgtgtagatacatgttttcagttctcttgggtatatatgtagcattggaatttctgagtccattgaggcttaaacaaatttattgcttaggcacgtttggcaaatatgatagttgatttttctaggaatatatattttttggcctaaacacagtgaatataggacatgttatgagtaatcattctaggagagttcctcaaaagcagagctgtagatacgtttaagtgatggcacccaagttggaataggtctccagcatctgtagctaagtattttgaagtgattgtgcaaattctgtggattgtttccaagatgtactacatctattaaaaattaaatcttatagttaatattcaatatatgatgtattgcatatacttggtatcagcatgcattcaaacgtgaattgaaaaagagaaaatggatccgtacttatggtctgaaagaagtaaaagaaagggtaaaatcggtctgtcaagcaatgtagaaaaactctggatgtttgctatctttttaaatggtatttttttttccatggggagaaaacacatgatgagaaaagaagagaaagcaagtgatgatgatatgattgataattaaatgcagctgagcagaaacaacgtggacacgcttagaatttgctttagtactttctatgcttccttcccgggaggctgttaaaactcttcagcataagagcatttaaacaaagagaatattgccttttttccttctactgcatctattcaaacatgcagaatgtatgtcttggtgaaatgctccaaagatagcttgtggaaatatttataatgcgtgtaccagcatttttcacataatttaaatacatgcttttaaactgtttattcttctctgaagttttgcaatatctatatgaccaaatttattgcatcatctgctaacttgaccgagctgttaatgtgtgatgcgaccttcttcaggttgaaagtgacagtttagcatatcacaaagaaaaggttatccttaaatgttgagactttgagatactagccaccgttgtcaatatgccaagtcccaggctacttgctgctcatacttaaggacaagataagtgtctttggaaaacattttctcccatttgggccatctttttggaaccagaaattgctctgcttctatgcaagggaagagaattttgctctctccattccctgtatcattttggcaaatccttgttactgttaattcagggggactgccaatttgaaggatgtggtgaatgtcaaagtaagaggccatatttgccccatgtttctcctgaggcagaatataatttttacattgtgatcctttgtgaaatcagataactaaggaccactggttccaaagacaagtcttctccctatatttttttcccacttactagtccagaaaaaaaaaatgggttactcaatctctgtgccagcaagtatttgttaaacacccatgcccctgtcacttacacaggcttgtgatgtaaaactgccttaaccttcatacagcttaccattctaggtaggtaggacacagggaaatttacagaataacacatcaatattaaactgggataaaactatataaggatgcctgccaattccatatatatttagataagggagaatttgggatgactgagagttaacaaagaagacctcacagatgggggtactttgagctgcctctggaggtagacagaacagaatgtcaatatatgaattggagactcttctgggtgtttgaggttggggaagaaacaaacaatgcctccaggagagaagcagcctaaacagcaactccaaggaagatgggtatgaaattcaccgtgtgtgtgaaattatgacaggagtcccagttataggataaagcagcaaaaccagaaagcaagtgtttagacatttgagcaaacctcttattttcttatctgtgtttgccccgtcacataatttacagtagaaagttatttaaggcgaggcagcactgttcttcatcagacttgcatttatgtattcaattttggaaacactatgacttttggaagcaaagaaacagagttaggctgaacgcccaactccagtgtacgagaatttttcttcaactcactgaataaatgagtattttggggtttttgtaatgttcagatgggaggcaaaatgcagacacaagcctagaaaataatgcagatgccaagttgatgtgttcttgagcaatggacattgaatcaacaaatagcctgatgagagagcagtgagggtgaagtagggagtggaatattcatgtttcctttcccggggcactgttcttacatctcctttacattttgttagatttaaaactaaggaatcagaagctgataaaaaattactgtaagagaacacattgaataaaagagtggtgagaggattcattcctctattaacatcagcagtcatctaaacatgtactttttttctggcacaaaatcatagctgtagcatgaccttcttgcttactaaagatcacttaaaatttttaacaaaaaatggcttaagcttgaaaggaggcttttaaaatgttaagtatggttctgatctacttttaaaaatccaatggttaaggccaggggcattggggttagaagttggtggggggtcaggagcaggttggtgattatctttctctctctttctctctctttttctccatgtctctgtccctttcaatctctctttttctttcaatctttctcaatcccccatctctcttaatttatctatttctttttctctcacagatatatactgtaaagtatataacaaaaatgaagtcccatgataatttgttgctaaaccacagtgcagctgtctaatcaagaaggcatatttttttgtggcacatatacaccatggaatactctgcaaccataaaaaaggatgagttcacttcctttgcaggaacatggatgcagctggaaaccatcattctcagcaaactatcacaaggacagaaaaccaaacactgcatgttctcgctcataggtgagaattgaacaatgagacaacttggaaacagggaagggaacatcacataccggggcatgtcgggtggtggggggctgggggagggatagcattaggagatatacctaatgtaaatgacaagttgatgggtgcagcaaaccaacatgacacacgtatacctatgtaacaaacctgcacattgtgcacatgtaccctagaacttaaagtacaataaaaaaataaggcataattgtaaaataatttatactcttttcataatctgccccaatgtcccttgtttcagacttatgttttttcccttgtttcagacttatgttttttctcccttccattcctactgccttgtcactttcttaccctttcacattccttagactctgggtttaaattcctgatttttggcagtcagaaatcccttcaaatgaggctgtcaatccatgcttcttgtagcctccaattttcagattagctaaattataaactttcccatttacaagtgtggcattcctccgcagcctaatgtttatctaaaaatggtgttcattatccattaggtcttattcactctaatttataaatttagtagtttgaccacttttactagtgaatacacttatttaaaaatactttttacatttaatttttgtggatacatagtaggtgtatatatttatggggtacataagatgttttgacatgactttgtatttaatagtcttgggctatatataatttttcttttatctgctagaaattactatcttcttcctttgggttggggactaaaacttgcatttaatatggaggggtggtaataatttggccctgttttctctgtatgcttgttgactccttgttcttaggacacatactgggaagaattatttttgcaactgaaaacaagtagagattttaatagggggtatagaatgaatttcagatgacagtaatcactaaaagtgtctaaacagttcaaattagttgtgtgtcttgtggacaactcatctaaatacctgaagtttggttatttgcacatagaacctgaacactatttcaagcttcaggttttaacgtgtgctgacttgtaaacaactttcaaaaatttaaggcaggcaagttcacctcaggccactgaattttcattgcttctgtgtatatttttcagcgttacccttgttcttttttgactttgtcattttcttcagtccaactgaaaatgttagtcagaatttattttacattagagtatatattcctagatgctaaatccctgagaacaaccttttctacccacttttgtttcttctggtgatacctatttacattttgctttcaaagggtgcccaaccactggatgccatacttgtgttattagctatctctatctgcctaagcctctggtttgcttcctcttgggaattaaaaataagatttctcttgatttcattgaaaaatcatcattctttcagctttgaccatattgttttgataaaaacagctgatttgtattattgaacatctttctcatttttctttctccataaggagaaattcatcacgatttattacctgaacatttgtgaaaccaatttgagagaatcccaaaagaatcattttaattgaagccacctaattacttgtaattaagaagacttaaaatgccaaaaaaaaaaaatcaaaattacagctaacaaattcagaggataggataaaatcaattactgaaaaatccaattaggtttggggagaagctgaacagaattttatttaaacccagtaaaatgtctttgagcttttcacatggacccatttgagttcaaactctttattattaagagttaattttatctttgttttctggtagtgtagtaggtttgaataggagctcttgaataggagtgcaaataattaggttaatggtttttcttttcatacgttattagaggaataatacaggaggaatgaaaatgaaagcaaaatttagaataaaactttaaaaagtttatgaattgttaaagctaactgttggactcccagcagtggctgggaaaatggtaggattttatgccaaatattattattgttgccttttgccagagtttagtggaattgccctgaacatcaacttggccatttcaactctcttatgtttgaggtctgctgccagtagtcagaccatgataaaaacccatgacatgctaagtaatggatgctgggcaataaggatctttctaaaaatggctcttaaaaaaatcatcatcttgcaactgtaaatggcctgtttgttaatagattatttttctcctttcagtcaagattttctgcgtaagtttacagcctataagtttataaataaagtactacattgaagcaacatttttattagtaggtatttcaacttggatgttgtgagggccttttaatttcactttgcacaaagtgaaattgtagaaatattttaaacaaattgatcatggcctaaaattttctgcaacatatttggttgactgaagttattgttaaatttggcctgaccaaaatttgaatttcatattttatggttaccagtgtactctttgtaacaagttgtgcttctcttgtgatgacaagaattctgaaagatggttgatttagtacttcgagtttcacattatactgaaaaatgtggatgcccacctgagccttgatctgatgaccagggaaacagcagcactttttcaaaatcttaattgattttaaacaagcaaatcatttaattctgtgagccttacactctgtttcttaaaagaaaactggagaagaaaccctatctcaatccttgtccttgagaatcctagaaaatccacataacccttttccccaagtcattggagaccttttttcatcctacaaactctagataggcttgttaccgggaagctttaggagccttcctagtacctactgtagtatcttgctagctctacagtaaagaaagaaaataatatgaaaaagtgctctgatttatagcccatatctctaattggctattagtctgcgctgacagtaaaaatattaaaacaaattacccttttaagttaaattcacacccaatgaatgaacaaataatctgaatgaacaagcattctcttgttgatggtgatagtaattattatctgttgagcaggttgacttaatttagtgaacataaatggcctctacttagggtgttcatataatttgttgtcaaaattgtagcattttggaaagtgaaaagaggcgctattaataattacactaaaataacaggcataacctgaattgtccctgttaaccctcacctggaatgtattgttctccttccttccatgtgtagtcaagtgctacccacttttgacggcccagatgaagttttctctaagaaggctctttagagtactttgtttatattttacctgaattaaggcattgaggtgccagcatgtcagaaattaagatgttttatatatttcaaggaaacaattgttgctgttatttgacatgtatttgttctctcttaccaagtagaatgcaaccttcttgagcacaagggatatgtcctatccttctgtcttgctgaagcacttaggtatattgcaacgcccaaagtgaagagagaacacattcttgctgagttgctttaccttcatagtaacattcctctctatgtttgtgaataaaataatggatattggtgccaaaaatgctggttatttaaagagatttcttctgggtttataatcttatacagtagaaagggataagaatcaagccaaatatagttaattatggcctgagtacccatttagtcacccgatgtttgaaagtgtccactcagatttagacattttaacaacaaccagacctttactagcagtactttatcatagaaaggatcatttgagaatatcttaattgtagcattctgagcaaaattataattaaattttactaagtatttattaaaaatataaagtggatatttttctaattataaaagtaatatatgctcattttaaaaaaatctcatagaatacaaaaaaatgtagaaacaaaaccaaaaaccactcataatcctttattatagagataattacttggactatttgggtatgtttccttgaagtagtcttttgtgttatttatatactatacagtgatccttgccttctggcattcacagccttgtgtaatcccctccgtataacttgcttataaccaataagagatgacaactttgggaggacatcacttacatgatgaggtcacaaaagattgtgaagtttgacttgctagccggttctatcttgctggatttgatgaagtaagctgtcatactggagaggtccacatgacaaaaaactgagagtggcctctggctaacagccagcaaggaactgatttctcagtctcataactcttaaggaattgaatcctgccaatgaccatgtgggtgagcttgaatgtgaatccttctccagttgagcctccagatgaaacccccacttcagtgacaccttgatcatggctttgtgaaagtctgagcagaggactcagctaagctgtgcctggattcttgacccacaaaatctttgagattacaaatgtgtgtggtttaagctgctaagattgaagtactttattacatagcaataggtaactaatataattacagagtgtctcatttatagtttaatagcatttttacttaacattttcttattaaaaatctcctgtgtcattaaaaattactgaaaatatgatttttcttttccaggtggaaaagaatcacatagtaaggatatgccaaattttaattattcttatctaattggatatttagattatttctaattactggctactatgactaccactaaagtgaacatcctcatacatccatctttcactacaatgactacatatcttattatcccaacaaaattcattgccataagataaatgatccaaaaggtatgcataattttaaggatttaggaatattgctaaattaccttccagaaagttaggctattaaaatgcctctgagtatttcaatgtaccttggccagcactgaatggttaaacaaattagtcaacttgagaaagagtatctctttgtgattttaatttttattttattatgtcttcatatgattattagttaaagcttattaagaatttaaataaaaataattaccagcctgggcaacataggcagaccccatctctacaaaaaattaaagaaaaatcagctgggcatggtggtgcacacctgcagtcccaaacctttgggagcctgggagacagagtgagaccctgtctcaaaaaaaaaaaaaaaaatagccaagcacatggcttaaaccactcaatccataagtaaatatacacataggagaatgcttttcagtgaacatttatcaagtgctccttatttgttttacaaatattaacttatttgatcctcacaacaactctgagtcaggtaccactataaatgctgttttacagaaaataggcaaaaagcaacttactgagagcagcacagctagcacagagctgggagctggagacaggcatgcccttgactgatatgtaatagacacccccatttcaaacaaaaagccacatccattcaccaaattccaaaggaggcatcaattccttcattatagatcagaaaaatgaagctcaatgcatcttgtctagtgaatggttcaaggttgtgcagcttgtcagtactgtgatttagaactcaaatgctagtctgtccagacgccttccacttccacatttcctatgaggaataagcacacaaagcaggtgctcagtaaatataggttgattgaactccaacaggctacatgcaatatgaaagggtgatggaatgtcagtgaattggaaacagtgggtatagtggagtgatgctaaaaatgacccatcatggcaggtcacaggaggtctcccagtggctcagtccctcagaagaaggtatggagaagtaatgggggaggtagagagaaacaaaaggtaagtttaaagagatcctactcataggcaagcttatgactgtttctgcaaaggcattcatggcactgggacagggagggtgtattgacacacagccaatactataagggaaaaggtaaaacaaaaaccaaggcatgtttgtccaggtagccgtagctgttaccagcagcatttagacaattgcatatgttttaggttgtattctccacaaagcagacagagctaagggtttgagtgctagtgatttgtagggaagagctttagaaagaagccagaacagtagtggagtaggaaggggaagaagccaagcaagggtgtagttttgggtggagtcccagggtcagcctagatcccacggggtgcttgggagggtaaattatacctcagagtttgttccaccatgaggcaaaggctctgggcattggtactcacacaccagtcaatggctaagtgtctcaggcacttctggcatgtgtgagctggcttcagcacaaaggggacaggtgccagtcactagcagcaaagcccacaaaagccaagggatggacacacaaagttagtaaaagggatcttagaagatgtggtggctaccagcagtgcccattacagcatgttttaaactacatatggcagggcatccacttaaatacatgtatttgtgagaactggaaatttctaatttgacaattctaatttcctcagttcctgctgggtcttaatgtaccagacagaagtagaaattatattatgttctttacactgtgaccattcatgcggaatctgtgggagttataattacgtcaattaaagctgcaatttgctaaaggaaaataaagaatagaacaaataattccaagtctctaacttagaggattagtgttcaaatcaaattggagctttgcaaatgttaatagttaagctatgtttaaggtatttcaattctctacccataaaggcaggttttaataaagtcacataaatggtaaccccaaaggctttctagcagcaggatggcaagttgttatgtattattgggaaatgaagtatatttaatacctttccaattgtcatcactctaaaacacacttcaacaattgattaagctgaaaccagaagaaaattatttccccttacttttgttttcttaatctaatgtctttgctagaaaatgtagatattagctaatctgtgtctggcagcaaatacctgcatgttttaagtattcacaaatttcactaatagagtagcttaacaatagttcttcatttctaggtgaaatattaaatattatattcttaactcttactgtcagattaggagaacatttacatcatatttaaggcaaatattcctgagtccttaaagcactctagctgggtatttaaaaaccaccttctgtagaccaggggtcagtaaactatggcccatgagcccaattcagcctttcatacatgcatttttgtacatcctgtgagcaaagaatgctttttatatttttaatggtggaaaaaatcaaaacaatattttatgacatgaaaatgacatgaaattcaaatttcaaggtccaaataaagctttattgggacatagctacacccattttatttacatattgtctgtggcagctttggcgcttttatagcagatttgagtagctgtgacagacactggatggctatcaaagcctaaaatagtttttatttgatcctttacagaaaatgtttgctgctccctgctgtagacttttgtgcctccctttgcccgtagtttgtgatctcttaaaataacattggaacacttagaacttggggagtcgtgctatggagacactggaaataaagtccattttactttttttttttttagacggagttttgctcttgttgcccaggctggagtataatcacgtgatcttggctcactgcaacctctgctccccaggttcaagcaattctcctacctctggcctcccaagtagctaggattacaggcgcctgccaccacgcctggctaatttttgtatttttagtagagatgaggtttcaccatgttggccaggctggtcttgaactccagacctcaggtgatccacccggctcggcctcccagaatgcttggattatgggcatgagccactgtgcccagcccattttacctttttgagggaagagttgattattttgatgagcattttacttaaagacatatggctacaacacagacattgcacaagatcttttatctatgcatatttgaaatgattgtagatttccaggggcctgaattatctgaactattatctctgttccatttacatgagtgacatgtcctttggcatagagacaatcatcaactctcttcaatttaccttgtcccagcattttaaaaaaaacagtgcctggccaggcagccaagcggccgctttcattgttactccatcccatcctctcgataatcctacaaataaattttatttttcaattttagcgatgaggaaatcggacaaaaaaggtgatgctattcatattaacattgcatacttaatcaaaggtcgcttcaggatccacactttgattcatctaacttcaaagctttgctcagagtattttgtcttattgccagtcaaaggaagaatgtcgttaacattggtcagaaatcttttcctaaatcattgattattctctacccctactcattctccgcctgtccaggtaactatctgcattcatctgcttttctgtctgtccatccatccatccatccatccatcctttcattcatcattaactcaaacatcaaatgtttattgagtacatgccagccatcttgctaactgcactaggcagtagacatacatttgtgaacagaagagacatggtccccaccctcatagcatctttttgacctgacagaactgcacagaggatggattttatttgtccacagatttatagggcccaggcatctatatcataagtgggatttgatgtctatatgtttcataatctgcccttttggaaatcatttgacttggacctcttggatgtcttgcttttacaagtagcctaaatagtgtattgaagaggttataatcagatttttaaattgaagggtggaaaacatatgacactgcatcttttctttttaactgaatgtaacgctttacataaacatttccctcagagctactaaacacatgccaaattctactaacaactttctatctatctatcatatatatatatttggtaatacatttttgttgatcctatcccaaaagctttccacccattgcttgtcactttgagacaacagaaactggcaggaggtaattaatagacttgacctgtagggtgaatacacacacacacacacacactagttgggggagcttcgattcttttcaaaggactttgctggtgagacttgaaagtgccatatgcctgctgggagaagttttgttttggtagtagttactggttaggctttggaaatttttcttttggaaatctggctggttctcaaaaattgcctttaagaattgtattttgtaagttaagagcagaagctattattagctgtgtgtttgtggttgaaacatgaggtcaggtttggcagggaactcttaagggtgtgtgaatgcgagcctcagcccagccatcctgtggccactcagtgccttggggagcggcttattcctggatacagaggcaatgcctttgtcttacaattcgtgggagtatgtgctttaataatggaatgcttcctttgtgatttaagagtgacttatagtaaatttttattaaggattcaatgtcctattgagaatatatatatgaatatatataatatttatattcataattgctttattagatcagggatcatgtttgtcttgtttatcattttattccatgttccaagtgcagtgcttggcatacattataaatatcaatatttgttaatgaatgaatgcataaatgaatgagtgaaaaatgaccacaaagagcacatgtagaaagattaaagacatatgttaaattgaaggatagaagttggtagtcagagaacatttgtaggtcaagcacttccaagtgatggcagatatctaagatggggtgaccacactcatgaattgcaaatacagaattctctggacctaagagaactgtggaactgtgaggtaattgtatgctctgatgttgaagccactaaaggtaatggcagatgaaggtggtggagatggaggaaagtaggcaggttccctcctttcctagctgtctcttggaatgaactaagtaattttgtatagatgtgtaaagatagtaaagatagaagatctgtaagactcgagctctagctcgtgtatacacacacacacacacacacacacacacacacacacgtatctgaagcatggggatgatcatatgacagtaataataattaaacacttactgtaagcagatgaccaaaattagctgtggttggacattatggaatgattagtacacataattattttctgctaataacaagacaggaagtatttatacccacatgaaatatttaagcagggagaaaacaattccagttttgccaaacgtttcttatatccattttgtggaaaagactccgtactagggaaaaggagttgatctgttcattgctcacttgctttcacgtagcagatttttagcgacacttagatggtgagctctggaggaaatggctattattattctagttcacagcagtacctaaaattgtgaatggttagaatctcttcatgctctgatgacccaactagctgtagagtatcacagaaagaaatgttgtcttgctaccatttgcacgtatgcaaaatatgcagagaatatagctgttttaaaagaaagctttgtaaaaagaaactagtaagctttcaataagaaatcctttaaatcctcagcattacacaataatacaattccctctttacagattcacttatacctttactgaatcagaagatgatgttgggggaaaagttgcttttcaaatgtaaccataatagaattttccctgtatctttcaaataattgtctgtgaaatcactttgtgatgtctatttcagaagcttagccatgacagcacaatcataaatattttcctctatgtcaaccattttagatgacagacagatctatctagtacattttgttttcttctaaaatctcaaatactacccaagtcagctgtttttaaagctgtggcctaataaacaattggatattgaattgctttattgcaaataaaaatgcctcatctttgtttcaacttattctcaaattaccagtgacattcacttttatattacattgttaatgaaagtttacctgtgggtctaaaaatagagacaaaaagcagtgaattgactggaaaactaaccattagggatattaattttttggaaacagtagttttattctgaatagtgtacactacctgaaggcttgaaggttgcatataccagtctctgaactccatagtggaaatgatgtctaccatagcaatcatcacttaatgagaaattactacttattacgccaggtactgagtgaattagattagtaattgcattttatctctcattaatctcatgtaaataatgttaattctccactttacagatgaggaaactgaggaccagagattagataatatgctcaaaatcacacaataagggcaaagctaagacttgaagccagatgtgggttcctaatcactttgacctaattactgggagaagcataataataaagacaatttattgtgacctgtgtattatgtattaatgactaaacagcatttttgcatgtttaaaaaaatctctgtaagtggtattatttgataggcattattctgcaacatattttctttactcagcatagttctaattatccattttaattgttatataatattccattttatgagtataatatcaattattttatctcttttcctattgatgaacagagtattcttcaaaattttcttggctattcttcaacacttcttcatttacataagttctatggtatgcttatctagttcctgattaatcatgttggaatattgtgtggaattgttttgcatttgtatattaatttaggaaaattggcacacatatgatattgagacttcatgtcatgaaatggtatatctctccatttactaaagtaatattatatgttattagcaatattttaaaactttttcaacataccctgtatgaattttcttgcatgtattcctaggaaccttaggattatcattgattttttttgtatggtatgtttactttctaatttgttattactctgatatagcaagggcattgattgaatgttgatcttgattaaacaaccttgctgaattatctaacttgttctaatagtttttctatgaatttctgagattttctttggaatatcatcatatttttgccagtatgggctgttttatctctttctttccaattcttagacatcttaactcctttatttttgttttgttttatttacattgattgtggccttcagaaaagtttggagggaaagtggtgatctaacatcttgtcttagattttaaaataatgtctatcaagttaaaaattgggagttctttaatttttgttaagagtttttaaaataatgagtaatgaattttatggattttttggtaaatacaatgagatgcagatataggttttcatgtgtaagttactaatgtggtgttttcatttttagatttgcttttccattgaaccatccttgcattcctgatgtacattttatgatgcattaagaaatacctgctatattttcttccagactttaacatctgtgttcattgtcaggtagttctcatattttaattttttatacagtccttatcaaattagtataaagaacattttagcttctttcagagaattgggtaatttttttccattttctgaaatagtctgtacagatcataaaaccctgtgagcctggatatcattttcaaggcagacttcaaattgacaattgaatttctctgatggttatttatttgttctggttttatgttttctcttgagtagtttttgtaatttatatgtttcttgaaaattatccattttatccaagttttgaaatttattatattacattcatattattctgatttaagattttattgtatttgtattttttgaattcttaatattgtgtatatgtatattttattttggcatatctgacttacaggttgccattttactagtttgtcagtaaaaaaactagcttttgcttttacatatattttattacatcttgttttatatttcatcaatttttgcttttctcttattctgttttttcatggtattttattttatttatttgtgaaaatgtgttgagaatatattatagaccaggcactgtttagagatttggcatacacttagtacaaaatttcagtagttattggaaacttaatgactcttttgtaatttttttcatttttcattttcatggatacatcacagttgtatatatttacggggtacatgtgatattttgttacaagcatacaatgtgtaatgatcaaatctgggtaattgggatatccatcacctcaaacatttgtcatttatttgtgttgggaacatttcaaatcttctcttttacctattttgaaatatataacaaattactgttaactatatttgtcctattacagaatacctgatcttattccttctatctaactttatttttgtatttattagccgagccctcttcattcctccccactacccttcccagcctctggtaaccaccattctattcactgtctccatgagatacacctttttagctcccacatatgagtgagaacgtgaagtatttttctgtgcttgacttacttcactaacataatgtcctccagttatatctgtattgcttcaagtgacaagatttcagtcctttttatgactgaataatattctattaaacacacacacacgtaaacatatatacatatacacacacacacacacacacacactccacattttctttatccatcaatccattgatggatactatatcttgactattgtgaatagtgctgtaaaaaacatgggaatgcagatatatctttgacagatgcattttctttcttttggatgtatatccagcaatagaattgctggatcatatggtgttacagttctatttttagtttttgaaaattcatattgttttccataatggctatactaatttacattaccaccaacagtatactagcattgccttttctccacattccatccgcatttgttattttctgtcttttggatataagccattttaatttggttgatacgatatcatattgtgggtttgatttgcatttccctgatgattagtgatgttgagtattttttcatatacctgttggccaattttatgtatccttttgagaaattcagatctttggccaggcatggtggctcatgcctgtaatcccagcactttgggaggctgaggcgggtggatcacgaggtcaggagatcgagaccatcctggctaacgcggtgaaaccccgtctctactaaaaatacaaaaaattagccaggcgtggtggtgggtgcctgtagtcccagctactcaggaggctgaggcaggagaatggcatgaacccgggaggcggaagttgcagtgagcactccggcctgggcgacaaagcgagactccgtctcaaaaaaaagaaaaaaagaaattcagatcttttgcccatttaaaaattggatgattattatttgctattgagttgtttgagttccttatatattcaggttgttaacgtcagatgaatagttgacaaatatttcctcccattctgtatgttttctctttactttcttgattgtttcctttccactgcagaagctttttagcttgatgttatctgatttgtcaatttttgctttggttgcctgagtttttgaggtcttactcaagaaatctttgcccagaccagtgtcctgaagcatttgccctgttgttttcttctagtagtttcatactttcgggtcataggtttaagtctttaattcattttgattttatttttgcatatgatgagagataggggtctagtttcattcttctgcatatggatattcagttttcctagcatcatttgtggaaaagactgtcctttccccattgtatgtttttgtacctttgtgtaaagtgagtaggctataaagtgtggatttatttcagggctctctattttgttccattggtctgtgtctatttttatgccagtaccatgccgcttggttgctatagctttgcaatatattttgaagtcaagtagtgtgatgcctctagatttatactttttggtcaggattgctttggctattctgttttctattgtggttgcatacaaattttaggatttcctatttctgtgaagaatgtcattggtattttgatagggattgcattgaatccgtaaatcactttgggtaagatggatatttttacaatattaattattgcaatttatgaacataggatatctttccaatattttatgtcttttatgtcctcttcaattttttttttttttttttttgagaccgagtctcactccgtcgcccaggctggagtgcagtggcgcgatctcggctcactgcaagctccgcctcccgggttcacgccattctcctgcctcagcctcctgagtagctgggactacaggtgcccgccgccatgcccggctaatatttgtattttttttttttagtagagacggggtttcaccgtgttggccaggatggtctcgatctcctgacctcatgatccacctacctcagcctcccaaagtgcttggattacaggcatcctcttcagttttttaaaatcagtgtttcatagtttttattgcacagatcttttgctttttggttaagtttattcctaggtattttttggtagctattataaatagctttcttgatttcttttttgagattgtttgctgttggcatctagaaatgctactaatttttgtatgtggattttgtatactacaactttactgaatctgtttatcaactctaacatttttttggcagagtctttaggatttttttaaagagtctttaggttttcctaaatacatgattatattgtctgcaaacaaggacaatttgacttattcctttccaatttagatgtcctttatttattttcctcgtcttattgctctggctatgacatccagcactatgttgaataaaagtggtgaaagtgggcatccttctttttccagatctcatcttttgcaattttatcagcaaatggtaaaggtaacatagaacatggttctttgacttataaatattaagattttacttaggttgttgataattactatatttttgttccatggtctttattgaatatatactactaaaaacttggcatagagccattaaaaaaatacaaaatgttttcttggaaacagcaaaatttctaatccatatacacatttcaaggttaatattttatacttgtgactactagatcatttatgctaaatagtacagcttaaagataccataatgataaccttttagattaaccaacatctttgatctaggatcaaggaaatttgatttccctcaatcccttatttttcagattaagcagttaaagtaatcagtcatttttgtgacacagcagggtccaggttacaatagttctccccattttttatggttctagacccttctcctacctatcttcccccaaccccctggtttggtaactatttctctgaacagtctttctgtttctttggtacatttttttccatgtataattgatttattctggtcatttacaattcctattaaattctctaaatgcttttccttgcccaaatttattattcatctcttcacttgaaagtagaattttctttcatagtgaaattaaaagcaatatattaaagtgggaagtatgaggtaaaatattagaacaactaaactcaagggcatttggcatttctgagagtgaagcagcttacataccacagcaatgtcacttgtttttcattgatgagacacacaaaattgtttcctttgtcctatgcctttcccttgaattcacatatctttttgctgaaatgaatcctttcatagttcttttaatgagtgcctgtgggtgttaaacagtcttaatgttttatattttgtaatatcattattttaacattgcatgatggtttctctgggagtagaattttatattggcagttatttttcctcatcactttaaaaggcattgcttcaggttcttctaccatttgttgttcatgatcagaaatctgtgtgtatgatagtaacttcttcacaggtcaaactgtattttgtctctgctaaattttaagactgatattttgcagtttgactaaaatgtgtctaggtgtaggacttatttgtatttatgtttctgaatactcatagggtactttcaactgaggattctcatttttttctgattctggaaaactcttggatattaatgttcaaataccgttcttcattaaaaaaaaatctctaaacataagttctaaattttaagtaagcctttgaagctagaggctctcaaaccatctgccctgattcttaaatgctcctttacaagttttgattactttttctctttttgctggcttctgggtaaattttttggtatcaaaatctaattcactaaaacacttaccagctgcctcaaatctaaagtttatcctatcttttgaatttttccttttaaaacaccattttttttcaaatcttatttatattcacctattcttatctcctttctgcctgattttgtgtcataatttgtttgatttttatacatgtgatttcatctatcttcctgagtattttaaacatgcttgttttgaagtctttgtcaagctattttataaaattaatttcaccacagtaaactcatattctggatattgatatattggctgtcttcttcagtgttatatttcttcacatgttttgggattttgattcacaggctaattttgagtgaattttttgtttgtgttcttctgtctcttgctctctgttcatgtatgtccgttctctctctctcacccactttctctctctgtatgagcttctttttgtggctggtatttttcagttgatgtccaccggggtccccaggacaaaaccacattttaggtgatggtttggagctcctgccctatagtaaaataatgcagagccagtctccaggccaggagcagcttgtttcagatctttgtctagacagaggctgtgttgacgtcttttaaatctgtaggtttttaggttttaacttcatataaaccaggttttctcagtagggcactgttgacattttggaccggatgattctttgttgtgtagagctgtcctttgcattgtagaatgtttagaaacatccccagcctctactcactaaatgcaactagtgccaacttccctccagttatgaccaccaaaaatgtctccagacattggccaaatgtcctctggggaagaaagtcactgactcccccttgataaccggtggtaaaacctgtaaaccctggagtcaattggcaatgtctgatgttagcttcctttatcaaggaaagggtgccaaatccagtccagctttaagcctaaagcctggcttcagcctttcatagtaagtagaggacttttcgtctcccattggaaagagatttctctgtctcactgcctgatttggggctcagcacccatcaggctttggcttcaaccacactcactattactggtcctgaggatgtatatcttaatttatattctggcattgtcttttcagtattcttttgttatatttcacttatcacaattgcatgtttcgagcaatggggacaccatatagcatgaacttaaaattctttcttaaccagaagtcatagaaggaagtttttcaaaaaaagtttgtttttttaattgcacttcttggtagttcaacattttagatgccttattaccttatgccctgacttgattatgcttttgcttcttctttatttgtgattaacaaaagcctccataaacctgctttatttgtagtcaaattctatatttggagtattgatcagactaataaaaattagatatttttgaatgatttctacagatatctctatgactttgtgtatgacctcattggaattgagcacaggcattgcatttgggaaattaagacaattaggagattgtcctacaaagtcagagcaaaggaagcctgtagttagttataatacagagggacagtgaagactgtgagggagaggagggcagcaggaggcttagaccttgctggaaaatcctcaggaatgaagtgaaatgtagccaatttggaacctaccccagccctttccctccatgttaaagttagttaaatcaattccagtgcctatttatagttaagccttggttttgattaatgatgttggagagagataggaaagcggggaggacaactgttaggaggaagggaggaggcaaagctgctgaggctgatatgctcatctgttgtttgaaccctactctttgtcacacacagatttctggccaaatatgataaaaaaatatttttgttagagggcagtaatccatgtcaacattttcactgtatgccaagtgaagaaatcaaatacctaaaccctgaattaaccatatgataaatcatggttccctttttcattgagtcatccagcatgcatcatcatggacacaacctaagacttaaatgtctttagaagttatgcttttatacattaacaaaaatgaaattattaaaacaaacccacattaatggttaagcatagattgcttttgagctgcaaagagctttagagacacacaactggtccaacatttaatattgtctggagaaaaccaagatttgagagtcctaaggacttgcttaaagctgcacaatatcttggttgcagaacagggactagatcccttgtcttccctccaatccaaagatctggttacttctgcccaaaagataatcaattttaattttggtagctagccataaatacttttctggttgacttattctctgcttttaatgttggaaatagatgaaagtttatagttctcataaattagcttcagttactaaggagattagtgtattattaatccctcctattttttcaaaaaaacttttactaaaacccactttccttgaaaactgatattttctaaagatttagctctccagctatgcactcaaacagaggattgtgaatggggattgtctgcattaaaaaaaaaatcctttctttcttgttaatcatgaatttaaatattatagaaaggtagagggacatacagtgactatgctcctccttccacttaggtggctatgtaaaatgtcttttccttgatatatgtaattgttgtttactcacagtaattttatgtcagaatctcaacagcatgggttgggtaatgactatccatttgtttatctacaggaaaatggtattgtgtatgaagcaagttcattatataggacaattgaatttttatttcataactttatcttctttttctctttagtgatttctctttgtggccccatgcatattgtgcagattaattaatcatgcatgagctcggtacaatctacaatgattcactgggtaaagcagttttagggaatgcattgtattataaatgtggaaatgggatagacacctagaatatatcagctatcagtgaatgtccttaatcatagtcatatagatttctacttactaaaatgaagtcatatattttggtagaatccttcattttgaaggaaagctgacatgcaacgtaatttatctgtgtatgtgtataaagctgtattaatttcctgttgctgctgttacaaattactgcaaacttagtggcttggaacagcacaaatttgttatcttacagttctggagatcagatgtctaaaatggatttcactgggctaaagctaaggtgtttgcagtacttcgtttattctggagggtctagggaagaagttgttccactgtctattccagcttctattacagaagctgcctgcattccttagtttgtggccccttcctccattttcaaagccagcagtataacttcttctattttctctctgacaatgcttctgttatcacatttccttcttgctctcctgcctccctctttcccttataaatactcttgtgattattgtgaaaccctaaggagtaaaaagaaaattagaaaatgggcttacctggcaggaacagaaatagataaggggagcaaatgttttgagaaatggggtcaaccacaaaaggctcactggcacccatagcatcctgttacgagcattcagctcatggcccacctgcattcaagcattctgtctgcaagcattcagctcaagcagcacgaccttataaaactccccttccagcccctgactctgcagatagcagacagccttctttctgctgtcttgcaatgtatctccccttctcctctaaataaatctgcctttctaaactcattactatcttggtaaattcctttaccaccagtgcactggcttcagataatcatcaaccatgacaattatattgagcctacctagataatccaggattatccctcatttcaaggtccttaacttaatcacatcttcagagttgcttttgccatgtaaagtaacacaatcaaaggtttagtggaaatctttggcagggggttattttgcctatcacaaatgcgtatgaaattgggagactattttgaaatagcctgtactcatgctactttgcatgatgaatatgacacatactatttaaactatgtattttctatagcagcaatctctatagcaccaatggtcatagaaatataatgtaagctacaaatgcaagccacatctggaaattcaaatgttctagtagacatatttaaaacataggtgaaattcatgttaattatatattttatttaattcagtagatccaaaatattatatcaacatgcagtcaatataaaaatatcaatgagctattgatattctttgttttatactgtcttcaaaacccagaatgtattttacacctacagcatatctccatatggattagacacatttcatgtgctcaatagctgcatgtggttcatggctctaactttggaaagcacaactctgtagccaaggtttttatagctccacacccatttaagagttatattgtctactcaaaagaatgtgatatgatggctaagacattgaataagacccgggtttctcaacactggcagtattgacattctagaccaggtagtttttggttgtgggaagctgtcctttgtattgtgggatgtttagcaatatctctggcctctaccactagattccaggagcaaccctccagttgtgacaaccaaaaaagtctccaaatattgccaaatgtcccctgggtggcaaaattgtgcctagctgagaactactaggctaaacatagaaagtgtgttagtctgttttgtgttgctatgaaggaatgcttgaggcttggtagtttattaagaaaagaggttggctgggcggagttgctcacacctgtaatcctagcactttgcgaggctgaggtaggcagatcacttgaggtcagcagtttgaaactagcctggccaacatggtgaaaacccgtctgtactaaaaatacaaaaaaattagctgggcatggtggtgggcacctgtaatcccagctacttgggaggctgaggcagaagaattgcttgaactgggaggtagaggttgcagtgagctgagatcacaccattgcactccagcatgggcaacagaacaagactccatctcaagaaaaaaagaaaaagaaaaaagaggtttatttggctcatggttctgcaggctgtacaagaagcatggcactggcatctgcttggttactggcaagggcttttgtgctgtgccaaaacattttggagagggtcaaaggaggaatcagtcacttgggaagggggaccaaacccagggtatactagttataacaatccattcttgccagaaataatccattcccttgagaactaatctgctgtcactagagtgagaacagcaccaagccattcatgaggaacctgcccccatgtcccaggcacctctctctacgcttctcctccaacactgctacactgtgggccaaatttcaacatgagatttggcagggataaagaaactatatccaagccatagcagaagggttgggtttgaattctgttctccatacattactgtgaccttgaaagaggagccactttaaattgttaacatagtttcatcctctttacaatgggaaaagtattatctaggctgcttgagcctcaaaagagacagtgtagataaaacagctctgtaaactgtagatactctgtaagacaaactcagcattgtctttatttgtttatgttcagcacttgaatgtaagtacagctatttcagtactgatgtattttctcataatatttaacttattttttaatgccctatttataatgattggactacagtgtagacaagatgttttaggtgttttgttttcctgtctgtgggtgctcatgggagtacagaaataagtagaactgggtcttttcaatgagttgatcaaatttgaaataactgggagttgttctgtggccttctcagctctgatagggtacacctgcctaaggaacttgcagagatattctgcaaattactttgtttgacccaacaattattgaacacccattcctgttaggaatagtgctagttcctgggagtagaaaaaagaatgagacaagattctatccctcagagtgcttgcaagagtagtaggagaaaaggcatagacattaatggaaagtatttggatggaagtggtgcttggaaaagagtcaggagaatgcaaagagaaggttgcaaaatgacgtttacaggaaggtcagagaaaggcctgagaaaggtgcagaatgaaaaagtgcatggactggtttgacattttgggaaatggagcatagcatgaaggaaagagagagaaaaggagaacataggagtatagtctccctaagaaaggtgggtccccttttgcaaaggccaattcttgggagaaggagtaagctaggagttcttagcaactgggaatgggtccaccagcagtaagggtctgtggcagcaccacagcatccactataggctctaatgtgtctccaccttttttttttcattattgccccctcaaggaagctttttaaaacattttttctctaatctccccagcctccacccatgaaatttacatagcacagatatcctatttatctgtttgtgttgtgtatttctgtgctttatacataaaaataatacgttttcttcgcctctcccagtaatcgatttttacccccttggtggcgatattgcctagttgagaatacatgtgctacgtttgtcactcatgagctgtgttattggctttggttcccttgactcaaaaatgttttaacagtcattctgtgtttcagggtgatatggtttagctctgtgtctacactgaaatctcatgttgaattgttaatccccagtgttagaggaggggcctggtggaaagcgattggatcatgggggcagatttcccccttgctgttctcatgacagtgagtgagttctcatgagatctggttgtttgaaagtgtgtagcagttccccccttggttctctctctcctgctctagccatgtagaacgtgcctcttcctcttcaccttcctccatgaatggtaagtttcctgaggcctcctcagccatgcttcctgtacaggctgtggaactgtgagctaattaaacctcttttctctgtaaattacccagtctcaggtagttctttatagcaacctgagaacggactaatacacaggggctacactgaaacaatccctttctcaacacttgggggagaaggctggagtaagagtttctgagaggtataggggtgtgatcctgcttgtgtgccacatgtctgcccagcaggtccttgaggatagagttggggtggaagtggctaggtgggccgtggaaaaggtcctatttactgaatttgccatatagagaagtgggtggtgcccgcacagggaccatttgtgccagtggtctgggagccctggatgtggtgccatgatggtctgcagaccaaaacccttcctggttcctgccaagggttcttggcctcatctggagttattgggaaaaggcccagctaaaagtaaagtacaaccttgttttctgttttgctgtttttctttgtacatgtaactcttccaggaacctgtgggcaggggacagagggtgaatacagtcaggatttagcccaaagctatcaaacagcaccaaccattgactcttcctaagagtgtgagtccattttctcttttccaaagaatggcagcctggtcacaaactacattgccagaagaatgatgggattgatactcaaaagatttatagttgaattatagacagggaatgccaaggaagaaacgctgtgagaaaactccacatttgtcctttatcatttactgttaaaaagctctgtcagagcttcccagaaccttctatattagatagggctctggtcgctagtaatctaagctgattgaactagctaaaggacactctgtgaaagtgtgtgggaatgtctgtgggtctcaaaagtagagatggagccagatctcagaaaaggctgaaacctaaagttagaattatatatgcatcattccagaatctctcattgctttgtatttgctttattcatctttctctgttcactgtccttctcagattctcaatttccatggtggccaaaaggtagcctatcctcagaggttatatcaaatgagccctgttcctcacagagccgctaacagttcttcagctttgcagtctcaattcccagatgcaagagtgtgattgaccctccttgggtcaggttaacgcttaagtttggtcacacataatggaacaaatatggctgctatgggccaacctttggaatagggatagagcgagtagattagtagatggaaggtcccagagaaaataatatcatattgttggcttctgaagctatctgctacaggcagtgatcactgatttttccagccagaataaaccattcaatttcaataaattatgggcattttagataatggaaaccttagtgtttaaacaatgttctttccttattctaagtttacagctagtaggcttagttggttggtacataaacaaggagtgataacttaagagtgagaatgtagaaggactagctggatcataatgccacttactgaaagaacactgaagaacactgaaagaacactggagttgtatcactagggatgctgagttattatagacctctcctctatgagaagtgttatttcttcccatcttagttcaggctgccatataagaaatgtctttgactgggtggcttataaacaatagaaatgtatttattatggttctggaggctggaagtgcaagatcagggtgtcagcatgtttgggatctggtgacggtctacttcctggttcacagatggacaactgtcttcttgctgtgccctcacgtggcagaaggggcagatgaactatctagggccttccaaaggctccacctcaaaataccaccacatcggggactgggttttaacatgtgaatttgaggggtacacaaacattccgtttatagtatctcccatcccaggtaacagctgtttagatcagaagtggatacctgacccaaatgacaacctggtttttctcttctgaaatttagaattgagattggaagaccttagtcagtttggacatctacagtgtgccagaagctagcagttgggtgtacagtatttaacaagagagaagttgctgctcacttaaaacatgcatttcagctttatgttcagctatgtgcaggcaaacagacacgtggaattatgatgattttcacttcctcctgaagccagctgtacatgtggcccttccaggtctgtgagattgagatcacattatcagtgatcacactaggaagattaagctaatttgaggtgaatttttattacttaaaaccaagaatgtgtgtgtatctttgtttatgaaatgtttttgataatttatttgattggttgattagtctccatctttttaaaaagaggttaaattctttgagggcttttttttttttgtacttttctgtccccagggtgtgccacccactatgcttggcatattatagtcactcagttgtcactgcatgttgtctggtgcccctgagcactcagtgatatggagtgagagaaagaatggttataacttgggggaactccaagaaaacttgatggagtgagtagccttgaaggatgaaaaacttttaagtggaaatgcaagggcaaggagtgagacaggctattgtaaagaggggatttactgcttgttggtttgaattgaaaaaaattcattgtgcgcttcctttggaaggttttttaagattttttttctcagctgcagagtgaatattaggcagggacatataaattattagatcttcactagatcccaactagtgattcattccttggaaagataagctttagcaactacatcttttgtcctaatggaaataatcctatttgttcctcatcatgcactaagtcaaggggaaagaatgctggataactttttctcattgttgtgttcagaaatgtagttacactccattttagcaagcacattatgccctagcttcttgccgtttttcttaagagtgtgtttcattccctacaaggtcttctattctcttgtaaagtgtcttttattatgggttcttagtaattgttcccttcattagttagaaaagttatgttttagagccctagctgtagaactctttcctctttatgctaagatggattatatgaaaacaatctgattaaaactaatgcatatttagaattaaaacacaaaaagttgcacacaaatgtttatagtagcaatacccataatagtcaaataatagaaacaactcaagtgtctgttgacttgtgaatggattaataaaatatggtacatccataaaatggaatataatatggcagtaaaaatgaagtactggtatatgctacaacatagatgaactttgaaaacattatacgaagtgaaagaagccaaacacaaaagaccacatattctatggtcccatttatatgaaatgcctaggacaggcaaatccataaagacagaaagtaggttagtagttgtcagggcctggggagaggttggaggaggggatggggcatgaatgctaatggacatagatgggatttctttgtgtggcgatgaaatattctaaaattaagtgtgatgatggtggcacaaccctgtgaaaatactaaaaacctctgaattttatcatatgtatcatatgtgaattatatcatatgtaaattacaccttcataaatctgtttacaaaataagacatttctgtgtgtgtatgtatgtatgtttctttgtgtatatatttacatatgtttatgatgtttcagatgttggcaagtgcagcaagcatcattaccatgggcacttcctccatatgaccgctggaggaatttagagtgcatataacaatccagggctctgccattggctgtgtgaatttggatgggtcatttcatctttctcagcctcagtttctcacctgaaaaatggggataagaaaccacctttgcacagtccctataagaattaaatgaaatggtgtatgtgagatgaggtgactcactcattaggcagagcaggcacagtgcctggggctcacagtacttcaagggcccatgaaaatgttttaatttcttttaaatgcagaagaaagaaagatgtccttttaggtccaataaaaagttttaatgtataatactaatgtatttgtctttacaccaatctggtcatacagcatattttgtatttttttttttttttttactggaggaagaggcccatgaaacaaaggtaactcaggcccatggaaggcatcatggacacttgaacgtggcagctcaatgacacaggctgggtttatcttattgctctgcaaattcaacagaaacctcctctaaaatcataccaacaatttagcaacagtgtaagcagtctgtgttgagcagctcacctgcacacgcctggaggcatacacctagaggagaggaggaacactgggttggccagcctgggttactggcaggttcttccatttagtagtgcccagcctcctctttcttctagggcatctttgccaccattgctcccatttgttgagtccctgttatgaaccagacacttcatatttcttatctctgatcctcacaatctcctgtaaaggtgagtagtgtcctgaatgtagcagatgctgttgatgccctttccacttttcttctgcctgatattccctgcagctttacagtgtgcagtttttggtatgctgataggttgccactgcaaggtcctgccattgtcttctttgccatagctgcctctcctgcttctcttccttcttaaactctgcctgagggcttcctctggcatcccaggagcttgctttattgtttatagcggcaacctgaaaatgtcaagcggggttaatgcctcagagaatagccctcaagtaatagtggacagaagtaagtagaaaaatgccatagctccctcctgtctagtgagtgattctgaggtgtgttccttctggtttctcagagagtgctttacaagattgagccccacctgtccatagcaggaacctattcatctatgtactttttgacttttttttcttcttctcacatttcacttcctcccttggacctcttgagatcacttcctatgtaaactccctgcatccccatacttctccagggtcttcttttggtggaacccaaatttaagataatgagtttgtaaatgtaaaaactaaggctagggagaagttggggaacttgtcccaggaccactgcccctaaccaatggagccaggtttgcaacctacatctatctagtcgcggggcattctgtctttcagccattgcagtaagtactattacaagccaggagttgcttttttagttatgacggaatctgccattcctggtgccccataggtggttagccatgccttaggtgggtgtattagtccgtttttacactgctgataaagacatacccaagactgggaagaaaaataggtttaattagacttacatttccacatggctggggaggcctcagaatcatggtgggaagtgaaaggcacttcctacatggcagcagcaagagcaaatgaggaagatgcaaaagcggaaccccctgataaaaccatcagatcttgtgagacttactaccatgagaacagtatgggggaaaccgcccccatgattcaaattatctcccacggggtccctcccacaacacgtgggaattacgggagtacaattcaagatgagatttgggtgggggcacagagccaaaccatatcagtgggcagagaccatacagctgaaaggacacagagtcatgatgtctcatagccagacttgtccagcttcaaagtctgggtttcttctccaaaagcctcatgcttcatggtggttatgatggtagtgatgatggtggcgatgatgataatattgatgatggtggtgacagatttttcggttgtcagagtttactaggcacctattttgagcctgaaaatgtgcaatgtaccataaccatgtcctcagatttaataatccaattttgcagaaaaaattatttttatattttgaacactaaaatgtaccagaaccatcattttctcattgatactattattccattacttaaatttatttgtacttgaaggaaaagtatcatttcagtcactgtgctcatataatcctgccatgtttgccgggttaccttagggttacttactctagagttgtagctgtgaattatcactttgtaaaactgaaatatatttatgcaatggtagtaagtgggagagtaatgaaaaccaggctttatctatttttgtccagtaaggacaaaacattcttaaataataatctgctgtatccacaagatataattgcatacagattgcagacttaattcttaaatcagcgtttttgaagaatatacccaaagaaaaaccaattatgattatttccccttatttttcattgaagcctgtagtatcagatgtgctgttaggcttttgcactggttcgctcaaagctttgttgaaagaagccagaagattacaaattatttgttgccccagctttttggctacaatcaaacataaatttaaagtagactgtaaggtcactgtcacaagctatacttttatacatggcataacttaacagtaaccaagccaacaataagaagttgattacattccttcacggctattttaaaaatacatacttacaaaagaagatggagattttaaaccctgaacataacctcagattctcagttactttgtctataattctgttagcttcatgaatttttcctctgagtaactccaacatcatctaacccatctctgaacactaaataatggtggaaataccttctcagtttgctttctattagggaaagaagtatggaatcaactattgtgctgtaatcaccaccagggatctgtccttttatatccattcatttctggatctggccttttcggggtacttcagaaacaaaatcctgcctctagagaagctccatcatttgtacattgtcactgttcaacatctctttggacctctgttgatatcattgcttgagatgacagactatgataagagaaacaaggttctctataaggcagcattgactgcaggaagaggtgagaattgtaagttgtcaaaatgcaaagggcaaaaaagtagtctgccaggaatatgttcatacagattattatatacacttactgtctgtaacagctaagcattcaaagattacaatgaagatgtttccaatatttttaatgggaactatgaattagttcatgagttggcaactgtaagaacaaaatcctacttaatcaaattaatactgactgaggcagaaggatttgagcatcttgttatgagaaattggaagaatgaaagaaataagaaaccgacttgagagaatgaagtattgaatgaagtggttttgtaacgtgggatttgtaatcactacattttgagcaacatttatgttttgtgaagtggtcttcctaatgtatttaagcttttaaattacccctcatatataggtttcattcaaaagtgaaagtggtacctaaattaaacaatgtctaaactttctattgggttcagatgaagttttaagattttaaagagtaaaactgagcctcaagagacccaaaagtaatttaagaaatggtatcctcacactaataagatgctcccactgtgctttcccctatgtgttccctggactgtgtctaagggagatcctggccattgatttcattttcactttaactaatgatgtgaccctatcaggatctattcattcactctcacaggcctcattgatcctgtttgccacaaggactgctaagacccttggatctgcatggacaaaccttgccttcagggagatcatgaagcatgtacacactatcaataagtggaaactgcaacaagagcacattcttggggttctcagaaacagataacatagcaaagagtttaataaaaatgcgagacaacccttggagaaccattacaaggagttccactaagtgtagcagctctatcctggcaaatctttattaattccctcagttcatttgtataacttgggtaaagctaagccacttcctatccagtccaagtgggtgtcacattcaaaccaacacaaattcaataaactaaatctttgttgctatcttctttatggtgaaattaaattgcacaacacacagaaaatcatcctgaaaatcttcaacagtctgaactcccaaatcctattcatcacagcgaactgcctttgcataatttctttccttcctgttctcctcttccctcccttctcttccttttccattccccacctagcttcctctctcacagcactccatgccccacaacttactttctggatctattcttttctccccgggatggggttgctcttggctctcatatagctcatactctcttctctgggctttttttcagttcacctttctacccattaccgagatcatacaaattaaggccagaccctatactctcaataaaaaaagactccatcttttttgggggctgatgtgaggctgtgaatattcaattgttgttattaggattttcctctgtcacatcagtttcatggagtatttctgggagaaatagtcttatatttctcagccctcctgggacatccagattagaggaaaagctcttgaaattcaaaattacaatgagatgtttaaaagaaagtgtcgggcacccaaatgcctgcctacttgccttcctcacatggcaatagaatctgaacagtgtactcattatttgggggactatccagagagctcttgtacaagtaacacagactagttagctgccacgcccactgccactccccctgttcttcttctcctgccccatctccaaagccacttggcgaagcttcacccaaacaccttccctatagcagaataccagtgtctctatcaccaggcactccaaaattcccagtcctctgtgtgccagcttgctgctgggttccatgtagaagtgaggaagagtggacagctccccatctcttagtcaggcttcgtcatttttacctgaagcttaggtactgagtctcccatggaaatccaagagccttaaccagagaactcaaacccaaacttagggaccaaatggagaacattgcgtccattctccccctccctcctcctgtcccttgtgcacaatcaccaactcttatctcctccctctgttacttagcatggcttcccaaacagatcagtagataccaactgtagtggatgctgtgaggcttcatccaggcctctcttcagggacagctcattcaatcctagcttctgggaatggtttgtactgaaggcttacagctgtcccctgaccagaattatccttggccccagggaactggctgtccaaagattacacttcctctgaaagggcaatccattaccattgactggctgatttagggatatgaaggtcaagcctccttgcctctgaagggccaccacagctccagagctccttgttgagtcagctgaggcctccattgcaattgtattgcaagtcaactcttctttctgcctgatccttccttgctcacttcctcataggtttatctctttagaggattttctaataaaccttctacatgcaactacctggtttagtctttttctagagaacctaatctaagaccccacaaatacttttatttggagaggatggggacttgggagaggccccagataggctaggtttgagcccagttacacaataaatagcagctatttatgcatgaggtatgtagatttcatggggacactgggaatttctagatgtctgtagaactcagcctccaaattcactcatgaaacttgagccactttgtgactcaaacttgagccactatgtggcagtttcccactgttgataaactcagtgactaaatcacttatatctaccatctacacaaaactattcatcagaatgtgtttggggcccttgatctgggccctttttgggttataatgatgggattcttgtacagtgtgatagcttggttgtgtttttaatgcttcattctctctaaggcagtatgattttccagtgcactagagtgggttgagtatatttttgcaccaataattggtgttgggggccatatgacttgctttagccaatggaatgctagtagctatgatgcaagtggaggttttgcatatgcttacatggttaggcttgtcctctggtctcccgatgttgctgtgattagagcatgctccaggtacttactactctttcatcctgggcttcacgaaacagatgagcctgagccaaaccaaactgactgcagtctaaagcagagacactgaatgggattggatgatacttgttactgctggacacagagctgtaactcaacaatttgggttagcatttttgatagtttcacacataaaatattgtgaatttttcatttccattttgatgtattatactcttttatcttgttaaatcagagatgttatgcatacagaccataaaagtgcacctttaagaaattttgttctttatgtgtaaacctaggtcttctctacacacaatcctgttttcttctctaagtataaattgcattatttttcttgataaattgtattctaacatataatctcatccctctttcctcactatatggataatgcaaaagcttcctgttagtaaatcacaaataatgtttaatatcagagtcacagaaaccacagaccctttgatgtctcaaatctgatgtatttcaagcatccccctctacacatgcatatacacaaatgagatctgtaaacactgcacatacacacccacccatgcatttgtaagtcaaagcagcaatcgactgagggtaaaacactttctagagcattattttgtaccttgttttgtgtgaaaaagcaaaacagttttcacattgaagctctgttaatttaaaaaaaaattataaaattaggactgaaatgctcacacctatagatcttcttcatcagggtagcatttgctacttcccaggatataaattatactctcagtggattaagtggcctgaaaaccgatttaggaatttcacaatttttgctcagggcttaaatgcttcttgagagccactaccggtgagatggaatgagcaaccttagtgctactttccagggcagaaattccactctgcttttcagagcgaaggtcatgttcatggccctttctggagcacatagcctcaatcaatgccatgctgacgaaaatgtgtatcacaatctccgtgacttaagaataaagtcaggtgggccagtttagtggttttcagtctttagggatttttaaatgtcctatcactcagacacatccggtgttctgggcaaagcatgagtccataagcactcaagtgagttgagctcacctcctcagtggggatcttaatgctaatgcttgcatgtaagtgccctgatttccagtatcctccagtgtcaattggggataatggtaattgaccacacagaggtttagtaaagagctccagcgtgggtctggcagataagcacacccagaggttgtggacagttggtagtgccacattaccacccctttcctcaactggacaatacccactgtgtgagttgggatgggaagcatatccctacctcctcttgcaagaggttgagagggaaaataatccctctcccatgcccaggtgggcagagcaaggggctcatgacatagacctaaccaatcagttatttcttcctgaacttgtagcctggaggtaagtggcagggtagtgtggccactgggccccatgatagtagcactgcacaggcacagagaaagtgtcaggtatcccggagagacacttttgttatgtagcctcccttgattcctgtgcattttccaagcctgaattttgagaaaatgctaatattcttccaatatattgcaatatacccctctgctttttaagttagatttagatttctgttgcttgcaaccaagaatcctagcagatacccagacaaatgtttcatttgataaactttaaagcatttcactgatgggaggtattgctttttttattaagatatgtcatgatattaggaacaaattatatatatatttatgaagcatcaaaataagacttaaaaagtatcagttacattttactatctagtggtagagaatatttgtgctgtccacagttatgatataaatatccctagttcttttttcatccttaatcaactcttgtactcactccatttttgctaagcaaccccctctcacctccatacacacagcactactatgactagcaaaactgcactgtaggttctttcaagctttgtcttactttttttgtacttactcgccatttgttcttagcttcttttaagtgttttctttgctgtggttgtccttcagatgttggagttgctcagagttctgttctcaatgttcctgctctccctgggcatcttctcagctgccatggttactgccaacatggttgtgctgtaagcttcaagaaggaaaggacttcttacttcatattcaccactgcatgtctctagagattgacacattggccggcacatagtagacatttaaaaaaatctctgttgaatcagttttatcttatattggatgctatgaaatatttgtcttcagcacggactgcttctgggttccttaccagtaatatccatagcatgcttttatttggataccccataggcctcaaactaaacatgttaaaaactaactcgtgatgctcactgaggcataaataaatggtctgtccctctgtgtccctggtaccatgaatggtgcagccatctggtgtctggaggcagacatctgagaatctccctctttctgtgattctttaccctcccaccattcaccacatcctcttgattccatcccctctctccagctctacttcctctccctgccaccaggcatgcaccaccactgctcttttggatcagttcaccagcctgccacctactaggcctcccttcataatggctcccttcccatacactgctgctgtccctctcccacacccctcccctaagccccactagctcctacaatcctttaggacttatcccgatcagtcacctggaactgcttgctggtaccctctttcctggtttgtgcttctctgtgcttaacattcaccattcctgtatggtctgactgttgacttccatctaccagccaatgccaatctctggacatgcctctgtggatgctgcagtctttctagcctctgcacagtacaggatggaagtgccaagcagtcacatctgccaggatcaaccctcagcacatgtccagtgtgcttccttagttttactaggaaatctctgagacatgttccacccaggctcgcaaaggtccccagcagaactgaacctcagtggcccacaatgggaagctgtgctacgggctttcttcccttgccaatctcacttcacactcccctactggtgtttcctgggaacatcagcaaaataaactccatacactcatatgcttgcccactgggctcaatcctgccagaacactttgggcgatagtatagaacacctctcagagttatcccaactggggaccagggaggttgatgtatttgcccaccaacacttcatttgtcattggtaagggcttcttccaaggacattaactttctggtatttccacttagccctgcacaggaggtcttgctccttcagccagaagaaaagccctcaggcagagatttacaggtgttcccggcaggcaggcttcagcaaacaaggtggaggtcgagggtgaggcatcaataatatctgttccacaagtttaaattttataaaagactttgttattctgctgcaacgctgagattttccctatttgtttctgggcttggagcttatgaaatagaatgcgagagtgtttcttcccccatgttcaacgctgaaagcatctggtccttgacagtctggttaatctggtgtgttaccatccagatatactctgggattcttacatagtcaaaattacaactgtccttctgcatactgatactgttttcctttggcttaccttggattcccaggaattcatgtatgggcagcatgctgtgcctgtattctggtcaaatggcttttgagagtagtgcatggtatcttggctatcactgcagagccacccacctatgagagtttccagaaaaaagagcttccctagaacatagggtattatgtcactgaaagcccagacttattacaaattgccatctctgttccatttactctctgcattctttattttgcacaagtagaaacattcgttttgaaaccacacatttcattgttctgctgtgtttcctttttgtgtatgttcttaaggtgtgcaactttataatttgatatacatatacattgtgaagtaatcactacagtcaagtttatgatcatatccgcacctcacatagttaccggtttgtgtgtgtatggtaagaacacttaggatctatccccttagcaaatttcaagtatacactattgttacctgtagttaccatgctacccaccagagccccagaatttactgatctggcataactgaaacttgtacttcttgagcaacatctctccatttccctgttcccccagcccctgaaaactaccattcttctctcggcttctgtgagttcgactattttagattccacatataagtgatattatgtagtgtttgtcttatttcatttaccataatgtccaaaaacacatggagattcttcagaaatttgaaaatagatttttgagtattgttaccataaaaaattataagtgtttaaagtgatggctataaaactaacccaattcgatcattatattatgtatacatgcactaaaacatcacattgtgccccataaatgtctacaattattatggagcaattataaatttaaaaaataaaaaatagaactatcatataacccagagattccacttctaggtatttacccaaaggaattaaaatcaggatctcagagagatacctgcactcccatgttccttgcagtattattcacaatagccaagacatggaaacaaccttaattcccacagatggatgaagagatcaagaagatgaggtacacagacacacggtttattactcagtctgaaaataaatagctttatttatttatttatttatgtatttggagacagggtctcactctgttgcccaggctggagtgcagtatcatgatcacaacttactgtaaccttaaccccccaggctcaagcaattctcccatctaagcctcccaagtatctggaaacacatgcatgccccactatgctgggccactttaaaaatgtttttgtagagatggggtcttaccatgttgcccagactggtctcaaactcctgtgttcaagcaaccctcccacctcagcctcccagagtgctgggattacaggcgcgagccaccatgcctggccatggctgtgtttcttaaatggaaattatgtatttagaatataaaaatgtggtacatatacatcgtggaatactgtgcagccataaaaagtatgaagtcacgtcctttgcagcaacatggatggagctggaggccataattctaagtgaattaacataggaacagaaaactaaacactgcgtgttttcacttagaagttggagctaaatattgagcacatatggacataaacatgggaagaatagacactgtggactactagaatggggaggaaaggagggggtatggattgaaaaactacctattgggtactttgctcactgccagggcacaatatacccacatagcaagcctgcataggtaccaccatatctaaaataaaagttgaaatttaaaaagaaagaataataaaagtatgtatatgttttaaagaaagtggcactgtaagctggtattctttgtaggtttttgtcaacttaagggtcagtgtataaagcagctgaattcatcatcttcccatccccactcatcctcttccagagtttccatccctgtgaagggcaccaggtccactgattgctgaagccaggtacttgaatgtcagtttctgcccttctgtcctcccatgtgcccaccctacatccaatcagttatcaagtgatatgtcttccattttctaaacatctctccagttttcctctctccagtgtcccatgtgagatcacaccaagacctgtggcagtcttaggactggactctctgcctccaatttgacccatcagcaatgcactctctccttttgttatttgagtgattttttgaaaataaacatctaacatctacttccctgcaaaaatgttttgatggctccgcattgctcttagaatcaagtctaaactctgaattcacttctctactttttcatccttagccccaactctctatcctctcctcaattttttcacaaacaaaacacacttttagcttcttgaatatgtctcatggcccctcacttgtaagtccttactcacgctcttctctctgcctggaacattattgcttagtcttgattgcttgtgtttctcaagagccaagttcaagccctgacctgctgtcagtttctgattaaaaatgttgattttggctttgctttttatattaacagtgataaactctgtaattccttacggcttacagaatgatatttgcttctcccatggggattcaaagtaatttttaatgcaacatatttgacaaggaaaaaagggcagattcaatactctactatcactaccaatgaaaaaaggtggtagaacagatactaatcagctatattaaattggccataaacttcactcctactgagatatttctcagtggtcacagataagatggagacttagttaacacggatttttctagctgtgccatatttttttaaagctattaacatttttggctttgaacttttctttttctctttaggttgccaggaattggcagaccatttttgtctaattataacagtacttggaccttatgataaattcacagaaaatcactattttggaaatggatgcttaaaaatgcagcaacaaaaatgcatgcaattgaaattaatcacaaatatttctgagtaaatgttatgcttaaagccctgtattaagcctgtgaaaaacacagataagctcataatttaaatcaaagggtatagggtgaccaactatcccagtttgcctgggactgagtgggggaaggagtcctgagaaattgaattttcagtgagaaaaaacagaaggtcccaagaaaactggtacgagttgatcaccctagctacatatcaaaataatagcatgaattgttttatgaaaagtgccacacattagttttaacaaaaaataattacatgcttgggtcaggtggggaaagaagagatatcaagacactcacaagccaggaaaatggctatgatcaaagacaatgtgctttgaaacctttgagtatcaaagataagtatgagtcatgagaccagagaatttagaagaggccaaatttgaacaccttccaaattccaagcctgggggccagaccttattctctaaggacttgggtgctaattttggagaatttggggcaagttggaccaaaaattattataaaagcaatttttatggaggagtagtctaagttcttttttatttttaatatactttaagttctggggtacatgtgcagaacgtgcagttttgttacataggtatacacgttccatggtggtttgctgcacccatcaacccgtcacctacattaggtatttctcctaatgttatccctcccctactcccccaacccactgacaggtcttggtgtgtgatgttcccctccctatgtccatgtgttctcattgttcaactcccacttatgagtgacaacatgcgatgtttggttttctgttcttgtggtagtttgctgagagtgatggtttccactttatccacgtccctgcaaaggacatgaactcatcgtttttttatgactgcatagtattccatggtgtatatgtgccacattttctttatccagtctattattgatggacatttgggttggttccaagtctttgctattgtgaatagtgccacaataagcatatatgtgcatgtgtctttatagtagaatggtttataatcctttgggtacataccctgtaatgggattgctcggtgaaatggtgtttctagttctagatccttgaggaatcgtcacaccgtcttccacaatggttgaactaatttacattcccaccaacagtgtaaaagtgtccctatttctccacatcctttccagcatctgttgtttcctggcttttcaatgatcgccattctaactggtgtgagatggtatctcattgtgtttttgatttgcatttctctaatgaccagcgatgatgagcattttttcatatgtctgttggctgcataaatgtcttcttttgagaagagtctgttcatatcctttgcccactttttgatggttttttttccccttgtaaaattgtttaagttctttgtagatcctggatattagccctttgtcagatggatagactgcaaaaattttctcccattctgtaggttgcctgttgattctgatgatattttcttttgctgtgcagaagctcttcagtttaattagatcccatttgtcaattttggcttttgttgccattgcttttggtgttttagacatgaagtctttgctcatgcctatgtcctgaatggtattgcccaggttttcttctaggatttttatggtcctagatcttacgtttaagtatttgatccatcttgagttggtttttgtataaggtgtaaggaaggggtccagtttcagttttctgcatatggctagccagttttcccaataccatttattaaacagggaatcttttctttttgatccttcttttttttttttttttctcttgagacagagtctcaccctgtcacccaggctggagtgcaatggcacaatcttggctcactgccacctctgcctcctgggttcaagcgattctcctgtctcagcctcccgagttgctgggattataggcgtacgccaccatacccggctaattttttgtacctttggtagagatggggttttaccatgttggccaggctggtctcaaactcctgacctcgtgatctgcccgccttggcctcccaaagtgttgggattacaggtgtgagccactgcgcccgactgatcattcatttttaagagaatgaagaaatctccagaaagttgtgtttactaagaagactgcatcatctcaggctttgttttttattttgtaaacaagagcaagtgttcagaaccttcttaaacaactagcaacatgacaagcaatattgaaaactacaggtgtgccttattttatataaaactgctttgtgaaatacagatctttatgtatgaagcaattagaacagcatccccaacctttttggtaccgggaattggtttcgtggaagacagttttttcataggtggtgggtggtggggtggtttcaggatgaaactgttccacctcaaatcatcaggcattagattctcataaggagtatgcaccttaaatcccttgaatgtgcagttcacaagagtccatggtcctacgagaatctaatgccactgatctgatagaaggcagagttcaggtggtaatgttcactcacgcaacgctcacctcctgctgtgaggcctggttcctaacaggccacataccagtactggtctgtgatgggggagctgatgacccctgaattagaaggttatttattgcatgagaaaggcatttttcttttctaaattaaatagcattttaaaatagtgttaaatatatttaaaatagcatttattatataatgtaagcattgatttacttagctgtgacttctctgctgaactgagacctgtagggtcaatagtggagtgatgaaaaattggaggaattgtattccaggtaagggaaatacatacaaaggccttgaggcaaagggagcatggaaaattttagaaagtaaaggaagctctgggtgactagagcatagagagtagggtggggctgagagaaataaagctgaagggggaatgggcctgggatatcatgaagggcatgtcaaattaattaaggacttccaacttcctcactgtttacagggggctttgaagggttttaagcagggaaccgtatgtcaaggccagggccaacttcatcagcatgtgatgaatgcccattgtttagagaggcccaatgtttgatttaatgctgtttccaccattttggaattttaaattttttgaccaagtggctctgcatttttattttgtgctggaccctgccagttacctagctgatcctggccaaggctctaggtcattgtgtgtagtgaattaatacctactgagaggaccatgtttttctgctcactgctttttttcctttaaatagactttattttttagagcagttttcagttcacagcaaaaattgagatgaaagtgcagagttcccatacatcccctgtccacccactgcaacagcttctcccattatcaagaggtttgcaccaaagtgatacctttgttacaactggtaaacctacactgacatatctttatcacccaaagtctatagttaacgttagggttcactcttggtgttgtacattctgtgaatttggaaaaatgtataacacgtgtccaccattatagtatcatacagaatagtttcattaccctaaaaatcctctatactccacctactcatcctccctaaagtctggtaaccaatgatcttttactgtcactatggtttggtcttttccagaatgttgtataactggaatcatatggcatgtagtctacttggataggcttcttttcaccgctttttcccctgctagtatcagataattgtgcaggccactctacgagagccaaaggtcgtatttctccttctcctggaataatcacaagaacaggaggttctgcaggagcaattgactttagaggattaggggacaaataaacactgaagttttattcttcaggatttttgtatttctagaatagttcaaagtatgtacagagttgacagatcttttcaactgactggtcattcgttgcaaattccaaagaaataaactgtttaggaaacaactaactgatgagttacattcaataccctttctttgattccagacactaaagttattttgcatgcccaaattttgtactcagagacattacttctggggtctgtctagaagtaaaggcacaaatatgctgtaatagaatgctgccaggtagtgagggtcatcttctggccagaaatttcaccagaggctcttcaaaccttgcttttcccaaatgcagcccctaccaccaacaggttcctctgagctaacaaacaactccttgtcttctgtgacattttggattttaattctcatttcttcgaagaaaagggcaagcacatcttctcttttgggcttttctacaaattgtatatactgtctcagaagtagtgtccaacctttattattatgtacatgtggattttatcactagtatatactaaatatattactagatataaccactaataactataatactatataatgatataataccatatttttgtatatattatataccagcaatatacttttttcctattttgtcttctcctgcctatataataaaaacatgcttgttgaagatgctgccagagcttcatctgtattctcatgcctccttgtaccatttattgtgcacatcagttcctgggtactttcactcccaatagccaagtacttgtatctctttcttgaaggatcaaccttaggctgtggcacacaaagaaccacaacaagtttctgtgaatttactattccaggcaggggtggaggtaggggtgtcagccaatggctgattggtgttgtgtgttgtatgtttgtatgggtggtattataaatactccagcttcctgagcagatgactttgagtgggacccacactgtgtcatcaacttccccttcccccatcttcctcctctgcaggatggagccatagttaaccctctcaggctctttgtctgatgtcacatgtttgcttgccattcttacctacttagtctccctttctcatgctcctattttttcctgggactacttcttacaaatcactttcacacagttcttcatctcaggactacttttggggaacctactgtaagaatttgttgaggtagaaaagttgcagatcattgtgaagtgtaaaaaaagaacaggaaatgaatcatactatttccctacccccaagaaacctgttgtcagtctttttctatgaatttttagaagctttattgaggtatactttgcatatcatttaatttattctttcaagtatacatttcaatgatatatgtagtaaatttactaatcagtcattttcatcatcccaagaagacccatcatgtccatttaaatgacattaatcttcattttcctccaccctagcccctggcaaccgccaatatactttctgcctctatggatttgcccattatggtcaatttgtataaatggtatcataaaatatgtgatcttttgtatgtgccttaatttagcacccgtgttgtagtatgtatcagttcttcatttctttttatggctagcatttcattgtatggattgagcactttttatccattcattccttgatgtacatttgggttgtttctactttttggaatattaataattattgattaataatagaggctttaaattaataattatataattaaataattatttaattaaataattaaaattaataaaagttttaaaacatattttaaatttaaggctgttgttaaaaagtaatcctgtattctattgtttgtctgtaattctattgtcagtatctgtatgtgggataacaatatacatttgactgctacgctggaatttatttatttatatatttattttatttatttttatttttttttgagacgagtcttgctctgtcacccaggctggagtgcagtggtgcgatctcggctcactgcaacctctgccttccaggttcaagtgattctcctgcctcagcctccggagtagctgggactacaggcgcccgccaccacgcccggctaatttttgtatttttagtagagacggggtttcaccatcttggctaggattacaggcgtgagccactgagcctggccccctgaatcttttaaatcaaatgattcaacttaacttatcttttcttttcttttctttctttctttctttctttctttctttctttctttctttctttccttcttttcttttcttttcttttcttttcttttcttttcttttcttttcttttcttttcttttcttttcttttcttttcttttcttttcttttcgagatggagtctcactctgtcacccaggctggagtgcattggtgctcactgcaacctccacctgctgggttcaagcgattctcatgcctcagtcttccaagtggctgggactacaggcgtgcaccaccacgcctggctaatttttgtgtttttagtagaaatggggtttcaccatgttggccaggctggtcttgactactaacctcaagtgactcagccacctcggccttccaaagtgctgggattacaggcgtgagctactgcactcagctgattccattttctttaagttatttgtattcattcattttttttttgtttaataattcaacaatttttaaaagtattatgccaggcattgtgtttgatactggaaatacatggttatatttttgaaaccaaatttcaaggcatgatttgacaactgcatatgtattattggagatgataaaacagagctttggaaatcaagattggtgagaaataatttagataaaaaagggagatacaaagaattataatatagtaattaacctctgggacactctacctttgtagagttatgatctaaatctttctcaaatctgagtagatttttaaaaatctccatatacacgccattgctgtgtatttttaagatatcagattccgattcaggaccataagaaatctcagaacacagagagccagtataagttgtgttttcccttattctccctctcttcaccctgcccttctcataatcacttctgtctcaagttctctgtgtcttcatctatagggctggtacttaaaggcatgcctcattagtcttaactgtttctttcccatcaaaggctgtataattaccttgtaaattccaatgggagcatgagtgagtttgtctcatcgctgagcttcagggttctcataagctagcgataaagtaacagttcacacagatgaagggggactggggaagtgtgggtagaagtttttgcaatgaggtaaattttcttctgcaaggctcgtaatgagacatcaccacatgagtgggctggtctggattttgtcactctcctgtatcagcctttcccctccaaaccagcctatcaggctccctattagataattttgtttggactcagcatttcagcagatagtaactaaacaccttttttccttcactcagaaaagtaccctgtttttatagaaaacaagaagagcttgccgaaatccttctcagaggcaagctctccaagtaagtatattttctcaggctttttatagtttaatctacttacaaacttccataagcatagtatgtgtctttccatgcagtcttctgcttgatatccatgtatgagaaactgcaaaaaaaaggttatatttgatttataaaagttcttcattatttaaaagtgtactagaacaagccagtataaattccagtgcaggctggtgcggtggctcgtgcctgtaatcctagcactttgggaggccgaggcgggaggattacttgaggtcaggagttagagaccagcctggccaagatggtgaaaccccgtctccactaaaaatacaaaaattagccgggcgtggtggcatgcgcctgtagtaccagctactcaggaagctgaggcaggagaaccacttgaacccagaaggcagaggttgcagtgagccaagactgcactactgcactccagcccgggtgacagagcaagactcgtctcaaaaaaaaaaaaaaaattccaatgcagcagtcaaatgtatattgttatcccacatacagatactgacaatagaattacagacaaacaatagaatacaggattactttttaacaacaccgtttttgaagatataatccacatagcacaaaattcacccttttaaagcatgcaattcaggggatttgagtatattcacgaggttgtccaactatcatcattatctaattttagaatattttcatcatctcaaaaggaaatcctgtgtcctttagcagccacccctcattccgttctcctcctcagccctaagaaaccaaaaatctactttttgtctctatggattgatctgttctggacattttatagaagtgcagtcatacaatatgtggtcttttgtgactgacttctttcatttaaaatggtgttttcaagattcattcacgttgtagcatgtatcagtacttaatttccttttgttgctgaataatttattgtatggatagatcacattttgtttattcatttttcaggtgatggatagttgggttgtttctaccttttggatagtgtgaataatgctgctatgaacatttatgtataagtttttgggtaggcagatgttttcagttatcttgggtatatacctaggaatggaattgctgtgtcatgcagtaatattatgtttctaagctttggaggaattggcaaaccattttgcaaagctgccacaccctcctaaactgacagcaatcatggagggtgattatctacatttgtagaccagaaagtggtggtccagagagcttaaaaaagttgcctaagtcaataagataaacctgtattacttttcaaaatgttgcatcagccctgaaatgaagccctctcagattcctttaagaatgtctaatgacagagatggaagccaggagattgggacctgagtaatggatgtgtctgcctcaaattctgaacatctcaagggcagttccataaatggcaaacacatctgtaaaaagcatatttctctttttaacagcagaaaattttaattcttattaaaataaacacatatcactgtgttcatggagaacgcagaggggttaaatatatagaaaagatcatgccactgaaaccatcatactctaagaatttattctgtcataagattaactcttctccctttgctttctttatgtgaaggtgaagaatcctatggcccatagatttttacagtgttctccatcttgcagcacattaaggagttaattcctttcaggaaatccatttctgctgaaaggctcacttttccagcccctgaacagcatatgtgacctgcagtggttattcttagcaaacttcttcccagggatgacccaatgggagcagcacagctcaatcttttcgtgaagagagaaaacatctcagattcttttcctgttttaaattattgggaaccaatggctcagaactataccagttacccttataactaactgcattaccatcttccatccttctataccagtctcgctagtcttccttgctggctgtagttcttggaactctttaaccaatcttgacttagggtcttctttcagattgctctctatgcctgtgatgatctcccaaattcttatctagaaagaatcttttccttccttggcatgcaatgtattcctcatatgtattaccaaacacattgctttaaaaattatatagatacctcaaaataataacagccacctatgacaaacacacagccaacttcatactaaatgggcaaaagttgaaagcattcctcttgaaaaccagcacaagacaaggacgccctctctcaccactcctattcaacatagtattgcaagtcctggccagagcaatcaggcaagagaaagaaataaaggggatccaaacagagagagaggaagtccaactatccctgtttgtagacagcatgatcctatatctagaaaaccccatagtcccagcctcaaagctccttaatatgataaacaatgtcagcaaagtctcaagatacaaaatcaacgtataaaaatcactagcattcctatacaccaacaaccgtcaagtcaagagccaaatcagtaacgaactcccattcacaattgccacaaaaagattaaaattacctagaaatacaactaactaaggaggtgaaagatctctgcaaggagaactataaaccagtgatccaagaaatcagagatgatacaaacaaatgtaaaaacattctatgctcatggatatgaagaatcaatatcgtgaaaatggccatattacccaagcaatttatagagtcagtgctattcctatcaaactaccaatggcattcttcacagaccagaaaaaaactgttttaacattcatatggagctgaaaaaaagcctgaatagccaagaaaatcctaagcaaaaagaacaaaactggaggcatcacattacccaacttcaaactatactatggggctacagtaaccaaaacagcatggtactggtacaaaaacagacacacagaccaatgggacagaatagagagccaagaaataagactgcacacctacaatcatctgatctttgacaaacctgacaaaaacaagcaatggggaaaggactccctattcaataaatggtgctaggataactggctagccatatgcagagattgaaactgtacctcttcctatcaccatatacaaaaatcaactcaagatgaatgaaagacccaaatgtaaaacttaaaactataaaagtcctggaagacaacctaggcaataccattctggaaataggaatgggcaaatatttcatgacaaagacaccaaaagcaatcacaacaaaagcaaaaattgacaaactaatgagcttctgcacagcaaaagaaactatcaacagagtaaacagacaacctacagaatgagtgacatggtttggatctgtgaccctgcccaaatctcatgttgaattttaatccccaatgttggaggtggtgcctggtgggaggtgattggatcatgggggcggtttctcatggtttaccacgacctcccttggagctgtcatcataatagtgagttctcacacaatctggttgtataaaagtgtgtagtaccttattcccacttcctgttgctctggacatataggctctgacaatataggcagaaggcttcacccttcgccttctgccatgattataggttccctgaggcctcctcagctatgcttcctgtacagcctgtggaaatgtgagccaactaagcctgttttctttataaactacccagtctcaggtatttctttatagaaatgtgagaatggactaatacaatgggagaaaatatttgcaaactatgcatttgacaaaggtctaatatccaacatctataaggaacttaaatttccaagaaaaaacaaaacaccattaaaaagtgggcaaaggacatgaacagaaacctttcaaaagaacacatacatgtggccaacaagcatatgaagaaaaagctcaacatcactgatctttagagaaatgcaaatcaaaaccacaattagatactatctcacaccagtcagaatggctattactaaaaagtcaaaaaataacaagcactgtcgaggttgtggagaaaaagaaacacttatacactgctggtgagaatgtacattagttcaactactgcagaaaacatggcacttcctcaaagacataaaaacagaactaccatttgatgtagcaatcccagtactggctatatacccaaaggaatacagattgttttattataaagacacacacacacatatgttcattgcagcactattcacaatagcaaagatgtggagtcaacctaaatgaccataaatgatagactggataaagaaaatgtggtacatatacactatggaatactatgtggccataaaagagagggagattatgtcctttgcaggaacgtggatggagctggaggccattatccttagcaaactaatgcaagagcagaaaaccaaatactgtatgttctcagttacaagtggaagctaaatgatgagaacacatggacacatagaggggaacaacaggcactgaggcctttctgagggtggagggtggagggtggggcttgtacaacaagcctccatgacactgatttccctatataatgaacttgcacatgtaaccttaacttaaaagttaaagaataaaatatttgttgagtttcatgttacacatctgtagttattatagtcataacactttagagctgcacagactcaaatgatcagcactgccagacgttctgacagcaaaattatctgaatagataagagacttaggtgggcttttgctcagtaaatgaggttgtttatattctttgaaacagtacggcaattcataatactccaacacacgactgcctgtgggcagaccctcctgttcaaggtactgtgtggggtatcacagaatgctgttcaggaagatatcactggggccttctactctcaaaggggttgataaacacttgagagcatgaggatgaatacccaagggattaggtatgctttgggctctgaagctggccacatcagtaaaatatcacatacttggcaaattagatctgagtaatcaaacagaataattcagcatctctcccccatagacttttagtggctgacattagttttcatttgatgataattactgatcacagtaatcctcacaactaacagtttttcacttctgtaactttcttatatagatctggcacatttcttagtagtttacagatttacttttcgtttgtttcttggttgtgtttgcttatctgggcgaaatatatttttcctatatgttctcaatttggttatttatgacttataggaaatcgattaacttgtaagtttgtcttgtatctagtgacattattgctttcatattagttccagtaaactttaaattgacaagttggatttgtagacagaaagtcatttatttgtttataataacactttggcatagtccttttccgtatttaaggctttaaagaaatcttttcttatatgttgctgaagacttctggtacaatgtcaattttaggcatctttgccttgctcctgagtttaatgagaccactttttaacttaagcaagataaatcagtttctttccatcttgacttattggtagttatatttttctttcaagctggaaagcctgtgaaattttgtaaaatatatcttagcattacttgagatgatcatgtttttttttcctccatctttaatataaatacatagagaattctgttaatagttttcctaaagttgaacctccttgaattcctgggataaagcctggttgatcatgatttattgttgtggagttttctatttgcttagctttgtaataattctccattaaaaaacacttattggctaagtgaaccaaaatatctaatgaaccatgaagttgtttgaaattatagcaaggaatataaatagactagttggctatgctgttccctttttaaaaataatttcattccatgctgacatgagcaataggatttgatcgtaacagagagatgacttcttggctgtgtaggccatatgtttcctgataaaatatctagtgtctaatatcgaatagcccttgtggcttattttgtgtgtttaaacaatctggtccagttctgctaagtgacaacaagcatcacctactgtcaaaactcttttctgagcctgcagaaattactacaactgtgggatgtacttgatttcaatgtgctgtattaatgtttgcccagtaatttctagttacagaggctatagcttgttcttccaccaaccatcctggagagcagttagtaaggtgtagcagttgagagtgtgaactatctggtttcacttcacagctctgccattaactggctgtgaaaaccttaaattcctcagttttattattttaaaaatgggactatttaaggtaactttgagctattgtgaatatttagtgactaaatataaagcacttaaaatgtatttggtgcatagtgttacatatgtgctagctatgatttattttttgtttcaatgtaattttttcctttttttaaatttaaaacttttatagctctattgaggtataattcacaaataaatattgcatatgtgtatatattgtatacaatgtgatgttttgacacatgtatacactctgaaatgattattacaatcaaactaattatcatgtctattacctcacagttatatttaatattaatatttaagattattctcttagcaattttcaagtatacaatacattattaactacaagctatgactttgaataatcaagttagaatgatcaatttgccaggagtttttgttacagatgtcagagtcctatgatcacacatgaaagatttgctttttttccttatatgtgacccatggaaacatatcccttgtagaatttgactagtcctttactcattcaaggaatttctgaaaataggcagatttgtttgactaatgtttttccaataaaaaagggctggctgtttttctcacaatattttacattttgaaaaattcaaagaaatgaaattgaagctgattatcagaatctgtcggggaaatcattaaacattggccagccctagtaaatagcaatggaagggtaatttacacctctcattgctctataggaggttcttctgttgcccctgtgttgaccggttcacagttagcaaaagtatcttgtagggggactccaaagacagagagattgtgtgcagcttctgctctcagactccctgggtcaaatctgagctttgccactggtcatcagcaagttgaccttgggtgtgtttctagtgctccagtttcctcatttgtaaaaatgtgataataataataattacctctcagggctgtggggagaattacaagagaaaacccctgtgtatgaccaacataggaccctgcacatacgaagtgctcaataagtaatgtgtcatttagtacaaagcatttgttatttggaagtttttttttgttgttctaaggtgtaagtcatcatatctccggctaggcagtatgccatacatgaaagtttgggagagtggggttcatttattttaaaaacagttcagtgtttttagtatagtcacagatatgtgcacccatcaccacaatcaattttagaacattttgatgaccccccaaaggaacctcatacccaataactctcatttcccccttcccccgtccatctagctggctgtaagcaaccactcatctactttctgtctctatagatttgcctattccggacatttcacacaaattaaattgtactatgtttagtcttttgtgactggcttctttcatgtagcttaatttttcaaggtttatccatgttgtaacaagtaccggtacttcatttctttgcatggcagaataatcttccagggtatggatagaccacactttgtttatccatttattcattgatggacatttgagttgtttctacctttcggctatagggaataatgctgcagtgaacattcatgtacacatttttgtatggatgtatgtttttatttttcttaagtatgtatctaaaagtggaattgttaggttatattccatttgaggaactgtcagactgttttccaaagctgctgcaccattttacatccccaccagcagtgtatgtttgaaggttccaatttctccacactttcaccaatacttcttattatgtttttgtttatagccatcctagtaggtatgaagtgatatttcattgtgattttaatttgcatgtccctgacaactagtgatgtagaccatctttttgtgtgtttactggccatttgtacatcttctttgggaaaatatctattcaaatctgttgcccatttttaattgggttgtattttcaattattaagttgtaacactggtaatttttattgagctattaatcgctgttcacacttgaccttgcacacaaatccctggggactttgttaaaaagcagtctctgcttcacttaggtcccttggggaacctaagagtgtacattttccagtagttgcagatggcgtagtccatggaccctacttgaagtaagaaagacactttttaaaatgcttcatgattggctttttatgtattactcagaaaagccatttgaagagagaaacacaaaacctacattttatttattctttcctatattcacttccacaaatggaagtattagagaaatgtaaaatataatatattctcactgttttaaagagagctaacattatattagtgtctgaaaataaagatatagttagaataatttaactttttttctcgaatacttgtattataatttaaagcatttagaagcagtatttgccaagtgactagatttactttcagtttttaaaatagttttggctacagatgtagctgtaagtttggactttctagtacttatttattatctttttcctttaaaaaacagtttgagacacagtctccttctaatgaaagattattcatcatcctctttggtcatgcttcgttgggaggcacttgcattgatgtaggacaggaagaaaggggagggaccctggctgaaccagccagatttgcagaattagtggccaacacgtgtctcatagatttatgtgcctacagtcttggcagcatcccaatataaaggtatattatttccagggacttaattcccctcacagtgtgaaagagcaatgaaaagcacaagtttggaaaagaaactgcaaatgaaaaaatcaatgtaatgaaatcaattgtgaacactagagtttgttcaaattagttttttgtttgtttgtttgtttagttttggtagctatcatcctcatagatacctcacctaccctataggacgtatgatttcactttcaaggggattttctggcctttaatgagtcatggcagcagttaacactagttgcagtggctggtggtataatttggaggcgcattctgttcttttgtgacattaaaatggaaaatatgagcccagaaaatgatttctctagggatgcacatacatggttacagctcattatggacctgtcaacatcttctcctctgcccttccttgggggagattttgtctcctgacgcagttttgaatgagagtttaacaagtgctgagtctcgtaccttttacagtaaaatatttgcccagatgaagtcatctccttcggaatttgaaatttccctctaaaaatatggctaaacccacaagctataaagaatcataataattcatttagagataactttttggcagctggaaccactagaaattttctggagtatagatttggtaagttaggcaggctaaagggctctgcccccagataagtgacccttagggaattttccatatctgaaggtaagaaggactatgggaaattggtttattgatagagttagttaatcaagatgttatttctggcaacttttaataattaacatttattgtacacacattgataaagttagaaaatatctactctgaaataatgggactataatttttaaaatttaacttaaataataaagttatcatttgtaacattatactacactaatactatagtatcaccatgcagataacactatgaggctgatttgttatattctctttacttcttagctcagaaggcaagtagagatgtttcataatctgtcgttaaaattgttttcttttcctcattgggcccatgatcgtccaaacgtttctctaaagaaagtccccttgaataaaagtggctttttaaaattattattattatacttttagttctagggtacatgtacacaatgtacaggtttgttacatatgtatgcatgtgccatgttggtttgctgcacccattaattcgtcatgtacgttaggtatttctcctaatgctatccctcccccatccccccatccccccaccccacgacaggccccggtgtgtgatgttccccaccctgtgtctaagtattctccttgttcaattctcatctatgagtgaaaacatgcgttgtttggtttactgtccttgcgacagtttgctcagaattagggtttccagcttcatccatgtccctacaaaggacatgaactcgtccttttttatagctgcctagtattccatggtgtatatgtgccacattttcttaatccagtctatcattgatggacatttgggttggttccaagtctttcctattgtgaatagtgctgcaataaacatacgtgtgcaaatgtctttatagtagcatgattcataatcctttgggtatatacccagtaatgggatcactgggttaaatagtatttctagttttagatccttgaggaatcaccacactgtcttccacaatggttgaactggtttacagtcccttcaacagtgtaaaagcgttcctatttctccacatcctctccagcacctattgtttcctgactttttaatgatagccattctaactggtatgagatggtatctcattgtggttttgatttgcatttatctgatgaccagtgatgatgagcatttttcatgtgtctattggctgcataaatgtcttcttttgaaaagtgtctgttcatatcctttgcccaaaaagtggtttttttttaaatcatgaaagcaaaagagatcctccctgtgcagagtggaagtgataacccttcattggtgagataatatcccattatttagatgggggaatcttcacattgttaacacactgaacttagagtatagagggtgggggatgcccattcctggctgcaggggccctgggacctcatctcttctgggtgcagcactgctgcctttacatcttttccactctagacctccattttaagccactgcttaaagagtataaaaatatcttctgtttcctttcttcccctttccttccttttctccttttcttccttcttttttttccttcaaaatttaagtagtacactcatgcatgctggtgagtatgctaggtatgaggatagaagtggtccctcaagacgatgactatgatgtggcccctgagacagtcataggctggggaccagaaaggaggcaatataggtatcggccgaaagatgatgactttcattttgactgtgttgagttttaagaactgggagcatgtgtccagctacttgtacagtgcctaacacatagtagcctgagacactgaatggaagccaccatcagtgctcttctttggtcatgtgaccttgggtaattccccctccccaaccaacaccaccattctgggcctctagttgctcttctgaaaaaagatatcattggattagatgaccctagaagtttcttcctttacaagaagctgttggtaccctctatgtatttcctagacacacacctgatggcaagtacctggtaaaaacacctgcaactctctttctagtagtttctttctggtcatgggaacatactctgccatgacagggcaagtttcagaagtgacagagagttaatgatcctaggagcagccctcaactggtgatggatgaagagtaggtgggtaattctaggttaactctttcagggtaactctgaagcatatccactctgtctcgcagagtctccctgcagggctgagtcccagtttccttcgatgataactgtattgtgaactcatgttttattgacttctttctctttcctatctcattgcctctcactcccctaccaactgtttcctggtgttacctcctgtggtcagcagaataataccctgagagatgttcacatgctaatcctgggacttgtgaatctgttctcttagatggccaaagagactttgcagatgcagattaaattaaggatcttgagatggggagattggcctgggttatttgggtgtgcccattgtaatcacaagggctctcataggtgaaggagggaggcaagggagtcagattcagagaaggaggtgtgatgacagcaacagagttagagagaaattggaagatgatacactgctggctttgaagaaggaggaaggtgccacaagcccagaattgcaagtggcttctagaagctggacaatgacaaaaaaagggggatggggggctcctcctctagagtctccagaaggaatgcaactctgcctcttggtttgagcccagtgagatccattttggacttctgacctccagaactgaaagaaaatatgtatctgttgatttaaaccactaaatttgtagtaatttgttacagcagtgacacaaaattaatacccctcctaaataaaccatttgttcaggaattgttgcttcagcatctgcttctgggagaacccaaattaagacacttcctaatctgatattgtatgcttatttttaccttagttaaaatatcaacatttttcagttgttcaataacaattagttattgtgcccttttatatgcttgatgtttctgtaaggcaagtcacaaagatgcaattaactcagcccttccctgcatagagcttacattctaacagtggaaatagaaaatgccacaaaaattgtagcatgtgtcttgtactattgagcacttttttcttcactagtcagataactgtaagtatttataaggcatctaatgtgaaccttgagcaaagcatcaagtatataaatatatgccatacacaatggtgtataaaataatatagtcactgccaacaaaaaaacacattctcaaatctaatttttaataaagtgacagtatcaccctaaaagaggccaatcttattttgtcagtagaagaaaaggaagaagaacaaggagttctcactgtaaacaatgtagggatcccattttagggaaactgaaacactgatttcaccttctagattcccataaaaagcatggaaagtttattttgttcccaaggaaattcactgttgtttagcttctgaaccatcagcacattaaaaaaacgataatttactgcagcattttagctgtgaaatatacggaaagaaagttgaagtcagattcacaagatatgagttcaaatcctggatctgtcacttcataaaatcatgagctctcaggcaataatttaactgttctgaactgcagctgttaaataacaagtcatgggtggaggtcagcacatgctaatgtcccaagctctttctctgttttatatggttgggcatgtagtagagtaagctttttcaacgctttaggctgaaattctggaatccttgttgctttcatttctgctttcaaagttgccaaattctctcccatctctcccccaccctctttccttttaatcccttgtcagacacaggcaagagtagccaacatatgctaacattttaattctaaaggtgctggctttgaaggcatgtggtcgcccttccaggttatcacaggtaaaagatgtagcaagtttttttgctgccacatgatatgagtcacctgtctttctaacctctggtatctagttcctctttgtctgttacctaaggactaagccagttctaaattcattattaggtcttggttatggcagcacctcactttaaggtgctcaaatatctcaagtagaatagtcctgttgctgcatcaagaagctaattgctggaaaaaacaaactgaacatttttgcgacttaacacaaatttagttttcgtttgcattggaattaggcatttggagggcaggctaccatgtggggattcaaggactcaggcttcttctgtcttgtggcatcctcatgttcaatctgtgtactccatggaatggcctagaaaatggcagatcccatgagcctgacctggaagtgacacacatcactcctgcctttgaccagaactcttatcattccattgaccattatttgatcacatggctccatcctacctacaagggaggtgaggaagtgtgaactctggcttagcacaatcccttagtcatcagtgagccatctctgtcttcttgtgcttacttcaaaatgttgctatgcaggtgaaaactgcaaaattgatctgagagttacttttagagtaaaacatatggtacagatgagagggattgattttttcaaagaaacctcattaccctgagactttgctgaagttgcttatcagcttaaggagattttgggctgagacaatggggttttctagatgtacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccggttttcaaagggcatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggatttggtttgccagtattttattgaggatttttgcatcaatgttcatcaaggatatttgtctaaaattctcttttttggttgtgtctctgcctggctttggtatcaggatgctgctggcctcataaaatgagttagggaggattccctctttttgtattgattggaatagtttcagaaggaatggtaccagttcctccttgtacctctggtagaattcggctgtgaatccatctggtcctggactctttttggttggtaagctgttgattattgccacaatttcagatcctgttattggtctattcagagattcaacttcttcctggtttagtcttgggagggtgtatgtgtcgaggaagaaacagagagccaaatcatgagtgaactcccattcacaattgcttcaaagagaataaaatacctaggaattcaacttacaagggacgtgaaggacctcttcaaggagaaccacaaaccactgctctatgaaataaaagaggatacgaagaaatggaagaacattccatgctcatgggtaggaagaatcaatatcgtgaaaatggccatactgcccaaggtaatttatagattcaatgccatccccatcaagctaccaatgcctttcttcacagaattggaaaaaactactttaaagttcatatggaaccaaaaaagagcccacatcgccaagtcaatcctaagccaaaagaacaaagctggaggcatcacgctacctgacttcaaactatactacaagtctacagtaaccaaaacagcatggtactggtaccaaaacagagatatagatcaatggaacagaacagagccctcagaaataacgccgcatatctacaactatctgatctttgacaaacctgacaaaaacaagcaacggggaaaggattccctatttaataaatggtgctgggaaaactggctagccatatgtagaaggctgaaactggatcccttccttacaccttatacaaaaatgaattcaagatggatgaaagacttaaacgttagacctaaaaccataaaaaccctagaagaaaacctaggtagtaccattcaggacataggtatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatggtagaacattttcgcaacctactcatctgacaaagggctaatattcagaatctacaatgaactcaaacaaatttacaagaaaaaaacaaccccatcaaaaagtgggcaaaggacatgaacagacacttctcaaaagaagacatttatgcagccaacagacacatgaaaaaatgcgtatcatcactggccatcagagaaatgcaaatcaaaaccacaatgagataccatctcacaccagttacaatggcaatcattaaaaagtcaggaaacaacaggtgctggagaggatatggagaaataggaacacttttacactgttggtgggactgtaaactagttcaaccattgtggaagtcagtgtggcgattcctcagggatctagaactagaaataccatttgacccagccttcccattactgggtatatacccaaatgactataaatcatgctgttataaagacacatgcacacgtatgtttattgcggcactgttcacaatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcattaaactatcgcaagaacaaaaaaccaaacaccttgtgttctcactcataggtggaaattgaacaatgagaacacatggacacaggaaggggaacatcacactctgatgactgttgtggggtgggaggaggggggagggatagcattaggagatatacctaatgctaaatgacgagttaatgggtacggcacaccagcgtggcacatgtatacatatgtaactaacctgcacattgtgcacatgtaccctaaaacttaaagtataataataataaaataaaaaataaaaaaaagaaacctcattacccattatgatttgattatcctgatagtacaaatagtttagcatctaataggtcaatcagtttaatggacttgagccctattcaacaggtgttaacattgctttttgggaaaatgcctgtttccttgctggctgttgacagcaggtctatctcagctttgagaggctgtgagcatttcttgtctcatggtccctcagtcttgaaagccagcaatggtatgtcagatccttgttatgcttccaatccctttgacttcttcctttataattttttatttttgagacagggtctctgtctcccaggctggagtacagtgatgcaatcacggctcactgcagcctcaacctcaaaggctcaagtgatccgctcacctaagcttccagagtagctgggaccacaggcatgcagcactatactcagctaattattattattattattattattattatttaatatacaaggtctccctaagttgcccaggctgatcttgaactctggggtcaaactgtcctgtgttggcctcccaaaatgctgaggttacaagtttacacctgaaaagccaccatgcccagcctttgacttcttccttttaaaggactaatgtgattagagcaggcccacccagattatctccccatgtaagggtaagtgatttgggaccttagttacattttcaaaatcccttcgtagcagtacctagattagtatttaatttagtaaccatgggatgggaatcttgggaggctatccttagaattctacctactatagttaagtgaattgcctgaattcacatgagtagagagtagtgagtgaagcaaggatttaaaccccagcctatctggcatcagagtctgtgccttttctacctatcaggtgacccctctatgaaaatcagtggtggacattaaccccaaaagaattttctagaaggaaagcccaaccctaattcttaacctagaggaatgtcttagttcatttgtgctgccattacaaaataccacagactgagtaatttatagagaacagaattttatttctcactgttctagaggctgggaagtccaagatcaagaccctagcagtgtcattttctggtgagggctgctgtctacataaaaatgatgctgtctgcatcctccagagaggaaggatgctgtgtcctcacatggcagaagggacagaagggcaaaagggggcctaagctggttacctctggcccttttacaaggcacaaatacacttattagggctgagccctcatgatttaaccatttctccaaaaggcccctacctcccaataccaccacaatagggattaactttcatcataaattttggaggggacaaaaatattcaaaccttagcaagccatataatttaaataattattacatttaaaattgtagatttagtgtttaaaaattatgcaccaaagtaatactgaatctttctgaaatgccaccaccaaagagatagtatgattgtgggctatgtaaacagatctggatcaagtctaagagccaccacttacttgccctgattccccatgcctcagtttctgtaccataagtgggggataataatagtggtatcttctggttgtgctgagagattgaaattataacacttaccatagttcctaggacactgtaagcactcaataatttctaaccacccccactactatcattatcatcatcatcacattattattattattgttatctccaaccttcagcctagatggttgatacctattaaacatattatcaaatatttatactttcatatcaataacatataaaataaattatgttcattcttcagatgagcagaagaggtatcatgccatgatctcatttttaacatgcatttgcttctgaaatctcagctgtagattagtaaatgtaatacttagtaattttttgatctgatgttttctctgcccttcctgtaatttagagtttgtacacttggttctaattctgtcagtgacttaaatagatataaatttaatgtcatagctcatgagaattaatgtcactttcaaagtcatcctctcaacctgcccttctcctttttcctcttgatccaagacccattattctaaggtttctaacacatttcttttcacttatactccagacttgagattgctgtaaacatgaaatttatttttagatctttttgctctgcattctactcagagcctttctctttttgcattttcacaacattcctaggcttctgctcagccaacattttaaatatgacaaaaataaatgccatggagggaagactctgtggcagcaacagaaatgcctgttgagtcctctgtggaatgaagcctgagaccccttgggtggtttaagcagaaatatttgagcgaagaagtgtgaaggacagaggtgtcagaaggaattttcaagagtgtttataaacagtatatgctacagagggtgcagggctactgagacctcaattaggatggggggtgtggttaggagaggccactatggtgcagacatccacccatcccaatttctgtagaagtcagcgatggaaatgcgcagtggtccaataatgttcccattggtggtagagtcagagctttggttttttatcaccttacatggattttacacattattaagacataagctagaggagagaaatttcttattaacaaaacctgaaatcctactagcactgataccttctcccagcacctgcactagccacccatgacatcctctacagattagtgtgcctcctttgctttccatgttaaccttttagcatccataccattccccttatttaaaatagggcttctcaactgagacaccattgacatttggggccagacaattctttgtggtgggggctgtcctgtgcattgtgggatatttagtggcatctctgacttctacccactagatgctagaaacccctccccaagttgctacaaccaaaaatgtctccagacactgccacatgacccctagaagtcacgattgtctgcacttaagaacgactagtgtagaaccccctctttcttctgctctactagtccttccttgttttcctgtataactctgctcaaagctcacctgtacaaaacaattcattaattaatcccacctagctctgagctttttcatcactaagtaccttctgtcctgctgggcctagacatagattttaccaattatgtttttgccatagcctccatttgtaataaatcagtttttgttactccttctgtatgtaaggaaagagtaagtttatgacttcattttaaaaatatctccaaagttcctgctagcatattctgcataaaatggactcagtaacactttgatttagtgagcagaactacttttttttttttttttttgagatagtatctcactttgtcgcccaggctggagtgcagtggcgcaatctcagctcactgcaacctctacccttagcgttcaagagattctcgtgtcttggcctcccgagtagctgggattacaggtgcccgccatcatagccagctaatttttgtatttttagtagagacagggttttgccatgttggccaggctggtttcgaactcctgacctcaagtgatctgcccaccgctgggattataggcgtgagccactgcgtttggccagaactacagttttctattactaccagttgcattgcttgacttttatttatttagcaattttaccattgctgaattgcttcaggattgaagagaatgaatctttagaatctctattgaaataaggaattaaataattgtgatttcttttattctgctgagaacttccaatatactcatttggtgatgaatacattttttaagtgaatattcccaacatacttgggaccactgtagctttcagctatatggcatgtacctgggtatgctgacgccacactattttttgttggagattcagcagttattttgtgtgcagttgacagactttttttttccaggtcctccctgggatctaattttgtaatgctctcagtgttttctcatgtccccttagcatttactctatgcatggaaggctgcgtgtttggaacacctaaaactctgccacctgagggcatttcttctaacagtgggaattgcctgggtgttaatggccatgaaagcaattctcccagcatggtgactcatgccacctataattccagtgttttgggaggctgaggcaggataattgcttgggcccaggagctcgagaccagcgtgggcaacatggctagatcctgtatctacaataaaaacaacaacaataataataatctggatgtggtggtacatgcctgtagccccagctactcaggaggctgagaatggagggtcgcctcagtccaggaattcgaggctgcagtgagtcatgattgcagcactgcactccagactccagcctgggcgacagagcaagaccctgtcaaagaaagaaaagaaaagaaaacaagcagctggttggatggggatttggcaaaaaactgccccagcttcctagtccccctgtgaggacaactctgaggcaaatatatatatatattttttttttttttgagatggagtctccctctgtcacccaggctggagtgcagtggcgccatctcggctcactgcaagctccacctcccaggttcatgccattctcctgcctcagcctcccgagtagctgcgactacaggcgcctgacaccacgcccagctaatattttttgtatttttagtagagacggggtttctgaggcatattctgtactgtctctcagtattacctagtaggattgatcaaattgctcacagaagtaacttgtgtgataacacacctcggttggtttctttcccttctctgtctcaccttccaaataaactacttacactcaaatccttgtttcagactccacttgtaggagaacccaaaccaagaatccatgttataaatatgatgatttaacatgtttagagaaatcttgaactaattcacaaaggcttgttcatgaaatgctgttgatcggtgttgtcaccaaatgttctaaggtctacattctgggtgggccagactgcatcagggactgctgtgcactgatgtgtttgtctgtgatgatgtgggcattgttatttttactgggtttgttgtgagtaaagcttttggaaattatgttttcccacaagttccgcaaatgttttcacattttagaaattgtttgagcatgctgtaagccataactttgaaagtcaagcagtttggctggtgatattatttttaaagaaacaaaagtcttgttttgttttcaattttggcttttgttatgctttgcaatccttttttgctctcatggccttaacttactttgtcttgtacatggttttgcataatactcatggagatatttcatatacatttttgtgtggatatgattgcaataaattttttactggtaatacttcacattctaaagctcttttacatatatttcatttaatgctcacaaaccccctaaacaataggattataatcacagtttaatgatagagaaaaccaagttccagaagagtttaagtgagtttctgttcagcacttttattttgtcatgaattaacataaacattttattcatgtgatcagcaattctacaaagacaacaaagagtgagaatgtaatctccaagggaagcagagtgtgtattagcatagctgtagggcaggggaacttggggatgaatggatacagacctcagcaattgtcctaagtctggtcttctttcaggtttgttaattcaccacattctcatgtaatggaaagagtaaacattctctatatgctagcattattttacaaaatgaacaccagtgaaccagacatgaaagcagcattttcccagtgctttctcaccttccaggaaacctccttcactgttgctgtcagcctctggtggattatcagcaccatgaacactatagtccatattttctgcatcaccaaccaggacaccatgagtaccatgtgttggtttacacacaatctctatcgtacttgcactaaattcgtatctggggtgaagaggaagtgcatcactatctcaaatgtcaacactgaattttgaattttagtggatgctgtttctcccaggagctagaatattgcgtttgatagccagctctgaataggtccctccttgacaattgccatcccttatgttggactcagtctgatttcttgaacctttgcttgttatctgctgttggtacctgaactgcttctatggaggccagttaaccccctttggcccttccaccgacagtgcacctgagttatgactaagccattctgcgctggcaaggattcagttgggaaaacataaaacctttagatatttcaagaagaaagatttattacaggagtgagaggctttctaaagaattgaaaaggacttcaactagcattcaagaaattaggaagataataacagcaggcaggcaccattgatggtctcagatacctactgtacctggaagcatctagcaacacctcccatgggccactggcccaaggctgttcatctgcctgccatcaccatattggactttggcttctcttaggccttgtgaatatatctcatttgtgtgagctcaccctgaactgtatcgcaaggtgtctggaaaatgtaattaccaaacttctagctgctgggatccagagaagaacataaaggaatgaatatagttctgagtagcctactggtagttcaggccatattgtgtttctaggattttctgaaactgatctgtgagcctggggtgcccaaagaagaggatgttgttcctccaaaactgaaggtgctgagaaaaacatttctgatctggggcagggcaatagaatcagggagaaatagcaactggagatgtgatgaccctcaaaattaagattcagtgatagttgttgatgtgaaataggaaaagactagtacctatgcttcacacagagctaccaggaaaattgggcaactccctaaccgtatccttactatacatagtagagtagtactctgagatttccctactttctggtaaaatatgttgtgcactttaatcagctggctgagtgtcttctctactcctgtatgccaaggtcagagtctttggataagttttctccttcagagacaaaccttggaaaaagtctccaggaggcaatgagatttgtccaggaggttatccttgcataggaggtgctccatccagccagtcctgtagggcatgagacctggccaggagtagtagaacaacttttgggattgtttttagtggcatattctacttgtcatgtgattcataacatttgcttccagaagcctgtgcttttggcctagatacaagactgaaaggctgaggcatccatgaaattgacctaatgctgtataaaaatgttactacatgttacaagtcataaagtctggtttattcctcgtagaatgctagcaatcagttttcttttcatcatgatgtgaaatagtctttttatattcataattaggttttgttaagaaattttactgtgttcagatgaattaatattaaatatcaaataatgatatattttttccttcaagaatatattataaaaccagaactctattaaaaaaaaaagttctgttggataagtcaaataaaaagtactatacctaagcacttatgggcccttaatttaagcaaactgaggtactaactttgagtttccttaataccttattaatacttttaatctttttttaaggaaatttgtatggaagttgtaatcaatagtgttctgaaggttttaaaaaattctagttggaaaaatacttcacagagactatacctaatactgaaattttgtttcttttataatgattaacatgcaaagagaaaggcataataagctccagttaattaattggaagttgaattatttaacctgtatatattggaaatcttcctagttgcactgaacactgatttatctattcttgctatctatcattttattgtttttcattggaataaaagcactttttagaccttatgtgaatttttttgttgacaatgataagctaacatgtcaacaaaatgttttataaatgagtagttttagaggctgcctctctttgtgacctttaacacacaatgctttagatctctagactaaaaaaagtgacaagtcaaaactaagaatactcggagacatgttactgaaaataaggcctgcaagaaattattttaagttaaccaacagtaacttatcaaagagtattatgtttcacattgcaggcgaaactaagaataccagcatttgttatggtgaagtttaacttcaaagtgaagtttaacttcactttgattttaagtataaacataagtgtgaatttctgccagttccttctagacttaggttatgatgtgaaattaggaacttgattgtagctgcaatcaagttcttaattgttatgaatgatgaatgtttgcaaagtttccaatctttgcagagatgtgctattctggcttacaggagtatctttctaattagtaggtggatatgtacttatatgcatgtgcacgcatatgagagagaaatacttttctcagttaatgtgcttctgattatatacatcttgtgagatttcatacaattgaaaattagctagaaagaacaataatactgagttttcttcataacacatttccataatgcctgttccattacttttgttatttacatatttgaacttattattattaaattggattatcttatgatttttttaataagtggatattccaactcttggctcacaaaattacagttggtaaataatttcttcaaggaattttaatattgataaattacttatttcaaatgaattcacttaatatcatttttattttcttatgaattttctaataaaaacatatttttcatttcttcctctcttttttcaactcaatgtcttttttaaaaatgacagtaatgtgtggttataattatgcattttttccaggtgctcaatggcccttatgtctcttttaaaaaaacttttatttattgtgggttttctccccaaagcagaagttagtccaatacacatggcatagaaatttcacaattaggcaattaaactagaagtataacagctgacatgtgttcaaagtaataaagttccaaaattagaaggtgaatcaaattaacataaaggcattattaactttttctaggaggcgtgagtttgcaaaagtcttgggtaatttgatttgcttattctcaaaatagccactgaaccttgagtgacattgcgtttcaaaggtgggagccagagggaaggtcactgttagtgttggagtggcaaagaggaggtttaactttcaaatcatctagggtaatgcctgctactctattttgagacttttagctagatggcaagaagtttttttttttttgatgggaatcagaaagttaaataattcctgaatttggaacttcaggtggtttttaaaccttctccttgttttatagtttcctctgttgtttataccttcctaacattcaaatgataaagttattttcatttttaaaagaaacaaatccaaataataatcccattatgtgggattgttgactctaagcattgtgttttcttaatataccaattacatgctaatgggctttttaaaaatctatacaggaacattttaagattgaatgaatgagcatgccatttccattacaagctgctagactgcagtttcacagactactgatgtggatctgagggcagttcctcaaattaatatggtagatccacagttttgaaaggcaattttcattttatataacttctggcatgttcttaaaaagaattacacacacaccttttaagtggttcccccagtgtggctgctattcattttgttgtcatccttggtattcaggtctggcctagtcccttcataatgtattacccctgtcgcttttgctttcttgcccttcctatgagctcctgctctcttttctggtgcttaggtggggcagcacttttcttgttgcatatggatagagtcagccctgcctctggcccctcccaaaggacatgctgtatcacctgccccagcagcttctgtggtaggcccacagtgcttccattttgtgattgttgccactggcctccgtctgaatttgtttcactgccctagccatgtgtggacatccagatgttgcatccttggtgttcatgtggaacaaccaatgcttcctgataccaaggaagccagggctttctgcagcttcccttctttgacatgaaaaacagaggtggatagggaaacttgaaatcactagtccatttttgtccagagctggcagaaaatttgggttggccagatataactttatttcctttggggtcatagccaaacttgattttctttaatacatcaattttcaaaacatgttattttatttttatatacttattaatgttgaatagttcatgtatacatacagataaaaaattcaaatggtcttaaacaatatgtgcttttattaaaggtctcattctcatctctagtcctgagtctaccattttacttacccagagacaagtgatagcaatgtcttgcatacatttccattcttcctgcgttattgtatgcatttataagcatgcacgtttctgaatctatatgtataccacttttgtacaaattatactgcataatttgtatacaatttcttatacttaacataccttggagatagttttatatctctgggtgtacatatgcttcctttgttttagcttttgtttttaagggttttatagtgttccattatatggagattaattataaaatagtgatcccttaatttgtttaacctgtcctctactgatggctatttctgttgcttaggatcctttactttggatcaagggctggcaaacatcttctgtaagggataaatagtgaatattttagactttgcaggccttgtggtctctgttgaaactgcttcactctgtattacaataacagccataaactatacgtagctatgttccaattaaactttgtttataaaaacaggctgcagtccaggtgtggcccctgccctagatgttcagttttgagagactgtcatgcaaaaagtgtttgtgactggcctgcagaaagtgcttaacagatagctgttatttgattgatgggtaatttgtctggaaatttgtcattagaataaggagaatgctaaacagtaaaagatttgaaaaatacatttgtatcaaaaaagaggtatggaaaatagaaaatgcatgactttaggagcatttgactttctggtgtttaaaaaattgtttaagatgacgctttgacttcttttcaaagtgtagtaagcaggaataagaaaattggaggaaggattatctacctctttgtagcactaccaacctttgaaattttgcttcctgctccagtctgactagtaaactcagattcacccacaaaactgggtatggtaacatagctcatggttattaaagccgtttggttttgcatgatgagtgtattttgttgaaaatgtgtgtcaaccttatgatgtccacatacaaatgtcctacataggcttttccctccttctggggttctagagaacacatgaaagtacttctcctttcattaaacactaaacttgatgcttttaaattctttgacgttctgtattagagatgagtaaactaaggcctgcaggccaaattcaacctgctgcttatttttggaaataaggttttattggaacacagtcatatgcatttgtttacacattacctgtggcttccttcatgttacaacagacaacttgggtaactgaaatagagaatatagaactcatgataatgaacatttactgaccctttatggaaaaaaatcttttcaacccgtctttttgattgcactatttttccctcaactttgagaatcgggtgctctcttctctgaagttgtagggaatctattattatttttttagcatggagaacttgcaatcagcatgtttcttagcttttaaagaacaggcatggttgttcggttgatttatcttttcaatatagtgaattcctactttattattattattattattattattattattattttgagaccgagtctcactctgtcgcccaggctggagtgcagtggcgcgatctcggctcactgcaagctccgcctcctgggttcacaccattctcctgcctcagcctcccgagtagctgggattacaggcacccaccaccatgcctggctactttttttgtatttttagtagagatggggtttcaccgtgttagccgggatggtcttgatctcctgacctcgtgatccaccctcctcggcctcccaaagtgctgggattacaggcgtgagccaccgcgcccggccctcctactttatttgttgaacagacagttattaaactgcctcttaaatagttattaaacctgttatgttcaagcctgggaatacaaaggcaaattatattgatttcctgtttgggaaaaaacttgggggccaatgattgacatagataaataaatcagtgattataagggtaacagagatatgaaggaactgttatgggaggaggaaccctccatattatcccggaggacaacaaaggcttgctggtgcagaaaggtgacattttgaaggataacaaggaattggacaaacaaggaagaacacattccaggcaggcagaaggtacactaagcatgtacaaagatgctgagatcttaaacagctttaaacagcttgaggtagtggaagaagcagtgacagtaaaaaaatgggcctcatcatgaaagaccaagtgcatcgatgatgtaagaggtgaaagtggcattgcttctcccttccataccaccacccagccaccagggggccatgacctagagattgctggaacatgaaggactctgatgttctggaggaggtgttgccatctctgatccctttaaaggaaggactaataaagatctgtcgctatagctgaaaaatagctgtggacagggcagacaagtggacaagcagaagcggaacaaaagttcccgataaattcccaaagcagttaactgtagtagagggaatttacgtgacttaactgtagaattctccataaggggagctgcttcatgcaactgcgtaaaatttgtccttttttttttttttttttttttttttttttttttgagatggaatcttgctcttgtcgcccaggctggagtgccttggcatgatctcggctcactgcgaactccgcctcccggattcaagagattctcctgcctcagcctctcaagtatctgagattacaagcgtccaccactactcccagctaatttttgtatttttagtagagacagggtttcaccatgttggccaggctggtctcgaactcctgacctcgtgatccgcccacctcggcctcccaaagtgctgggattacaggcatgagccaccacacctggcaaaatttctcctttttaaactgtacctacagctctttatcttagtgcaactaaagttgataaagtcttcatgatcctttgcagcctagttcaagttaaaaccaagagagaagaaaacaaaagcaaattaagcccattcctttgccaagaagaagtgttacttgatttttatttgcatcctcaatgttccttggaaaataacatgatgtttggcgatgttcaaatgcctgttgacaatcctccgacatcattttctgtttccattgcctcactcagcacaagggctctcataagctttccagtcaacgatgaagcccagatgttatggataagccacagacttttgggggaaactaagcaaacaccaataataaataatgccttgaggacatactacagctcctctctaagtatcgtgatggtcaggcttcatcatttcccaagcagattgcttggattttaattttggcagcaaataacatggagcgtgtgggtttgtaaatggtagctctgtcccaataattccagatgatggggccattccagctttctttaacttagagatttgagcatgcattgtggtaggtctactcaccgtatctgtctagaatgattcagagaggccactcctgggctgagttacttctcatacatatatataattggaggccacattagcctgcagtataactttggaattaagatttgctcaaaaccaaggctgagtttgattaataggttgtaagttagaaacttcctttcttgtgttctgatcccaaattcctactttatattgtggcacctataaaattgtcctagctaaggatgacttgatggtacctaacgtgagactggtttatggatgaagttctttgtgcttacagggttttttcctgataattaacactgggatgaatcgcaagacccatctttgcaaaaggcagtttcttttcttatttttagaggattgttcctgaaatgattttgttcatgttttggctcctgtaatatctctattcatttttttcatggaattttttctttgggtctttttcttcataattttttttttttgcctttcagaaaacacaacacaaaacaaaaaaaaagaaacaaatggttaaaattcaagggattgttgtagctctgagggtaaaacgtgcagcctgttggtgtcatttgttactcatacaaactcttagtattttatttctgttgcagcattggggttgctatctttctcatcatgagtaatctagcattcatgctgcattctattcatagctgtcatactgtctctgacagggtgttttcaaaactttgatctgcttccagaaaagacttttacatgggtgataggatttatggaggaaattttcaactgaataccaggtattaccttcttggaaagagcaaagcatcaaacgtgaatatctcctttttcttcttcctctcctcttcttcctcttcattttaattttatcgaagctcagtttttagtaactttatgtttcctttttattactgtatctttgtactcttcaatagcagtgtccaaggggtagaaatttgattgttgtggtaggggaagaagcaggaaaaactacatatttcaacaaaggtttgtctgactctgagcaagttattggggtacagacatggataagacatagtctctgtccttggaaatttcagaacctagtagggagacagttacataaacagaaaatataacataggaaggaatgaacaggatattctagaaataccaaaggctctgaaagtagggtgatttctacttttaaagaggtaatttaggttctgaaattaaattcctgaaaataagggccaccctagaaccttaccataacaaaattagctacagttagttatgctaatagtaacctctttcctgtctcgaggaactccttttctttattccacaaagagcctcaccttcatggaagatccaaaacaagaaactgtaagtctggttttgactgttggtcttttaaagaaactctgtaatcggcaaagaatgggtccattgcaggaagttgtccaactggatgttaactagtcagatagcagccttgctggggtatagcacaagttggccaattcgcactggcacatagcctggcctcttgggtcttccttgtaactcaaatcactttgcaagccctggtagtttcacgaaagtcagatgtacccttaactcttaccccatacactcatctatcctggaaagaaaaagttgttggatcttggcccactactcaggaaagtgtattgaccacaggttgtatagttaagtaacagcattttgaggaggatgataatgatagtgatgatggtgatgatgatgataacaacattgatggtgctgctgttgctggtgtgcttaatgataaggatatgtgattataatagggtaggaactatatcttatccttttatacctagtatttggcgcagagtagggatttcagaaagtttgtttgttgtggatggagtgagcagttagagtttcccacttaaaacctgacacagagcatgccatcccacttactcaacaccctccagtgaacttccgtttcatcagcatcaccctgtgttgacctatgtattctggctctcctctgatgttactctggtctcatctcttatcactccccagagactggcttctttgtttttcttcaaacacatgcacgttcccatgtggaggtctctgcgtacgctcttccctctgcctggaatgctttcccccaaatatcactgtggctcatttttgttgttgttgtttttgagatggagtcttgctctgttgcccaggctggagtgcagtggcatgatcttggctcactgcaacctccacctcccaggttcaagagattctcccacctcagcctccccagtagctgggggcccaccaccactcctggctaatttttttgtatttttagtagaaacggggtttcaccatattggccggctggtctcaaactcctgaattcaagtgatctgcccaccttggcctctcaaagtgctgggattacaggtgtgagccacgacgccctgtcccaatgtggctcactttttagctttctcagttctctgcttaaatgtccgcttctcagagaggcctcccctgaccactgtgcacccctctctccctcccatgtccctttatccagctttatttttctttgcaatatttacgtattaagcattatttgtgtatttgtggcctatctctgctcactccatctcgactgaatctaagctacatgaggactacctcctttgttttcatcataggcatttccctagaacctagaacagtgcatggcatataggcatacctctgtaaatattgttgaattaatttgaaatgagttaatgaattgcttataccatcagaagacacatttcatgaactggcatgtatttcaggtatctttctaggtttgtctttcttatcaccctcttggttgtgtgagccccttcagaacagagatcctatcagatgtgttttgttgtcccaaaaggagcccagcacaaccccattcacacagtagttgttcagtaaatgcttattcattggtagattgtctcaaaggttcccacttaggagtattgcttttcttttttgctctgcttcaccacatttttcagtcactctgttttccttcctgcgttttgacactttatcaaactgtactttttcactgtagacatctatggggggagagattatacaagagtatttttatttccactctcaaatacatgtggtggattcaggtttaattttgtattattcataccactgcaccaaagaccaactaccaagaaaactgtaaaaaccagagaatatattttctattcttgatgaaataaaggttctgtatgagaaaccaaatttctaacttcaaaagatttaataggttgattcttttttaaaattgacacataatatttgttcatatttaggaggtacatgtcatattttgttacatgcatagagtgagcaatgatttagtcagggtatttagggtatccatcacctcgagcatttatgatctctatgtgttgggaatatttcaaatcttttcttctagcagttttgaaatatacaatacattgtggttaactatggtcaccgtactctgctatcgaaccttagaacttattctctctatctaactgtatgtttgcacacatgaaccaacctctcttcatctcacctccacccacacttcctaggctctggttactattattctactctctgcctccataaaatacactttctaagctcccacatgtgagtgagaacatgtggtatttctctttccgtgcgtggcatatttcacttaacactatgacctccagttatatccatgttactgcaaatgatgggatttcattctttttttatggtggaatggtattccattgtgtatattatacagcacattttctttatccattcattgaacaggatgattcttaaaagcaacttccagctgattacatttaggcaaatacatttaaacatttgctgtggtttttagcatgttagtagcttttgaatatagtacattctgcctactcaatgcccttgaaatgtctttctgaaatagttaaattcatgttggtattcacactggactctgtatcactgcctcccttacccaaaggagtttgactagttacttgctagttgaaaccagcttggtacaagctgacacatttttcaagaaatagttgtgtaatacatgttgatattctttgttcttcctttccttattcatccatttggctcctttcttctttccctgactctattccttcccccttgactttttggaagccattatcgctttagtaaacttaatggtgaattgcttcaagagtaaaaatgctctgcttttcaaattagaaaaggactatttcctgtattcttggggatctcattctctcatagctcttatttaaaacgttctggccaggtgcaagcactcatgcctgtaatcccagcaatttgggaggccgaggcaggcagattgcttgagtccagaagttcgagaaaagcctgggcaacatggtgagacctcctgtctaaaaaaaaatacaaaaattagctgggcatggtggcgcacgcctgtagttccagctgctcaggaggctgaggtcagaggatcgcttgagcccaggaggttgaggctacagtgagacatgattgcagcactgcattccagcctgggtgatagagtgacaccctgtctcaaaaaaaaaaaaaaaatgttctaagcaacgattttgtttatttgttcaagattggattttctacacatttaagcctgatttatcacaaataaagcactttctcacaaaatatattctcagctaattattattttcattagtagcactgtcctaactttataacacataaagttcccctggtcttgtttttaacgtcttgacatatgtatacatttttgaatgactaaatcaagctaattaacatatgcattacctcacatacttatcttgttttgtggtaagaacacttaatatctactctcttagctattttcaagtgtacaatacactgttattaactgtggtcaccatgttgtaccatagagctcttgaacttattcctcctaactgaaattttgtatcctttgaccaacatcttccaatcctccctctccatctccagcccctatcaaccaccattctactctctgcttctatgagtttgccttttttagatttcacatataaattgatatcatatggcatttgtcgttctgtgcctggtttgtttcactaaacataatgaattccaggttcatctgtgttgttgcaaatggtaggatttctttcttttttaaggctgaacagtatgccattgtgtgtgtgtgtgtgtgtgtgtctatatatatatatatatatatatatatatatatatatatatatatggcacattttctttatcagttcatccactgatggaactttaggttgattccatatcttggctctcgtgaatactaccacagtgaacatgggagtgcagatatttgacatgctgatttcatttcctttggatatatactcagtagtgggattgctggattatatggtagttctatttctaatttattgaggaacttccatactgttttccatattggctgttcaaagttacattctcaccaatagtgtaccaggcttcctttgtctccacatcctctccagcacttcttatgtttcatatttttgataaccattctaacaggtgtgaggtgatgtctcattgtagttttgatttgcatttctctgatgactagttatattgagtatgtttttcatatattgaaaaaaatattgaccatttgatgttttcttttgagaaatgccaattcaggtattttgcccatgttttaaatgggttgtttattttcttactattgagttgttttagttccttataccttttctaggtttttgtttcatctatgctgtcttctcgtacagctcattgtatttgtttgctaaggctgctgtaatgaagcagcacaaactgagtggcttaaacaaatgtattgatccacagttctggaggttagaagtcttagatcaaggtgtcagcaaggttggttccttctgaaggctgtgggggagaatctattctaagtctctctcctagttttaatggtttgctggcaatctttggcatcatttagcttgtagatgcatcaccctaatctctaccttcatcttcacatggcattctttctatgtgtgtatctctctgtctgtccaaacttccctatttcacaaggacaccagacatattggattaggacccactctaatgacatcattttaacttgattacttctgtttattccctatctccacataaggtcacatttcaaagtagtgggggtaaggactccaacatatcttttttttggagacacaattcatcccataacactcatcttctgaaatgtcaaactctggagttagtaaaaccaacaaaagtgttcattgcagcattattaacatgggttaataatgggttctctggtttatcaaatgtttaactttgactctttagatatagtaaaactttaactgagtagggtgagaggttctaacagatggaattttctaatttgctggcaattagcctgtagatgactatgcgagatgtcagctctggttccttcagtagaatatacataatagaaattttgatgattaacaatccttctatttagtattcatcctaacctcagactcttcatttcatttcatgagcctgcctacccattatggcaaagtgaagacactgtgatgttgtccatgacatttatgttgttcccaagtcacccttgtgttgtccatgacttttatctcactcctttcttccttgttctaaccactcctccagttcccgaatcttgcttctctcccctacttttgtacatttgtatttgttctgtagatttttttactcaatgccccctaaagaatttatcttagatatgctctactggctgttcctgattcaaatcaaactgatgaatgggccatcctaactagtccttttgacatcagtcaccacaccaatgagtccactcaccagcacacaaactgggcccccttagtttatccacaaagtggagaatttgacaagataatatactgtcctctcatgatatgtattgtgagatgccctcttaagagactttccaagtggctagtctctacctcatctgattacattaacatgcagttattccaatgatcttcctaatgtgtaattctgaaaagcaacttgcattcaaaatccatcaaggcccctccctccattgcccattcaatgaatgcattcttcagactgacatcttaccttcacatacctacctactagagctccaaacaagtagttctcagccttggttgacattgaattacctcaggagatttagaaactaaagatgcctgagccacacccaagataatctaatttaattggtctggagtgtggtctatgcatcaggatttttaaaagttccaatattcagtcagggttgagaactacttgtttagagcaacatgtctccaatcttaatgtgtgcagtaattgtcttattcaaatacacattcttattcagcaggtctggggccagccaaggttcctgtattttttataaccagtgatttttttggtccacactttgcataacagggtgataaacggagctctgtcaggtccgggaccacatttttctcatctttctgtctctaaagtatagtgtagaagctcttagcaaatgtttgaaatcaaattaaattacagcctttccccaactttccaacctttttctctgcatattgaagtccatataagcataggcttatctctttttgaagcctatccctagccacaaccagaaggccaatgttttttactcattcattcaaccaacattttctaagtgccctttatggcctgttaccaagcattctgtagataataaaatgtaatttccacctcaaatttgcatgccctaacaggggattatcctcttggtgtgtgcttcacagattaccagtgctacacaaccaggtgttttgttttaatatgctttaccttcgtaaaatacaaagttcaacacttgggtgtctctgcaatgtcaagttgctataaacgtttctaaacagtgctctcaaattctctccttgtaaaatggcagtaagtaattttcagatcatgttggttcatggactacactttgagtactgctttttcagggcctttccagacaaagtggagtctgtagaccagcagcatcagcatccttgaaagcttctgagaaatgcagaagcttggatctcatcacaggcctactgaatcagaatctgcatttctaggtgatttgtgtgcacattacagactgagaagcacagctccagggcagtggctctaaaccttggctgcatattagattcacccctggggcttctaaaaattctgctttccttcttttgagaattgtctattcagatcctatttgtttttgttgttgttgagttgagctctttttatatcgtggatgttagtccttcattggatgaatagtttgcaagtattttatcccattctacaggttgtctcttcactctgttgattgtttcccttgctgtgaagaggctttttagtttattatagttcccttagcctgtttttgtttctgttgcctctgtttttgatgtcttagccatacaatttttatggaattacttaaggctaatagaattagctgaaagtagtttccaaatgtgcatctctaccccttgctttgcaaccttctgaaaaccagacaatactctgatgtaatttgggaaagaagatatattagtttaggcctaacgtcttaatgtcctgaagaacttccctgtgttttcttctagtagttttatggttttggatcttatgtttaactattcaatgcattttgagtttatttttgtatatggtgataaataggggtctagttttattcttctacatatatagtacatatacacaataaaatgcttttcagccggctgggcacagtggctcatgcccgtaattccagcactttgggaggctgaggcaggtggatcacctgaggtcaggagtttgagaccagcctggtcaacatggtgaaaccccgtctccactaaaaatacaaaaattagctgggtgtggtggtgcatgcctgtaatcccagctactcgggaggctgaggcaggagaatcacttgaacccgggaggcagaggttgcagtgagctgagatcacgtcgctgcactacagcctagagtgagactctatctcaataaaaaaaaaaaagaaatacttttcagccataagaaagtgaaattctgtctttcttggcaatacggatgagcctggctgacattatgttaagcaagataagtcagacacaacaagataaatactggatgttctcactcagatgtggcagctaaaaaaattttgagccaaaggaagtaaagagtagaattgtgggtattagaggtagagaaggtcagaagggaggggaggatggggagagactggttaatgaatacaaacttacatctagataggaggaattagttctggtgttctagcactgtagggtgaatatggttgactataacttattgtatatgtcaaaaaactaggagagaggattttgaatgttcacaacacaaacgataaatgtttgaggcaggagatatgctaattaccttgatttgatcattacacattgtatatattataaaaatactctgtatcccataaatatgtagaattgttacatgtcaactaaacacaaaaggaaaaataattctgctgcacaagctatgtcccaatgaattaaactaaaaatctctgggggtggtccccagtcatcagtatttttttttttacagctctccaggtgactctagcatgcagcccagagtgggaaccagcactaagtcagcccagtgtccatagagtcccagaaagtggccagccattgctctaaccttcaaatcagctcaggttctcagatactcatttattactccattcccttcacttaggaaactcaggaccacagctaaggtattccttagggggtatttaaagaggactgcttagatcagtggttcctcaccttttgttccacagcagttcctgaaattggatgggtgcatctttaaagtgcagttgcagggcctgtgccttttttattgaggtggagcaattattgtgaccctgttctgctcagtaagacataaagaaaatatgctgggtggctttctccctgagagaggagcacagaaatagaaatattattagaaacagaattagaaatagatagaggtccacttcatgactgctcaactggactttttagggtctcaatttctacttgtgtaagctcagattgctcagtgggccaattagtgaatcccagagaagggactagagaacagacctcgtttggaaatactctattatcgtatttcaaatgtgggccatggactagcaacatcagcaccatctaggagataattagaaatgcagaatctcaggccccaaccagatctgtgaaatcaacaatgttcccaagtgatcgctatgcacattcaaatttaagaagtggtggtctctaagaggcagaatatattttttctcaaactacttttcagttcccctgttttccttctgctgtcatggaagatgagcttgccacaaagggaagctatgaagaatctagcacattcttcccttggaaattcaaacacccatttccacactgcagtggaagtgttgtgacatgttctattggaaaaccactacctacatgccatcatatggagccataaactatttttaggttttctggacaggccaaagattctgctgcccaaatgattccaaagaacgtgaggctgatgtgtctcagattttcttgtaattcttgcatttctaaaaatatcttgggtgtttgatgttgagttcagccctgttttactaacaagcgaagcctttgtatttactgtctcatttggtaggttattttctccctttttatttccagtgacatgtcatgtttcctgatactgatttatcagagaagtagaacaagaaattgattcaacatgcataatattttattgaatgaccatctccatgtaaaatttttcttggagtttgaagtggggaagaatgttggatatagacctggaaaagagaaggtatggtggaagttcaagtttcctcatttttgttagaggagtttgaaagctgccagcaagtgtttaacaaataagaaggcagccacctgagatagtctattgagataggaagagtgattgtagaagacaaacagcaacccatggtccttcaaagaaaaaaaatggcatgggcaggaattacttaagtctaatagaattagctgaaagtagtttccaaatgtacatctttaccccttgctttgcaaccttctgaaaaccagagaacactctgatggaatttgggaaagaagatatgtgagtttaggcttaatactttcctagtctttattattatattttacaggaatttcataatatatattttaaagattcttactaccatgattaaattctgcccagtatgatgatcaaaaagggcttactgaatggagaaagacatttgtgtaacacctagcagtcatttattgcaaagccaataagcgccaggcattagggatataggtataaataatgtcccagcataaaaggcaaatatatatttatttgccaaatatatatatatatatgttttactttatacatatttttcaggagttcacagaaaacaatgaaataacccttaaatcatagttcatttcttaattttcccagtaggagaaggctcatttttcatgtttttctttattattttgaaggcaggacttcaaaaaggaataaaaacagaaggtcaattgcagggcaaatcacagcggctccgttcttgcatatccagatgggcatcaccctcgtttaccttcctaaattgggaagctttacatcctttcacaaaaacatgatccataattattttgttgcagttcacttttttaaactggtagaaagcatgctgttaatgtgatagtaagtacttactctgtgaataataaaattattaacatttcaagcctgcattttggggagttaccttgagcccacattgtgccactcttaaacacatcagtgcatgcagtctttggggcagctccctgaactaactctcttgttgtcattttagagatgttgagattaaggtttagggtatagttttctccaaatctcagctataaataaaggatagagtgaggatgtctgcctgacttctatgcttaagcttctaaatgttgccttgcatgctgtctgttttgtgatctgagagtcatagtttatctgctattttgaagcacaaattattttttttaagaaagcctgatagctttatctgagaggattagctcctactatgcaaaaccttgaagggaataaattatgggaataaactagacagctacctgaatgtttgtattttagatttcaaggttattgaaagtactagagatatacctcagtctaatgtttgcaaataagaagcacaatatctccttgaagtcaagatttttgaaaggcgttattacttggtaaattaaacattagcttgccaaatagattttttcttattctggagaattacataatagaatcatgggtattttgtacttgccaagaatcacttcttgtaccatgtagaacactcctgactccctgcccctcatcattgtatagctgaaaaaatcagagaaggaaaggcacatgccccaggtcacacaacttgctggtgtctgaaatgagtgaaacctgagaggttgtctagtccacactgcaatggatctccagctgaacgttaaacataattatgaactatctacatattttttgtaggaagtttcagagtgatgagatcatttcttcaaaggttttgtttgtttgtttgagataatgttttaatttctgacaaatagcgttggccctattagaagacttgcgttatgtaagtctagcataaaatatttatcatatccttcatttgctaaaatgtttgatcttcttaccactgcatcaaaacaggctgggttctgaaaggctgatggagagtcaatttattcgcaagaaagaaatcacacgattcaagtgacccaagatgtcagtgtgaaattaaattccaccagagaactgatgatactgagattgacccttgcttgaaacaaataagatgaaccatgaagtgaacctcattccaaacatggcatcaacaaacataaatgaagacctaaaaagtgacttgttttgggtgccagatttttcaacctcaaaactgaagtggttgtgaagccaatttcaaaatgacaggcataacccaacctttagggtttattggaaacttgattatgttcttaaggcctctcagatttttggcatggtttaaacatttgcctctctgtcctacatatgataaatctgtggcttttggctaaagtctggcctgtggaactttacccatgtgtgaatctcaagctttcaaacatgttgcattcttctaaataaacattgggccactaggcatctgctgttaatgtagatcctgtagtcatgcattgttttttatcatttcattcattatttctcttcatcttttactgagcattatccattacatgggcaacatacctttcacatgttctgtgtttcgctttccgtgtgtcatgattatcccaaatgcctaaaaacaattgaaccagcctagatataagaaagggggccatagggagccttaagagtgaagataccttctaaataatcaaaagttgaattacacttgatatggctttagcattaagtcaatttccttgtacacttgttcttacaaaattgggtaatcaatctataacaagtatctgttcttaatgccttgctgtgttactcagagaatcttgactttaacagaatattttaaaaattcagcaaattaacaaaataagcactagaatgtaaaactctttctgtccctctttctacacacacatacatacacatttgcagttgtttacaaggtgtctgggctatgcacatcgcatgctgtttaggagtataggctttagagtcagacagtctcgggtccaaactcagctttgtctagtggcaatgtcacttgttgccactggcaggttcccatcctcatgaaagcaaccaagaggggaggataatacttaccttttggagtttttatggtctcagtgagctaatttcagcaaaatacctttgcattgtctaaactggggtctctcaacttcagcactattgacattaggaactggataattctttgtggtggtggtggtggctgttgcatgcattgaagatgtttagcagcatccatggcctccaaccactagatgccagtagcatgctcctcccctctgaattgtgacaactaaaaatgtcccatgacattgccgaatgtcccctgttgggcaaaattgcccctggttgagaactattgttctaaaattatacaaaataacctctttttgctaaagcaaaataattgttagacattctaagactcagaagagaaggaaacttgaaatgaatcaagccactaaggacatttgaactgagaggttacatagaacagaagctctaaggggaccccaagcatccccatctaaatttccttctctcctaaagttccattggtatctgcaataaatcaacattttttgtaaaatccacttgctccatttctcaaatcattgcttcatctctcatttgtgaagctattgtgtttgattactcccaaatacaattttttttcctacccaaaggagacccttcccactctgcatcctaaagtgtctgggtgtcgactcatggtcagtaaggtggttgctatgtagattaatgtgcgctagctgatattttggtttgctctcctggcctattttgtcaagcttggagggttttctaactttgcaacttggactcacagactcctagcctcaaagaaatattttcacaccagccttaagttcacatccaagatgtgacagattgtgtgttcttggggtggaagtgagagggaaggggaataaataaacccatttttaggaagtatagtcagcacttacgcccttccatcatgcctttctgaaggcattgcctcaaacccagacttgaagttgagcatactgcttaaattaggggattggggcaggggcatgggcatgatctacccataaaccatagatggtttcttccacccccgcattctccctcttctgactctattgaccactccctctccccaccaattctctctttttattttcttggcaccagaaaatcttttttttttctttttatcgaggtggtgtctcactttgtcacccaggctggagtgcagtggcgcgatctcggctcactgccaacctctgccacccgagttcaagcaattctcctgcctcagcctccggagtagctgggattacaggcacccaccaccacacctggctaattgttttgaattttttgtagagatggggtttcaccatgttggtcaggctgttttcaaacccctgacctcaggtgatctgcccacctcagctggcctcccaaagtgctgggattacaggtgtgagccactgcacccagctggaaatcttaagatttaattgtcttccagtgaatgagctgagagaaataggatttatttaaccagagttgtcttctcctcttgggagtgagaaaaaaaaaaaaaaaaagtagggctttgcctaaccattatttacagctgtagaaaaccaaatgcacagtctaaatctaagtaaggaaaaacacaaacacaaccttagaagatagaaatcattcacaaaaagctctgcatttgtatttcagtatgtgatgttatatgctttcagtccagttcaactgacattttgaaaccaaacgcttatacagtgtttgcagtgattttaaaaatattaatcaatgttatcctcatatcaatcctatgtagttgttattattactattatccccatttcacagataaggaaattgaggcatagataagtaacttgcctaaggtatgcagctagtagtggtggctctaggatttcacatttattgagcaatcagtaaatgtgctcagtcttgggcaacaaagacaagtaagaagccaagcagttttgtggggaagacctctgaatggttaatcctgtgatggagtggtgagtgctatgttaactgctggattaattaagcctttttaatttctatatttctgatcatttgatatccagagccttgctgatcctgaagggactgcccctcccctgggagagctagctaattcctagggatggtaaacaactcacttggaattatacctttcctatgtggaccaaccaatccagagcccataccccaaccacctcatttattgggctctcacagggctctcaaacccttgccctaatcaccccaggccaggtaccagacactagagatggaccctacaccccagagtccacttaaattattcaagctagccaatcctaagcctgctagccctgcctcacccattcctttccacacaaaccacaataaaggctcttgcccatgttttctccttgcttcctctttcccctgaccagccctggtgcttccccatgtggccctatgtggtgtggcatgcctctcctcttgggaactgtgtgtaacaagctgttttcccaaaggcaattgtctactgatctgttagccccactatacctgaataataacaaaacttacatttagaaacatttgcgtgcctgtggagccccatgcaggcactcaggagacaagtacagctggacgctgttttcaagctgctcacagctgtgctgtactgggccacaaaatgcaattcttctgccatggttggtgcacagcagctgtttggctccccactggcctggtctgtgtaagtgtaacagatgacttccatgccgttcttaaattacagcccagagaaatcagttggtttaaatagtctcacttatggactacttccaacgccctatgattgctttgtcccttctttatttgaaggttcaccatgttcttctttacagaagtacactatgttcttctatagaattttctgcatattctctcaagccttcttggtgccaataagccatcttcaacaatgaaagccactggtggctgctgggtaggagttggtcacctttggagatcccaaagagggatctaagactctctcaagctggggggacatcaaaatgaccagctatttggccaaggaaagacagttatctgtcctatgggtaattttgcttgtggaactctgctctctaccccaaaggtgaccatttgccatgattattgaaaagaggattccagatctgggcgaacaaatgaaatttgaggtttcttatagcatgggaccccctcctcctcctattagctgctctgtaaagctgaagtattgctcctcatggtaacttttcttatttaaaccttttcaatattgcacttgttgaggtttttttttttttttcttttcctttttttcttttttgacagagtcttgctctgtcacccaggctagagtgcagtggcgtgatctcggctcactgcaacctccaccttctgagttcaagtgattctcctgcctcagcctcctgagtagctgggattacaggtgcctgccaccatgcctggctaatttttgtatttttagtacagacggggtttcaccatcttggccaggctggtcttgaactcctgacctcatgatccgcctacctcggcctccctaagtgctgagattacaggcatgagccaccgtacccagcctgaggtttgttttgttttgttttgttttgtttcactttttgtccctggataaccaatgagattaggggcttattaatctcctctggctagttatctccattaagcttattgattttcattctaaataggttcaaaagagctgtttatagacttaactaaaggcttaatggctggcgatttggaggtctgtatcctttgccagagtgaggataaagtcacattcctttttctattcccaacccctcctaaaacagtgggaggccgtagttaggcactccactaacatttattgaatgtgggtattttctgatgttggatcgcttaggctagttcagaagtgggagctgtggtctgggtctctgtgaaacatctcctgagaggatgagaaaaagctgtttactctcgagtgtctgagtttatgcccatgtggatggttagcgggtctgtcattcagcagggtaggcaactctgcagaatgccatggaaattacctttcttgaaatccatggaacaattttaagttgaaatcacagtaatgaaacaaagctgttatggggatggtgtcaagaaagttcagtcatattccaaagtcctctcaatttgcatttgaagggtggtgcattaattgtctcaatggctcatttctcagacagttgaatgataaattgttagaactatagcagtggttctcaaccaagaaagatattgcattgtctggagacatttttgattgtcataacttggggaatgttactatagtaacacctagtgggtagaggccagggatgctgttgaacattttaaaaggcacacagtgggccaggcacagtggctcatgcctgtaatcccatcactttgggaggccgaggcgggtggattgcttgaggccaggagttccagaccagcctggccaatatggagaaacaccatctctactaaaaatacaaaaaaattagccacgcgtggtggcacacacctgtagtcccacctacttgggaggctgagacgtgagaatcccttgaacccaggaggcagaggttgcagtgaattgagatcacgccactgcagctgcactccagcctgggtgacagaacgataccctgtctcaaaaaaaaaaaaaaaaaccacacacacacacacacacagtggtccccacaataaaaagttttctggccccaaatgtcaatagtgccaaggttgagaaatcttgatctttattaatctaacatctggattagtttcaattaatctatgctgaaaaaataagtgttcagaatctaagaaatggagaaaatgattaattaaaaatgaagtaccttaatatttttaaaattagaagcatttagacattcagtatttggtttttattgtacacattataggagttaattctttattaaattgagaaaaaaattataaaaatattgagttcttcctgaaatctgcataaagaaaagagccattctgggtcttctctgtgagtaattgaatttttggggtacagcttgtgttagttactcttctcctaaagatacattttatagacaggtgctcagccataaagggccaggaaaatcaaagaaaatataatttaaggtcttaaagtccctttttattatcagatttcactgagtgtgggcacatgaaacatgagtccatgatcttctgatagtttcagatgtctcagattagaagatggaaatgactgattgtttttctcaaatgatctctaagatcaatgagccagtccaatgtacatattcaatatttaaaaagatcaaaagttgctgttatcatgatatagttgatttttgtttctcttgtttgtacactttgggccatagagaagctataagagacaactctgtatcttttagaaatgagcatatatttacaaggagaaaagcctttttatgtcacaaaggatactagtatatttatcaatttctaggcctttaaagtgatgtctttagtcctgcagttttcaaagtatggtctgaggaactattgggtttttttttttattcccaggagttccttgaggtcaaaattattttaataataatatgaagatattgtttgtgttttttaattctcattctctcaagagtgtgccataagagttttccagagaccacatggtgtgcaatgaatatcatgctgatagctaatagaatgtgttcttgtgttttaaaactttctcagttttaattcctaattcaataaatagcaatagataaaactcacataaacacaagcttttggaacttccaataatttatgagtgtaacggggtcctgagaccagaaagttatgagaactactgctttagtgattgacagagaaaatgaatcaagttgaacaaaagttcagaacttgggatatttcaaataccatggctaataacataagccagcatcatcttttattgctttgtagatattagagacacgaaaaacccttggattctgtgccagagcttaaaagaactagaagcaattgtttctgagttcttgtttcaaatccagtgtctgatttggagttgtgtaatctctgtgccgttgacattttgggcagggtaattctttgctgagaggagctgtcctgtgcattgtagaatgttcacaacaaccttggtctctgcccacttgataccagtaggaacctcagttgcaacaactaaaaatgtctcaagacattgccacatgttccctggctggcaagtcacccagttgagaaccactgtctcttaaggcaaagtatctgttgtcgcgacaggacgtttctgattccctctcattgtttagaatttattcacatagccattcctaattgtaaataggctgggttatctaatatttattctagatgggtatatgccagctaaaattggatgttgtattactgtgacagaagaagagaacaagtattgagggacagctcccagttttcatcatgtgtggaaagagaatctatgcttgaaatatttgtgatggtgatagcacattctatcaagtctaggaaaacaagtcactggattttactgaagtatttaggtgtaaaaaattgaaggcccttccgtgaaaaagttctaattggtaatttcattttatgcaaacccctattatgttattatttgagagagttcaagcgtactttttatccttggtaaatattacacagtaaaaaattcaaatatcagagacaatacaaaaataattgtacaggctctttgctttctttagttacgtttttgtccagaaatatgtttttgtgcatattttcataccacaagttaaattatttttcaactttcattaaggttttatcgtctctcttgatggtgattgttcacaaagaaacaaaatatttatctattaaacagagtgtgatttgcatgaggttctcccagaagtagcacctgagtcaaggattcacattcaaggagtttatttggagaataaaagtagaggagcggaggtgtgagacagagaagggaggaatccaataacaggtgtactgttgagcacatttccactttaggagatgggctgcaatcccattagggaaccctataagccagtatagaatacaactcagagttatcccacccaacggacaaggacactgaggtatttatcctccaaatctcagctgctgttggctcagggcaacatccaggggcattaggtccctggcacttctggctttcctttttttccctagtcaagagaaagcttataggcagagagctgcttatgtgtgaagctggatgtcatgggatgtcctgaagcagcgagtgctgagaggacatgatggggtacctacagcatctattccaccctctacactggttggttggcttggctcactcaccagcctctggcccaccagccttgctctatgttatgttgtgggcttactaaggtcagataggcaaaggaaaatgagctgaagctggacctcaaaaggatgctgacaaaaatccttgcatgatgaataaatggtgaatgaacttcatcaatgtgatggtcaggaaaacataaacattaacaaaaatatgaagctagttttcaggagccatagcaatatagttttaaattccaacccaaaggatatctgcagagcaacaatgggaaatggaattttttgctgttgtttgctttgaacatatcacagattcctcttctctaggatgttaatcagggccatcttggatcgtacttactgtcagatgtaagccaggccactgttaatgagagactggaatgcagccccagaatcggtgtctgcttcaacacagatgggcatggggatgagagatgccgggtggttatggaatatggggaaaaaatatggtgacttaaaggagggcagaggcccttaaaacttccttttatagtacatcaaagctgttgatcattgaggagaaaaagcttaaggtgggctactgggacctgccgctttcagcaagaaggctcattattttgaggataagtaaaacaagtagcctcatgtaaggatgaagcgctcttcagtagatgttggttgagtccatatggcttgcagaacatcacattaaagtttgctgactcattccatgcaagatttaagcaattttcccaaggagacaatatggctgtctccatataaatgggaataattctagaaggtaaacattagtcagcacagagaatgatttgatgaagagatagagacttctatgggtaatgggggcagacataacacagatacatgggaagcagggtggctaaatgcaagtgtgttttaagccaacaaaggtagcagtggccatggtggaggaactggagagaggggccacttgttgataatttattcctaccagctcttattgcaataaaaagaaactatgtaataccgtatgtggttaaaaatttgaaactaataagataaaggaggatgatggtgaaatggggggaagaaaataagatggtatcagtatataaaaatgcacgctatgagatactgtctccgcactgttcaatatagtagcccttaaccccatggagctgttgggcacttgtaaggtgctgagtccacattgagatgtgctgttagggttaggtatgcacactggatttcaaagactaatatgaaaaaatgtaaactatatcattgataatttttatgtagattacatgttaaaattatgataccttggctacactgggttaaatagaatatagtttaaaatcagtttcacctgtttcttttcacttttttaatgtggctactagaaagttataaattacatagtggctctcatttgtggttcacattgtatttctgttggacagggctgttcgctaccatggcctgtaccagtggttctcaaagggggatgattttgcccccgagaagacagttggtaatgtctgaaaacatttttggttgccactgctggaggggagggatgcttctagaagccctctagtgggtagaggccagggatgtggtcaaacattctatgatgcacaggaaagcctccgccatcaagtattatccaaatgtcaatattgccaaggctgagaaactccactttacaccatagatatagggtactgggagcccaatatggaggtatagtattaacctaagtgtgagggtgtaagcatcttctctagagtgtagacagtgggacccataataacacccttcactgctcaactgcatgtcaacaggcagtacagcaagcacctgatattgatgttatttaattcccatgagagcactattgcggtaggcagcatctccattttgaatctaagtcagctgattccagcttatgggctttatcgcccacagagataagaactgtaactacttcaagtctcttgagtccatttatttctttccattgtaagggcctactatcctagataaggccacctaactagtctctagtcttgaccacttcagtcctccagttctttctccatgtcacagtgatctttccaaaaatccaaaacctttcaatatttctataattactctcaggatgcagcccacattctttatcatagtctagaaactattacttggtttcaacacatttttgtcaaggatacacaatgtattttggacaaaatatggtaagaatcacaaaatgactgcaagatgatgcatgttaatggctgtcactactagagatgcatcttgaagacaggattggtgacctttctctctgtaaacaaagacttttagggcagtattttgcttatgtgggacctgtgaacatttgggtaaaacatgtttatgcaatttaaatgattatcaaaccaacaataagtttattgaaatgagaagattttaatttgggaatttgataggaagatacatgttgtttgttatactataaatctacaaatgatcaattctttggagggagaggttctgatttgtatctttttctgtctccagcaataacgagtataaagtaggttttgatagttccaccttaattaaattacaaactttgtgatgatcctgaaatgtgtattttgaataagggatcttaagtgccacctagtggcaatgaggggatatattacacattacattacaaaatgtattagttttgaaattataaaggatcttaagtgccacctagtgggagtaaaggattatattacacaacatactacaaaatagagccgttttgaaaatgtaaatggtcttaagtgccacctagtggaaatgaggggatatattacacttattttaaaatatgttactgaaaagttgtccccttctcggtggtagccccagtatgacttaaacgctgtgaatacaaaaatggtatctccttaaaattatgcattctcatcttctttattcagtttacctgtctgtcacactgccctctggacatctaattttttaaaaaagaaattttttgtatgagttgaaacagatgaatcctgaaatctgagtgaaattttgaaactgcaagtttgtttctctcttatgtaagagtccaatgaggatatttggtggacagccttccttgtagtgacttggggatccatgctcctcccatcttgtagttcagccagactttagggcagagatcagcaaactgtttctgttaatggccagatgggaaatattttaggctttgtggactttctggtctgtgtcaaaactactcagctttgcctttgtagtgtgaaagcagctgtatacaatatgtaaatgaatgagtgtggctgtattccaataaaagtttatctttaatgctgagattggaatttgataggtttttcatgaaatagtcttctttttaatttttcttcaaccataaaaatgtaaaaaacatgattagctcacaggcagtgcaaaaccagtttgttaacacttgccctagggctttggaatccttacttccagccagaggctggagaaaggatcttgcatgggaagtttttttctaggccagcctgtaatcagtcaagcaccatcccattggccagaacacagtcacatgatcacagacagggtggagagggaataggttttggtgaacacatagcagtgtacccacagtctctaacacagtccaccctgttactttaaaaataaaattttgttattcattcatttattctttatcagttgatgccatttcttagccatgttcccttggtatttatcattacacgcacatgttcgtgaacatatccactttaagaccttgtctttaaactcggtacgtatgtataaagtgattatgatgaacataagaaatggcatcagttaataatgaatgaatggaattgtatttttaaagaaataccatgaactgtattagagattgtggctacagtgttgtgtgttcaacaaatctttctctaacctccacccacatggttgaaaacaaaggagacttcgaaccccagctcagtgtagcaccaatgcctcaatagcatccttggagcagagctcctcaaatgagaatgtgcatgtaattgtctggtaaatattaccagcacaatggggcctgagcttcagaatttttaatactggttatgctgatgttgctggactgtggaacacactttgagttgtaagaataagtgtactgagctaataagagaaaccacgtttcttcatctctgtaatcaccgatagttttgactgtaatagctgggaccccaggcagctgtctggattttggagaaaatgaggatataaagggaatgtgaactgaagctcaaagcttgggatagctatggattataataaattttaaagcaacaacttgcaaacaaatgggtattatgtatctgatgcagttcaggttttaaaaataaatcttacagccaaaaaaaaaaagaaccccctgtcattaatctaggttgacaaacatgaaagaaaagtttaggaaagaaaggaaacagagagatggggaagaggggtaaggtgagtgggtgggtggaggaatgtcttagattgactagagaaatgggttttgcttcatgggattttttcatatttccaggagagggcagccagtccccactctaaaaacaatgtaaacttttacatttgcatctaccattttcagaaagtattgtgatatacagtgattttttaaaaaacttacttctgtccattctattaaccataattggaagctcaatatatacgaagggcattaaactaagagtcaaacatctgaatttggaaggtcctttttcctagatcttagcaattctgtacctgcaggcaagttgatgaacatcctagattttttatatgtaaattagatgcagtaagactagatccgcctcctggaaggatggcagataattaatgaatattgtttgtgaaagccctgtatgaatatattaattcattcatctatccattcacttgttcagtcacacatttaagccttaacgtgttgcagtgctggatgtcgaaatacaaaatgaccgtcacacagattctgccttcaaacaacctattgctaactgaagaaaaatagtatgattatgctataattgaactgcaaagtgacagtctaataaggcttggtaggagcaccctctactgacaaccctgacctgctgtccttttctcccagtacttggcacttcactcattccattccagttacataggcctcccccagctgttcctcagactcaacaagttctctatgttttggggaatttgaatttcgttttcttgcctgaagtgtttttcccttagttatccacatggctcatgctcaaggatttttaaaaaaagatctctgctcccttgtacaattcttacagaggccactcagagtacattatctaaaatagcacctcagttactctctatttcaccctctctcagtctgcaaattaagatgtcattccctaaggcatccattgtatgcaatgaattaacttctctcgtatgtatcgagaatggtaatagctgtgcatcatccttgggaaaattgagaatatagtctgtcaaagtactttctgtgttctgtggtttagatgaagatagcaagttgagtccgtgttttactttgctttataacagttttcacttaccaaacacaatattatgaatatatttaatttgtttttctctcctttctcaccattagaacacaaactctaaaaaggtaggaaccatggtttgttcaatgttgtatctgtagcacctacaccaccatgtgccatctccagcttggcatattgtagggtaggcaatacacttttgttggatggatgagtgtgaatgacgaatgaatggatgaatgaatgttgagaatgcactcaagaggtaactcttgatctgggtcttgtaagatcagcagaattttccttggtagatggggatgggaaaggtattcagacacagtatggtttaatgccacagtcttgtaaacttgagagagccatatccaggtaaggcagtggctttctgaagtggcaaatccatacctattgtagttttcctgatttttgtccttctttggagagtattatacactgcatatacattgtattattcacaatatatttttgacagaaataagttgtatttcctgagcagacacctccacttgttgatggcctgtgtactaaggaaaatacagattttaacattagcctaaataccacataattagaaatttaatctactggggaaaatatcattaaattttcatactgcatatattactttgacttatcagagttattcttctcttattaataaaagaacaaggtgtcagtttactcactgattaaaataatcatattattccatttcaagagcctatgttttcaatagtgaaatgcatgtttaatgatctttagatccatgctactcaaagtatggtccccggaccagtgccaattcttagatagtccttgcaggtctgtaaggatatatgcaaatcaagcaagagtaaacatttagaaacttttatagaaatttggcaccataattttatatctattgaacctaatttttaaaactgggcttgtgtttcatgtgcttccctccacccctttttagtaatttattttatttttattacattttacaaaagtatgattctgcaatggattggaaacaaacaagcaaaccttgtctttcaatacaggtcatttgagaaacactgctctagagcatgattcgtgcactgcctttagtcccacaaagcctaaactatagggaacactgagaatttagcttggagtcgaactgaccttaaaccaggtgacagtgcctgttaatagtgctgatagctggcatttatcaagcacttactatgttccagacattacactaaagactcgagagatttcccttgcagcaagggcctgagaaaagtaaaagtagatgggggagagggagattgtgtgtgtgacatcagaagcacacacagatgtttcttgctctatccaacttctttcagggatagaaagtctagaatgacaaccactccactgacagttacactgatttgacatccattttcttttatttctgggttggttttagtaatgttttggtaatataagccattaagcttacacatgggtacaggaaaggctgagtttcgggttgtttgtttatgcatgcatggatgccttggagacctggtggagaacccaaaagcttaatagcggcctttgcttaaggaaacctggcctacttcacccaggggcaaagctattagtgtccagaatctgggccctgttgcataaagatcttgttgtaactggttcaattctaggagggctggggaaatatgttttttagaagccttgaaatttacaacctcattgtccattgtggtcttttcaaagcattcaaagaatctgcattgataacagtctgtggattaaaaggacaagcaacctttgctatagtttcctgcatttggaaaccctgtggaccctgctaggcaacccttttggtaaaaggtaggcagcgaaatgcaagaatcggtagaatctacacagcatctgggctaaatcagaagtatgccagaataaaaggggaatatataacatatgcccttggtaagctggacttcactagcagggcttcatctccctctgtgctgaaaggttagcaaatattttatctaaacgtgccacagaaaagcaccataggtattgtctattggtagaataaatagttcaatcaatagctcagtgtagtttaagttgaatttaataagactttggaagcagatggactaaaagaaacacagacacacacagaatttggggcccttgttctgtagcgattgctcataaaagaatgtgaatctttagactacgtttcctaaaaggaatccagccatacttatcgaaaattttaatggaatttataaaaactgaactgaaacttgtatccacaagtccttaagccttttgaccacctctgtgattaggcatattcagctaatgtaactaattgccagatttagcaaatcactcagttacatttgaatttcagaaaaacaaatatttttacagtatattccatgtggtatttataagtagatcccatgcaatgctttgaaaagaccataatgcaaaataaggttgaaaattccagggtttctaaaatcatgttttccccaacccatctagaaccatgcaatatttgggacatatttatgctaaaaatattcatttattatctgaaagtcaaatttaactgagtgacctgtattctgtctggcaaccctaatctagtgtcattgataaaaagatgtgggaacagataaaaaagatgcagcagacaattggttaattcttttttcttttcttttctttttattttttgagatggaatctcgctctgtcgcccaggctggagtgcagtggcacaatcttggctcactgcaacctccacctcccgggttcaagcaattctcctgcctcagccttccaagtagctggtactataggcgtgtgccaccacacccggctaatttttgtatttttaatagagacaaggtttcgccatgttgcccaggctggtctccaactcctgaccttgtgatccacccatctcagcctcccaaagtgctgggattacaagtgtgagccactgtgcctggcaacaattggttaattcgtatttgaaatctttatacatatatctcacttgaactttacaacactcatagaagaaggatatattaaaaagcttgttttacagatatggaaactcaggcttgaagaagttaagtcatttgtctaggttcaaacagctacttgagtcagagaggtaagattcaagatcaaatttaactctggagcctagacacttaaacatatcagtgtaatcttaagtgacatttaataatactttggaagcagatggactaaaagacacacacacacacacacacacacacacacacacacacacacacacactcctcatattagcaaagcatcattaggactaattctcctttagtgttttccaaccattatatcaatggtttctaaacttttaaattatggacacctctcctccattttaacctctcatagttagaattactaagcatggtaattttagttgtctgatataatataatgacagaaattagcaaattaatttgtcaatcaaaatgaattcatatataattttcacaacacaagtagcatctaacagcatatgaaagacagtaaaacataccttcagataaattatttattctagaaatgatgttgagtgtgcaaatagattggaggattcccttatataatttgaggctctcccactaccacctcaaagcagtcatgtcccacaagttgggaatctataaattagagaaattaaatcttagagatagacccaagatgaatgaaatttctttccctgaatgtagaaatgaacccaaaggaaaacaactactgaagctggggagaaatgcaaggtgaggggaggggagggtcagtgatttaattctcagccacagcaggtgcttctggtgtcctgcctgcttcagcctgaaggctttatactacaaacattggcaacttttgacttgatggctttctctgccacctctccctactcatgtacagctgacagtaggacagcagggaagtctggaagtggttacacctagaaagcaacacttaacacaaccagcttccttgccctttgagtgggatgactcagagtgaagctttacccaatctcccagaggcccccagaaggactaagtcccaggtgcccacagtagtcaccagctcattaatgcatttgaattggtcaccttcccttcctcgtctcactttcatcctttcccagtgcttcctgggatcttctcccaattaaactgcttgcatgcaaattcttatctcactctctgcttctgggagaactcaatgttaagaaatggactaaggaattttatatttttgaaccctgccataggtatcaataccagaaaagattagctctctgttacttttctgatcctcagtgccttgagaattagtccagccttttgaggataagcaggttggtgagcctggttaatatcagttcttcatggaggggcccatgtggttactaacaacatgggtaaatagagcctgacgtaaattaattatgcttacgtagattttttcctctgtaaattttggtcattataaataaagaattgataggtttttgtacacagtacatggtgaataactgctgtccttcagtgctccactcctagcatctttatttgggcattttctttggactgaactataaaatataaattagattaatttattggatgagaaagttgtgcaatgataaagcagaacaatgtattcactcagtcttatgccaggcagtatggggtagtaaaagcagaatttaaatgggagttgggagcctaatttctgcatggtgtgtaacacctctgagtcttattttccttatgaatcaaatgaactctaataatccattcaccaacaagtgtctatgatcttttccaccaataaaagtcccagtgtcaattgcagagttgaaaaggattgtagattatgggcagacttcaacatctcaagatttcctgctcaaccacccctggaaagagatcatgcatgcagtattgtgaatacctctgaagatgagtaagatgagtatatggtaagataggctcttcaggggacacttgacaatgtctggagacatttttggttgccaacaaccggagtcagggaagatgctagtggcattagtagatagggatgcctctaaacatcttacaatgcaggggtccccaatcctctggtcatggaccagtaccggtacatggcctgttaggaatcaggctgtacagcaggaaatgagtgatggacatatgagtgaaacttcatctgcatttacagcagctccccatcacttgtattaccgcttgagctctgcctcccatcaaatcagcagcggcattagattctcttaggagcatgaaccctattgtgaactgtgcatgcaggggagctaggtggcacatgccttatgagactctaatacctgatgatctgtcactgtctcccatcatccccagatgggaccatctacaagctcagggctcctactgattctacattacggtgagttgtataattattttattatatattacaatggaataatagaaataaggtgcacattaaatgtaatgcgcttgaatcatccagaaaccatcctcctcccctccggtccttggaaaaattgtcttctatgaaaccgctccctggtgccaagaaggttggggactgctgctatagtgcacagaacggtcccccaaagaccaagaattatccagtcccaaatgtcattggtgctaaggttagaataagacaacaaatagaccaaagcatccaatggctgaaagcaatagaaatttaatttttgcatccataacaatctagggtagttcaagctagaccagggtggggttgtgggagtgggcaggtagacccagctctgctctgtgagaggatatcaactgatggcatgattgtcactttcagtatattgtttccacagctataccaggctccctccatttcagccagctgaaatagggaaatggtatggaggaacatgtataggaggtttatctgggtaaaatccggcaataacacacacgtcttcctctcatgttccattgactagaaatcagtcaatgcaaggcaggctaggaaatacagtgtggactaatccattactcagaaagaggaggaaagaatattctgcctactagttagcaatctctgccctaatgtgcaactacatcacttcttttattataataataagagagataatagcttcaggttttgagtacttgtattttatgaatttgtatatattttgcgcatgttaactcaattttcccagtaccctaataagctacattctgttattagctccattttacattttaggaaaccaaggcatgaatggttaaataatttctctaaaatacacaataagtgtcagagcctgcttataaacccagactgtatgatgctaaaacctgagttctacccattataccgccattcctgttttctccttgagtaccgtggttgtttctactattgaacccaaatctgcctttccacaccctccccctccacttgctggttctacttttgttattggggagaaacaggacaatcttacttagcgttttcaatatagacaactagaggcataggtggaaatcaaggtaatggccatgggggctggaaagaaacaggcagatgtaagagatgcagactccataggagaattcaatggcctcgaatttttttctaaggtaactggaattctctaactgttaaagaaaattgattctcacattgattttgtatcctgagactttgctgaagttgcttatcagcttaaggagattttgggctgagacgatgggatattctagatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcactatgatattggctgtgggtttgtcataaatagctcttattattttgagatatgtcccatcaatacctaatttattgagagtttttagcatgaagggctgttgaattttgtcaaaggccttttctgcatctattgaaataatgatgtggtttttgtctttggttctgtttatatgctggattatatttattgatttgtgtatgttgaaccagccttgcatcccagggatgaagcccacttgatcatggtggagaagcttcttgatgtgctgctggattctgtttgccagtattttattgaggatttttgcatcgatgttcatcagggatattggtctaaaattctgttttttgttgtgtctctgcccggctttggtttcaggatgatgctggcctcataaaatgagttagggaggattccctgtttttctattgattggaatagtttcagaaggaatggtaccagctcctccttgtacctctggtagaattcggctgtgaatccatcttgtcctggactttttttggttggtaagctattaattattgcctcaatttcagagcctgttattggtctattcagagattcaacttctcatggattagtcttaggagggtgtatgtgcccaggaatttatccatttcttccagattttctagtttatttgcatagaggtgtttatagtattctctgatggtagtttgtatttctgtgggatcggtggtgatatcccctttatcattttttattgcgtctatttgattcttctctcttttcttctttattagtcttgctagcggtctatcgattttgttgatcttttcaaaaaaccagctcctggattcgttgattttttgaagggttttttgtgtctctatctccttcagttctgctctgatcttagttatttcttgccttctgctagcttttgaatgtgtttgctcttgcttctctagttcttttaattgtgacgttagggtgtcaattttagatctttcctgctttctcttgtgggcatttagtgctataaatttccctctacacactgctttaaatgtgtcccagagattccgctatgttgtgtctttgttctcgttggtttcaaagaacatctttatttctgccttcatttcgttatgtacccagtagtcattaaggagcagattgttcagtttccatgtagttgggcggttttgagtgagtttcttaatcctgagttctagtttgattgcaccttcagctgataagcaacttcagcaaagtctcaggatacaaaatcgacgtgcaaaaatcacaagcattcttatacaccaataacagagaaacagagagccaaatcatgagtgaactcccattcagaattgcttcaaagagaataaaatacctaggaatccaacttacaagggacgtgaaggacctcttcaaggagaaccacaaaccactgctcaatgaaataaaagaggatacaaagaaatggaagaacattccatgctcatgggtaggaagaatcaatatcatgaaaatggccatactgcccaaggtaatttatagatacagtgccatccccatcaagctaccaatgcctttcttcacagaattggaaaaaactactttaaagttcatatggaaccaaaaaagagcccacatcgctaagtcaatcctaagccaaaagaacaaagctggaggcatcacgctacctgacttcaaactacactataaggctacagtaaccaaaacagcatggtactgataccaaaacagagatacagaccaatggaacagaacagagccctcagaaataataccacacatctacaactatctgatctttgactaacctgacaaaaacaggaaatggggaaaggattcactattcaacaaatggtgctgggaaaactggctagccatttgtagaaagctgaaactgggtcccttccttacaccttataaaaaatcaattcaagatggatgaaagacttaaatgttagacctaaaaccataaaaaccctagaagaaaacctaggtaataccattcaggacataggcatgggcaaggacttcatgtctaaaacaccaaaagcaatggcaacagaagccaaaattgacaaatgggatctaattaaactaaagaacttctgcccagcaaaagaaaatactatcagagtgaacaggcaacctacagaatgggagaaaatttttgcaatctactcatctgacaaagggctaatatccagaatctacaaagaactcaaacaaatttacaagaaaaaaacaaccccatcaacaagtgggtgaaggatatgaacagacacttctcaaaagaagacatttatgcagtcaacagacacatgacaaaatgctcatcatcactggccatcagagaaatgcaaatcaaaactgcaatgagataccatctcacaccagttagaatggcgatcattcaaaagtcaggaaacaacaggtgctggagaggatgtggagaaataggaacacttttacaccgttgttgggactgtaaactagttcaaccactgtggaagtcagtgtggcgattcctcagggatctagaagtagaaataccatttaacccagccattgcattactgggtatatacccagaggattataaatcatgctgctataaagacacatgcatacgtatgtttattgtggcgctattctcaataggaaagacttggaaccaacccaaatgtccaacaatgatagactggattaagaaaatgtggcacatatacaccatggaatactatgcagtcataaaaactgatgagttcatgtcctttgtagggacatggatgaagctggaaaccatcattctcagcaaactatcgcaaggacaaaaaaccaaacactgcgtgttctcactcataggtcgaaattgaacaatgagaacacttggacacaggaaggggaacatcacacactggggcctgttgtggggtgggggaagggggagggatagcattaggagatatacctaatgttaaatgacaagttactgggtgcagcacaccaacatggcacatgtatacatatgtaacaaacctgcacattgtgcacatgtaccctagaacttaaagtaatatatatatatatatatatatatatatatatatatatatatatataaaatcaattctctaactgttaaagaacattggccctttgtcagatgagaaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtgtaaggtgtaaggaaggggtccagtttcagctttctacatatggctagccagttttcccagcaccatttattaaatagggaatcctttccccattgcttgtttttctcaggtttgtcaaagatcagatagttgtaggtaagcagtgttatttctgagggctctgttctgttccattgatctatatctctgttttggtaccagtaccatgctgttttggttactgtagccttgtagtatagtttgaagttaggtagtgtgatgcctccagctttgttcttttggcttaggattgacttggccagaatctacaatgaactcaatcaaatttacaagaaaaaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccactatgagatatcatctcacaccagttagaatggcagtcattaaaaagtcaggaaacaacaggtgctggggaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaatgatagactggattaagaaaatgtggcacatatacaccatggtatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaggggaatatcacactctggggactgtggtggggtcgggggaggggggagggatagcattaggagatatacctaatgctagatgaaaagttagtgggtgcagcgcaccagcatggcacatgtatacatatgtaactaacctgcacaatgtgcacatgtaccctaaaacttaaagtataatttaaaaaaaaaaaaaagtgcactgttgcaagggaggccttgaggaagagatttttttgaggggagaaagcaaagaaacatcccttagttggaaggcactgttactctgatggagtagacatgtgcctttccaatacttaaattctgaccaagaaagacagtaggtcaaaaaaaaaaaaaaaaaagaaaaaaaaaagaaaattgggccaggcacagtggctcatgcctgtaattccagtactttgggaggccaaggcaggaaaatcgcttgaagccaggagtttgagaccagcctgggcaacatagaagaccccatctctacgaaaaacaattgaaaataatagccaagtgtggtggtatgcatctgtagtcacagctactcgagaggctgaggcgggaagatcatgtgatcccaggagttcaaggctgcagtgagctataatcataccactgcactccagcctgggtgatagaccaagaccctgtcaaggaaaagaaaagaaagaaaagaaaattgaagacaggaggacaaactgattttggttgtggatgagtgcgtgggtaaggaagatactgataatttcaggttttaaaatgttaggttaaggtatttggggctgggatgttgcatgattattttatttttaattttttaaagtttttatttttattttaaattccggggtacatgtgcggatgtgcaggtttgttacataggtaaacgtgtgccatggtggtttgctgtacctatcaacccatcatctaggtattaagcccaggatgcgttagttatttatcctgatgctctccctcccccaaccccaccacctgacaggccccagtgtgtgttgttcccctccctgtgtccacgtgttctcattgttcagctcctacttataagtgagaacatacagtgtttggttttctgttgctgtgttagtttgctgtggatagtgacttccagctccagttccatccatgtgcctgcaaaggacatgatccatttatcacaaacctacagccaatatcatactgcttgatgattttaaaccaaacacataggattaaagttcaggagagagatgagggctaaagataaccattttaacattctcttaatagacatgacagttgaacctatggaagtggaaaggattcatgatagagaacagtgtgcacgagaagataagattaaaagcagaaattagtaatgccagttgttttattggctctgattcctcacctaccctcgcatccacacccttgtagaatttgaagttccatgcacaaaaaggggagagtacgtaatacgctgccccctgatgtttagatctttgacttgctttggccaatagataaggcagtagtgacagtgtgccagttcctagcctaagcttaagatattttgcatgtgtctgtttgttgtcttgagcctctgccaagaaggtcatgcctgggctaaccaacttgtcttgggtaaaggatgaatgacatgtgaagcagagcccagcctacattagccagcctcagtctacctagacactcatgagctacatcaatgcctcttgtcatattgttatgggcctctgagatttcattatttttgtgattgttattattgttatgcagcatggattttgagttctggagagaggctcgcggatagatatagaagattattttccaagaaacagtagcggaagctgtgaaagtgaataggggccttgaaggagaatacaacctgagaatgcctacatttacagttttggaggaagtgtggagatgacagagaaggaggctggagtctagaaggagaagacagggttagcacagcctttagatttggaaaaatatttgcataatcatatctttaccatttactagcaatgtgaccttgagcaaaatatgttttaaaaacatacaaaatatgtttcaaaagaaatatcaataaaactgaaacattaaactcccaagtcctcagttttttcatctgcaaaatggaggaatgaggacctatgttgagtattgctacaacgagtaagtaaacttatcacggtatgtgttaaatctaatagaatgcacagtaaatgttagctattctctaagaaactcaatagttatgatagctaaaatgttgcatacatacttggtgagatattgaaaatatatttttagaagaaaaaggatgcatctcaaaagagaagaacaaaatgaaaccaaaggctggggagagggaggaattgggagttgtttaatgggaatagagtttcagtttaggaagatgaaaaagttctggagatagacgatgatgatggttgcacaacaatgtggaagtacttaacgctactgaactgtacacttaaaaatggttaaaatggcaaattttatattatgtatatgttaccacaataaaagaaataaaagagaaaacatttgaatgaaaggaaacttacaaaatgtaattttaaaaaatacttagtaactaacttttcgactgacaagtattagatcagagatataataagtgctcaatcgctgtttttgtaaataaaaacatggtagcagagagagttcccccagaaacaaggttaggagtagccacagtagattgacaggagaccttgatggcctatctctactcatagccaattaactttaataggaaaattgttgattttcatttgggatatcacgtttgggggtgaaacacccctggggggtggtctggcaatgcagaggttcatgggggcttttgactccattttagtaatttagtcttcactttttgttttagaaataccaataacatttcataaatcatgtgaggttttgagataaagctcaactaaattttagggaatgttttgtgcaaattgtttactgtttctgaaaaggacatttctttcattactaatttgtatgaatcattttgtaataaacaagatgagtttgtgcccacgacaatgacacatctagttcttttaataaaaaatatgttttagaagaaaaataaataaaaatgaaacattaaggaggcagatgtccaaaaacatattttaaatggtataaatttccatggcctataggtttttagccaagcgcagaaatttggccaagattattgagggaaagctttggttgttaaaaaagggggaggtatagttatgtgctccagtaagtatataatgtatagctgctactcaaactgataattttgatgaaaccaaaataatgttccctaacatgacactgtgattgacacagagcctagggaatgattgcttcaggacgcaacttttccttcttgataaatgtattaggaaaatgtttaggaatgatttcacaaacttatgtgtaccttagtgacttatatacttttactttccaagaaagttcttccttctgcatgaaacacatatcctgcttttaaggaaattatactagaactgggaaaagtcaacagagagcaatgtaagacaatctatcttggatggcatggctaccaccattctacttcaggtccatgacagacattactaattgatcacaacatactgttgctgagcctgtgtacaccctcgctttttcaacgttgtgctccaagcagccattgtcagttatggtttttctgtgagatggaacccatttttcatcccgtattagaccatatggctatgagaatttacagataggagaaaccagtgagggtggaattcaaagcctcatgggaatggatagtaggatcaagcacacagaagtaaaatgtgtggatgagtgtgtgtgtgtgtgtgtgtgtgtgtgtgtgtgtgcaatgcatagacaaaggtgaagagggcaatattagggagattcagttgatttgttgtacagtaattatcaagaactttggaaagtaaaagtgggtcaaatcaagaagatactgaaaatcacatagaggactttaagtttccaattattcaaatagagaattgtttgataactagacgagtgaagcctgtgcataccaaatagatgagaaatgggatatagtaggcataagaggccattgggtctcaaatggaggcaatttgtcttctcaggggacatttggcaacatctgaagagattttggttgtcacagctggcagggtgttgggaacggtggggtggtgcggttctgctgatgccacggccagggatactgctgaacatcctatgttcaggataggatatcccgagaggatattcccccacgacaatgaattatccaggccaaaatatgagtagtggtaaattgagcaattctgctataggctaattgctgtaatctgtaaccccaaatctcagtgatttaatacaacaaaatccatcttgctcatgaaaagacaaaagcaagtattttaggtgaggtagaaattctgggagttctccttcaagaagtcactcaggaattcaggcactttccgttatgtaaaaccactttttttttttttttttttttttttttgagacagggtttcacttcgtcacccaggctagagtacaatggcaaaatcttagctcactgcaacctccacttcctgggctcaagcaattctcctgcctcagcctcctgagtagctgggactacaggcatgtgtcaccacccctggctattttttgtatttttagtagagatggggttttgccatgttgcccaggctggtcttgaactcctgagctcaagtgattcgcccttcttggcctcccaaaatgctgggattatgggtgtaagccatgatgcctggcctaagccactgtctttaatatgtagctaccaaggtaggcatggaaagtgaaggagagtgtgttcatagagaagtcgtccttgctcttacctgccttggaccagaagtgacctatcaatacactcacattcctttggaaagaatttgtcgcatggttccacctagatgcaaggtgcctaggaaatgtggtttatctctgtgcccaaagataaaaagaactgggtctcatacgtttcagtctctcccatactgggagagactggacaaataactcagctagaaaactattacggattcagtgccaagttgtaagcacctgggcaagtgatggcataaggacagagggcttagcaagagactccatttaacaggtaaaacagtgcaagtgtccaaagtaagtcaacaatggcaagtcttggatgttacgccttccaactaactataatctctgtaaacgtggtcttgagtcttgctgctctttgaagtctcaacttgcttgggcacaggtttatgacccacagtccatgcaagaaagtatggatatatagaaataaagtaggaaagaacaaaatcttgtgggtttttttgttggtggtggtttgtttttgctggggggtcctggaggagggaatgattacttaagatttcgaacatgatgagttttcagtaatggtagaatattctaagagctgggccctaaaccattagataagagggcagtattgcagatgtagttttggaggcaatcatcagttgagtggatttcactactatatccctggagtccagttcagagcctgacatggaatatatggttaataacattttgttaaatgcatagatcaacaggtatttgactaacataaataagggaaatgatacttttccctttcattaaaatgaaaataaacctgatgcttatatatctttgtttcagttagctattgatgtgtaacaaaccatcccaaacctcagaggcttcaaacaatagacattgattatttgccatgtatttatgaatcagccagatgatctgtctggtcttggctgggctttcttatgcatgtgcagtcagctgtaggtcatggagaaggctctgctgatcttggctacctctttcatatgtttggaagtcagcaggtctagggtggtcatgcctgagaaaactgggttcttttccatatggtttctaatcttccatcagattctcctgggtttttcttatggtgtggcaaggatctatgagagaaagtggaaacactcaagatctcttaagatctaggctcaaaactgaagtaccatctcttatgccaccagatgttaactaaagcaacacacaaggcctgctcagattcataggtggagaaatagacccaactcttgatgagagtaggtgcaaagtcacatttcaaaggttgtatatatggagaaactgttaataggctccatcagtaagataaactcaccacagtctgggaggaggttgctacatagtgtggaaagagagaacactaagcttgatttattcacttctgagcatcctgatctccatggtaattaatgagatttctaaaataatttccaggttatgtttttattactcttgatcagtgaagaattaatttgaaaggcctaaggtttaccctgcactttaaaagtaaatagctatcacacaaaactaatctccttataggttaaatcctgtcacaacttgccccaaatgtatcctatccattttcatgtcatggtgcataaagaaaacgcgtggtggctcacacctgtaatcccagcactttgggaggccaaggcggacagatcacaaggtcaggagatcaagaccatcctggctaacacggtgaaaccctgtctctactaaaaatacaaaaaattagccaggtgtggtggcaggcacctgtagtcccagctactcaggaggctgaggcaggagaatggtgtgaacccgggaggcagagcttgcagtgagctgagatcatgccactggactccagcctgggtgacagagcgagactctgtctcaaaaaaaaaatcataattttgtggcacgctagagtaaaaggacaaggctgcttgtgattatggggctctgacttccccaggtctgtttcacctggctggttcaagggatgagttgattaccacctccacacacctgtaacccaccagcagagtgagccaggtaggatgttctgcaatggaccaaaatatcaatgggtccagggaatcctatgacttagttgcaggatcaggcatagaggccaggtctctagaccttcagtcccatgccttctttatggaacgatgttgtcttcagagatatgtctttaatcagcacatgtttctcagttatctgctgttagccttgaaatgtgcaagacacctgaggggaatgtatacactgtacaaggcatggccactgtcctcccaggggttaggaaagaaactctcgtacacccattttgatttcctctctgggtgcagtatcaatcggtataaagtctaatgcaaggtaaggaggcaagtgccatttcttctggagtagcaagcattgcaaaaatgtctccttcctctattttaatcactgtatttggatgcaaaataatccagcatagcacaggaaatataatcaatttactcaagaatccctggcaatatgatacaatagcaggcttgtataacccattcaggaaccatagatcctctgattcttctacgtttgtgtcattttaattatgctcatttcctgtaatgcaattactaataattatttgccgctctattgtaggggaaaatcacttacatattgctgcatagtaaaccacttcaaaacttggtggctttaaggagaatcaaaaagctctttttggaaagagctaggtagtaaatattttcaggtttgcaggtcatatgttctctgtcccaactactcaactctgcttgtagggctaaagcagccataagcaatacataaataagaatggctgtgttttaataaaactttatgtatagatgctgtgatttgaatttcataaaattttttaggtgccacaaaatcttcttctgatgtgttttctacccttaaaaaatgtcagatccttgaatggtttgctgatagaagctggatttggctcgaaggccttaattttccatctcctggcttaaaacggccatcactatcactccgtagtcttcagattggttgggagtgcacaatgcaagcttgggcttttttactctgattcaggttctagatccatgtgaccttggattcttaccaaaatgggaataacttttatccttgtgtattcattctgggacccaggatgggtggcagcagcttttttcatagctgtgacacggaaaagagtacaagctcaatcatccaagtgcatctgtggcctcaagctggctaccatgtcattggccattccatactatcgcatggccaaatccaaaatcagcaggcaggaaaatatcctctttagtgatagaaactacatagggtatgaattcagggagccatgaagaattggggccactggtgccgcctatcacactcaccttcccttttctttattgaaaaatataatgatctccttatttttcctccaactttcttctagacagaaaagaagggcatatataatctattttagattatttctggaggggataacttcctatgagtacttctcttagtcatctgcaggaaaatgctgtttataattttgccctgatccgatatctgtcatgcaggaaagtacacattacatatctttggacattccacagcttaatctgatacaccaaaggtcaactgaatgttttccttgagagaattttgaaacaccaactgctatctctgaattttctttgtttggcatctaaaggtatccctgttaccctagaggtcctctcattctgaacacagggaggtgagaggagttattcctggaagtggggcctatgaaaccactggaccttttcctgacaattgctatacccacgtcactgagcgaggactgtttaacctagcttttcttgcctttagccacattccttccactcaccatttgttgatgcaacttttaacacaggacaaagtgtcttatgtttttctaaccatctttgctttctggattttcttttctgataaccttctggattttagacttacgatttcaaattcctgaatggaacatttctcaaaacaaaaaccactttttaaaaatatgtaccctgaatttaaaaagtaatagtgaacagaatgtagcaaaatatcagggaggactgagaatgtgaaggtccacctgataggctaggagggtcacttagcttggcagagcctcagtgtttgcatatgaaaagaaaagtcactcccaacttggaaataatttgattctgaggttccacaaaatgcatatattcagaattctgtgtagaatttgaggtacaacttaaagaagacatctctgtcttctatatataggctgtatattgggccccaaacattatttttcagctccctagctatcccccttcttttctacttccaccccttcctggtcctaggtacagaaatctcaaattttattttgtttagctgaataatattagttgtggagatgctcttaaatatatgatgaatggcaaataaagaatttgggggagtttccccagtatgatgaactctgttaactgtcattgtagggatgagatattttgatcaaaagatcttctcatgggattatgatcaacactgtaagtagatcgatcacttgtttgcagaggtttagaatcaatagcataacttagtacccaaactcagatgggtataatttgaagttttccttaatgattccaatatcaaggttatcactatgttggtgagggatggtaaataaagaaacctaaatgataaaatgccaaatggccaaatggtgactaacttaccatatagatcgcatgtgtgatgcgtgatatgtgtgtgtgtgtgtgtgtgtgtgtgtgtagtatgagttggctcaggcatgaggcacattttggaatttcatcagcatttgaagtagtgaagagacgaggaagctgagattcgaaaggggtggggctgaggaagtgatggttgaagggatatctttgactccagagactatgccaagcacaggaggcatacagtggaagactggagaggtgagcatattgcagaaggactccagtccttgggtgggtccaaaggcagctggagtcagtccttgggagcaatgaaattgtcaggctaggaataccccagccaagttgactggtatgcagcttagaaggaaatggaaagacggacttagtggcatggagttaggagttggggttacagtcggggtcagggcaagcctgcatctctgaaactacagctatttcttttctccctagggttgccaggtaaaatacaggctgctcaggtgaatttgaatttcagataaataatgaataatattgccagtatgaatctgtcccaaatatagcatgggacatacttatgttaaaaattagccaggtgatgtggctcactcctgtaatcccagctacttgggaggctgaggtgggaggatcacttgagcccaggagttcaaggttgcagtgagctatgatcgcaccattgtatcatagcaacagagcaagactccgactcttaaaaaaatactcattttttatgtaaaattcaaatttagctggatgtcctgtaccttatttactaaatctggcaaccatacctacccacatccatgctaggtaaacaccctgtacttttctttccttgtacctttccattatttgggtgatttcttcatttaataattgtctccctcttgagaaaccaagttccacgagggtgttttgactttcagcatactttgtgcaaaaacataggtgaggctcaagaaatatgtgttgaatgagtgcatactactttattagcagtgggactataagtaccactagaagtctctctgaggctgctggccaaagttctactctataataagggctttaggattttgtcagtagaggcaactgcaaggagctgggggcaaagtgggggattgacagtcccataacttcatcattattctcatatttaaatacacatgtctgcctgggggcacaattgcctctgtggaaatccacagccctagatggaaaatcagatggcttgccctgtcattaattggcacaatggctttaggaaggttcctcaacctttagaagcctcagtttctttctacaaaataggagtgaatctcctgactcatgggcactcacaaggattgagaactcatgaggtgaaagtgtgtattggaaataattatgctgtttttttaagaagatacaaatgtacactttatgccgcagaaacagtagaggcccctgagataaatttccctgtcacctgagcaaatatcccttgttttaaagacacggagactgagatgtggaatctttcttattcaagcacaccctcagtcactgttcaaaagctgtgctgccatgtccatcccaagtgtcactggaaggtcacatcctggagagtgtagggaaaggagtccccctgcaaagagccaataaccgcccttatttctgaagggtcacagagtcacaaacctctagatatttcttaggaattcctctccccttcagaatgaggctttaatgactcaactttctctactgaataatcagtaggggttcaagagtatattaatagatcaggctcaattaaacaaacatttctggagtcctacaaggctctgtgcttagggaaaacagtggagaaaataaagatgattaagacactatgtactatgaaaaaatgctcaccatcactggtcattagagaaatgcaaatcaaaaccgcaatgagataccacctcatgccagttagaatggcaatcattaaaaagtcaggaaataacatgctggagaggatgtggagaaatagggacactttcacactgtcggtgggactgtaaactagttcaaccattgtggaagacagtgtggcgattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactagataaagaaatgtggcacatatacactatggaatattatgcagccatataaaaggatgagttcatgtcctttgcagggacataggtgaagctggaatccatcattctgagcaaactatcgcaagaacagaaaaccaaacaccacatgttgtcactcataagtgggagttgaacaatgagaacacatggacaaagggaggggaacatcacataccggggcctgtcgtggggtggggggctaggggacggataacattaggagaaatacctaatgtaggtgataggttgatgggtgcggcaaaccaccatggtacgtgtatacctatgtaacaaaactgcacgttctgcacatgtaccctagaacttaaagtatatataaaaaaggagactatgtactgtcttaggaagaaaaagcccccactcagataatgctaatgtaagagcaagacaaaggctgaagagaagaagcaaacgcttctgactgagagttggggagaatcgtgggagacttcagggaggagggtcttgtaggttgcatagaattgatgtaatccccgttcaagctcttctgtgttctttttttaacttttattttaggttcaggggtacatgtgcaggtttgctatataggtaaactcttgttatagcggtttgttgtacagactattccatcacccaggtaataagcatagtacctgctagttatttttttctgctcctataccctccatcctcaagtaggccccaatgtctgttctcttctttgtctccatgagttctcatcatttggctctcacttataagtgagaacatgtggtatttggttttctgttactgcattagtttgctaagaataatggcctccagcttcatccatgtcccggcaaaggacatgacctcattctttttgtgtctgcatagtattccatggtgtatatgtaccacactttctttatccaatatgtcattgatgggcatttaggttgattccatgtctttgttattgtgactagtgctgcagtgaacattcacgtgcatgggtctttatggtagaattatttatattcctctgggtatatacacagtaataggatttctgggttgaacgttggttctgtttttagctcttggaggaattgccacactgctgtccacaatggttgaactaatttacactcctgccaatagtgtataagcattcctttttctccacaacctcaccagcatcttggtattttttgtctttttaatagtagccattctgactgatgtgcgatggtatctcattgtggttttgatttgcgtttctctacttatcagtgatattgaagttcttctgtgttataacactcaataatagtatgaaacctcaagttcacgaatctgtgccatttacatgtttgactaacccaagcataaaacaaggggaacacaacctgcctaggctgccacagagagccaaacgggagctcataggtgaaagcgtaatgcactatactggtgggaggttggtcttatttactggcttgtcatctgcctagtttggactctgttgcgccttccttcattatgttggtctttacggggaaaatttcagggaagctcccaagtttgctcaagaaaagccacccagactttacagtcattttttactttgaaaaaaacaaatccaatcatcttccagatgttttcatttaccaggtctaaggaggagaagtacaaaaaggaagacatgctaacttttgggtttactcttcccattaaaacttctccaatgtgacattgaaatatctttctagcattgttggtggctgttaaccatttttgttcattttctccccatgtgtttacctccaggaaaggcatgaaaccaccattgtccattccctgactttaactgtgtgtctcttcagtctcagtcttctggctcagtaagccagtgggtgtgtatgtgttttcctcattcagctaaagacctgcttatttgcacttaatgtgagtaaagatatagttggggttttaatcaataattttcattgcatcttctttaatagctttttggtgaacaagtttagatatgagggtttaaaagggttctacaatatttatttatatagttaagagacggattcttaacgggggtaattttatccaccagagggcatttggcaagatctggagacatttctgactgttacaactggggagtggtgttggtgacactgctggcacctggggggaagaggtcagggatattgctaaacatgttacaatgtgcagcacagcctgacaacaacaaattatctagtctaaaatgtcaatagtacagaggtggaaaaaccctaatttaagatatgtactctacctgctttccaaggaagcttaacaaattaaacataataacaaaaagtaattacaaataaaagtagaactgaaacagaatagaaggagcagaagcaaggatgtcactggagtcctgaaatgacttaatcattagggttgaatatttgattgagttctgtatttcccaacaaatgagaaaaaaagaaacagttcttgggtagcccccccccaaaaaaaattgatacataactccatcagccaagaccacttttttttcctgccattgattttaaagagaaatatatcttgtagggcattatatgtgggacattgtataagaaaatagataatttttcaaccacggttttgcaaaagacacagatgtgtgtgtgcatgtgtttgtgtgtgtgtatgtgtgtctctttgtgtgtgtgtgtgtgtgtgcaaatggatatttctggtctaaattctctactaaaacggtagcagacagtataacattaggttttgtgagatgaaattcatttctttgagttgcagaactaatacattctgggtattgtctttgcttgtgatcaaatgaataaagagtcgtgtctctgaagatccgagagagagaaagaacgtttccatcgaactttgggaatctctccctggattatcaaatgactgcaacgagtctttggcaagggctaaagagtaatcaattcatggtagcattttccagtgatcatccaaagtgtttgaaatcatttgatagtgtttattcctagtctgctgtggatcagtctatttgttaggctttggggacaaaaagattattaaaatgtagtccctgttttcaagtagcaggagtctaaccctggcaagaacatatataaataatcatgaattaatacacacagtcgaggaatgtgcagtgtgccatgggaacccaatggaagaagcgaagtttcactgaggaaacaggagatttgaactgtgtgggttattgaagaagtcttcacaagtcttatttgtaaatacagctgatccttgaacaatgaggggttaggggttcctaccctctctgcaatataaaatctgcatatggctgggcacggtggctcacacctgtaatctcagcactttgggaggctgaggtgggtagattgcttgaggtcaggcgttcaacaccagcctggccaatatggtgaaaccccgtctctactaaaaatgcaaaaattagccagacgtggtggcgcacgtctgtaatcccagctacttgggaggctgaggcaagagaatcgcttgcaatctggaggtgaaggttgcagtgagtcaagactgcgtcactgcactccagcctgggtgacagagcaagactccatctgaaaagaaaagaaaagaaaaaaaagaaaatctgcatataacttctgactccccaaaaacttaactactaatagcctactgttgaccagaggccttgcagataacataaacagttgattaacatgtattttgtatgttatatgaattataccctgtattcttccaataaagtaagctagagaaaagaaaatgctattaagaaaatcataagaataaaatatatttagtattcattaagtagaagcagatcatcataaaggttatcatcctcatgtcttcttgttgagtgggctgaggaaaaggaggtcgaggaggggttggtcttgctgtctcagaggtggcaaaggcaggagaaaatcagcatataaattgacttgcatatttcaaatgcatgttgttagagtcaactgtattttataaatgtatgaaatgggtgcagaaaagtatacaaatcataatacacacctcactttgttttcacaaagtggactcacccatgtgactatcatcagatcaagaaataaagcatcatgagaaatagaactccagaaacttctcaggcctccttttccaggcattatctgcccctgtctgccaaaggtaatcattatcccaacttgtaactccatagattaattttgcattttatacaaatgtaatcacatgttatatattactttgtgtctggctttaacatttttgtgacgttcagattgtcacatgtagttgtaattaatgtacttttcattgccatgtagtattccattgtatgaatatacaacagtttattccattgatgaacatatgagttatttccaggttttggctattgcaactcatgcattgttgtacatgtttttaaataaacacacttgtgtattgcatgtgtctatacctggaaatgaaattgctgaggcttcatttgtatataaacacacacacatgtgcacacacacacacagttgatctttcaacaacacaagtttgaactgtgtgggtccacttgtatgtagattttcttctgcctctgccaccctcgagacagcaaaacccaaccctcctcttcctgctccttctctacctactcaacataaagatgatgaggatgaagacctttatgactatccactcctacttaatgaatagtaaatatattttctcttccttatgattttcttaataatattacttttttctagcctactttattgtaagaatacggtatataatacatgacatacaaactaagtgttaatcgactgtttatgctgttgataaggcttctggtcaatagcaggccattaaaagtaaagtttttggggagtcaaaaagttatacacagatttttgactgcatgggagtttggcgcccctactcctctcatgttgttcaaatgtcagttgtaatttagttttagttttccaacctgcttgtacaaatttattctaaccaacaatgtattagagcaggaactggcaaactatggctagaagacctgttttgttttgtaagatcacagctcactgtagcctcaaactcctgggttcaagtgatcctcctacctcagcctcccaagtggctaggactaccggtgtgcaccatcacacccaggtaattctgtaactttttgcagagttgggatcttgctatgagagaagggtggtctcaatttcctggtgtgaagcaatcctcccttctcagcttcccaaagtgctgggattacaggggtgagtcactgtgccagcttgtaagtaaagttttattggaacataatctcagtttctttttaatgtattgtctatgtcagttttcctgtggcaagggcagagttgagtagttgtgaaagcaactgtatggcccacaaagccaaacatatttactatctggccctttacagaactaatttgccaacctctatattagagttatgagggtttcaaaaccttgccaacaaccacgctgttgactgtttcatgtcagctcttctagtgtgtgttctggtgggtgtttcatgaatcatgttatggcattaatgtccatgatcctattgaaatcttcatatacattataaatagagcttacaagagagagttgtcattatggttaaatgctgagctccacttgagattctataaccttcccccccaaaagacttgatttattttatatgatttttctaaagtgtatactagtaatttcattttgaaaaaaaggtttctctttgcttcttctttttttttttttttttttttgacagagtctggctctgtttcccggggtacagtgcagtggtgccatctcggctcggctaactaaaacattcacctcctaggttcaagcaattctcctgccttagcctcctgagtagctgggatttcaggcatgcatcaccatgcttgggtaatttttgtatttttagcagagacggggtttcaccatgttggccaggctggtcttgaactcctgacctcaagtgatccacccacctcggcctcacaaagtgctgggattacagcgtgagtcaccgcacctggccttctctttgcttccgaaacttaagttgtgggatttagtgaaaaattattaaaatgtactttggaaaagggtattttattctcagtggagtacagcttagtaggcaagtcaataaggagagggaacccccatggatgaagcaggtagatgaccaagtgacttgggaagtaccttccaaagaaaggaagggtccataaatatttattgatagaatgaaaagaagaaacagtggttcaggtggctcaatgccctttcaagtactttcattttataaaatcacagaaaagtttctacatgtgactaaacaattttctcccttcttcagatatcctcctaaagactctgttagaaaatagtattactcttccagtaagaaaattatgcaaataaaaaaacccacgagacctaggtatctgaatcagtctttgagaagaaagctgatgtgcacactcattaaactgcagaatatggctcagtaagtctttctgtctcaagattgtttccagctgaagtcacacttggcaaatctgaatgcctcagaatgtaaagatggcccttgtccaggggcagacctccatgccgctgcttcctcttcccatttgcatccagcagtgcctgggagaggcaaggatcagagtcccttcaggcagtaaggatgaaatagatgaaaaatgagaacattaacactgggaaccagaagtcagggaacctagagcccaagatagcaaaaagatgtgagaaaacagtcgttatataaacacctaaaagttggagaaacctttgctctttggagaggaattactgcaagaagactattgagaggatctttaagtcctggaggccccagaggggaatggagagggagaatgaggagacaccattttgtttaagaaagcaaaggagtggagaaatacaggactactattttgaagataaacaaattaatagaaaaaaagtcctacagtgtgtttagaaggggaaaaaaaactgcttgcctgaagttgagaaaacatttccataaatgtaaacttcacaaatatcttcacatcaagcacatgactgactaaagatgaatgactcccaattccgcaataaacattagggttcatctacacacacaagtcagcttgactcaatgtattagaaggagaaaaggtcaagtcaatgaaacaaccagtccttagagtgccaagtacctgatttgcctgcatgttttcgttttcacttgttttggcattcttagacatagccagaaaatattacaacagaaacatctcattccaggatgttattttagttagtgggacagggaaggggagaagtgctttcctagatataacttagttgataggtaccctggttcttaaaatctgtattggaagttaccagagaccctgaccaaatgcagcatagtatgttcatgccaaaatgcctcctcataaatatgtacaattatatgtcaaataagcaaaagaaaaaatgaaataaattgcttccagatattgctcttttaccaaatggtttcaaaacatggacaggattattgaggtcacctcttctacctgtgtataattgttttatttcaacaacaacaaaaaagtatttgagaattgggacattattttatttttttttaaattccctttgcccacagatgcttcgatatactcaaactttggtttactttttactatttactctgtgaggtaaatgttaccccactttgattaaaataagaccaaagttcaggaggctgaaatgagtagcctaagatcttatggtagggagggcacagacaggttttcctactctgacacccccactggactgagcacatagtgggccctttatcaatgtcttttgaaggagtgactgactgaatgcacagatggtgagagtggaatgaggtggagctgagtttgtgatatagatactcctccttctttagtcatctggcaacaggcacagataaatttttggagttaacgaaagtgaaagaaaatgagagtatgtatgaagttctcatccattgcatgtaaacatgaaagcctataaattgtaccacctctatggagagcaatatagtggtgtctattaaggtggaagattccaggctcttgaatcatcagcttcacttctaaatacatactctagggaaattctcatatacgtgcatgagactgttcattgcaacattatttgttatgggaaaaaatcagaaagaacatacccttatgagaatagataaattaattatgggataatatttcagtaaaaataagtgaaatgggccaatatgtgtcaacatggataaatctcaaattttggcaaaatataatttatatattgaaattcaatcaaattcaagcttacagcaacaataatgatatgctgacttatattctagtatcctattctgattgcaagataaagaggtggcagccaattgtgcacaactttggggattatacccgcatggaagaatgtcgtgtatgtgagcatcattgtttggtgtgttaaagtgaaaaaaggaaggttgagaaccattactctagagttttgttgttcaagtagtgatcaattaggaagaaaaattttcatgaactctgtcttagctcaggctgctataacaaaataccacggactgggtggcttaaacaatgggaatttatttctcatagttctggagactggaaaatccaaaatcaaggtgctgacagattcagttcctggtgaggcctctttacctggattgcaaatggaccctttcttattgtgtcctcacatggcagagagagagagagagagagagagagagagaaggagggagggggaagggggtgggaggagggaggcacactctggtctttctcttctcataagagtactaatcccatcatggggtcccaccttcaagacctcatctggacctaattatcttccaaagaccttgccttcacattccattacattgggggttagggcttcaacatatgaattttagggggatacattcagtccataacagattcccagtgttgacttactctaattttactgaaatagggctatagttatttatgtaagactatgaataaacttcttatgttcagaaatcttatctatataatccaactaagttatttgtatcacacaaacatggctggatgtattgcattagaaatttatgtttctgatgatcttacttaaaatacaggcttcgtagcatacagtaaattcactttgatggccctcagggaaccacaaaaagttaagtcctcctcctccacagcagttgaagccaaagcagaagaaagaagatctggtgatcactaaaccaataaaagatgtatccatagcagagaaaataaacagaatttcaaatatgggccccaaaagaaagtcaccaaaatagtcaccacaacttgtagggctgatgtgtgatacagcttcccactaagcagctctttggtgctacaaaataaggggcaggaggatttatgtattttatggataatgattctctgggatattcctctattgcattgaaaccacctactactaaatctattaatcaaaacaaatactttatatgtaacaatcagtaagtttcacagtagtaatattaatttaatttgacagatgatttggctttgttaaaatccagtgatggatgtatggttaaaaaaaatgaagacttgggtccaactccatgctttgatttcaataacacaaatgtagaaaatgtctgtctgtataagaatgctttaaaatgttacaaataagcacaataattctttttttttctagttcaaaataatctgaatacatttaactgaaatgaatcactctcaaatgtcaactgtaatgaggaacacttgataattttgtgaatgtccctcatttatttgaatataaagataacacacagctttttttagaatcttatagtagcagatatataagataataaattttgtaataagcagtagctcattcttgtgctaataaaatattacaagcacaaaaagataggatatacacaagaaatcttcctgtgtatcagctaggctacttttggctgcactaacagagtacatgattgaaagttgcttaaatagtaagaacattttttatctcacataagcatggcattagatattactgtgtaacaaattatcactaacttagtggcttaagacaatacatatttattatctcacagtttctgtgggtcaggagttcagacacagtttagctgatttctttgcttcagaagttatatgaggctgcagttaaggtggcagcctgagctggggtcttatctgaaggctcaactggtgaaggaaggccctatttaccagcttaccctagttgtttgcagaatctccttaaaggccatttgactaagggcctcaccttctcattggcagttggctggaggccaccctcctccactccttgcctcatgggtctctccaatatggcagcttactttatgaatgcatgcaagccaagaaggcaacagcagaatcaactgtcaagacaaaagttacaattctggcaatgacgtcccatcacctttgccatattctatttgttagaaggtgctatggagtctatttgttacagcacctttgccatatttgggtagaccagctcacgctcaaagggaagagattgggtaggggcataaataccaggaagggaaagaggagaatccttaggaccaccttagagtcagcatgccacagacataaacctggagcatggttccaggattacctcagggactcagtgactacatttacccagatacagttcatctctcttccctggctcagagatgtctctctccatgtagataggctacagccttaccaggtgctgtgtgaaagagcatactcaggtgaagaaaagagggaatttcaatttttgttattttggaaaaaaacctttcccaaaagtctcctgggagaagtcccgtcaagtctcatttatcaggattgggttgtgtgtccatatccacattgcaaaggagtctagggaagtaagggcaaggatatggcatttttgccctcagtaggaggtaagtctctgccagagagaaaaggaaaggggtgggtgggggcagaggctgggaatgttccaccaactactaaaagacagacttctttaagggctaccttgtgttaacatgataactgaattttctgcctctattctccttacttgagatgttcattcatatagtgcgctatgatgtcattgggtctttacttggctcaaacattattgtacagacaaatgcaaatataggtcctgagactgcctgaggttctctattactgatatgattatttttgttccaatatttcctaaatatgttaagctagttataaaattcttattcttaaatctcttatctgtaaatgtttttctttttgtacttcttcaaacaaaagtgactggctccttaacttccaaccatctagagtcatttatttagatatgcaaaggtaatcatgaaaataaaaatagatggtagaatgagcctttgatctaccctggcttttctgcaaaactccccagataagtacacaaagggtgagttgtttacaaaaatctctctgtaatcagagcaggacctgtgaccttcagcaccttagactatgagggttccagacttcctttcaggttcctcaaagcctggtgaccacctctcagaggtgaacttacttccagtcaacctagctgaccactaggagtatgtgtgaaatgactctgaaagcatctgctcttgcagaacttcttttcaggaaccaaatctctactcttttatcctataatttgctgttgttgatttggattcaagtgaataaacttacatttatccttttcaaatacagtcttatttattaggtccatttgccatgaccttctgaatcttgcttctgtaatctctcttaattaatgtaaggctccatgttgtgttgaccacaagtttttatagcatgtccaggcatgtttaccaactgagccaatgctcagttacgtcccaaaggatctgaccattttgtgtggattttaaaagaaaacatattagaaggaatacactgatttttatttgttcatttaatgcagtggttctcaacctgggttggaggggaggatttgtccttcagaggacatctggctatgctggagatgtgtttgttgtcacagtggaggagggaggcatgttacttgtgtctagtgggtagataccagggacactgataaatattatctaatgcacaggatgccaccatccctgtaacagaaatggtcccaaacatccatactgctgtgttgaggagcccagttttcatttcagaaatggagctgggcatggtggcatgtgactgtagtgccagctacttgggaggctgaggtgggaagatcacttgagcccaggaatttgaggctgcagtgagctatgatcctgctattatactccagcctgggtgacagagcaagacccatctcaaaaaaaaaaaaaaaaaggcattctgttttgtatgggaaatcttacataacctttttctgtcagtttgataggaatttttacgaaatattttgatgcttgaatgtagagcccaggtcttactatatttacgtgcgtctttgttctatttctctgttgagcaactctttttgctcttacatctggactccacagctgaatcctctgcttacttgtctggggcccagataccctcaggaatccgaccctattgtccataccccaaaccactggcagttggtaacacaaacacagtcacaccaatgaatagtaaggtaaggaagtgtcaatggacacctaccaccactcctgctggcttctcaatgctattttggccaccatgaattgtgccatctcattgtcctattgctctgcgtcactctccacgcatttaaagtgctggtcaggagcattcagctggctaagcctagttcccatgatgcagtctgagcttttgggatgggctctggaccagagaattcatgtgcatcactctttgaatctattcaataattactgcccctcattgccatgtttgttgattctccagaaataaccacttgtaacagtttgttgagtgtttttgcaaacattttcagtgcatatacagacacatacatagtatgatatactttttatattataatgtgcatataagttaggattgcttaagctgctataaaaggcctccgtgattcagtggcttaaaaaaaatgagatttgttttttctctgcatcgtggcccaacatgtatagtccaggttgataggaagctgtgctccaggcagtcagctggggacccaagatgacactggctttgccatcttcaacatagtccctcaggtcactctggtggtcaccattttgtctagtggtaaggagtgaaactgagtatgaagaagacgtgcaccttgacttaagagacaaggctgggaaaaagcttacttacatggctatccctaactgttaatggggccgagaattgaagtgtagctgggaggccatatgccaagctacaattctattgtatacaagaaatgaagaacaaattttggtggatagcgacctaatcatctagttcattctttctctctcctctttctctcttaacataaataggactatagtatacaagcacatttcattaccttcaacattgtccatgttagtatatataaatattcctttttccacaactatattaactatattattcgtgactcttatgagaatcgtgtataactttcccctatcaggtttatcaagttggtcttttgagtacctctgtttgtttagctgttcattaaatgctcagcacgtataggacttggtcagtagatagcagtgctctttgaatggctcactagggttttctttttaagccattcttttctagtatagaaatttgcattctgatatagaatgtttggtttctaattatttaaaaccatatattgcctaggttttcttctagggtttttatggttttaggtctaacgtttaagtctttaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcgaaaactgggtgaaggacatgaacagacacttctcaaaagaagacattaatgcagccaaaaaacacatgaaaaaatgcttaccatcactggccatcagagaaatgcaaatcaaaaccacaatgagataccatcttacacctgttagaatggcaatcattaaaaaatcaggaaacaacaggtgctggagaggatgtggagaaataggaacacttttacactgttggtgggactgtaaactagttcaacccttgtggaagtcagtgtggcgattcctcagggatctagaactagaaataccatttgaaccagccatcccattactgggtatacacccaaaggactataaatcatgctgctataaagacacatgcacacatatgtttattgcagctctattcacaatagcaaagacttggaaccaacccaaatgtccaacaatgatagactggattaagaaaatgtggcacatctacaccatggaatactatgcagccacaaaaaatgttgagttcatgtcctttgtagggacatggatgaaattggaaatcatcattctcagtaaactatcgcaagaagaaaaaaccagacaccgcatattctcactcctaggtgggaattgaacaatgagaacacatggaaacaggaaggggaacatcacactctggggactgttgtggggtggggggagtggggagggatagcattaggagatatacctaatgctaaatgacgggttaatgggtgcagcacgccagcatggcacatgtatgcatatgtaacctgcacattgtgtgcatgtaccctaaaacttaaagtataataataataaaataaaataaaccatatattaaagaatttttgatttgttctgtttattattgcactgttaaataacaagggtcattaaaatgatacactgcaaattgcattctgttttccaagtctagagacaaatttgaattcccccaaagcctgttctggcttgcttttacactgttgacattcctcagaagaggcaagaataggcaaataattatgtgatgcccatttcaattccaacctcttgactgcttcattctcacccttcaccattcacatttggcattacaattccaacattaaatattctttttgaaaaatggttaagtttttatctgatgtttcaatgttgatatactatgattgggtcttattgtccaaagtgaagtcaaattcgtgtttaagtaaaataattctagcatggtttcctcctacctcccacccattatttgaaaagtgacaagaaaatgtataaagctggtaataattgaggcatttctaggcttgggatttccaaaaactgtgaatagccataaactggcaaatagaaggagacctggaaacgaattgcagtttgaaatcacagcaccatctgggacaccattttcctaatagtattagttttctattgctgcataacaaattaccacaaacttagaggcttaccatacacctttattatctcacagtttccataggtcaggagtccaagcacagcttaactgggtcgtctgctcaggggtcccacaaggctgcaatcaatgtgtcagctgagctgcatttctctctggggcttcagttcaacttccaactcatgtgattgttagcagaattcatttctttgtggttgtaagatcaaggtccctattttcttgctgactgttggctgggggctacgctcagcttttggagtccaccctcattccttgcctcctgtcccttttccagacctctcaacatggcaactcacttcctcaaagtcagcaagggagagtctcttagcccagcttgctaagatggagtcttatataatggaatataattatgggaatggaatcgtatcacttttgctgtattcggttggtacaaagtaagtcacaggttctgcccacactcaaggggaagggattgtataagggtgtgattcactggaggggggtcatcttaggatatgtctgccacccgtatttctggtttaactcactaccttgtttccatttcaccttcagtgcccttctgatgcctgtctggtgcctggtttcgaattcctacctgtctggtcctcacattctcatggttctcacatgcttcctgattaccttttaccttacatttccaacaccttcacagaatgcatcctgctacctgtctctatggccttcttttctctatggtcaagtcaccaatcccttggctctgctagccctctccttttagtgttcaagcacagcatgggtaaatgaaactgatgctgttatgttgaatacctcctcctcctggcttttctactcatttcagtggtgtgatcattcttcaagtcaccctaagtcaaaaccatacagttattcatatcttggacttccctaaaccaggggttggcaaattatgacctgtgagccaaatttgatccacatgcctgttattgtaaataaagttttattggtgcaaagccatacctatttgtttaagtatggtttatgcctgctcttgcactacagtggcagagttgagttgttgctacagaaactggcctaaaagctgaaaatatttcatatctggctttttgcagaaagcatttgccaacctgtgctctaagctgaagaagacagattgtttcttttgcatttaaaattccaatagcgttctttccttaccttcttttccttctgctattgttcaccttggttagtgcttttgttgtcatacacctgaattgactcagccatctcctaattgggcctcagcagctattcagagcttctcttctctgaagcccttggttcattgctgttgtttgagcatctgaagatcttccttgtctagttctaaattctttctctttatttttctatgctttttacagaaactcatcttccctgggtgggctgagagcaaacactggctcaaatactttacccagttttgcatgtatgattcattaggaacttctcataaactatctggatttaacagttatgtcttactctacataagacctagatcctctatagattattataaaatcattgcacacaagaattatgtcttacacgttacatctgataaaatgcttaacgttgagttgagctggacagagaggtatagaaggtgtagaccagcggtccccaacctttttggcaccaggaacctgttttgtggaagacaattttcctacagaccagggttgtgggggggatggtttcaggatggaagtgttgttccacctcagatcatcaggcactagttagattcttataaggagtatgcaacctagatcacttgcatacacagttaacaatagggttcacactcctttgagaatatcatgcagccgctgatctgacaggaggtggagctcaggtggtaatgctcgctggtctgctgcttacctcctgctgtgtggcccggttcctaaccataccagtaccaggccatggactggtactggtctgcagcccaggagttgggtacccttggtatagactgttgataggtctttgtgacaagctgctttactatttaaaaatgaaatagagctttgtttcattttatatcgtttttaatggtggtgattaaagatactttaaataaatttaaacttacaaaaaggtcgaagtaatggtataaggaactttttctctaaatcatttgagagtaagtttccaacctgatgccctatccctcctaataatttattgtgtaattcctacaaaaaataaccaaaatactaccatcaaaatcagtaaatgagcatggttcctgatagccatttagtccctatgctctaacaagtttaactaattgtctaagtaatctcctttgtatcaaaaagatctagtccaggatcataagttgtacttggttgtcatatctctttactctctttatatttggaacagttcttcagtattttttgacttgcatgactttggcattttttgaagagtattggagagctgctttgtagaatgtaaaattgtatttgtctgatgattccttataattaacttcaagttatatgtttttgatatgaatatcacatttgaagaggtataaatatcccattcgtcatcaaactttcactcactagttttagtggtgtttcttggctaaattaattattactgtgttagttgacatttgataattttctatttccatcactcctataattattatttggcattccattacagggaaaacaattcatctcttcctatttgttcatttatatcaccatggactcatggattcctattctattcagtgggttagaatcctttactttcatttattttgatgctcaaagggtcccacatttagcagtgggataaggttgcctgataagatatagaacacccagctaaatttgcatctcagataaacaattaataattgttttagtaaaatatgtctaaaatcttgcatatacatgcttaatattgcatggacatacttaaattattagttgtttaactgaaattcaagtttaactgggcatcttctatttttatttgctgaatctgaagccctgaagtgggagccccttcaagatgcttactgtgttctttcaatatgtccccatcattctttgaatacttccttgatttctggcccaacaaaatgctgtagcctcacctcgtacctttcttgctccagctctcaagccacttccccaaagaaacctggctctgtttagtgtaaaatggtatttagaaaccaagatctgtacacagagtatactcattactgttgaatgtcacaactcttagaccttctcagtggagagatccagggcaatctatgtatttatctatttacacatatgcatatatgtacatacatctacatatgtatttacttctgtatctatctctatgtattgaaaaatcatgacttcacaccaatgcttctaattccaatctagtaccacatgaacatttctcattttccttttctacttctctaacagtgagaaatgtggtcctcccaccctccatataaccataattgatcaattacccccatatgtacccaatctcccattgccaccaccagcctccacatccctacacggatgctttgctcacctttcttgggctctgacaccccaccctgtgcttcctctcactgcctcaggctccaaaatcccataccaagccactgccagtaccacttctgccaacgtggcacatgggcaccttattcacctgattcaggcttcaacatcccatgccaggccagcatcatcattcccctgtgtggatgccctcttcatgccacttgggcttgatccccagcaacagaccaccctgagtgaatgccctcctcatgatacttgatacactgtgctgagtcaccactcctgccccacctgatgcagatacctgtcctgcaaggcctgatgtcatgggtcttggattgaattgttcaggaaaggaaggagggaaaggaggaaggcatttctcaccatgtaacattataactgatttattattttttataattgatttatgttttcattctgttttcccctcaacctggctcattcactggcagattaccttattacaagaacaatgcttgctttatcataagcactcagagattatccatcgaatgaaaaagtgagtgacttaatgaacaaatgaatatgtagagagctaaagtttctacatatgcagaaaataaattttaattctcctaaaaaattattttctcttggctcttgaacttacttaacatctgatttaggattcacccatggtaacccaatgattgtttggggttttctacctcacctagcatgacatctgggcaagtttattttcaggtcactataacccagagttttcttgcaagagtatggtcaaaacatcatttttccttattaggaggtggcttgtgtgtgttgagctcacatttcttttctcacaggcttctcttgctctcatcccctgtgcagacttaatcatatgcctaccggtgatttctatatactgagatcaaaatcagcttctgtttcttatgctatcaaataaaatatctgctctgtaaaactgcttctacatataaaagaaagaatcggggaccagctcttcaattggtatgaatgagttggagagaaaaggcagtaaggcacccacccataggcccccaggggtcaggaagcaatgttcgatgttttccttctctcaccagctagctaaattcttgtggaaaaaatcccttcctcacgaacctgcaaattgaagagatgtagcaactgggctcactgatcctacccaccccaatcctgccccaagtcatcacagggaaaatgagcagtgcatgtgtgaatgggtatggcatataaaattatattttcatttagcatttattagagctgattcaaaaaatcacatgaaactattataaattgctgaacagtttcaaagtttattttgcttatgtgtgtggaagagagacaaaagtagatgagaactttaaaaataatgtttattgcatgactaaaaacttgggagctgagaagggagaccaacattatgtaagctcagaatatttttggaagttaaatggcatttcctacaattttacttccaatgcattcagctgatcacctctctgaaaacaccttgtgccttgcataccttttttggaagcttacttctccctccctcttctcttctaatactctttccgtgataaatcctcattcatcctggaagactaggcattaaaaacattttctgtatgaaacttgcagtggctttcaagtgagttcattagaacagtggtcatgcattagaactacgtatttacactttgtctccactattggctgtgaacttccagacaggggaatgttacatctcattttgttttcttttacttaatgttaaggatctcatatatacataattgggtaattacactggctagctcatgacacctgagtgatatgttttttttttgttgttgttgtttgtttgttttccattctcagtgaatgtcttcagtggcattgagcacaagagtggctaagaatggggctaaggacttaggcacacctggtctgaatccctgctcacccacttaactgtgtgacttggggcaatttatgtaactttttgagcttctgttttctcaaatgtaaagttagaaaaataaagcccctatttaatagtttttcttttttatttctgagtgttaaatgtaatattgcaaactaaatgctaaacatgatttatatgacaagaagcagccagtaaattttagctttttaattttttaatggagtggggctcaacagatacttaatgaatgatacagccattaagctttttagaatcccaattatgtatccaatttgttttatttattttctttttctcttttcttttcttcctcttctttcttttccttttcttcttctcctttctcctctttttcctctttttccttctcttcttcctcctcctcctctgcctccttcttccttttttctcttcctccttctcctctgctctcatttttcttcctcttcatcttcctccttgtcctcctcttcctctttcttctttttcttcctcttcattatcatcttccttctctttttcttcttcctcctccttcgattctccttcctcttcttcctcctcctcctcctacttaatcttctctaaaattctcctctctctctcctttctttcccctttcccctcccctgccctcctctcttttttggacatctctgagcacagctgctgcacataccagggcaaagctgcatcagatgccaaagtcttttcaagggaagccagttttcaagctcgggcacactgacttttaggatacaacccaaatactattaaataacaaaacattaagcttctttgcagataagcctggaataccttattctctaggtttttaaatttaagagaagtggaaccaggcactttacaatttgaaatgttatttcaaattattctcatagcagccctgcataataggaattattattcccactttacagataagagagttgaagacggtgtcactataagaattaacattagtataagagcagtctctcagctctgtttccctccctgctggctttaacttcttccactaaatatgtctttctccctatagtcataaaagataatcacaatccaacagagacatccatccctacagctcatgatcccaaaggaagtgagaccatttctattacaacatccaatttattaaccagtttcatgggagggctatgattgcctttcatctcaggatattttcattggtaagcagaagagtaatcagcagtggcttaagtgaaaagaaaagaaaaaaaaaaaacatttgattatctcacagagctagaagtttggaggtaaggggctcttgggttgagtcagtgactcagtgatagcaggagctgagcagtgtcttgtaaccctcttgagttcatgctcatgattgcagctccaagcatcacttcttcacctcagcatcataaggaggaagaaaggatagaaaagaggtcattcctctgacaacactcttattttgggggatagaagatctctactctaaaacccccagtggacttctctttatatcccattggccagaagtggggcacgtgtccactccaagaccaattattggcaagaagcgacggagttaacatgagtggtttacaacaatcatggctcggcatctgaggctaagtgaagggacagcttttcctgaaaccaaaggttcctgcctcttgaacacattgcaagttctgtgtgcatggcaggagagggtgtgtgtacagatggttgttggtaaggcagtggtcaatatctgctgcagcccattttgggtcatatgtctatccctcatatctgctgagggcagcacgaagagttctgccttcgactgtgttcctctggtgcagtctctgagagtaggattaacaggaaaaggattggtcaggaaatattcttgggaaaaaatggtagaggaagtgggatgaagaagagagggaggctccacagagttcaaggtctcataaaattcaccccccagaggataacttaagtgcaactccacagagaagtactggggacagtgtagaccccactcagtgctgtgttccccatcgggattaccccaccaacactgtggggaggggatataaatttctgggcactcctggttcttcacatgtgcaggcaaaagagattctggaagtctgtgggtagttctctaaccaggagacacaaggctggccgtttggagtaagagcctgttagagccactaagcataacactggggacttggaggggatatgagctgagccccaaggacatctgccacagggtccatgacagtccagaccagcatcaagtctgcaccccagagccacggtgtgggtgggcattgcttgatggttgccaagtgaaccaggacagtatgagcacaaggaaggtggccccctatggaaagaaaaatgctgagaggtcaacatctcaggacaccaactcatcagccctctgcacattccccaaactcattagggtgcctccaggagaggtcttacgtgagaacgggaattttggctgcccaggtactgtgtggaatctgctggattctctttatctgcagctgctgggggtacgccagctgtcagtgatgacttctagtgccattcctcttttccccatttaggcttttcttactttttagctgagagtagagtttctcctccccaagtactattgatatttgaggctgaattattcctcactgtgggggactatcctgcgcactgtagaatatttagtagcatctctggcccctctccacttgaagccaattccaccagcattcccccaccaaagttgtgacagatatcccctagaccttgttaaaaccactcctggtggagaaccaccggcttagaacactgggctcctgcaactgtagcttccaggtttcacctgctaaattgggggaaatgccctctaagctgtggaactctatgaacttcatgggagtttgccagatttagtgtgactcttattcttagtgagttaatttgtcatttgtgtcttgtttcctctgtgctaggggaataaagaatactggacctgtattcagaatttcctctcccttctcacatttacctgccattagtgagctgaggctttctttccttagaattagggttgccagattaagcaaataaaaatacaggacatccagttaaattggaatctcagaaaacaaacaatgttttagtaaaatatatcctttgcaatatttggaatatagttatactacaaaagtatgtgttctttatccaaaaccaggtttaactgggtgtcttgtagtttatttggccactgtacttggcacacattctttctctaaggactccactaggaaatgcctgcattactgtattctggtgcactcatcgtatccttcaatcatggagtccccactctgcctgttggttagcttgtactccactcaccgtggcaccacaacttgggctgtttctatcacagcactttcagcattgctgctactttccatagtgccctgtcccttcttttagcttttgtgtctttctgcaaattgattatatggagttggattaaggcctgcagtcattatatgtgggtgtgcgtgcatgtgaaaaaaaattactcttagcttccctaagagaagctcatgggaatcgaatcattgagtaatacagccacggaggatcctggggaaggaattctccagcattccacagtagcccctattctgaaagcctctagttagtatcaccatgaaaatattagagggagaggaaaaaaaatcctctgtaaatagtagcactccaggggagatcctagtaatttgcatttttaagaccagatgcagttaacctttcatatattgtacatattttaggatgatttttttctaaaagatttattaatactatcattgcctaaaagatcagctgatttgtgagttatttgaataaaacaaactaaaaaataagggaaataaatgttgcttgtcatcttccttacattcattgtggcagaaagggcagcaatgagctcttgctagataagagaactacagcagaggtacaggatgcagcatcatgggaaccagaattcatctgagagactcaataactctgatgattgtttatttagtaacccaggggaaatttggcttgagttacagtgtgtgtattgctgagttctttctgtgtgtcttggttatttcaactaaaaaagactggggggaggaaaagcagctaacatgctaaaactgtaatgattacttaacattacattttggaaaaatggctttactgaaatgtaattcacttatacaattcacgcatttgaactgcataattaaatggcttttagtatatttacagaggtgtacaaccataaccacaatcaattagaacatttttatcacaccacaaagaaactccatatccattagccagccatcactccccatttctcccactccatacctactcatcctcagcccctggcaaccactaatctacttgctgtctctgtggacttgcctattctgcatatttcatataaatggaattatacagtatgtgattttttttggtttctggcttttttcatttagcataatgtttttaaggttcatccatgtcgtatcatatatctatactttattctttttgttgccgaataacataccattgtgtatatcacattttacattcatcagttgaaagtcatttgtgttttcagttttgggctattatgaatactgctgctatgaagattcacacacaagtttttgtgtggataggcaaaacgggcagggaaacaaactagagaaagaataaactgcagaaatccaagtgagaacaattaagagctcaactgtcgtacatttccctttcctttccttcccttcattattaccctgacttaatccttgcccagccttcctttcattttcacagtatcctgctcccaccctaagcatgtgtatttcaaggtaaggctttttgtggagccaaattgaagggggatcacctggccagatttgcaaatgtaaaggcagactggtacatagattctccctccacggtatacccccgacccccagtgaatttaagaaccaaatttaatatatagattagctcttgattaagagcagtggggccaaggttcacttttagtctcaaggtccaggagagatgagcttctgtagcatcagctgggactggctacataattggcagaacccagtacaaaatgaaaacacgaggctccttttgaaaaaattattagaatttcaagatggcgagagatgagccttaaaccaagtgcagagcccttctgagcatggggctgtgtgcacaggtcatgaacccatgaagccagccctgaaaagagttctaagtttgaaaatatctagattccatctgccatagagtaccagcctgtaatcagaatgtcacatttgcagatacttcctaagcagctgaatgtatacaatgacctgttgatcagagggatgctaccctccagaaatgaatgtgttactaggtgtctccaacattaaatctctttggagctgtgttctgatgagctgaaccgggatgttgcccttgctggttgtacagtcataccacttcacatttcatgatagcaacaataaaacaccatgaaagatgtgttgcttcttgtgcggcaggcactgtttgtctcatggcctgtgagaaaccttccaagacacagcccttcaaactcaggaccctgtaagtcagattaactgtgaccacagactacatgagttgttatgagtaactctgggagaaagccgcctttcgttaaagtggagactgagtggattcaaatgcattttaaaacatctgtcatggccagattgccatttcaatagccccattgcctgcctggagcttttgcatgcatgagtatttctgctaggaaacagaaaatgtttggattcccaatttagaatcccttctatgagttcaaagagtttgggcttacactgctcagcagtctcctggttttgtttctttgtgccctcatgaaactagagctctgtgtcactttgctctaggaagaattttgttgttggtgaagaatattcttgatagttagcatctttgaaatctctatgaaaatgagaaattaagcacaaatgaacacaagctctgctgaactctcaaccccccaatctttctggcttcaaattttatttttatgggttttttttcatgctttgcaaggcacaatttagtaaaacacagcaatattaaagtgtacgtcttgaagaaatttgagaaatgcacatggccattacccagattaagatataaaacatctccatcaccccaggaagtttccttatgcctcttccagttagttcccctgctcagaggcaactgccatcctaatttctatccacatagattagtgctgcctgtttttgaaatccatataaatggaataatactgtatgagttaatgtgtctttcactgtacgcaatgcttttgagactataagttgttgtggacatcattagtttgttcctttattgccaggtagttttccattgtatgaacacaccacaatttgtttatctactctcctgttgatagatatttggggagtttccagcctttggctattacaaataaagcttctgtgaacattcttttacaagcctttttgtggacatacatactcatttctcttgggtataaagctaggagtggaattgctggttcatagggaagctgtttatttaactttaactgccaaagaagttttccatcaatgtacaggagttctaattatttatatctttgccaacacttggtcttgcagtctttataattttagtcatactgaagggtatgcatttatatctctttttaaaaaaaatcacttttattgaagtatgattagcatacaataaaatatgccatcttaagtgtgtaggttgactaagtttggcaggtatatatatccatgtaaccaccacatcaagatatcaaatatttccatcaccataaaagaaactcttcatgccccttcccagtcagtgcctggtagcaggcaaccactgatctattttctgaccctacagattagttttgtttgtctagaatttcttagcattggaatcatattgtatgtgtattttttggtctagcttctttatctcaacatatttttgagattcatgcatgtccttgtgtatttcagtaatttctttttattgttgactcatattccactgtacagacatatcacaatatgtttacttgttcatctgtggatgaatatttgagttgttttctgttttgtgctattatgaaaacagctgcaataagcatttgtgtacaattcttttggggacatatgttttcctttctcttgagtaaatacctagaagtaaaatggccgggatatatggtaagcgtatgtttaactttataagaaattaccatacagttctctaaagggttgtcacattttatgcttccatcagcaaggcatgagagttccaattgttccatattcttaccaacatttgtcattcatacagtaatcatacagtatagttttaaattctagcaagtttagtggtatctcttgttttaattcacattttcttgatgaatagtgctgataaatatcatatcttatgtgcctatcagccatttattatcttattttgttaagtttccaaatcttttaccagcttgaaaaattgtttttttttttttatcatatttgaagttctcataactgaaaaattgtcaatttttgagttgtaagatctctctgtatactctggaaacaagtcacttgtctgatataagtattgtggatatttttttcctagtctatgtcttgccttttcattttttaatgatatctttcaaagagcatgaattttaaattttgatggagtccaatttttaatattttcatctgttcttgttgggtttttcttgtatcttaagaaatctttgtataccacaagattgcagaggttttcttctatattatcttgaaaacattttatagttttaataattacatttaggtctatgattcattttgaattcatttttatatatggtgtgaagtagagggacagtttaattttttaagaaaacattgttataccatcattttttgaaactctctcctttccccattaaattacttttgacacctttgttgaaatcagttgactatattatgagtctgtttgtggattctctattctgtcccattgttctatatgtctttcttcatgcaattatcatcctgtctttcactgtacacaatgtcttgatttttgtagctttatagtaaatcttgaaaccagacactgtaagtcctataatttggttattcctattcaaaatgtattggctaatctgggttcttggtatttcaatacaattttataatgtctgcaagaactgatgatgggattttgattgagattacactgaaattatggtttgatttatttgtcttttttctttcctcagtaatatttttaaattttcagtttttaggttgttgtgtatatctggctaaatttattcctgagtggtttgtgtgctttgattaaattatacgttgtattgtttttctggtttcatctttcaatccttcattgattacaaatagaaattcagttggttttggatattaaccttgcatcctgaggccatgctcaatctacttatagctctagtggctttttaaagtagatttctggattttcttcctacataattaatacatgattgtcttttctgggaaaaaaaaaagcttagtatttctcctttgttttcaatgtgtatgtcctttatatcttttgattgccttgtaacactgtctcagatatcttattcaatctctctgtggctttaatatgcatctccttgctgagcaccttttcatatttattgacagtttgagtattttgagaatttctcgatcacgtcttttttcccattcctattgttttgtttatttgcattatttgtaggaattttaaaaatctaaatacaagtccttcattagacatgtgtttttaaaaatttctcctagtctgtggtgctttttttttttttacttcagcaatgatgtcttttcatgagcaagagttgtttttgtttttaatttgatgaagtgtatcaaattttatattctaggaaatgttttcctacctcaaagtcgaaaagatattctcctgtgtttttgtctggaagcttttaagtttttagatcaatgattattttcttgaaagctctgtgtgtgtgtgtttgtgtgtgtgtgtgtgtgtgtgtgtgtgtgtgtgtgtagtttctttaatattacactcaaatgctttttaccatttttatgggtaactttggcaaagatgaaaattgtataatatataatgctggtaattggattgggaaagaaacactcaagatatgctgctggaggtgcaaatgcatacaacttttttggcatgggtaggaaaaaattcagtaataagaatcaaaagctgtaggaaccaaaagccttaaagatgttaattcctgaaactctataggttcatatcaagacatttatcctgtagaaataaccctgggtgtgtgctaaaatttagcttcaaggatgtgttatcacagtattttttaaaaatagggcacaagaagaatggaaacagtctataatagtggattgattaaatgatcatatagcgctattatggaatactgttaaaccactgaagataatactgcagaatattgaatgcctgtctttgtctgttttgtgttgtgataaaggaatatgtgatgctatgtaatttacaaagaaaagagatttatttagattatggttcttcaggctataaaagtactatggtactggcatctgcttggcttgtggtatgggcttctgtgctgtgtcaaaacatggcagaaaaggtcaaaagggaagtgggcacatgcaaagagggaccaaacccaggagtatcctggatttataacaactcatttttgggaaaaataattcattcccttgagaactaattccatttcacaagagctagaactcactactgcaaaaatggcaccaagtccttcatgagggatctgcccctatgactcaaacatttcccactaagccccacctcccaacaccaccacactgaggatcagagatcaacatgagatttagtgagggcaaacaaactgtatccaaaccatagccatgccatagaatgccacactttaaaatgaaaggcaaattattattgccatttgttcactgctttataattttaatttgtccctttgattgcatatttttattcttctgtatgactaagaaaaagggcttcttgtcccctgccaaagagttgaaagcatgccagagaagtgccaccatccaaaacatttctcttgctgtctagcattccatcttctgagttacaatgccttggtccacttataatttggtgagatttatacatccatttaaattttcattagctggatatggaggtggatgtaaacaagaagcattgattagatctagaaaaggtggtatgtggacccaaagaagcaccaatagataacgctgtagacagacttggggatgaaactgttgtgtactccctggaattttgctgactcagctgtggtgtggtgtgagggtgacacctttagaagactgtccaggtctctttggagtagtgtgtgcttgtcaagtttacagcttgtgggaaagggtaatcagaacatgcaaaggctcaatcaacctttactgaggctccctcaggcatggtactcaggcttcagggcccagagggtacatattgaatttcactttgcaaagaacccagcattagagcctggaccccaggagcttgggtctagtggagcagttgagcagccaaaaggagtgttgagaaggcagctttaacagggcatatgtgttcaatatcaactgaattcagaaggtcaagctgctggagttcttcatctgattaaccttcatcattcaaatattctgtgctatagcttttcaacaggaaattcacatgtacttaaaatgtactttttttggcccaaactgtctaaatgtgcattgtgttagtttcctagggctgccaaaacaaatgactacaaactgggtgttttaaaacaagagaaatgtattctctctgtcagttctggaggccagaagtccaaaatcaaagtgtcagcagtgccatgatccctgtgaaggtgctaggggagattccttccttgcctcttcctagtttccagtggctcctggcaatccttgatgttccttaacatgcagttacatgactccagtctctgcctccattgtcacatggacttctttcctgtgtgtgcttgtgtctgtatgtgtcccctcctttttctgtaaggacacccttacaaatttagggccctcccgaatccaatgtgaccatcttaactaattacatctgcgaagatcccatttctaaataaggtcacatacacaggtaacatggggttaggacttgaccatatctttttgggagacacaattcaacccgtgatttcaatcactgtttaaatatcccttttggggttactatgttgtactgtacattcctctttcttgcatttttgacccctgtatgtaccatgtcttttgttcataagatgactctgagaaaccccctaggctcttctctggaattcatgatgaagataattcttgggtttctataatcatagaaacagaatgttcagctttagctcccgagagacttcaagtgctggcaatgtttggagggaaaccggatgtgagaaaatggtagggaggctaagggaagatgaggtttctggccatggagctgactagggcagcggtcaggggtgacctattagaagatgagggtacagagtggggccaagaattagagattgagcccaaacaggaatgcagcacatctggcctagttggaggcaggggtggatctccagcagaatatagacaatgggacccatcttggcagacacctaaaggagaaggggaacttgttgtccatgtccagtctattagcaaggcctcttacctccacatcaccatgtgacagatctgttcagtgactcccatttccttcactaaaaccctatttctgctcccacagtctttctcctagactaccaatttccccttctattcaggctacctcaaattgttctccaaagagcaactgaatcatcttttcaagcataaaccctaagttgctgtatgatctggcccctgctcacgcattctgtgtcatcacacctcagtcactctgttttctttatgttcctttaacacaccaagctccttaccacctcaggaacttttcacccgctgttcccactgcctagaactctctgccctcatatgtcaatgcctgattcttggccttctccccttgaaacaaccttctgtgaccctccagtctaaagtggtgcctctccatctctgtccatcatccaattttattttcttcatattgcttaccactatgtgaaattattgaattcatttatgtcagtggttcttaacatggagggattttgtctccccagggcaaatttggcgatctggagatttttttgttcttacaactggggtggagggtgctaccggcatctagtgggtggagaccagggatgctgctaacatcctacaatgcacagaaccaccctcacaacagggaatcattcttcccccagtgtcagtagtgccaaggtggagaaacctatttatttgttgcttttgtattctcaaatctgtgcttaacccttttgaatgtatatcccaagaaagcaggaaagcaaactggtatgtgtcttgttcgttgctctgtctctcccccagaacaatgccctggtcagagttggtgatcaaaaaataattgatggattaatgaatgcgttaatgactgaatgaatggtctcaagccctggatctgtcctttcctagctttttgagcctggggacatgtttttaagtgaattaagccattgctgacctggttcagcctcagtttgaggtaggccctgtatccctgggtctcaggatcagactattacattgtccttcccccaaggatgattccctgcatcccccaggggtacagagatttttcattatctttttcagattacagaaagaattttaaaaatgtattactttagacaagtctgatatttttatgaaattaattatttccatccagcaataggatatgattcatttacttcagtcttctttagtatcatttagcaaaattttataatttattcacatacacaaacacatgcacatatcgttaatgcacatttctgaataaagggattttcatttttcctattgttgtggtccaaaagtagactgttgagttttaaacatattttttgctatatttaaacaattctaattaaatcctttaatggttatgaaaataatagtaatatatttccaagtttacaatttccatttttaattttctttgatcaagtgattttttaagaagaatactgttgtttcttttttatttttaactttcaagtgtgaaaggcttttgttactgttgttgtttctggttattttacaattgtctctttataattactacattctttttaaattgatgatgagctggtctttatattttagaataattttagatttacagaaaagttgcaaagattgtacagataattcctgtataccctgtacccagtttccatttcttctaatgttatcattttactttactgttctctcatcctgttttttatccttgtggtgggccaaacctttcagagactcagctactaaaagatacattttatatttaatatgaatagagaaacctgtatatgcaaacaagaaggaaagttgtctaggaaggaggtagaagtaaagccacattgctgtttccaggtttgcaaggcccagttcaaaatgagaatgcagagccccttgttcaagaaatattaagaatttcaagatggcagcagcagagcatttaactcagcacagagccctttgtactgtgaagccctgagccactgcctggtttcatgcctgtgaagctacccctgctgttcctacagttgaaagtaatctttcaacttcttccatgatacaaatacctcagtaagttaagggaaagtgtcctgcacgaccaagctaaatctactcatatttgagtttttctagaacactcaaagtcacaagctttgcagcttgcctgccttctaaatctaagttcaaaaggctttgagttgaggacaatagtattagctaccctgaaatggcagtgaagctaattctaaaataacatccacattagctcacacaggctgatattttctttgctgaagatcaggcaaatggagtgtttgttttgagtgccttccaataatacttacaagtagccaagaatgcttgggctcttggaaactgtacctatgcccagaggctcttggtgaatatatttttttaaccaggtttactcatttaacttgtccaaatggggcactttcacaagggaacccatcagccagtcatttctgatgaaataccaaaaggacctgtgaggaaatgaaatacgagaggtcttggtaaactgacattttgaaagtatctgggaaatacattgctggaaattggtttagcttcatcatttatttatcaatgttcaacaacattgtatcttgaaatttgagggtacaatgtccacttacagtatttggttaactgtgctagccagatagcaacatacctacaacttacaacatacacaccatatgtactacataattccagttaggcccatcttcccttctgcatcccttctgcactgatgttctattcatcatggtgaaaaaaaggtatcctggatctgaggctgcttcctcctgtttatgcaacatgggcactggctctactgtggaaccgaatcccattagatagaacagatgtacccacctctctctcctgcctcttttgactcacaagtgtgcccccctagtttctgggaattaactcccactgagagcaaatggacaggtgacctatgagaatgacattgggataggcttttcttctgctattattcccttccttgtatgtaggcattgtgtgcaattagcgtgaaaatctaatactttacatcctcccacccttggaccttggaccttagttcctgggttgcaaagaggtcccaggttggaccttagttcctggggtgcaaagaggtaattgtcacttatagttttgggctgtattttagtggattagagttgttagaagtctgcaagagatttcaagtaaaagactcctcaggagactatgtcagcattctatgggcatatatgcatgcacatatctatgtaggtatgcacacatttgagtatagtatggtacttgtgtttttaaaaaatcaaatttgtttaaaacagtacagaatacgtcagttcaaagagcaaaatagaaaagtaactaattaagtttctagaattagaaatagaattgccttaaagattgctttgaatcatttatttttaataacatcatcacatttgttttctaagaaaggcctgatttatgtgcagattatcttcctagaattctgacatagtttcttaaaaagcattatcatattctaaaagacttaatttttgttgtgtcttagccagttcaggctgctctagcaaatgccatagactgggtggtttgaacagtaaacatttatttctcacagttctggaggctgggaagtccaagatcagggtgctggcagattctgtgtctactaaggaccttcttcctgatttgcagatgcctgccttcactcatatcatcatgatcatctctctcatgtttcttctacattagtgtctttataagacatgaattccattcatgaaggctccaccctcatacctaattacttctcaaaggttccaccctcaaatactgtcacattaggtattaggccttcaatatatccacttcaaagggatacaaacattcattgcatagtaccttgacataactacatttttgtggctttccctttttgtcatttagaaattgccacttagcatcaattctgtgtttcggactttgttggaagaaattttctcaaactggaaagcaaaaaacagattagaaaatgttttctagaagtcatttcagatattttaagtacttctgctactaaacagataccacttgattaatatttttgccaacaatgtccatctcagataaatgttctttacattttaaaaatattacttttcattaactattgagtagattcaaaataaaatttgtggttaagaaaagaaggacgtgatggctagaacactagaaggtaccaggatttaaggaacagaggtggaagagaaaaagccgatgaaagagagaaggcagaaggctttagaaagattactgtgaaatgaaggggcaggggctgagctgcattcagcataatttcttcaaatgtatcatccaggttactgattcagctatgcttaatctacctttgaaactgttcgttgagtttcatttttgtttcatttcttattatattgaaatgtatacacacaaaagtatacaaattataaatgtacagcttcatgaatttgcaccaagtaataacagtcatataactagcaccctgatcaagaaatagaacatcattggaatcctacaaacctcccttgtgcccaatcatgatctccaacccaccatctccaaaggttgctaatattctgacctctaccaccatcagttagctttggccatttatttatttatttatttatttatttatttatttatttatttattcattcattcatttaagacagagtcttgttctgttgcccaggctggagtgcagtggcacaatcttagctcactgcaacctctgcctctcgggctcaagtgattctcctgcctcagcctcctgagtagctggaactacaggtgcatgctaccaagcctggcgaatttttgtatttttagtagagatggggttttgccatgttggccaggctggtctcaaattcctgggctcaagcgattcacccatcttggcttcccaaattgcttggattacaggcatgagccactgtgtctcaccagctttggccatttttgtactttatataaatggatatctacagtgtacccttttgtgtctgattctttgcttatcgttatatttgtgagtttcagcctcagtgttgcattcatctgtagtccattgctccttgttgctttgtggcatttcattctatgtatataccataatatatccattctactgtgatttgtgttaagagttgttttcacttgcaaagtttaaggtaggaaattttcctgcctttggttgagagagggctgttctcccttaccataaagatacatcctttttagagacccagagtgtttttttttgtttgtttgttttgagacagggtcttgctctgttgcccaggctggagtgcagtgagccatgattgtggtgagtgctaccacatccagctaatttttaaatatttcgtggaaatggggtctcatcatgttgcccaggctggtctcgaactcctgggatcaagcaatcctcccgcctaggcctcccaaagtgttggggttagaggcatgagccaccatgcctggctgagtcccagctttatgggaaggactgtcccattcaacttgttaccatgggcaagcctagaattcgcattttgtccactgaatcctgtgaggtcaggaaaacagaatttagattcaccacattcaacaaatgacttcaaggcaagcactggctgtagggctgcaatgttcttcctgattattttgagacataagtgttctttacttttttgtccactcatgcatattttaaatagggctttaaaatacattatccaacatccctagttgttttctgtggaaggctggtgtgggtattcattctgccttactgtaagaaacatatatagacatgtactttaaaaatgccccttgtgtttgggtgtggtggctcatgcctgtaatatcagaactgggggaggttgtggcaggaggattgcttgaggccagggattcaagatcagtgtgggcaacatagagagacctcgtctctacaagaaacaaaaaattagcctggtgtggtggtatgtgcccatagtcccagctactcaggaggctgaggtgggaggacagcttgagtccaggagtttggggttacaatgagctataattgtgccactgcactccagcctgggtgacagaacaagactttgtgtctatagagagaaacaaaaaggcccctggatttgtgaaaccaatgtatctattataaaatttaaaacaagtgaggtgtggtaatagtttttttttttttcatattctttctcaacctatataaggataccaaagaggttataattttttaccgaagttgtcctcttctggttttgtttgtggagagtaaatagtttatttcaaaggcttagacttgtgtcattttaatatttccctcacaaatcattttgagtgattcatgcacaaaatatttttaggagctactttttacattgttttgaggtaagcctttatgggtttccaaagatggtagtacaggagtcaggagtgaaaggaaatgtgtactctacaaagagaaatatgatcattgacattcaagaggcccagaaaaagtgctctgcaagttcaaaggagaagtttacttccttttgagtggatcaggaaagtctctgtgtaggaaaagacatctgaactgggcctcggaagatgggcagggttaactgttctcatggaggaggaggaagaggaagaggaggaggagaaggaagaggaggaggaggaagaggaggaggaggaggagacatactcgtctgcatgagttcaggtaggaaaatatagttgagtttgtctggaagaatgcattcatagatttagaactgtgctatccaacgtggtagccactgactaccatgtggcttttgagcacctgacatatggctcatgtgactgatgaattcattttaatttaatataatttgcaatgaagtgaaatttaaacttttaaaaaagtgatgctgtgttcagtttttggaaaagttttaagtacgtttggaacaacttgggtatgtgaatctattcttgcaatcatatattttatgaagtctaagtccagatcaagtatttctaatgaaaatccactgtccaaattgagatgtgctgtaacaatgtaaaatatcttattaataattatttatttacatcaattccatgttgaaatacgatttgggatatttgggttaaatgaaatatatagttaaaaagtcagtttcaactacttatttttacattttttatctgactaccagaacattttaaactacatatatggcttgtatcacatttctattggacagtgctactctacagagaaggttgaagcataaaatgagagtgtcttgggaactttagcaagttacttatcttctctgagcctaagtttccttatctcctgtggtttttgcttcatacaagtattgagagggcaaaattagagttgcacgcaaagcccatgttaacacagtaacaacgggctcaataattgggtatcattattcttttatttaaagggataaaaaggtagacaagtaagttctgtagaaaagggaagggacagtgagagtatctgatttataaagtatgtaatggcatgggcagttataaggatcatagacccgaagatcagtgagtaatgagtgatgcgtggcgacctggcaaacaagattaagaaagctgaaagataacagatgaaccgtgagggatgaaggtggtgcagtcagaagattgttctaggcttggaagccggttctgactttgccgtggatagatggggaagccagctcacttactatgtctctttgtagcatctgaagaatgacatggccagaccaggtggccacccagattactttagggccaggtatttaacttggtagaagaaatggaagacaaatttttcataaatgttggtgttgctccttacatgaagctcattatagttaaggaaacagaagcattttatctaaaggtaggtctaaggaacttgtgatgacgtattgaagaaaatgagcagtgaaaacaaagaggaataaagtcttgaaagaagagattggcacattctttagctttgcagttgaacttgcttggcaattactggagataaggaaaagaagaagggtttggccaaggtttgttaatctttataaacaggcaggaacatcctgtgccttttcccctgtaattacagtttatgaatatttgtttgagtgttaggatacttttttctttgccttttgatacatccttgtgtgtactccttgtttatctgtgacttagtttcagttttcatgtctatgtgcttcagaaagtcagaaaaattaatcatatgagcttaaaatgccgatcaagaaaagctcagcaagatacattgtattgaatgcagtgatttcttttaaaataaaatattaaataatttctgcttacctggaggtaagggaatagctttgtaaatattccttttttggagaaagttccactgtggtttatattcagccacaaagagggcatgcttcttatattatatctcaaggtggaattcattttgcatgtaaacaatgtgtagatgaggatgaggtttagccgcatctatccaaaaactcaaagtaaccatagctgaaaaagataggaagttattattttctgatttagatgagactggaatagtgacttcacatttacctgggacccaggtttcttcaagctccctcctccatcttcctagcacatgtctttcttctgaagggcatttcatggtttaagatggctgttgctttggcagccaactacgaagcagttgacttataattgaaggccatgttgtatttaaagaatgtatgacttcgaacactaaatgcggttcatagtttagcttagtgaggtgctgtctgtgggaagcacgcaaagacagacaccgactgaacaggcagttgtgatgactttaatggaatcacattttcaaagttatgtgcactcccagggggacacactcatgagtgcaatgtagcatgtaatcaaatgtttgaattacaggctgggttcagtggctcacacctgtaatcccagcactttgagaggccaaggcaaagggatttcttgagtccaggagttcatgacaccagcctgggtaagataatgagaccccatctctacaaaaaatcaaaaagttagccaggtatggtggttagtgcctgtagtcccagctacttggaaggctgaggcaggaggatcacttgagcccagaagtttgaggctacagtgagccatgatcgtgccactgcactccagcctgggtgacagagtgagaccctgtatcaacaaacaaacaaatgaaagaacaacaacaacaacagaaaaccacaatagttgaattatgttttttcataggcattctcccatttttccctccatcctccctctccacacgccccacccacaccttttccagaacacccatagttgaattcaaggtagatatatttgcacgttacgtaacttcactgtatagtgaggtctccctactcctccaacaccaccttccactctgctcaggtgatctttggatcctgcagttctgtactggatgcagaaagagagaaatccaccaatgctaatgggagacacctaaaaggaatcataaagtaaaaagatggatacccagatttctggctgggacagactgcatttctcagccatggggcagactgcaagaggagagatacaagaatacactcaagtactttcaagggtctcgccactaccttttaaaagccatttcagtcagccatgcagttagtggaaacgcctgtgacagtctagcaaagtgctggcagaggtccagtttttgctcacactttttagctttgatggtgtcaccataggtatttgagtttaaaagttggaagcaaatgcatcatagaatccttaccacacaacattataaatttgaatcccatgcaggtaaagcctttatattggatttgagggatgaaatggctgctttctaagatttggagaatcagaatgttatcccaaatctcattataaaaatcaaattaatcgatttggagtgaattgtcaaacacagcacgatggtaatgttttctttcttgattgagtcattaaactacaaaatcgctgctatgtttctattctgttattccttaaccacagctgaaataaatttggaaagtgttttcagacagttgggatggaggaaacacaaggacgccattactacactgtacaaacaatgcaaaggtcgctttcccacatcatcccaaggcttgctgttaatctgggacaaacacagttagatattttttgatggagagggcattgtcgtgggtggagaagagatgaggcagttcccttcgacccagctgtgactcagctcaggtcacaacttgtggccttaaatctcaaagagaattagatgtgtgtgatttcacaagttggactttcttttattgaacctatttctaaagcacaagaaggaaatgtgcagcctaccgtgcattaaaaggccagtagacactcttactatctgtatcccctggttccttttgtgtctcataaataaaatatctctacaaaaatatggaaaatatcctcgctctaaattaggaaagcagccttgctttaatttccttctctgcaagttggcagctgggtaaaagaaaatattttgacttccagagatgctattgtccctccttcagcctccctcctagccctgggcttcaggcagtctgcagggtgttctttctggccagtctctggtcagatctgatatgcttcttcttgagagaggcccctgtttctcagccagcagaggctgcagtggggaagagttgctgcctgcaggaagtctaaagtccagtcacatctttcagctccatccttagcctacaagataggaatgtggtttccttgataatgttctgctgaactgtcttgtacacaagataatgtttgcttcatcatccctgaaatatgtttccaaagcttcgttgtgatggtcaagaagcagtccgtaccttggagagaggcccggggaatgaaattcagagagacaagtatgtcaaccccaccacctcattcatgtattcattcagtaaacaaagtgtctgaggttctactgagtgtccagcaagtgtgttaggcacttgggggatagaagtgacaaacacagatagctcccccctttgtgtggctacgagtctaagaggtgacccagacagcactttctgtctctctcactctcttgcttttgctcactctgtgtgatcttgcccctccctatctctccaatgatttcttctataactcttgtccttagtcaccacacaactgtcacactgagcttcttactctttcgtgaacatgtcagtaattccttccccacagcctgtatactggctcttctctgtatatgaaaagatttccacagggtgggctccttctttgtttgtctcttcccaaccagcttgagttacgtgagatcacttgactggttttgcagcatggactgtgaatggaagtagcatgtattactttctggccaagaaagtaaatgaccctccagctctgtctaagcaatctgttaagatggtggcatctcagtttggaggaccctcgctcagctggagtccattagtaactacaagaagtagagcccccgaaaacccacagcatcactgaaaaatatgtttccattgcattaagccagtgaggctccatggttaatttgttaccccagcataaccttacctgactaataaataagctcatttgagtggagtagacaccattattattctcactttacaaatgaggaaacaggcacacagaagtaataatctacctgtagtcacacagctagtaaacagtagaactgggatttgaacccaggtagtctagctcctaggactgtggtaaactgcacaaacaatgcaggaggaggcacttaaatataattaggtccaaccaagggaagtacggtggaaaattccagcctgaggaagctattctggagtggtacacacagcaggatctcaataaatgttaaatgaatgactggatctttttaaggagcagtatattcaattgttttggctgcataagagagtaccacctagtggcttaaaatagcacacatacattatcccacagtttctgtgggtcaggaggccaggaacacctaactggatcctgcactcaggatcatacagggtcatacaagggtcctatgaccctaagtgaacgtatcagccagggctgctgtctcatcttcagctcaggatcctcttccaagctcatgttgatggcaaaatctagcttcttaccattgcagaaataagatacccttttcttgccagctgtcagccaggggttgcactgtgctcctagagtccccttgaagttccttgccatgtgaccatctcacaggccctctcacaatctggcaacttacttctcaaaggccagcaggagcatctctctcctgtaggctactatggagtcttacacactgtaatataatcataggagcaacatcccatcacctttgccacagaaggtaacctaatcaaggggcagactgttccatcatattcccaggtcctgcctacactcacatgggaaggggttataccaggtgtatataccaggggatgggaatcttgcaggccatcttttaattctgcctatcaaaagcagtgaacaaggatcaactataacactttttttttaacactaattcattggctactcactattaaatgcacaacctagggctgaagtctgtgaatggtcacatattaaatagaccatgtaagtcacacctcaaggaaaagtaagggagttaagacaaaatacagaactcacacttggcccatgaattagaaacttgagtaattaaagacagatgttctgtagggtaattggggtgaatgaaactggtgatttcagtatatgcaagctaatctttccagaaccccttttcaaagttcattttattgagcaatagtttaataaactgcatccatttcaagtgtacaaatggatgaattttgataattgttgtgaaacgaccaccacaaaacaatagctaaacatttccatcaccccaaaaatatatctgatgccccttgatagtccagatatttctctacaaccccaactcccaccaggtagcctttccagccccctttaactgtccttttaattaaataaaggcagtatggtacagtggtttggcactcaatacttgagtcagaatgtgttgtttggatcttcctttccctactttcttgctgtgtgaccttaagcaatttactaatttctgcctgcttcagttttatctaaaaaataagatagtgcttctctgaaagatagtcatatctcgaagaattcctatgagaatcgatgtagttgatagatgagaagcctaagtagttcttggcacatcatgagcactaaataaatgtttaccgtgttttttattgttattgtcaatattgttcagttcaattaaaaagccactataaagatggctagtagaagttaatgttcattaaaatatatttatgtcttttcctggagcactcttcccccagatataagtactccaactccctcctcttctttgaatattttctctaatctcaaactctgattgaagcctaccctgaccacattatctaatactgcaagcttcctcaccccaccccatcccacctcctctttcctgatgtttccctaccctgctatagtttttacttctccttagaatttatcaccattaacatcctaaataatttacttatatattatatttactttttattactatctctccttattagaatgtaagctccatgaggacagaaatctctgcctgttttgtttgctgatgtaccccaggctcttagaacaatgcctagcacatgatcagcgctcaggaaatacatgctaaataaaagaaattggaacctgtggcctaagctttatttatattatcacatataactcttaaaacaaaaccatgagatgtagatattatcactaccttttgataaatgaagaaaataaatcttggagagatgtagcttgtcacaatatacacagtttagttggtgctactccaagacatactctttttggctgtagtataccatatggaggagcttggaggaaccctagggtggatgtgacgagtcagacattgttgcccagctctagtaacccacaagcaatttgtgtgtttacatgcactggattttggatccactggcttatgccaagccaattccttattcctgccctgctgcttttgaaagtactggagtggcaagaggccgaggcatatttttgaaggatgagctcattccctggcccgcagccttactaaagtcttcagtaaatctattgaatctatggcaggaggttcagctgcatcaaatttaggattatcttgctttaatacagctaagactgcagaataatgaagatttggaccatcatataactctgaatcagggaccatcttaatacaggaaagatctttaaagtatgactcccttccatttttttaggctgtgtctacacatcacaaagtaaagatgtcagttatggacactaactgatgtgggtttatttctttgctctatctgtcttggtatggattttccagaactagaccctgggaccaggaattgagttcaggtagtttatttgggaggtaactgcaggaacacagtgagaaagtaaggaagacaaggaaaggaggaaagctaatagaagctatgttaatgagttggttactgctgtgggaaagtggggctaaatgcagctgagggcctgtgtagaacacaattcagaaatgtcccagtgaggggtgatgatgcaggggtattatgccatcatctgtaaccttttctgggcccttacctcccctgcacttccagcctgaccagtgcaggtgacctagtagacttccattgccggagatcgccctggagcagtttgaatttaggggagctgtctgcagctgacctctattgaaaggcagttctccatgtgtcgctggcatttctaacatcttgtgaacagaggcactcacacttttggaatatcttttcaaaaatatttgtttagtgaacagtctcaagagggatagaggtcatgtctccctctagagagaagggcaggtttgttttctgtccctaaggaagagaatgtcttccttagggacaaaggttaggcaaacttaccatccatcacaaaagatttcggttctctaagctcagagatgatgtcctgtaatgcagtccattatgtgagcaggtgtcacctgactcccataagtcaccttgtagggactggggcttggagggactggagcaaatggtgatgctctggctattactattgttgtgaataatatattgtccttgatcttggactcaggtgtctcatgtcttctaacagcatccatgaaactggcagaatgactcattcgcttgaaagtagagtaaaatttcagacctatcacagtttttggggacctccatggtggatctaggggatatgcacagggttccagctgtgactaccaaatgctatgcttcgctctattgatagcagtattaacaggatagtacaaaatctctgttatgtcctgcatgtttgattgagcctcagacctaagcattgtgttcctctaagtagaccagccctcttttaaggataaaaataatattaggggcaaaacctatgagtgtgtagaagtatattgcctattgaatactcactatatatttcattttttcaaggcaagacacgttttctattttgtaatatttggaatagaatagattcactgattagtgaacattgtaattattcttttctgaattaattatgttgaacacattagaaaattgctaggattgtcttttgtaatggaggtttcatgttgtttccattttcaaggagttctctcacgtactgtggtatgcagagaagggttgtcttctgctgggcccaaggaggcatcagtgggcttgccccacctccaccccttgccactggttaagttgggtaattgaagttctttattctatgaggccaggtctgtcatatatcacaatttcaccaatatgatctggatctgtagctaaattctgtcccatttcaaagttttctttgttctttcacccttgtcacattcttttaatgacattgggcagggcaggtctctctacctgttttttgttttcctcgaagaaaatcttggacacttggaccctttccttagcaacttcaaaggaaaataattagtttggattttgattgaaattgtaaaaaatctgtaaaaaatggggaagaattaacatcattattgatattttgtcttcatattcatgaacatgttatttctctcattttacttcaggcttctttagtggcttacgatagttaaaatgtgtaattttctacataaaatattgcatattttgattttgtatggtatattatatattattttgcaattataaatggcacagtttttaatattacagtttacaactgctggctgaaagtttatagaaatgcactttgcttttgtatattgaaattattgcagccaccttactgaactcttgttaattctaataatttatctgtggattctcttgagttatctatgcaggaagttatatcatctgcagattataacaacaggttagaaattttaaaacactttcacatacattatgccatctgattttcccagagcaagtattatcatctccattatagaagtgagaaaatagatcaaaagattttaagtgacctgccataggtaccaggtaccaagttattgaggtagaagaatctagtctcatgtcatcttatttcaatccaacactgtgcctcctaaaatcactcaccttgaaaaggagatgaaaactacaattggagagaagccacggatagtgggggtagatggaaaagaggaaaataatttcacttaccatgtgaacatcaaaatatcatgaattggctaagtcttgatttattggccatagggacttacagactcctttttattttttcccgtttgcaaggtttaatattattggtatgtctataaaagtaaatatttcagttttgtcccaatgctactgaagtaatgaagtccttggctgcaattacacaactgtggcaagatccagctactgcagttgtaatggtggcctcataagtggtaggaactagtatcagtaactattctgcctctcataatgctttgtagaatgacaaagatgtcaccaaagagtctatgtttatgtcatcagaaccattattgcaaaaagaaggtcaccatttcttcttttgtcttcactctgcaaaatctgcaaaagtactttagagtttggattcagtaagagtatatcccatttcttcctgtggttattttcaaaagaggcctggaaagcaaatagaggaatttccatttagtaaatataggaatttcttccactgccttggagaatatgttttctctccaatgtcaagtagatatattggaatctacccattggataataaggaaatagagtctaggaaaactcaagagcaattaagtgttggtttccatgtttataataaagatctggcatctccccaagttgtgcttgaaaaaaatatgttttgttataaagccaaacagctcctattcccaggtagttcaatattggttcatagtctgcagtgattccaattatgaaaccaaactggattgaggtgtatatactgaataacaaatattttacaccatacatgtcctatgacatgagatccgtctcatcccaaatgctatctaaaatgcccagtgcacaccaagaacctcttaaattcccttgttgaaccatttgtttcatatggaagtgggaattacggattttcaagcaggacttctggttgtcactcacatgaggcagagctagactggctgtccaatcagtaaatgaaatgatataaacctaatcacctccaagacctgaaaaccacactccttgattcttgccaatacaactccatatggaaacttactatacaaaatactccaatgaattcaagtgccagattgttggaaaccttccttaagaaaaaagaaatctcttttattcaggtaattattttctttaacaaagacaccctcagttttatttaaggggcttaaaattaggtgtcctttctctttttctttactctgaatgcttcaaggaaagtattttagagcttatattttagagtgtgattttatagaaaaggagcttcatcgtggaaggttccatgcaaacccactaatgtttgaaatgatcctttaagaaacagcttttggctgggtgccctggctcccgcctgtaatcccagcactttgggaggccgaggcgggcgtgtcatgaggtcaggagatcgagaccatcccggctaacacggtgaaaccctgtctctactaaaaatacaaaaaaaaaaaaaaaaaaaaaaattagccgtgcgtggtggcaggagcctatagtcccagctactcgggaagctaaggcaagagaatggcatgaacccgggaggtggagcttgcagtgagccgagatcgtgccactgcactccagcctgggcaacagagcgagactccatctcaaaaaagaaacagctttttttggtttctgggacagcatgagacaaagccaaggaaagaagatgagaaaacagctgaagtgcaaaaccacaagagatttctcaggaagatacattattaatgcatcttaaaatgttatcattaccaagactgagagttgacatgtatgtttgcaggctactttgcttactcttcttttggaaatactaaacaaaacaaaagcaagtggattgataggcttttttacgaaccttgctgagcaacaatataccttcagagggctggggatgtatcatgtaactcatgtgtggcttagttttagaagagtcaagagaatactattggtacaaccagaagtaattttaaaacaagtcatttacttgaacttcttggaaacaactaaatatttaatacccagaaatattgcttacaatgtcttctttcctctcccatcaccatccttaaacactataaccagatttgtacctctttcaagtgctcaaaaatctcaagtacaagttttgcaagggtccccgttggaggccagggcaggtacatgctgaagctggacaagccagaagatctttaacattctggagaagggagtatttaggaacattcctaagaattatatatatatatgctatatatatactatatatatatattatgtatatatatagtatatatatgctatatatactatatatatattatgtatatatattatgtatatatatagcatatatatatattatgtatatatatagagagagagagagccaattccacataaaactgcagaaaataaatgtaataaatcccaaatcaaattttagcttgaccacttctaagttctgagttgacaaagtgtagctaattatttctgggttttccaaatctacactagtgtttccttattttgaataggggcttttaataaatgcctttaataaatgcttttaataaatgcccatgtaaggatgcctctaagtcagtcttgcagcatatattagtgaggagtagatttggaaaacttgactttccacaactctgcaagactgagaaaaattgtagaattcatttagcttctgtttggcttccctttgctatttatcttaataactaagtgagctttctgcccttggacaaagcccaggggaccagtcacacagagagattcttgtgtgcaaatgcctgcttctatgaaaaaatctctgtagagtaaaattcattagctgtcatggtatgtgagcagaatattgaagttttgaaggttgaaaaattcaattatttgcttgttgagaagcatgcaattcttcagaggtatcattctgaatggaagtttttgtaaaaagaacagtaagcatagcatcggtcagaagagccagatttctcacttttgtatgatcttaggaaatgcaaccactcaatgtgtttccggatattcctctgattaggttctgtggatgaaactgttacatggactgtaaaacattgtagaaatataaaacatggcctggtgcggtggctcatgcctgtaatcctagaactttgggaggctgaggtgggcggatcacctgaggtcaggagtttgagaccagcctggccaacatggtgaaaccccgtctctactaaaaatacaaaaagtagctgggcatgatggtgcatgcctgtaatctcagctactcaggaggctgaggcaggagaatcacttgaacctgggaggcggagcttgcagtaagccgagatcgtgccactgcactccatactgggcgacagggtgagactcagtctcaaaaaaataaattaaaaaaattattattctcatttatcatgtacctagtccataatagacatctaatagatattccttgaatgatttaatgaatgaatgaacaatgtggttactctgaacccattgatggaatatttaggatttcagattgcatccatactaatattatatctcctgccagaagtctggggtcaggggttgatacgtaattgtggtttttcttgttttcctaatttttgcatgagtttcttttgttatctgttgattttcatcttaagtgtcaaacataaagagtcatttcaattcaacagacatttattaaacccttattaaatgccagggaagacatcatctctaccttcaaggagtttccagtctagcagtaatttcaaacatgtaaaggagtggtattacagtggggcagattgttaccaaggtgctatgcatcatggagaaagggcattgtcttactctggggagcaggggagtgacacctgtgcggggtgcagaaggtactgtagacagagtgagcagcaaaagcaaagctgaaagtatagatgagtgggggttgtgagtctccagaatgttgttcttcagaactgttacttgtattgctagattcgctttcatataaaccctctttcaacttgaggaaccacgtttgaatatttatcatcagttgtaactaaggttttacttcttgaactgtaatgcttgagtggactgattgttctgtgaaagcaattagcaaatcaagtcagatggcaccagaaagctgcactgtgaactcaaggggtacagaaaatatactccggctttgttgctatggtaacaagtggttctcctgcgttttagttccattataggccatggtgataacagtttctctttgggtaattatgaaaaataaaggagagagaaagaaaagccacatcttggtgtttgcccctgcgtctaacagctgcattttattcctgcaactgttaagggtattggaatgaattcttgtaaggggcagctattgtgataactcttccctgaggatccatgtgacattggctttatgaacacttccaatgtgtgcaggttacagggaggctaagcatccctgggcaagctatgctgcacagccagatccacgaatgggaatgctggggtctctcacctgcactcatattaacagccctcttggtaattctccagcaagatgccatcctttggaccagtggtttgcaacggaggtcagcggtggggaaatgggggaggattttgccacccaggggacatttgataatgcctggagacattttgattgtcacaacaatggagggaggtgtgcaaatgacatttagtggacagaggcccagggtactgctaaatgttcttcaatgcacaagacagctagcaccacatggagttatctgcccacaccggttcatagtgctgaagattagaaaccctgctttggaccatgattttcatcttttggaatggctggcattcaggaagtactagcagaaccagtgtatgaatctgatgctgtaaaacggatttcttcggggtgagttttctgtgacttcttagaggatgtcggagatgttcagccttggaagaacgtgcattacaaagggcaggctcaccagagccctgcagtgaagggctcatctcacactagcatgactcagaagcccagcaggctcaggtgctcagttccagaaaaacatttctcttctcctcatattgtattacttgtttagaatttcacgtaggtagctgagcacgttgaaatgacacgtttgttgtatttagtttgaacaccatatgttgacggggctgcaagcccaacaagctgtttttttataggatttcagctatcaccctttcatcaacctgggatcaaacatacaatagatagcaaaagaacacacacacacacacacacacacacacacacacacacacttattatttgttctacaaaggggatttcaagcataaatcacttatcacgctctatgcaaatatcaacgacctgtcagcttacttcttatttttctgggaagctctcccttaaaggagcaagaacaaactgccttgttgttggtatctaggggctgttctggtgacaactgtgagtgtccatggtcgtggaatgtgcccactcatcagccatttctgtcagggtgaatatctcacctgtcacagggaaaggatatcatacctgtgtgtcttagagtgttccccagcagcattgtggagcttcacagcctgacatttttcttcctagccaagatgtttctgacatgtcagtccacgtatgtttactcccagttttgcctaaggcgcctatgatcactgatgccagtcagctacaaatcatccaggaatccttccaaatccctggaccttgatgcatccatctactaaggctttgttagcacatctccagcagtgtgccagcccctgtgctgaaggatgcagatctaaaaatcaggaagttgtggctcatgctttcaggggaacttggtaagggaaagaaggcacatgtagaaaataaatgatgacttttaatccaagagaaggcatgtacaggggcagcgtagcccaaagaggtaggggtgcattggcctgtgggtgtagaggaggctccactagtggaggtgtgactttagagctcgagcctagaagcctagtgagaatgtgcccaggcgggagagaaaagctgggatgcattcctgggagcacaaaccaatgtgaggtcttccagggactcccaaacaacacacaatggctgcctggatgtcagatttctgttgctaatcagatgtaattgaactggcacttgagaaagacagttttggcagtggagagtaagctatatggattggggcttgcgaaggtggggatggcaggccaaagccagggagaccaatgaataaaccattggtggtgaggacacaaaggaaataaaacgtatagattcaagagagaattctgacatggggcccactagccttggtggcttgttgggttaggggccaaaggtggtgtctcagctggcagtgacaaaggaaggctagtgaagaatacgcttctcatagctttcacaacatcttgttcccagctgccccagagaagtatagaaaccaagtcaacaaaacttactcccagcctcccgcaccaaactgtattgctgcatataaaaccctggaggcatcactggcccctggcttagaaaattggatgaaggtgagacatttcaatgaaacatactttatggtaggagagaagtgtggataatgtttggtatttcacatgataaatttgagatgcctgtggaatgtacatgcaggggtgtccagggagctttttggtaggagctcagagaaagagctaagatgaacgcactcatttgggaggaattaaagactaggccagtggttcccagccctgagtgcatcatctatggggcctttcagaatcccaatgtccaggcccacccccagaccaattatatcacaactatacagcagcatattttaagggatggaggaatagttcccagaaatcgtgctggttctctgtgagagaagaggtaactttaagtggtgccagttcatgcaggggcttgagaaaagaagtggagtgagtacaggctaaaagctgcaagtcctggaagaggaaggaatgcaatggactgatggccaaccagtgctctgaaccccatctgggataagaattgtggatctgtgtctagtctgcatatttgtgcactcattttgccccagtgtacttaccatccaacttgaggaaggagggtatggtggtatggtctgagacaacggaagggcaagaagggtttctgcagctgactttggaatccaggctggataaggaaggcacaaaagtcaagagggactgatgatccagaagaaaatcaagtaaggaggaaggattggaggctgtgctcaaagactggaatatttgaggttaagatttccaagtggtacaattatagtggatgcatgacagagagtggctgaatatgctttgaggcgaaagctgttccaattgaggtggaaagcataagtgtggagaagtatttgtttagtcttcttgtactcctttgttctagaagtctgccttggttattcccaacttccttaacataaaggctgtccaatggtgactgcaagtgttttaacacagctgtcttctatagaacgggttattattatatctgttattttaaaacacccacccttgcatcaataaatatacatgtcaaccaaattctttatattaattgacaattatttatgaaaattgcaatgccttaagtgaaaaatttgtggagccagcatcccttagaaacacctttcttgctagaaccatgtgttcttgctttgtgactgtttgcatgttttattgctaagtctgtagataacattctttcttgaagattattaattatgtatacaagtacccctgtgtaaaagtattcacttggaagagacccaggaatctaaggcaggggccagcaaactgttcctgtaaaaagccgagagtaaatattttcagctttgcagactagacaatctctgccacaactactcaactctgcttttgtaaccttaaagcaaacatacaatacatgaatgagttgtggctgtgttccaataaaactttatttacaaaaataggcagtgggctggatttggtctgagagctgtagtttgttgacccctgatctaagataataaaggactctagtggattatttttgtgggaaggtttccaagttcatattttaattgatttgacttttcagttttggcttcaataaaaccatttaaatcatagtttgttatggtgctatagaaatgaagtaacttgtaaatgatgacacatggaaggttctaactacagatgggtttgtggaaaactaataggtcacgatattctgatgtagacagtcatcaggcttgtcatcttaacttactcccttgaagactcaagtacctcctccctcatcttggagaaagtgcgtgtctgacgctacagtgtcatttccttcaaccatgtaatccataggcacaagtgaaatggtgtaattcaatgttgactagaccaatgacggtattctaaactatttccttatggaaattcagtgtcttctgggaaaactaacattagattgcaaatctgttcctagcatttagagactcctcattaataagcactttttttaatagtaaaatatggcctggccaaaaaaaatctctgacaagatgtgagactcaatgtcgttcttatgatttagaagataggctgaagtgagatatacttccctacaaataaaatagatattcctcaaaatgtcaatcgaagttatgtggtttcattgtctctgtaaagtatttacatatttgcaactaaggcctattaaatatttattattaaggttgccaccctctgaggtggtttgatgtttcagtcagggcccagaggtttttttaattttttttcatcagtcattctttggaattaaatgtgtgcacgttggtaggacagaaaaggaacggaatgtcagctttctgccaacaactcttctggctacaagagaatttctcatttttttttcttttcagtgtgagtcacatggagaatttatctgaggagggcatcaaaagaaggagtgaaaagcaattaaggagaaaaaacacagttccttacatccatgttggtccatattggaaaatgaatactgagtatcatggctggttatcaatttcttttctttctaaagcccaattactgaatttttcacttggaacatgcccagataagatggaacttattcaggctccattcttaaaaaaagataccagaagtcatgatctgcctttctcactctggacatggaaattctcatcacagtggtcagttgaggtgatttcaaggaataatacctgaagggatcctttaattcaggttgtagaacaaaagcccaaacaaatcattaacaataattaacctctcagatgtaataaattacttttcaataagttagtttattgagaaatgtaatttgaacatatataataacaacagtctgacactaacttctgtaccctctgcttgaagcaactggggaactctgactgtggtgtgatgggaagttaactttactcaacctgtgagactgggtctttcttctgaaccaaccacagggcataaggttcatgctgatgtgctttggaatgtgcatggcccatcctatctatttctctagcttctgctggctttaattcagagtttctcaacctcagcactgttgatatttgggccacatgtgacaggccatcctgtgcactgtaggatgtttaacagcatccttggcatctacccactagatgccagtagtgcccaacccctgaccctcgtcacgacaaccaaaatgtccccacacattgcccaatgtcctctgggaggcagaatcaccctggttgaaaccactgccctaataagatgttgcaaagttccagatttgatatcattgaactgatattctaaaaagcattggctacatctgcatgctgctgccctaggcttctcttgacatatttgatctcaactttgcattgagtcttggagggaaggggcaatgtgtgtaggatgtccacacatctaggtttgcctaggataatccagtttttgtctgtcatctggatgtaattattaagtagcaccaccttgaaaagtgacacagtaagagtgaaaattatctggcccccatgtggtcttggaaaatggggaagagttttaagagttcttacaatgtcagaaaacttttaccttgcagaggtttttgatgccttcctgtcctattttaagagcctgggaattcaactatttcatgcccatatggaccacatattcaagtcttcagccttaactcttaacagcttcagtttttgtccaagtaggcaaagtgagctcagacaacaaggaaaagaacagtgcttttaaaagaatgttcttctcaataaaaataaattctaaagttctaagtagggagttactgctgagtttataatggctttcatatttgcttttacaatcacagtattgctgggctcaggcttcctgcttggaaaagtgctttgcaatgcttcagacagaagagaatgattttagaacaggctgggctatgaaacaagagagttgaagaagcccgaagtggtttgaaagcagtcattcctttggtgttaaagataggggaaaaaagattgttcccccttattaaatcctgtcacatgtagacaagagtgcttgttaaagcctcgagtggacatttgcattgtgtggttctctggtgtgtacctttgctaaaataagtatgcaaaagtctccaggtagtaatatgcccttgaccctgtaatcagaatcggtctctcacctggaaatgtgaagacaagatgtttggctagtaatgaaggtaagataatcatgtgggaccacaccattcaaaaggttgtctcatgctcacaagatgaatgctatatttccagccatcatgcccatgtatcagacagaaagaataaggaagaggggagctcaaaagggcatccttgctgagacagcttcccaaaattactgaagccctcaacctaacacttgctctccaatatcgatagttttttcagccaggtatttttaccacctccttcagtattatcttaccaatgaatgacaggagaatggatattgggtagacaattagcaagctctggtatatagcccaacttttgctaatgtttaaaagtcaaaaccacacaaatcttctaaaccagtggtcaacattcgctgcctgtggactaaattcagcccgctgactgttttggtaaataaagttttattgggacacaaccacaccccttcatttacatatggtctgtggctgcttttgtgctgtcaaacagaatagttgtgacacagactgtatatatgacctccgaagtctaaaatgtggtctctctggccctttatagggaaatgttgccaacctctgttctaaacagataactcaatgaaaaaaatgggcagaagacatgaacagacactttacaaagaggatatccaaagaccaataagcacatgaacaggtgttccaactcattagtcaccaggaaatatttttttttttttggttttcttttttgttttgttttgtttgagacggagtctcgctctgtcacccaggctggagtgcggtggcacaatctcagctcactgcaagttctgcctcccaggttcatgccattctcctgcctcagcctcccgagtagctgagactgcaggtgcctgccaccatgaccggctaattttttgtatttttagtagagatgaggtttcaccatgttagccaggatggtctcgatctcctgacctcgtgatccacccacttcggcctcccaaagtactgggattacaggcgtgagccaccgcacctggtaggaaatgttaatttaaaccacagtgggatggcactgctttcccatcagaatggctataatcaagaaataaagagagagctgacaatatcaagcattgcattaatatgggacaactggaactcttgtacattgctggtggcactgtgggttggtataaagactttgagaagctgttgggcagtgtctactaaagtagaacatatgtccccctctgtgatggagccattccactctcaggtatacgcccaacagaaatgcctacgtatattcaccaaaagggatggaccagaatgttcacgttggcactatttattaataatccaaagttggtaacaaccaaaatgtctatcaacaatagaaaagggaaaactgtgttttattcatatgatggaatacttttagcgatgaagaggagtctcgctacctgctacaacatataatattgacaagagaaaccagacaaaaaagactgattctgtggccttaaagttcagaaacaggcaaacagatcaatggtgtttgaagtcagaatatggttccttttaggggtagagatcaggagaggactcttcatgatttgggtggtcgttatacagggggttcactttggcaaaatgcagagttgtacacttatgagttcagaatttttctgcttatatattgtatttcaataaagagtttcaaaaacagaaaaaagaatgcacatctctttaatgatagaaatgtatcagcattgctctcagccagttttctattgaaaatgatgcctatgacatgtccctcatgaaacaaccacataattagccctggccctttggattctagtcttattcacaaatggaataaattttctgttttcagatttttgcatttgactacgtctaccctgacagtgtgactgactaggtggtctcagctccacacaccccatggcaaaaataaaaaggttgtgtctaaactgcagtggattaacccactgagcagactgcgtgctcctgggctttcttgccaaaggagagagcaaaggatgcaaagaagctgaatgtggaatttatggaccctaagaaggcaatttggaaggattttttcccccgtttctgtttagtcttaacttcgtgaaattgtaaagaagtgctggagactgggggagctgtttgtatgcaaagtgttgtctgcctcagttgtgctcctgaattttgactggctgcccagtcttatgtgggaagctgaataaaatgtgtatacttctaaaaaaaatcaattttagattttacaaaaggagtcaaatattattactcccaaaggaagaattgaggcagttttttttttttttaagaagagggtcagaagaaacagccaggtcttttttaaaaatcacccatattttttggctgacatattcagttaaatttgtcccctctcattgatgccggtggggagttataaaggaaagaaaaatattaaatgctaaaaatgaatagaagggatgtaataatccaagaattagggcaattgatgacaattttttaaagacactgctgtaaatgaaatttaaataactgtaaagctagatattcaatccaatagttatatacataagatgtactagttattgtttcataattatccagaatctttcatttaaaaatatcattttatgtttcttagactgtatatgtgtatatgttacgtatatgtgtgtatatatatttcaaatacatatgtgtagaaattcatgagatttttttttaagttaccatcctccaaaggaaaaaaaaaaaacctggcaagtgatgagaaggaattggagctgtgtacaagaatcttagaagatttaggtgatctcaatgcagcctcccaggtctcgtgtagcacctaaaaggatcattttttaaaaagaaatccaaatattagtttaggagaaaacacagaaaatctcatgactctcgattttgtgaaaattaaaatctgacagtagaaagcaaagtggcatggcccctgtgcttgggttaccgctgcttcccaaggggctccttagggaaataacttccctgttccttctcttttttacttggcagtcccaggaggacagttgagttgggggactaggggcattggaacaagtgtgtccttgccaggctcctgtggttggctgctagttgggcttctcactttgtgaaccaaaacgtttggagagtcttgtcttaggaaaagcaaattattctgccccgtgatgtcccttcagtgtggaaacatcaaggagatagatctcactgataacagagttgatcaggggagagtatgcaaagacaagacccaattatcaaagcacagcctttttaaagggttttgagtagattgcacttgttttggtgagaaaccaaattagagagttctgcctcctaaactctacatagactaatgtgttcttgggaagcacccctgctctgggagtcgcatttacctcttggtcatactgaattccttcgtaggagggcctttgatatatttattctgtaaccaaaaatggcagccctgagattggagagcatccctttgatttcctgtggactgtccttttctggagatatggtttgttctttcctaagggtcggaattatgattctgaaaagttttgcttttgaaatactacatcacagtgtcctaatgagaatggtgagccatctgcagcattcagcacttgggcatggcaatcaaatctgggcccgatgaatgattatgttatataaatcaccaggttcctccaggcagcagtcattgccattgtaattgattcctgatgagactgtttcttgatttgctggtgctgtaaccactgatgctgattgttctcatctcctgaaattgtatttagtaacagcattcaacaaatattactcaagtggttattgtatatgggaccaggctctggggttaaaaaatgagtatggcagccctgtctttgaggagacaagtgtttcaggaggaaacagacaagatgagcatcctaacagaggtacgaacaggaagctagcaaagctcctattggagggtggtgaggtgaatcggggaatgtccctccagaaaatccagagaggctaatgggagttacacaggcaaaggagaaatggaagggaggtgacagaggaagtagagcattataggtggagggaaatttctccttgaaaacaaaggaatcacattcaatgtgtgacctagaatttcagtgggcatctcctctggcaagaaattgagtagaaggatggctgcattttggaatgttcaaagtgtggagaggatgctatgtgtactgtagtaagtgcaaaacaatgggttggatttttaaaaattttatgtacacacatatttatctatatagtatgacgtgacatagaagttacagcctgttgaaaagtttatgccataaaaataacaattcgagttcacttcctgtgagtggcctagggtttttaagacaaggaagaataataggatgtcaagggccaaatatagacatggatgttttagaatcctttgcttttctgatctcagagcatgtggcatttggtgtaattgaatccaggacagatgggtgcaagccccattcaactttggagggaaaccaattaacaagcatgtgtccaaatgtaggattaaacttgcaaggcaagcgagtggcttccaataacacttaggaaacactaattagtgagagggaaatactttgtcaaatggtttgagaatagtaaatacaaatgcaacaagggaacattgtttttagttacaatttatattgttctagaagaaatggggctgcaggtgctttctacagacaaaatgaatcccaaatacatttacctaaggcttctagaaataatacaaatgtgtctttaaaagctcagatacataaagcagtagcatccaatttggaagtcctcttgatctaagcagtctggtttctctttggtaagttgcctgtttccagactataaatgaaacaaaataatcactatgttaatagagatgaatatatggaagataatttttttttcttttgggcttataaaactccaggagggaaaagatgaaagccaaaagtagaaaaagattcaaaggaaacaaattgcaattttagttttctaaatcaggggtgggtgaacattttctgcaaaaggccagatattttaggtttagtgaacatgcagttggtctctggcaactgctcacctctgctggtgtagtgagaaagcagtcatagacaagtaagtaaacgaatgggtgtgactatgttccaagaagactttatttatggatgttgaaatttgtatttcatgtaattttcatttcataaaatgttattcctttaattttttccaaccacttaaaaatgtaaaaacaattttactcaccctgtgctagatctgagacaattatctccccacaggtttgttctgttagaaagtccttggttgaaaagcaacatgctttccttttaaagttttcataaatttattaaataatgatgttttcccccactggtgttttcctaggtttttctagaatgctctgtgctctcgtaacactttctaacatctgttgtcatcatgcatttattaagcactcaccatgaactgaaatgctgaggacagacgtcagaggaaaagaaaatattagcaatagaaagtggtacagaagctcctctatttatggaatttcaactcgtgcactttcagagatacaaacaaaaccatactctggagcaaagccctctggctctctcttcaccaccaaaatatgcgtcaagaggttctgggacctcttttattttctgccctttttaaaaagaatttctcatttttcagtctatggaatatttgctgtctttctgctaggtgttgaggaattttgccaggaaccccatcttatgtgataacctcagaggacttgaaagaagaaagtgctagtaagaagtagtagaagtaaaggcaagatagaaacaatttctttttaattgaaataggtcagaaaaactgttgtaagccctttggcaggaagaatgattttgaggacaaagatcccatcatacaacctgagagaagctctgtacttgtgtaataatagcaaacattgatacagagcttctatgtgcctggctgtgttttaagtgattacacgatcacatgagtgtgcatgtacactaatttaatcaccaccaaaaaagtgttaatcaactaatgagctcacgaaatgattgatgaaacagtgaaatttgaacgtggctccggaattagcatcgtaggcctatttgtgttaatttaagagaaggaaacaaatctggtaagtgtacccggtcatggatggttccatgggtttgcagcttttggcatctgcccaaccttaaagtaagaggcagaacagcaatgctattttggagtaatattacggatgctaaagctgttgaggaattccctgtggtgcttgtgggcagattacccatttcagaagattttcggtgtatgaaatgaaacagatcgaatgtaggcaaagatgtcagtcaaagcatttatcagtaaggaggagtacgaaaagaccgactcatacctcacccaggtggaaatctggaggttgcaagcttctaccctgttcaagacctctggacgtaggaacaaggtcatacatagcctttagagcttaacatgtattcaaccaaaaagcacagtggactctgtctgtgctctgcccggaatatctcagatcttttaccagttctgtgtgcctgtcccattcaccagcttctgtgtagttttgcttctaatgaccaacatctgtgagcactctgtggggttctggagcagttgccctatattcacaaagagcaggaagtgcctgggagtttacatcaccctgggggcggggcgtcccacagcccatgactgactgatgtgtgtgaaaatattaaagtccaaattctttggcgaaggcgggacaaagtttagatgtaattaataccccagagcttccctcaggaccagactgagactgggactttgctagaaatcacacccttacttggctttattcccttccctaccctgttatgctcaccccttaccagtttctcctgggaacaggttcttaataaatcaattgcacatcagtctttatcttagtatctgcttctgaggaactctacctaaagcaacaagcacatatattattaagacagagaaatatcgtaaggctttaccttaagtcagcaatgaaatattgaatgaaagaatggactgaatgaattgatagaagccagctttgcactactcatgttgcagttagggaaacagaaaaaggataaaatattgaaacagtgactgttacattttagagtttgaagggcgtatagtgagactgcccacatagtgcagcctctctggctgatggtaatctaggttcagcttacatatggccagggaagaagatactaccacctcctgggactgttgccttccatctagatttgttataaagtcagtccttccttcctctttccctttctccctccctccctttcttccttccttatttccttccttctactttatggaggtaaaattcacatgccatacaagtcattcatttaaagtgaacaattccttggtctttaacatattcaaagttgggtaaccactattaacataaatttcagaacattttcatcaccctgtaaagaaacactgtaccctttagctatccccccctcaactcctcaacccccaagctctgcagtcctaggcaacccgacatctactctgtggatttgcttattcttgacattttgtataaatgaaataatataatatgtggtcttttgtgactgacttctttcaattagcttacaattttcgaggttcatctacgttttatcagtatttcattccttttaatggccaagtaatctttcattgtatggatagatcatattttgtttattcattcatcagttgatggaaatttggtttgtttgtaccttttggccattatgaataattctaccataaacatatgtatacaagtttttgtggacatatgttttcatttctcttggctatatacctaggagtagaattgctaagtcagatacagaaagttctttcttatattcagacaaaatctgagtctccttaacttccacacttggtacttatccagctttctgaagaaatatggacaagactttcttatgtatgacatcccctcaaattattcatcatctttatgtcctccttcaactttcaaagactgaatatcttctgttctttcaatcattccactgcaaaaatgggacttacagaaatgcaaactgatagctttgaggttgtcatattatctgttataatgtacaaaacagctttcttttgttccaaatctcagactttcccatcaacaacagggaacaagtggctaagtttattttgctaagataagagaaaacaaattattttctgggtaagaaggcttttcgatagactctgcatgggttttccctttggaaaatcaagaggactaatgatttgtgtagtttatgtatacatttgtcatttcttgacatgttaatgtgagaaaaaattttgtgcttctgaaaaataaaattggatggaaatcaattatcttaagagctttaaaagaaatcacgtgtagcattctttttattcttagtcatgaagacaatggggagaaaacttgacaaaaccacaggaaaatgtagcaagttacttagcaggctctgggttgtgctgaactgggccaaatgttatggtcatttcttcttctgtagctatgaatggatctaatccttgcttgttagtcatacacttaggactattttccaccttcttttaacattaaatccagagctcaggatggcttctgactttgtctcatgctatctgcatgacgttggacaaatcacccggcctttatgagtttcagtttctgcatcatactaccactacatcagtggctttcaaactgtgttgcacgggataacaaccaaagaatctcactaaaaatgtcaatggtgtggtgctgcaaggaattgtgcaagtaggctctggggaggtcctcaaaatctatttttaaaaacccacccaagtgatgctgatgcccatggtcctgaagaccataccttcaaaaacactgactagccatttccttctggtccctcttcctcttgttctgtattccactgaaagggagaagaaatcttattatctttccaggtaatatcttttcatctgtgctgtgtgcaaggacatgaaggaagacaactaaagttgaaataatgaaaaaagtcccagtctgatgcttagattctgatttattagaattattttgaccataacaattttaaccataaagtagggtttcttaaccttggtactattgacatttgggaccagatcattctttgccttgtgtgtgggaggctgtcctgtgcattgtaggaagttgagcagcatatctggcctctacctagtagataccagtagcatctccccctccctccaagttacagcaaccagatatgcctccagatattgtcaaatgcaccctaaggggcaaatctgcccctggctgagaaccaccttcataaggcatggtccccaaagaaaataatcaagaaattaggcttggagcagttttcttcggttggttcttactgcacagcaaggcaaagaaggccctgctaaactgttggttcttgacctttatgtaccaagcattcctgggggatctggaactccctggctcatcctctctatttgctggattaatgggatacagacagtttaagtgacttggcaggagaaggacattctgttttattctcctcattttattacactcctgacaacgaattcttaacatttgccttatatgttctgctccctatcattatcacaagatagattagttggcggggggaggggagggaaaccaatatatgcaaaattgctttgaaacctgcaggcaccagagtaatgccaggtgtcatcattcatcctactcctgagcctctgaagccaggggtttcttgaggttataaaagtggtttttttaggggggtgactagtcaagcactccaaagaactccagagtggtcagttttgatcacacagatggccaatttttacccagtctgttagccttttaacaacacacagtgttgcgtggagacccacttgtgtatgggtcttcaacgatgggtggagacccagggctcagctctactcttctgctctggagaactttctctttgttttcttgggtggtgcaagacctacttcactgaaagaaaatgtgttgttggtgtgagaggtactgctaagtggaaattattaaaggatgaattccttatgtctgtgaaagatttctccgccttggcactctagacatttgggaccagaactttctttgttgtgaaggccgtcctgtgcagtgcaggatgtttagcagcatctctggtctccacccactggatgcaagtgacacccttcccctgcagttgtggcagccaaagatagcttcagatattgccaagtttctcctcagtggcaaaatttcccctgttgagaatcactggcctaggaggtgtggatgggacaccagcaatctaatgaatgggcctgatttgtcaaaaagaatctccaccttgaaacatactggaatgacctgcaaagagattggggtcaactaccatttacatctcaactccaccatttattaggtatgcaaaacaggttaattaacctcataaataaaattaagatagtcatactttccttcccagttgttctgaggatccagatgtttgcaaagcatctagttgagcctgtgatgtaggtgcttaatgaatagtggaattgttaccatttcaaacaataattctagcacctgcggtgttggcgttgtcatgggaattctgcaggctttagacaactgaaacactgtgcaactgtgcagaagaaaggagattatgatcagaggaatgaaggcaatagactaacattagattatggatataaatgaaaaatcatttcttaattcccaaatggttatttggaaagtcgtagctggagaaattgcggcctctcctttttgcctaatgacccttgaatagaacatatatattagaaatgtctctttttaggcactttttaaggataccctccctggctctgtggcatggagtagaaattcttcagtgaaaatatcaaaacggcaaaaaacaagataaaccaataataccaaatagaacctactgtaatggtcatttatttcctcacccttcctcacttgttttctttccctgaattctcggattatcatattctcgactccaattgatgcataactttatgatattctttgtactagggtttgaggccaaagacaatggtactatgctgtgccaggatgttctcctctctcttctccatctctcctatgtgactgcagctccagctgcaggaattcctccttcactggtcttcagcccagctgtcttcaggctgggggttgtctccttaaacttacctggaaaaaggaatgagaaccttcattcttccttagatttcttctatctccatatccctggaagggttaagagggtgggaagaaattatggctatagagtaaaatgataattcctgaaatggcatatatgtttacagttatcaggctgagattttacccccactttgctgaaattctgcctaatgagatgtcctccctcaaaagcacattcagtgtatccattgctcctgtctgtgcgtgtgggtgaagtcggccttatcactgccaatgccagggccttagcagggctggtaggtccttcacttacaggagacacatgatttcagccaaggagggccttaagctgctactccagctctcctttctgatcctggagtttgatttccttaatttcatctttgtagccccatgaaaaagacttaaaaaagagacaactctaaactgtgttcagtcttcatataaactgtgttcagtctgtttatacaatagtgtaaataaagattctaattaatacagtttggaaaactgttaggcattgtctagtaaagttgaagatatgcatgcctatgacccagcaattatattcctgggtttggaccctataaaaatgcatgcacatatgcacaaggagatatgtataatgatgttcaagcagtgtggttttcagtggtccaagattgaaaaggacataaatgtccatcaacagttacaaagataaatagtaataaacacatataatggagtactagacagcaattggaatgaacaaacaacagctacatacagcaaacatggatgaacctcagaaacggaatgttgagcaaaagaagtcagctataataaaaacatacttatgaatctgtttacataaagttaggaaacaggcaacactaagctctaatatttatggatgcctgacttcctaaaaggcagtggatttcaaccaggggtgattatgcctttccccactccctgggggacatctgcaatatctagagtcatctttggttgccacaattggcgtagggggaataatactggcatgtagtgggtagaggctggggatgatgcaaaacattctgcaatgtccagcctctaccataaagaatgattggttcccaaatgtcaagagtgctggggttgagaaaccctgctgtaaaagggaagtgaagaagtgaagtcatgacagtgtctaccactgggatggaggagggaaatacagccaagggacatgggggtctagggtactagcaatattttaatttttgacctcagtgaaggttagacaggtgaatgttttgtaacaattcattaagctgcacattatatgctattgatttttccatttcaaaatgttaaaaatactccaggggctagattaacaggacaataggatggcatagtgtgggcactgggtttgggggaggggattccccatcttagagggtctcatagtaactctgttaacaatggtggggctgggccttcaagaagggcctgtcctgccatctgaagtgatttttagtactcagatgggccctcagctcttcctacactctgaagttgaatttgcttccacagatttgggtaaagtttttctgaaaaaagtaatcacccttgcattggcattaactgtggaaaattttaactcagcctataggcaggcagaataaatgcaaacaagtattttaatttaaatgctctggcagaaagggcagcattcagttctggaaatgctgtaatgtttagggacaggaagacatggaaattccacagttagcagggcacgttttctcttaaaggtgatgctagtagagtaactcatacagattatttttaagtcctctctggggtgaatgataaacatcagataaatttattattttttaaaaaagaaaaacaaacaaaaaagaacattagcctagcaggctcttaaccaacaaattggatgaacttcagcctcctctgaagtgaggttttatgtgcttcttgctgcctttttatctctctccattaccccaaaggatcaaatgtgcattttaaaaccacatgccatgtcaatatacagtttagttgacctagaacaatacctgtgcatagtatgcacttaaaaatatttataaagtgtggaatgatagacaatggacactcagaagggcagtggggtggatgatggtgaattacttaatgggcacaatgtacattcttctggtgatggataccctaaaagccctgacttcatcaccacacaatctatccatgtaatgaaattacactgttaccccatacatttatacaaattaaaatttaaaatttaaaataatatttgttgaataatgaccaagtgaacaaataacatgggaaggatacttggaagtagagatatgcaaataagaaattttgattagagtggtgttttaaatataccctgaaatatatttaaatgaaataatgaataatgtgtgaaattcaaattgtttaagattgaacagacttcttagagttctgcatgatcttctagatcctttctggagctttgagccttacacaattggactaagaattgaaggaggtggatgattcattccaaggtgatttaagagtcttgcagcatgaactgatcatttctttaggtgctttgcccaatctcacaaactcttcaaacacagagaaaaaacaatcctattgcacttgaacattttactccaacttagctatgacactttagcaataaataatgctagaaggcagaagtcattcctaaaatgtaagtacacagtgtggggctgatggagtatttttggcttacaagaatgtcatttagtgacttactacatttttgaaagaaagaatacaaaccaaatccaggatgacccagttttaagaggtgacttactcaggggtaatgatcaaaaggctatggttaaggttttaagacccagggatccaccttgtgttgtttaaatatattcataattaaatagtatttgtagggaaagggatttttagcttcaggggcttaaaggcaagcgtgatggaagaaaaagtcctaaggctggagtgttcacctttatgaatagaccacagtgaagtgaaagtccctaaactggggcttgtctaggccattgaattacatctgtacacacgtgcccccatcaggctgccctggctgcaattctctgaaagatgccagatggtgaagctcaagctggttctctgtcttattctgaggatctttgatgactttgctctaaaggttgcttttagcagcagaacagagtgagagtaaagagggaactttagtgtgtcatttttcgagctctgcctggacatgtcacagagcaaggaaggcctccaaggtcaatgggcatgctcatttctcctacaaagcagaagaaaggagacttgggtagatcaggctgtgggagaatgaaagacttgggcaaatagttcaattgactttctcataagacaggcaacactgtttggaagttcctgggtttggcaagggattgattttaaatttatttttatttttattttttatttttgcagtataaaatacatgtagtgaagggtgtaaattacactagtctgaactgtactgcacagtgaatgtttacatatgggtgtactctagtagctgccatacagatcaagatatagatcatttccagcaccctagaaggttcccttgtaccaccttcctagtcaataccaccttcccactttggtaaccactgttatgacacctattaccatggattccatttgcctattgcacttaaacatttgaatttcagttgcagaataaataagtgaaatcttacagtatgtacacttgtgtctgatttctttctcccaacataatgtttgtgagattaatccatttgttctgtgcatcagtagcattttcctttttattgctgaatagtattccatcatgtgcacagactacagttggtttgtcatgcatcagttggtgtacatttggatcgcttttatttggggcaattatgcctcaacacagtatgagcattctggtatatgatgagattattgtactctgtatatctaggggtggaatttgctggattggaaggtaggcctatgattgactttagcagatataaccatccagttttccaggtggataaactgtcatgggactatctaatggtagattcctcaggccacttgcacccctggcttcacattcccactgctaattataattatgctgtgattgttttaaaatattacatgccagtggatggttcattcaactaaattgtaagggctgaaattccggggccacatccaactttcctcccctctcctcccctctcctcttacacagagcaagtggagagtcattcagccggttcagtacagtgggaccctgacaaactggcacaagctacccccaagcacatcttccactttgtagccacccctctggggcttgcattgattgattcatgagtctggagtctctactctggccccaggcctggccttcctctgggctcaacttgtgggaggctggacgtaaattacagaaggacaaggctgtggagggaactcgctgatcttctccaaggtgttttaaagtgcaggtttccatgaggggatttcagagcagaggccagttttaagggttattgtgaacctacagaatgtgccctgcaagcccccctggaactcgggtcaccctaagtgaccagcatcctgggcagccttgtccccgcagcagttctcctgggtagcatgacttggttcctctcagtcctgccctccccaagggtccccacaatttgagactctcacagaagaaggctttctagaaagggaaactctgccctcccaggagaaggctctgaatctccttccactgtcaggcccacacctccttcaaagttagtgaaagtctctctttcttggaaacccaagttcgccttctcgctggcattaaaggctttggcagtccccgcctcagcagccggggtcccacgggtccggggagggtggggtggcaggaggcaggcgtgccggccagcctgacacctgtcgtgggcgcgttcggcctccgcagcccccaacagctgtcagcggcggcggccgccggagggacccgccaggagcggaaggaattaaacgcccgcccatcgcatcagactcggccgctccctcctcctcctcctcctcctcctcctcctcctcctcctcctcctcctcttccccctcccccttcgcgccgctgccttctccaggtccccaccggctccgcagcggcagcgggacgctgtgccaggggcgctttgcacagcactcggcacgcacggagcagggctcgcgcccaggggctgccccaggatggcagtgaagtgcggggaactcagagagacaccgtgaccccaggctgagcccaaggcgcgccactcctcccggaggcgacatggggcacccggtgtaccgcggcgagaagccccagctgcactacgcggtgagtgtcctgacgcgtgcagaggacacagggggcgccactgggccgctccgggtggggactgcgaggggcgatggtagtcggggctccccacaggtccacggctgagggggtggcgggtggccgggtacgtcaccccgaagtgccacctgctcactaactcagtggcgcttcccgaaatcttttagaaggtacaggggagccccaaccctgaattcagtgtttctttgccccaacgctgtggtcactgcatctgggacggggctggactccgccaccacctcgctgacaaaggctgacaaatggggttcctggggttaggcctaggtcgctcattcagccttcagtcagatatgttgaaaggacgagaataagactggacaggaggcagggccgcttcatgatctcagtgtgcggcgagtggatttgctgaagaaatgctgccgggagcgttggggtgcagccgtttcactccttagaaagggagtgcatttccctcctactttgtggcgggacagaatgttgcacattatcattaatgttgcacgctaatacaagagaataccaggggctcttctgtcgtaccttccccctcccttatggtggcttctgttctccctgttgatacaaagatttactggggacctactgtgtgccagggactgcgctaggtgctgcaggtactgcaggaaacacaacagagagaaagctcatgggatttgccttctttgaagaaggagtcaagattttaaggttaacgaccgaccaaatccagatactagatgagtatattctttgagagagagaaaagaaaggaaagaaggaaaaaaggaaagttgtttctgaggaatgactactacttctgaagatttcaaatgccccctccaggaagggggcagggagaaggtttaccttattccagtcttcagacattgattttccacgtgtgagatgtgtcgttttgagatgagacactgcagttgttctgtcatctgctaatttactgagttttccttgaattgatttgcactgttgagactggacgttctgactgccaactttaaaaattggagagaagcaggcagagagttgacaagaatcattaatatttataatcaggcaaagacagttaactgtctggaattcgtgtcttccaaaatccagtccccaacataaaaaaaaaaaaaattgtttttttgaagaaaggagtagaggtggacaggggtggtggactcaggcatcccggagctgctccagttggttcctggtgtcacctcggggctcctggattaattgcagggccattgggcaaattgcacacctcgtacacttcgctttcctccactggaaaaatgaagacctgaattaggaaattgttaagataccttcccaggcaaacgttccaggaacctgtaacagctctttctctggtttttctatagttacttgtcttgaaacaccaaatgagatacttgtaagttactaatgctcgttcatctgtcttggagacaccggtggctcagtgatttgccttttaaagtagtttaaagggtaaccacttttcaacagaggttgctttacactgaaggaagtagagtctgtgctcattgtgcccattcaacatctccaccccaccacctttttgaactgtgtgctggtaccctttgattcatgatctgaggtctttgccatttgcaagagtgcgggtgggggaggaaaggtgagaacgggctccttaattttaaaaaaatctattcattcaatgaatggttattgcctcaattatgtaaatatattacaaaaatattttaaaattgtcatttaattaggctgtctgattcttctaaaatcataaactgaagagtcaagccgatgctaatgtcccctcttggggctctgaagactgctgatgaaatagccctttattctagtacagattatcatgtatgtatattctggtttaagactataaaaaggaagattccagagggaatttgttgggattccaggttggaataagtcacccgggctctctgaagtttcctatgcatactttaggatgagaaagcagcagctctgaatcagtcacgtgtccagagaatgttctttattaagtgcgacccattgtttttcatattagtataacccttggtggtataatatctattctaacgctgcacttttgtttacttccctcatttgggttttgataattccagagcttgttttgccgtttagcacaaatattccacttactttgctcaacagggttttgtcccactgtgcattttcctgtgatcttgggttttttttgggtctgtcttccttgacatgaatgaccctccatgtgtccttaatacctcctgcctcctctgaaatataattcggggataagtatgtaatgctcttccttcagtgctttttcgtttgtccaaggtgagactgcatataagaggtcagtggctcacatttgattcattcaataaacatttgttgaatgcctgttgtgttccaggtatttggtcaattttccaaagagacagttagatagtgaaaatgttaggagttgctatggacatctcactcatctttttaaatggtcataatggtcacagagagcaaaatgcaattaactagacaagaacatcctccatttacataaacagacattttcaaagtataatacaactgtcttcttgctttatcatcacacacagaaaataatgtgtgttagcagctaatgttctcctcaaaaaatttcctcctacagttttcccacgttcagattatggtgactccgtccttccagctgggtgttgtccttgatgccttttggtgactgaatcagatttacattttgaaatgatcccagtatggagtgaggatgaggaggagctagagtgcatcctggtatttgggcctgggagagattcgagaagatgactgatgctagggtggcagctgggtaggaggttgagagcagttggcatattggagagatgcttagaacatagaacctgtcagacttagtttggatgggataaagaggtgatagagtatgaaggatgaggatgacatgaatgaatcaatgattttctggcagcatttctagagaagctcttgaagtttatataataagcaaatagtcataatgatatttccctccttgttactgtcttatacagattgcaaaatatttgaacacagtctaggtcaatttcagtctgaaatccaattgctgccttatgcaggttttctgtttcctgattgaagaaatctaagctcagaacagtagaattcaaggcagcacatgtgtcgctgctgacagaactgagagctttatccaggtgccctgatcctgcagtgctcttctgagtcatttagacaatgaggatagtcgaacctaatcatccctctgcgatccactttgccacagtaataaaccaacaaccaaatgttggaccttcagtgacttaatgtgactatctgtattgtcaaattgcatggccaaatagcttttaaatttgactagtgtagacaaaaactaaaaatttaagtatccattaagttcaatgcaatatctttatgtctttctgaaagacactaaaaaaaatctggattaaaagcttggccttgtgacttactggggaccttaggaggctcaagctcttctctcctggtgccccaacctgtctttaccctcaagtggggcagagaaaagcaaatcagtgtccattatacagtcaccatcaggaatccctggactgacatcattcatttctctctcgctggcaggttgaaaacttgctgggagtagtactatgtgtgtcttgtccctgctgtcacctggacacctagcagagtgctggaagcacagtaggtgctcagtagaaatgtgttgaatgacttcatgaatctagtagttgagacctagtttttgaggtcctaagctgctcattctccttccttgtactggtctagtctgagctcctctgctgctgatgtcacttcctgtttggtgtggtcactgcaccatctgtgcttttgaccacagccttgtaatcagatgctgactctgcccttgctccagttaaccccttcctaaggaactcaccagaagtgccaagctgcttaccctgacagagaacctgttttcacatagaatggaaactatgaaagtttccacgtttgttctctatgaacattcaattttcaaagactttgaagtcattaagtttgcttaataattgagtggtattgaatacaggatactctctggtaattctgaagatgcccagaactgggcgccgttgcaggcctatgctgatatgaatcagttatcatccatcggtgctaacagtgtagacatcttaggaaactcagcagaacttatactgacctgtggcatggcccagaacttacttttataaaaccatttttatattactctggttgtcatttgtctcctcataaaagcaaaattttttcaacttacaaatatgtgagagattattgaatcctcttaattgacacctctactaattgtagataccttttctactcccacccccaacctggcatgcttacttttctgctgcatgcagaaattttcctggatgaggcctctttggtgtggaagccccatcatcttaggaagctacatctcccctccttcaaaccactcattaagtaccactactaattgataaaaaatcagattcctgttggatgttgcatagcagacatctctgccaatcatttgaaaacaattaccaccctttgcctagtcctttctggtgatgaacttttattatttacttttcctgttcccacattgtgataaccctggaccacacacacatgactctcaacttggttgtgaaattattgtccagtcatacaaagtcttcattgggttcttgattcctcacttccctgtcacctgtttcattctcagactttcccatctcagtgagtggttggctgtccctatggccagtgcaatctttttaaaaggtaatgaaatagtgacatttcagtgcttaagctctttggttggtttccattccacttagaataatagcttcatccatgaccttgaccttccaagtgctccttacatggtcttctctgcctcataccacaccccactccacaagcttatcattgcctggccacatctgtgccctttctgttcctcaaatgcgaccagttcttttctgccccaagcctttgtacttgctgtcccttctgcctggaatgtcctctgtgtgataggctttttttttttacatccttcaaattgcaggaaaaatgtcgcctttcctgactgctttctctgaagtgtttctgagcccactcagttaccctggatcatatcacactagccacttccctcattgttcacatcaccacttggtattatattatatattcattgtttgtctgtctcctctgactagtgtgtaagtttattcagggcaaggacccaatgatcctttcccactgtctttccactgccttagagcaggtcctggcacagggtaggcatacaataaatatttatgagaacatgaatctggctgcctgtgtatttttccctaggttacgctaggactttccaaacttaaccctttattagttgatgattgaggtcagagggagagacgagactaaaaattagctttccagtttcactgaattcttactaaacgagaatctctaaggaccagacttggaatcaatcctttgaaaaagctttgggggtggttccaatatcagctgggtttggcaaacactgattaatttacacggtgaaccacttactactcaagcagcccctacaaaatgtaggattcagcagcaaagtagattcagaaagtgcaatacaatacttcacctcagctgactctgaggtaatctagtacaagttttcagagcagtcctttgttttaccacccagtgttcatttcagccaaactctctaatgatacaaaaggtataggaatacttcctctatataatgtcatctggcaatatgtccctcggtatccatattctaggtaaaatcgaccagtggttctgaaccagaggaccctgggcaatgtctggaggcacttttggttatcataactggcaggggttgccacaggcatctattaagtagagacctgacatgttgctgaacatcctacaaagcacaacacaacccaacaaggagttgtccagcctcaaatgtcaatagtgctgagacagagaaaccctgacttaattgtatctcagtagatatcaaaatcttaaatgtttttgagaacaattttgtatggcactttctaaaatacattattcgtagtttcttgggttttcagagatagaggtgagaaaatgtgagtgagcttccctggctgtgagtcacagttatgaacagtgtgtttcatactgtgtggggattactctggagagggtgttggtggtccttccagaagcctcagcatcttgggctttttgtttcttcactcctcaatgccaaagcccttcctaatcttgggttaaaaaaatgtttactgtcttctctctcatgtcagacattagctaacttcttcctttatgaccgtctaacagccttgcctaatttgccacctctcttctgatttagccagaatacccgtttaacaaatgtgttaatcgtgggcctaaaattagaagttataatctccaaatgaggatgtgtggagtgctcagcagccttggtgtgtggatgtgggatctgcatctgtatgaaagtgagaaactagagtgcctgcttctgtccctactccttgaggataatgacacagaccggcctgctctggggaaaagggaagagttgctgaaagaaaagccaaaggaaagagggagggaaacagtggctcccagcgtttctctctcaatcacatcagggttcaaaatctcctgagcagcccagggtggcaggcgggtttgtggcctacctgttctcccattgaattgcagagcccgttcttaactcctggccatgtcactgcatgtccattagcatggtctgttttagattgtgagttacgagatgatggggagggtggggatagatttaacggtcttgggtgcttgccacattttggactgagaccactgtttacaaacacaattaattaatttaatatcttttaatgtactttctgttctcaggttttctcattctaaccttattttcaaaagaccaatttttctgatttattttattcttaaatataccctgaatacttaaaaacgtaaaggtagatccagtgatgcaacaaggactcccaccagtcattatgtggtactgctttcactatctttgtggtgactacttggatgtgaatatgggatacttttcaatacaagaaacatatacaaaatataagccaaattttttcattcaaatacagttactgttactgaagactcttccacttccaatttccttgaaagatgccatgactctttcaaatgaaaacctgtcaggcttgttctcctcttctcttcggatacttgtcattttcttagaacttttctaacataaaaaaaaatcttatagtaaaatttgagtgtttgggatgtcagctaaattagatttctgaaataacaattttagaagaatttggagttgtggctttagagaaaagttgccatggcaacagcaacagaagtagtttagatgaataaacttttaacatatttttgaatgacccctttctgcagttgactgaaatatctggtaaagaaatgtataagccagtccaagtgcaatacagaggctaaaagcatctcagcactttgtggagcacgtgggctccatatttgccaagcatctctgtgccaggtgggtgcctctccacatgggcacaaatccctggacattgctctaggttcctagcttggtgatgccatgttaattagacccacagatgaataatagattagcaagggtatggaacattgagtttgctagaatgatttgaaaatggtaacataacacatagtattatttctgtgggtatctatgcacatgactttcaacagttccattcatgttaagatgccatttcgatggtctgagcaaaatgcaaaacacggtcttaacttttatctcaaaagttaaggcatcctcccacattagctactgattcacagtcaagggctttgtgtcgatcaggatccaaacaggaaacagataaatcactcaaaaggcttaatttgaggaatgaactacgccaatgtgttgacaggtttaaaggaaccaacggtgagtggtgaagcacccagcaattagcaacactgagaagctgttaccagggagggaccagcgttaccagagcccactgacttgcagccttggctggaagggaccctggcaatgtgtccagagaagactccagcaagggcaaaatacagagaagcagggatagactggaacagtaaatactctgacttcttggtctccctgttctccatctccttctgggcccaagcccagccaatccagtgagaccagcacagagaagggcagaacattttatttcctatttttgttgagggctggcgggagggggggtcggtgttgacaaacataaaatatcattacaagcattttcagtcttgtttggggtttgcttacatttatgaaagaccttaaattcctaagtatatagaagtctcccaaattgcttcaaatgtctctttcttccacactgtagattattttgactaccacatttaaagtactcaggtgctatgccagctccatccatacgtggtgtgcttgcttttaaggatttttatatcacaaacctattaaagcatttagtagagagtgatatattctacgtatattttgtcattaatctaatattggaaagttcattactttaaagtgccctggtctaaatttattagtatttattaatataattcaaaatatgtaaatgtattaatatagactacaattagattttttttccctctaagcccattaggatagtctaatgtaatttccttgccaaacaaagaaaaaggaagatttggtttggctttttttctggttgatgggtaaagggttttaactcttaaaattgcacatcaacacaaatggtctaacctgtgcttgactgaaaggcaattttcatttatctctgctggtcaaggaatggttgcagctaagtattgcagttaaaccgccctgtaccccagtaaattttagcagagagaaaactctcatttcaacctggactgcagaaagtacctcttattcttaagttagttcctccttgagtcttctgtgcacccactttcataaatattcatcctgcttctttggagaccatattcacaacagaaccagaaaatccaaaaggacgcagaccagaaccagggactatattgtgtgtgactcaatgcttggccatttatagcatgtgcctgatgcttagtatgtacttgagtgtcaatgaaattaatcagtgatttaaagctctcagaaatatttagtctgacttagagtaataataatagccaatatttattgaatgctctctatgagtcctgcttattctacatatattatctcacttaatccttaaaataaccctgtgagataggtcctattatcctcatttaaaagatgaggaaaccaaagctctgaccttatgtctgtttcagggccacacagctagtacgtagtggggctgggactcaaatccttgtctcttaatttgattgccaagtctgcatgcttgaatcactgtgcagtgggtgattgttgacatgccattggcttaaggtgatacctttgaggtaatactttttaaagcctttcattttgtaataattgaagacttataagaacttgcaaaaatagtactgagaggtcccatgtaccccttatctagcttctctcaatggtagcatcttatttacacaatatcaaaaccatgaagctgacattgggacaatcctattaactagactacagattctcattttaccaggtttttacatgcattcttttatgtatgtatatatgcgtgcagttctgtgcaattttattacctgtacagactggcatatccactaccgcattcaaaatacacagctggtccatcaccgcaaaagcactccccccatgctacccctttgtattcacatccaccctactcctgccctcatcctgaatctgggctaccactgaactgtctccataagatgacacattttaaattcttcctcctgttcttgctgcacggtggaaacattcctgtctccattgattatttacacccaaagcatccataaacataacagaagaaagtatggtgaattgatagggagatcagagaggattttggtgtgtccttgttgtcagcaatgcatatatatgtatgtgtatatatatatatatatatatatatatatatatatatatatatatatgtacacacccatataaagaacatcctgtttgttatttttagttgagggtttgagggttgtggtaattttataattccaacacctgtgttttcactagcaaactgcttttgattgaaacacggcagagtttatctcctgcgtaaatgcggcacactccctctttgcatggctgttctaacggcacatccatttctggaccgacaaccgcgtgactgaacttgcagcagcctggaaaaggtacatgagagctggcactctgcccttgtcagggttttccaaaagtatttacgaacaaggataaacacgagtcctgcatggatttgaggtagccatgaccgagctgggctctgggcagcacaacagttacgtaaaccttggcattcatggcacacatgcatttttattcatccatttcaaagggagtggccgttcgtagacctctcttggggaaaggtttgaaccttatcatgatgaactggttcaaaaaatccttaatagctgtttttattcaggattgctgaagagtgaaaccttatcatcgggacacagttagaaagacttcctgcatttatttggtgctcactattttaaaaaaggtgtccaaactgctgatgctgtctgattctgcaaacataggcaaacttactagatacttcacatatttcagttttaccatatgattatgacttgatatttattagaaaggaagaacattttttaaatgtagtcatactgagcccaactcttgcttttaatgcaatttaattgcattaaaattagacaggtaatgtcaccattaccacgcagatactttgtatcacccattgcaaacatctgtaaaggatcaaaggctcatgtagtgagtctaagaggaaacttggtttgagaatgaggccttccatgatatttctgtgctgccgcaggtgggggagggcacatttttatttaaggcgtcattagaaaggaatgaaatatagaactcctagcatgcatacatatatgcacatagacacacaaaatcgtactttaccttatagctgtgttgtctaaaatgtagaagtgtgtttgtatcagttagctatcaccacactaatgctgtgtgacaagctactctgacattcagtggcataaaaaaaccatcacggatcctagtggatctgtgggtcggttagggttggcttagctagacagagctcagctgtttgaccagaggccaaagtgtcaaggctcttctgtcaattctgtcccatgtgtatctatcctggggcccaggctggcagcatctacccaaagaagttcagcaatgacaaaggcacaagatggcaagtgggatcaactgaagactcttgagacgtaggcaggaatttgacacactattgtctccacccacctgctactggccacagcaagtcacatgtaaaagcctaacttcagtgtgtggggaaatgcactccttccatgatggggctgtggtaaggatgtgaagcaacgagggatgaagagatgggggaattgattcactttacctcagtgtttaatcagtttatcctgagaatgccaatacttttaagaaggtacaaatctatcctgattttctttttctgtttcgtcagtgagttctttctgtcatggatgtcaatatctatgtcatcatgacccaattaaatgacaaaagcagggttttgaggttctctcactgatatcagttcccataaatccacagtgattggagaaagactgagtagacattaagggaatatagaaatagactgaatgatattaacatttaaacagaattgcgacactcgtccctgtttccttgtgtgtagcagctctggttcctcaaactatcaaaaagaaaccattcagaatcacctccctggatactttttaaaatttatttttaattgacaattaaaaattaaatatatttatgatgtacaatatgttttgaaatatgtatgcattgtggaatggctaaattgagataatcaacatatgcattacttcacatacttattttttgtggtgagaacacttaaaatctattgtcttagcagttttgaagtatataatacattgttattaactatagtcaccatgttgaacaaggaatatgaacttactcctcctgcctaactaaaattttgtatccttgaccaacatctccctggagattttttatctgcttctttttactagtatcacttttaaaagatttctgaatttagctactgtttcaaaacctagaagaaattaaggatgaggtgatttatgaatgaaagaaaaatatattaatcctttaggccaaacacaccagaggcaacgtttggcaattaaattattaatttgatcaattttgacatgtaaatggataagctacattaaaagcaatgcacttaaagtacacacacagaatcttgtctcattgaagtttgaacaccttcaccatatcttcctctattatatcaacttgattgaacagttgccaaggcctgtttttttttccagtttgctctgtacgtgatcatatctagtagactgtctgccatattacggtagctcagttcttaaatcaggggtcaacaaactatgacccacaggccaaatccagacaactgcctgcttttgtgtctcctatgagctaagaatcagttttacatttttagatggttgaaaaaaataccaaaagaagaatatcttatgccatgtgaacattttatgaaatacagattttagtgttcataaataaagttttattagaacacagccatgtgcatttattgacatattgtctttggctgctttcacactatgatagcagagttcagtggttggttgcaatgaactgcatggcttgcaaagcctaaaatgtttactctttggccatttacagaaaaagtttgcctatctctagtctaatgctatgtctcaaattaccacagacactgtagataggtctacgttacatcagtatgaaggcaaaagaaagggacacatattgttggtatggaggggagtggtgggtatatttcagataagggcaaaatgtcagtgaacattcattgattcaccagtatatgtgcagaactgggtatgtgtatagcgctaagggaaacatttttttaaaaggttagtctccaatttttactctaaggcttcctcttgaataagaagatgcatctgcaagtatagtgtctgaaaactatttgccttgtccaatctctacatcactggaaaatgctttaaaaattttaagttaaaaatagtatatgtttcatggtttattttgcaattattctaggcagaataattttcataaacattgccattcttaccagtgcgaaagggagacttaaactcagaaaagtgtcatttactcatgggtttaaaatgctagttcttcttgtggatgtatctgagatttttatgttactgtatccagaactccctcagaggcaagaacataaagggcctccaggagctgactctaaaaacaccagtctcctgttctttaaactccgtgtggcttgctgagcgctcagccacaagagctgggggtgagccatctctgggtcctgccaatgcagccagtgttgtgccaaaggaagtagccctgtcttacactttgtgatgtttcttttggctgactcttccacattcttgtgaccctttgaatgaagacgtcttaacagctttagctctacaccatggcctcccgctatcatttcctgcaggtcttgtcttagagctcagcagcttcctgagtaaatgtcaccttggtgtcttctaagagggtctcactgaggttcaaaaaaccatggcttccaccagattgaaagcataatgtccacgagtctttgtctcactggactgtgcaggaggatgaacctggaattctttttggttttgaagcaacgagtaggtcggggcacagaacagagaaccaggaaaatgtctctgagggtggaaatcaaatgaccccagaggaggaaattccagttgaaaatagaaaccgggtcagcacccttgtgagagccacagcatcctagacttggaaagtggcaacctgtggcctgtgaaggctgctatcagaagtccatggactggcctgaaaagagtgttgtgttttatggcaatccaaattgaaacaggatttatctagcttcacagatgtggtctgctggagagttatgtggaaatgactcaatgtcatatatttgtcacattgaccaagggttatttctttagtaggaaaagacaattcgggaacaatattttcttgagaactatgatatatgcatacatgatggtggtagcttccaaattaccatggtacgaattctctccattgatggttaaggggaaaagggttattttgttgcagctgtacaatatcccttcattaattcaatgaaaagatctcaattaatgattattccttaaaatgacagatctataattaacttggaaatgcccacaatataatcatgttgctatgaaaagtgatggtttttaaactagtctaacataattccggattatctttaaagagaatttaatgtctagaaaagtttctgtagctctaaaaagctgcagaataggatgtcattttgggaagtttcccttgcttaattcagcttatgatccaaatttgaaggagaccagtagtccaggagttttgtctgcaaataaaatgaacaatatgtgttctaaagtgttttggatttttgtttttggtgggaggctggttagtcatggagcagggtagaattagtagcttttggctttaatcaggaaaatatcacatggtgttaaagtgctgtctattaattggttattataaactttaaaatgtatattatggtggagaaacttctcatttgggggactgtttttcatagcatttgtggcaacttttatttattacttaaaaattttaaacatcacaaacactgaaattctggggtagagataggattttcttaaaggagagatatatttttgatatatctttttctatctgtgtgtgaaagtgtaatgccttccagaaatccataggaacagaaaatagattagtggtttcctggggctgtggttgggaaaggagagtgactgtcagtgagccccagggatgttattgaagtgacaaaaatgttctcaaattggattgtggtgatggttatccaacgcagtaagtttacaggtgaagtttatagaatgtaaattacatctcaatgaagttgttttagagtatgagttaataagagaatcaaaaagtacttatttacaaatgaaggattaaaatcaatattatacaatcaaacttgaaatacgttagtaatggtatatatatattttttcctttctaggccacctcttagaaagttcaaaatctaataaatgaggggaaacacctttttattttttgctagttgttcaggattcagtgatctgaccaagcacccatttgtagttaagacataaacatcccactgaactagacaccagacttctaagaaactcgactttctaaaatcaaaagcaaaaacatatctgagcagccaccaggactgtctatataatttgataaaaatgttgcaaaactgaattaatagttatggttacacaatttggtacatttactaaaatatcattgaattgtacacataaaatgcataaattttatgctgtatcaattataccaaaataaagttatcttcctataaatatatgttcatttgtttatatatttatgtttattatatatgcatatataaatctaacgtaaacatataaataaatgtttatatatttcatatatatttgtatattttatatatatatatatatatatatatatatatatatatataaataatgtctgccagtgacacaggcccaatatctatattccacataatgaagtcatagcaacagggccataatcttatcttattcatcttattttgggatattttggccttaaccatgtgacactgaaatttgcttgggactgttgaaagcattccccttgtttaaagaggttctactaaaaacaacttttcacccatttttttgtttgtttgtttctctctttttattttttctagcacagtggtaacaccctattcccactttaacttcttttccttccttcttttttgaaaattttctaacttgtatttataattctcttgctcatcaaggtcatccagacactatggttctgttcatgtggaattttagtctcatagcaatcagtaagactgtcttgcgagagccggaaatgtgttcattaacttgagaggccttcctgctaagtggtcaaacatggaaacacaaagttatgtagggacattttgctctgtaaactcaaggtatagcatcatttgtttaaaccctctctattgagatgtaattcacatgtgatacaattcacccatttaaagtgtacagttcagtgggttttagtacattcacggagttgtacaaccatcaccactagctaattttagaatatttttgtttccccaaaagaaactccatgccactggcagtcactctctttttatctcctccaccaatgctactctgagcccctgacaaccattaatttgctttttgtctctagatttgcctgttcttgagattttccataaatggaatcatacaatacgtggtcctttgtgactgtctcctttcactgagtgtgttgtcgaggttcacccatgttgcagcatgtattagtacttcattcctttttatcaccatataatatttcatcatatggaaacatgatactttgcttattcattcatcaagtgatggacatttgtggtgttttcagtttttctgcttttatgaataatgctgctatggacttctgtgtatatgttttgtatggatgtatgctttcacttctcgtgggtatataactaggagtagaattgcttggtcattataggaactctatgtttaactatttgaggagccgccagagtgttctccaaagtgattgcatcattttacattcccacaatggtgtttgagggttccagtttctccacatccttaccagtacttgttgttgttattattattagtagtaatgtttagagacagcatcttgctatgttgcccagactggtcttgaactcctgggtttgaggaatcctccaacctcaatcttttgagcatctgggagtatgggcatgtgccaccacatccagctttgtctatttgatagtagccatcctagccagtgtgaagtgttttattttagttataacttttatttgtataacaaacaagaggcacattagatggtgatcatttgcttcacaacagtattttttgtagtcctccttttaaaatcacaaaaccacatatgaatttaaaaccagatccttttctttaaaaatagtccactgcagtctgcccatattccagcagtatccattatcaaagtaaagtgtacacaaaaggctccctccacctctccttgcttgagaatctgtgtcccctgagtatggatgtcctgctccaccttcacagtgtcaccttggaggaagtggcagggggtcatccacttcaaccattttccagccctggcacttggcagcaagacttggagaggccagaggacatgtggccacaggcccctgcttgtgctcctgagtgaacacttgacatagatatccagtgaatcatggggtgcaagccagagacaaccccccaccccatttcttgcaggctgtggatctacgtgtcggtggccctagttattatatctgttatgctttaaaagtgaagactaggccaagacctacaggctgatgattattaggtggattaacatacggaaaacactatagaaaagaaggaatagtttgtgcaaagatgctgaggagcaaagtggcatagcaagttcaagcaaatgagtgaagaaagtagcagactgagtgaaggagtaaggggaacagtagcagaacagagctttggagagatgggtgcggtggtcaagaaaaatggcagggacttacaggccacagagtaaggatattggagtaaggggaagttatagaaacagttaagcagtgtgagggttggaggatgcgtgtgtgtgtgtgcgtgtgtgtgtgtgtgtgtatgtgtgtgtgtgtgtgatgatcaatttcctcaattagaaaaaagagatgtgatgaaattgtgttacagccttttggacactcagaataggaggtcttttattgccaggatacccatagcattgccaccctcagatatcttgtaaactctggtaggaagaactcatggatgactactttgtcgtcctactgcctttaaatctgcttctgtctgttcccggcacccactgaacggcaatttctacaactctcaatttgggcagcagcgtccatactgggaaaactcttccatcatgcttcctcatagacccctattgactgggtaactgctgcatcggtcacctcctctccctgggcctattatagctatggctaagggtgcttccgttgtacctggatagagttttatgcttataagctgcttgtggctattaaacagagcaagaggaaactgtgtacatggaaggaactttgttgcccttctctgttacagacaagcaaaccaccaatgagagcaacaactttttaagaaatcctggcagacttgtggcaagaataaccaatattgtagttcacccgtgaggcttatacaacgtttgccacactgtatgcattgagaatctggttgcgatttttgttataaactcttccattccgcttccccctccctgcctccttacacacgtttacttcagtgaactctgcttgacagactaaccaggctgaggtctcaatctgtgacctaggagccagtgataacacctttgactaatggacagaagacttatagttctatttttgttgttttgattttttttaagttatagtgttgaagtcatacgttgtctttagttattaatcttactgcttccttcagcattttgttgaatagcatttcatcatgctttggttaagtgatttatagttagctcacaaatcccaggcttaagattaaaaagctactcataaattccttagaacattcattgtgccagcagaaagaaaaaaatactggactataggatatcattcctgtatctgattcctacactattcctttgaatatcatcccacacctcctccccgttcaactccaaatggccaatgaacacatggaacatacatacagttagccaataagaacatgaaaacatgctcaaaatctttagcagtcagggatatggaaatcaaaaccacaaggaaataccactttacacccaccaggatagtaatgatgaaaaaaatacaaagaataagtgttggtgaggatgtagggaaattagaaccctcataaactactggtgggaatgtaaaatgctgcagccactttgaaaaacagcctgtcagttcctcaaaaagttaagcatagagttaccatatgactcagcaattccactcctagttatctacccaagagaaatgaaatgtgtgtacacaaaaaacttatacatgaatgcacatgcattattcataacaacaaaaaagtggaaaaaacccaagaatccatcctaactgattaacagataaacaaaatatggtcaaccatacaagagaatattattcaataggaaaaagaatgaagtactgacacacgctcccacatggatgaaccttgaaaacatggtgctaagtctctcttgagctggacacaagagatcacatattctcttgtgattccacttacatgaaatatccagaataggcaaatccatggagatggaatatagattggtggttccctagggctgggggtgggataaaatgcagagagactaataatgggtatggggtttctttttgaggtgataaaaatattctaaaattggttgtggtgatggttgcacaactctgtgaatatactgaaaaccatttaatcaaacacctgaaatgtgtgagttgtaaagtatgtgaattatatctcaataatgtagttataaaaaatgaaccaagaaagccaagcaatgctagacatgcatggtctattccactgtaaggtaatagtctgtctaggcacatttacttattaaaaaaaaaaaaactccccatttatctatttagatgtttctttgttatatatgtgcttaacaatcttctcagtttacttgcagtttgtaggtgacagtttattttatgtcatgggaaactgaaacagaatatgtcaggactgtttacgtgaacacggtctggcctttcgctggacactgggatacagtatatttcaataccccctacgcacacatcccacacacattaatcagggccaacatgctgggagtaaccacgatggccaaccacaggatactaggatgctttttatatggacatttgtgggtgaatgtaccataatctgtttaactggctgatagtcatggtggcagtggcatatgtgtgtgtgtttacattgtgtgtgagtgtgtgtgtggggtgtgtgtgtgtatagtttacagcaagctcaggcggaatgctgtaagccaaacagtaccatgaatctctaaaaaggaaaaaagatcattatctttaaaagtgcattcttacatgctgtcaagtatttgaggattgcttttcctagctgaggctcagtatagtcttctttagtctgttgccaggggatcagcaatgggcaaaatctccgcccccatcccagtacccactctgtgtcatacattttccttgatgacttatgcgagtactttataatctttacaattctcggctgggcatggtagctcatgcctgtaatcccagcactttgggagagaaaggaggatcatttaagcccaggagttagagaccagcctgggcaatatggcaagaccctgtctctaaaaataaaataaaatattagctgggcatggtggcacacttacagtcccagctactcaggaagctgaggcgggaggatcacttgagcgagggaggctgtggctgcagtgatgatcatgccactgcactccagcctgagcaacagagtgagatcctatctaaaaaaaaattccttacaactctctaataggtttctttatatcattttatagatgaggaaactggggcttgtagaggctaagtaacttttccaaagtcacaaaaataagtggtgaagttgggttgtaaactcaagtccactgattacaaagaccatatttagggtcccttaagttaagctgtcttacatcttcccgaggagaaataacatgcttttttgctactgacttaatcataattattaatgaaactgaagtagaaattgattatttgactagaaattgattacacaacaattcaatgtttagactaagaaccaaggatttccaattaatatgccagagcttgccattaaaattttttaaattgtcatttttttcttatggatatgtaataatcatacagtaaacccttgatttgtaggataccaacctgcaggaatgactagtaatttttttaaaaagaaagaaaaaagaaattctccttaaaagtagaattgggatccagatgtgtttttacccagcagtgtcttccgtcatggatttgtcttatagaaggaaaaagacattccaccccagtggtgataggtgcatgaaaagctcattttgagaactaaggatggagaaagcaaagaggagcagagtggtagagatcacagtggcaacagtactggggtcacctgggacctcaaggtgggcacccatggccatgtggtggtagaagtgagaatcaacagagggacagcagtttgcccttcctgttgacagtggaaaagagagcagcaatgaagaagtagagtcaggaactgctctaacgtttgctggaggggcagccagcagccccttatattaggcctaccaggacgctgggtgccatattgaaaagatataacagtcataatggattgtcagtgtggatgcctgcagacatttgcttcatgtggtaatatcatgacagattcaatcagctctttatttaatctgtattttcacctataattatgcttataagacaaactgttcaatggttttaaaagacatgaaaatgtctccattagagaaatagaagctcttacaataagatagttagaatgttaaccctgagctatccaggatgtgtgcttatctagaattactcgttcctacatgatccaggctcgctgaggatttagcatactgggccttaagagctatgatctgcttttttatttttaatatttttggagatattcttccttcctgaggttacccaaagcagtatcctttggccacattttctttgagctctagattagaaaaacatttataaccacccacaaacacaaaactttttaagatgaggttttggagggtaaaaaacttatgaactgaaaagaaaatttggttcctgttggcagacagtgatactttctttgagttctaattatatggaataatttgtaaatgaattaaacaaatgcaaaacaaagggattatttttatgttttaatgtaaatgttgcattaaaaagactgaggattgacttgaatagattggaagactacttcattattaatgattctcgtgcttgcctttggaatctcttgcttggctggattatgtagaatcggattttaaggctttgatgcaaggatgacctcgatcctgggctgcctgctactctcataggttcttaagccaaaagttgagatgatttgcaatggtagggggacaagacagattagcaatgggagatgcaaagagtggagaggctcatcagagagatgaggaagacggctttgcctctgacccaggtgtgaatcagttaagtggtggaaattaaagaggagatgccaaaaagcaagaagtatcagtaaggcatagactggtgaacttggatatctgtaacatatttgcattcataaatgcaacgttttctctcttgccttgtgcagacctggcctttctgcatctgtgtctttttgaaacattacaggatattcaacattagcacctaattatgagcccatttcaatgttagagcctgttttatctctgctttaacgtggtttaagtatgtctgcaaaggaagaaagtttagttacattgttaaccatcctttttcatgtctcaaagagtagaagatttgtttatctaacagattttgccaagaaggcagtgaatgaaatttcagttttgaagtatatttgaagttaacattttgagatagggagccaagctcagtcaagcaacactttcctatggaagcgccttcctttgagctcagcataaatcatgccttaaagtaactttcagcctgattagtgttgtccaatagaaatgaaatccaagccacatatgcaattttaaattttataatagccacatttagataagtttaaaaataaaaagaaacagtaatatattttatttaacctaatatatctgaaatattattttaatatgcaaacaatagaaaagttcctaacgagatatacacatttgtcatgccaagtctttgcactattatttatttcatacttacagcacattttaattctgactagccacatttccagtactcattggtcacttggggctagtggctgtcgtatttgacaccagggctttagagaactgaatgagcaaccaaaagatgactgatttgactcagtttcctactggggaagttttcacatcaactatctctaactctcccccatacctacacccagccctgagcaccccaagattgctgaacttttctcacactgaaatagtcaggatgtcttatcttcacaggtggggaggatacagagctgtgttttcacatttcgtagtaaaattcagctgctgttctctgcccgtattctactcagctttgaatttcaaccccttggctttcccatactgagcagccaacgcaaactattgttttcaatgacacctgttcctttcgaagaagatgaaggcagtaagcagatttgtgcttagtacaaggtgttcaagtgaaattacctatttattttggtgatcaccctcccaaattgctagggtgtatcttcatctggagttacataaataggatttgcccacctcctaaatagagtgtgtgataatggaggtaacctaggcatcctcctacgctctgccacaactgatgctcaattattccccagaacacctaatgctttatgtaacagagctctgagagaataggggagtggcaggcaaaaatgaaatagatatttcaaacatcactcctatgtgaaacatatagatttggcatttaggtggaaggctcttttttccttccacttacagagtttgttaaattgcaagcatgccttggtgttgccagagcaatgtcttgtagctgatactcacagagagctagtgacttgtagacttctctatacaagcatagttgtggataaagccattctagaagggaggtgacccctgtacaataaagcctgggttgttgcaatgtgagatcaagagagcagaacaatcttctattttgttaattaatctagtatataaagtcttgcttaaattaggcataggctcaaagtctgactcacagtcttttatgttttgaaaatgttcaaagaaggtggaaccaaaatgggtgaaaaaaacttgacacatatttgaattgttctcatttgttcatatttgtaattctttaaaacgagacagacaaacgtacagcatacttttgtggccaagaacttgggaatcagatcctaaatctcaatgcaatgttgtactttgggtttgtgtttggaatcaggcatggtttcaaatcccaactcttgtatctactaattggatgacttccagcaagttatttgtgagccttagtattatatcataattgagtcagcagacctatctttcagagatggagtcagaattaagcagaatgatgtacataaagttattggacagtgatgggacaaagtctgactaaataataacaccactgaattttaaaatttaacatgttatcagatctccttcaattatttatatgtatatatgtatgcaatgaaaacataatgcactagcctttttactgaattattcttattctaaaacaggaaatatatacaatcatatggttttatttaagctaacaaacatttgctgagttttggtaatgtcaaataacttactgttggatactgaagggtatatttttgttcaggtcgtaagtatcctaatatcctgtacatatgaatggccgttaggtcacagcttccctcctgtagctcttaacatgtaatgcctctagccctgtggctctcaactgggggcaattttgccctcccccacccctactcccccaccaagggacatttggcaatgtctggagacatttttgtgtatttgcttgccacatcttggggagggtgctattggcgtataagcaagtagaggtcagagatgctactaaatatcctacagggcacagaacagcccctacagcaaagaattatccagacccaaatgtctacagtgcctaggttaagaaacatggtcttgatattatgtatttttctagagtttattatgtctttcatcatttgtgactttggccatgctatgaggactgtctagataaaaattgtccagtcatgagctggttggacataaagctgtgactacttgaactcaaggtgatacttacctaatagcatcgtcggagggaatttgttcattgggcgggaggctggattagctgcttttggatgctcttccaatcccaggaatcccgtgcttttcctcttttgtcacacaaagctatatttcagcaagaatctctcccaaactttgtgttcaccatgaccagcttcttctcagatcctgccatcaaggccaagcagagtatttttggaatgtggatgaatgtgacaagaatgttattcttaaatagcaattctgctatgcaacaccatgatacagtctcctgaatggatctgattccaagtggaggcttgaactctaatatttaatagtaaactatagaaaccttatcaagataaacagcactaggagtttttaattctatttacatgactagaagttgacattcatgtccttcttgaaactcagacccccaaatattgggaaagtcaaatacaatacggcacagtcacagcatgagtatcatacagtgatagttcatgctaggttaatgtcaaacattaagagtataatgctgaaatatttctggatgaaagataggatatctaggatttctttcaatgtaattgagtgggacagaaatctaaaagttggtgttttaaagagaaattggtaagccacagctgtgaaaatggaggcttaggtggtttgcatattggctgccttgaactgtaaattccacctgaagcagaggtaaacgacagtgcttttagccagggggggacggggtgcgggggggcacgttcattgacaatattattgcaaggtatgttggttcttttttttttcatgactggaacaatgaccagcttcacttcgtcaccttctttctcttctatgaaatgccttccctccttaaacctaaatccaatgcatccctgaagacctagctcaattatcccctccccctggaagcctctaaggtcttccaaattttattaatacttctccactgaactcctgcagtgatgcatcttttgcatgttttaagaaattgaggtctagttcacataccataaaattcccctttttaaaagtgtacaatttagtagtttttagtatattcacagaattgtgcatttatcaccacatgttctagaacatcctgatcacctcataaagaattgctgcattcattagcagccaaccacccctccctttccctttaacacctctggcaactactaattactttctgtccccatagatttgccttttatggatatttcataaaaatagaatcatataatatatggccttttgtaactgtctcctttcacttagcataatgttttcaaggctcatctatgttgtacatgtatcaggatttcattttgtggctgaataatctttcgttgtatgggtacgccacattttgtttattcattcatcagctgatggacatttgggttatttccactttttagctattatgaataatgctgtgaacatttatgtgcaagtttttgtgtgtacatgtgtttttgtttctcttgaaatgaaatatagctaggagtggaattgctgggtcacatagtagctctatgtttaaacttttgaagagctgccagacagttttccaaagtggctgctccattttacattcccaccagtgatgtaacagtgatgattaaaagcaatggcaaaaactgcaattacttttgcaccaatcttaatacagggattcagatttctccatatcctctttgacattttaccctgcacaagtctgttgatgtcactatttgtcctcaggattgattatcccacatcccaaattagtctcacctcccaaattagactgtaagctacttaggacaatgatccatttatttggtctttatttaagccagtggtttttttttttttttttttttttgattgcttattgtgtggcaggaactggtaagtgctaaggctttaattaagaagctctattttgtgggggaggcacataaaatcacactggcctgttttggggtgatgggtgcagtaataacagcctattcaaggtatagcctttgcttcatatagtttccctcccacaatgtcatacttacaaacaccactcaagtctactatttaatacattctattagagaggaacagatctctgtgtgtgtcctctttttagtccaaatgtagaagctctgatttttctgttgggcttttgtgtttaaatgtgcttaaagaaatcaatgccagcaatatttctagcagtaactttggatgtaccatgtaagttattttgaaacagtgaatcatcacgaatgttaatctgttgacttgtatgtataaaagcttcttgagactctaggctaaggagagacaaagcatcaaaaatgtaattcctctggattcagaaataaattatccacatgccattttcacctgcagttaatctggttttatgtttgtctttctgcaactctcattcagtgttttggagaaattaggacatttagaattcctaaatgacatcaaggataaaaggaatcaaactgcaaactgtagaaaagaatgcattgttatactatatataaaggtataattatataattatgactataataattaaaacatattgtgcttaacaatagtatcaaattgttttcatctgagttcttaattacctaatataaatatgtctatgccagccatgccaaagcaggtacctaaaggaatttcttatatctaggaaaaaacgtattgatcacctcatgcatttaagggacaagaatggcactttcattccagcttataaatcatgtcaattttaacaatgacttaaaaattcttttgtgatttgtttaaactctgaaaagaggcttgtttgtgttaaggaaaaatcaaactgagaatgagttatgtgctcatattatatatagatgagtaaaactcttactccctctgcaaacattagaaaacaataagatactcccacggtttctttttttttttttttttttttatagcacttacgcagtccttactatttaacaggcactggtttagaatttttacaaatacttctttaatcttcataacaaccctaggaaacatatacaattattatccccattttacagataaggaacctgagagtttcagtaacttgtgtaaggtcaccaggtagtgtaagcccatgagatttggcaccttttccaaagtggagtaggcctgccccagagtaaagagtgcctgttctagtctttatctcaaagaaagcagtgatttaattagttactatcaatgtggggaatctgttggtctgacatcattctaggtttcagaggcaacttggctgcaggttttgtttttgttttcgtttttgttttcatttttgttttgagacagagtcttgctctgttgcccaggctggagtgcagtggtgtgaccttggctcactgcagcttcgacctccctgggctcagttgatcctcccacctcagcctcctgagtgcctagaactacatgtgtgtgccactacacctggctaattttttgtgtttgtattttttgtagagatggggtctcaccatgttgcctgggttggtctcatcctgggcgcaagtgatccgcccactttggcctcccaaagttctaggaaaacaggcgtgagtcaccatgttcagcttgcaggatattttcatacagcttaggagagcaatgaaattaaatgtgagagataaaatatacattgtcacctacctgtttgatggtatatataatggattatctataccatacattatacattatagataatatatattatattacatcttcatattatgtatagtcatgctgtctttgatatacatacacatatatatgcatatgttatacacacacataaatgcttagccccttgcaggctaccctttcccatgtgcttccatgtcttgggtaataattcttctcagactttcaggaagtacagtgctactaatattcttggaggttattattctttcttcttggtgaagaggatgttgaaagatcaataatttccatctatctccagatagtaaggatgccttgtaggagagagatctgaagaccctgacatgtccacagctttgcagcctgattctgacctttctgctttgggggcaacttccatcaaaaggagtttcttgtcgcagttcttacaggcaggggcatctcacaacagttgctagtaatgataccatctactcccaagaatgggaaacctatactcatctacttggcctcccaaagatggatcccatttagggtgtgtgtgcacatgtgtgtgtttgtgtgtgtatatgttttaaccaaaataattagtgttaccaaatctctaggcctccatgcctagaggatctctcattaagtaggatattctatgcgctcatactagaaagttataaaggcaaaaaagacactagattaaaactgataatgtccatataggttctgagatttttttaaaaaaaagtctgagcttatgttaaacagaggtaatgaggataatcagttgtataggcttccctaatgtaagtcagcgtctctcatcttggcattcattccagaactgtttttaaacaggcttgcatgtgcacagtatgttaccttgccttctaagtactgtcagaattggactggtacctagcaaaaatatcaaaattatgagtcctagaacagtgcttggatgtaataagcactccgtaaatacttttggaaaaaatatgttgatcaactacggttttattagataatttaaaaaagataactttaacccctgccctctctggaggagagagttgctacagtaagagggagcagtcatccccagacctctctttgatgcttctgggtgtaagaagggcaattgaaaagggatttaggaaacaccaggcatgctgggtgagtaatatggctgccacctaagagaccatcagggaagtgtcttctgtggtatcatgccctgagccagaatgccgttgactgcttgactctgaagaaattttaaagtgttcctgagggtgagagaggtcttttgaatcagggattctcaaggtagcctatggtgatttgaaatgtttacattttaatatcacatatactctcctttctattggaagcaactaaaactgatagtgaagacttatgcttttgctgtaaagagtaagagttgcctatctgtggtatgatagtactcctagagggtgattcataggttaaaccattggaacagaaaagagaaaatatttttacttggccatgctctcttttttaaaaacaaatattactatttttttaaaagccatatcactggcatagttttcagttgtttttacagtcggttgctctttaggcttacaatctttaaccttgaaattattcagagataattatttttggaaggaaagtgacaagggaaatagttatgtagtcaatttttgattatccaagatgattttgccattagaattagtatcttattttagcaaatagcaacagtcaccttctctctttgctaacccttggaacaaaatgttttataagggaacagaactgaattttatttctcctcctgtgccccgggcctgtcttatattttcactgccggtagtacctaatgttttccccatttcagcagtatgctggagccagcttgcgttggctggagaaccagttgtgtgcatctcttcctaactgcatgtcctgtgtcctcaccttggtaccctggaatccgccacaatgagtatttatattatggaaattaacaaatggcgcaaatcagagctttcctccagagaaccagttgttaaatgttttatcagcacactgctgccccattgagtccttcctttttgttttttgatgaatattttctaaaatgtattagatgttgctgtctttgcaaacagggtgtaatagaaaaatttactatttcctggtcccattattatacttcatattgctgggttagcttcttagtgtttcttcacttttcccttcagaagagggcttcttccttctgaaatcttccactcagttcttatgtgttgattttgattgcccttagtccatcaaatgagataaccaagtccataaatgtgcatgtagaataaaatgagagttagaggacttctgttacagaataaacctcttgaataaaatgcatggccttagtccagaatttttgtgacaactagtttgattgccaacaccagctttatgagtatcctacctgtgtggtcgcacagggcccatgctcagaaggacaacatgactaatgttctgctgtcatcattttaaaattattaatctgagcaagaggtcctgcattttcattttgatcagggctccataaattatgtagccaatcctgatagttgttcagatgccttttttgcttctgattttagaaagctgaatttcttagaagtctggtgtgtagatcagtgggctgtttctatattaaccacagatggatgcttggtcagatcactataaatactaaataagtagtaacaaaaaaatgatgtttattttcattcattatattgtgatttttctaaatgggtgtcctaggaaggaaaatgatacattataatgttactcacttattttgaatgtataagattaattttaatccttcacttgcaagtaatttctggttctcttattgagatatatttttaaaataactttattgaagtaattttacatcataaaatttactcagtttaagtgtgcaattcagtggtttcttaataaatttacagagttgtgcaacattcccacaatctgtttagaatatttccatcatcccaatgaaattgttcatccccatttgcagtcattccctgttcccacccccagccccaggtacccactaatctactttctattggaacagctttgccttctatggacatttcatatgaatggaaccatacaacatgacatgtggtcttttgtgattgacttctttcactcagtattatgtctttgaggctcattcatgttgcagcaggtcaatgcacaactttacgctaagatttataggatatgtgaggttggtgtaggacaaataatgcttatctacttatctgtgagtgcacatttatttttgctgaaattttcattgagaatggaaaggtagccccattgcattctacaggaagtccatttttggcttataacgcttatcattttggcaccttctggatcaactactcaccctaccttctgagaaactttaagctatttatgagggtgtaagtgaacttaatatttgagttcaattactaccaagcacactttctggaattactactaaattgcaaacatattgtagcagttctaaagacgcttttttgagttaatgttcatcaatatttaaaaaatatttttctcagtattaaaacaagttaaaaataccattgataagaattcaggctctgggctgagacagctctcagtggaaatcctagctctgcctctcaaagccatgtcctaaaataagctattaaatctctccaatacttgatttcctagattatgaaataatactacacactacctcagagaatcattgacagaattaaataagtcaggtaatgcattgaacacagtgcttagtacaacaaatgttactaaatgtaaacatttctacaatgatgagtgatgattctgttatgtacagatatgtactaccatttgctagtgtatcacaacagaatagaacacatcatataatatgatgcaagttatattaataacataatgtctatgcatatattttgttatatccatagaaaattttaacaaattaatagcacagtgtgtggcctttactacactcaacaaatgttagttatattattattatcattattacttacaatggctttcttcagggggaggaactataggagatttcttcttttcacagtatatttctgctgtttttggtttttgcttttgtttgttttctttaaaaaagtattacttttttaaataggaaaaattaaagactaaaaaacttaaattgctcttgaatagatttgtaatcattatcatatactctcttaaatcacttattattcaccttttataatctttggaataaataataattaaaacttccattttctttaaataagaaaataatactgctttataaatactcagtaatacaaactaactgactatttcctgaatttgatagtgtctttttcaggatatccttcttgtaattcagtaaatagaaagggcccccattaaaaatcacatggagaaagtagggtgtagggttgggacaaacacaccaacgtgacttgccttgtatctcttatttcccattttagatactggtgggttaaatttacttaatatcaagttcaaatgtatgtacagtcttaggacttggttgttgattcttaagagtgtgttgaaaaaataaagaagtcagctaggagaagttgaaagaacttagactttgaattcagatgcctgcctttgattcttccttctgtgattttgtgctctttggcatctcaaaaactcagttttcctaccttgagaatggggaaaatccccaccctatgagtttttcataggcatcaaatgagacaatcaatttgagattaagctataaatgtaaagcctcctccaaaatgctagccagtgtgattttttaataaggtcattatttttcttccttttaggatttctctctcccaagaccaatagtactaaccaatattcaggcttcattcatgtttcagcagggcatgggaatggttgtgggtttctttgagctcactggccatttattgttattgattaattaactcgtgataaacagctggtgaaaaacccaggataaggaaatgagagtgatggggtggggttgggaatggtacataggaggaggctggaatgatgaacaggaaacagccatgcagaactctgctgaaagagccttccagaaaaggaaacgcaaaagctaaggctggggcaagttacctgtattaatataagataacatcaaatgggctgtccttccagaggagtaactgagcttcctttggtctacaatggaatttcttcccattagaaaatttgacccttttttcttgcaaaagataagccaaagatatgtgaattgcatgacagtgatttaggatggaacaattccttatttgaggaatgcttctttttctattttacttctgtgcccacatagcacccagcttacaactaggagcttagtcatagacagttctcaatgctggctgcacattagaatcaaacaggaagcttttgacacctcactattccaagtgtgttccttagaacaccactgttgacattgcaaaatgcagaatctcaggcacaccccagacccactcaattagaatctgcattttacgaagatccctaggcaatctacatgaaagttaaagtttgagatgtgctgtacaatactgtgccaaagatcaagcttcactcctagagcttctgatttatttggtctgggaagaagcctgccttggcatcattttaaaaaagaaaaagaaagcttgtaatctccaactgatgagaacgtacagcaaaacttgaagaccactgacttgattgttctcactcacaggccctcaatcactgatgactatcaagcacgtggaaatgggattcatcaattatttaaattgcttgtttgagagtaccagttatgttttaaagttttctggcttttttttttcttttcttttctttttttaatcatactttaagttctagggtacatgtgcacaacgtgcaggtttgttacatatgtatacatgtgccatgtttctgtgctgaccccattaactagttatttacattaggtatatatcctaatgctatccctccctcctctgcccaccccacaacaggccccggtgtgtgatgttccccttcctgtgtccatgtgttctcattgttcaattcccacctatgagtgagaacatgtggtgtttggttttttgtccttgcaatagtttgctcacaatgatggtttccggcttcatccatgtccctacaaaggacatgaactcatcgtttttcatggctgcatagtatttcatggtgtatatgtgccacattttcttaatccagtctatcattgttggacatttgggttggttccaagtctttgctattgtgaatagtgccacaataaacatacgtgtgcatgtgtcttcatagcagcatgatttagaatcctttgggtatatacccagtaatgcgatgtctgggtcaaatggtatttctagttctagatccctgaggaatcaccacactgtcttccacaatggttgaactagtttacagtcccaccaacagtgtaaaagtgttcctatttctccacagcctctccagcacctgttgtttcctgacatttgaatgatcgccattgtaactggtgtgagatggtatctcactgtggttttgatttgcatttctctgatggccagtgatgatgagcattttgtcatgtgtgtattggctgcataaatgtcttcttttgagaagtgcctgttcatatcctttgcccactttttgatggggttgtttgtttttttcttgtaaatttgtttgagttcattgtagattctggatattagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctacctggaggcatcatgctacctgacttcaaactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaagtattccctatttaataaatggtgctgggaaaattggctagccatatgtagaaagctgaaactggtttccttccttataccttatacaaaaattaattcaagatggattaaagacttaaatgttagacctaaaaccataaaaaccctagaagaaaagctaggcaataccattcaggacataggcatgttttgtggcttttaatgaatactcttaataatttgtaaatctttctctagaatagacttctagttcccattagaactagactagtggttaacattactgttatcacagatcagagactgggatgcatgataagttttccttgtcttccttcagctctaaccacaccgactttctcatgtttgggggtgatattatttctcactgtatttgcattgcaattctgaaaaatatcttcctatcccacctctgttttgttttccatgaagtgagcaaatttaccaagtgatttggaagaaatttatataattgtatagcttgaaaagcctttttttcccctacaaatgtattatttaggacatgtaaaatttagcaaacacagatattttaagcataatttactaaatattgatgataacgcatgctcagaagtcttcatttagaggactctcaatttgtctgagtgtaaactcaattccaacaatcaaaataatttgatatctggtttttgctttagcaacttcacttggttggccaatgttttaattctccagtccttgatctctcattgtggtaaacccacaggataattttattagtgctttgattttctgtaagaggcttttttgtttttctttaattcagcatataattggtgcatgtttaaacttatttgtgtttcggttgaaaggcagttattagtagagagtatcaatagagagttattatagagagtattagttattatttgcagaaatgttaaccttactatctagagcaggatctttctgcctcagcacattgatattttggactggataattctttactttaagggatttgtcatgcgttgtagagtgtttagcagtgtccctggtcgatccccggtagattccaataacaagctgccaatcatgacaataaaaaatgtctgaaatattgccaaatgtcccctaagggtgcaaaactgcccccagttgagaatcactgatcagtagagatgaaaacagaaaaagaatctgtaggcattttgtgacctaaataagacattcttatctccgtgttgctagcttttattttgtggctgagtgaattgttttcagtgtgaagaccaatggtacactggatttctatttaaagatggtttcaaatatgtaaaataattgatagtttacaagccacccaaacatatttccccacttccttttctgagtttagttgagaaaattttatatgtagaaagctgaaactggatcctttccttacaccttatacaaaaatcaattcaagatgggttaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaagagaaaataccatcagagtgaacaggcaacctacaaaacgggagaaaatttttgcaatctactcatctgacaaagggctaatatccagaatctacaatgaacacaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttagaacggtgatcattaaaaagtcaggaaacaacaggtgctggagaggctgtggagaaataggaacacttttacactgttggtgggactgtaaactagttcaaccattgtggaagtcagtgtgttgattcctcagggatctagaacttgaaataccatttgacccagccattgcattactgggtatatacccaaaggattataaatcatgctgttataaagacacatgcacacgtatgtttattgcagcactattcacaatagcaaagacttggaaccaacccaaatgtccaacaatgatagactggattaagaaaatgtggcacatatacaccatgaaatactatgcagccataaaaaacaatgagttcatgtcctttgtagggacatggatgaagctggaaaccatcattctgagcaaactatcgcaaggacaaaaaaccaaacaccgcatgttctcactcataggtgggaattgaacaataagaacacatggacacaggaaggggaacatcacacaccggggcctgttgtggggtgggggaagcggggagggatagcattaggagatatacctaatgttaaatgactagttaatgggggcagcacaccaacatggcacatgtatacatatgtaacaaacttgcacgttgcgcacatgtactctaaaacttaaaggataataaaaaaatttcttcctttcttccttctgaattttaaagctccttaagtcaagtgaaaaatctagtcatttacctgcgaagttcaaataaggaaatgactttggctacaattattggagtgcttcaggtgcaagtggctgtttgggcctgataatttagagatatgggacctcacatttactctctctgcatgcaaagcagtgggtctcagccctagctgcaaattgagatcacctgggagctttagaaacttcatacccaatccccaagccccagagattccagctcagtggtcgagggtggtgcataggtattttgtagagctccccaggtaattctagagtgcagtcagggttgacacccactgatgtaggtagatagggctttgctgcctttctccttcattgatcactttcccacatttccctgtagcctgctttcttcctgtctgcaacatcctggtcaaactcttctgcctatcccttgttattatttttaaccaaatgattttttccaagtgtttttcctttgttcagacttggacttggcgtggaaactgctggatcagtctacttaatccatgaccttctttcagctgctgccttcctttcaactgctgcctttatttcaactgttaacctcagtccaccttaaaaaatatatatggtttttaagcgggtatttcttcctttgccagcaaatcattatacgcagttcctgtctatgtttaccaccatcacttgcctctatttctttttccttactgctatttatagtttaattttctttcttttctttgtgctcttttttattcatgtttccatccttagatgacatgctcacgttttgtgaattaggtgtgtttcaagatgctgggaaagtaagttttctgtgctttataacttcagacccgtgtatttggtttgtgtcttatttaaaaatgtatgttcttatggccctgtttgccccacctaagcgtttaaatgtgacacctcatgtctgttgggctcccaggttcctattatggccggtggatctgggccaggcaaaccatcctaggcctcaggcatctcgtcacgtctagattcacctctccccttcccacaagacaggctcacctgccttccagccctgtagctgctggcctctccctgaactccgtggtctctagcaacctttggacttctaagtaatattgcaaagatctttatccttggcttgcttgagagcatttctgctaagccctaccagcaactttcatcttgtttcctcagttagttcttctaaaataaatcataaattgccccattgctaaaacttacgtcacattctttcaattctagtatctgagtcattgcaaaaaggcatctcaggttcgttccagagatttggcaggggagcttcccacaactcagcaaagtgtttggcccctttgggccttttcactgagacttgaggctagatttgctgtgcctgctctgtcctttcccttctaatttctcaggaattgtctttgctgtcttcttgtgttctctgagatcacacttccacagctgttccagaaacatcacaccacttgtatttttttaaagccttagcttttgcttgtgggttcacttgtacaagaatattaacgttgactctcactttgtgtaatactagtatatcaagctagtcttttaaaaacaccttttttaagcctttaagcccaatttatatatctcatttttttatcatttttgcattaatgtttaaaaacaaaacaaaacacaacacctttcttttgatcccttaaataccagctagtgagactttcaaatctagcacttaattttttactgagcatctaaatattccttacaaaatttaaacttctagatttaactcatcagatttcctcaaacacttaaacagagattgcaaacttaaatcattaagtcccaagtattttagttaaaatcataagttcgatatgtcagattctccaaaacaattcaaacacctcaaagaacaaataaaacttgcatatcctaacatgttgattccagaagttatttttacactcaactcaattgtattaataccaaagtttgattaatttcttcatttgccccatgtattttatcaatattactactagtacctgattagtattaatactggtagcagcattatcattagtattcataatagtgttaatgctagagctatcatcattattagtaccagcaccagcactattagcatagaattagccttggtcttagaattatattagtattagtatacttctcagagttgcaaggttactgacccaaataaggaaaacagaaatgatagatacagttattggttgagaatgtgacttcaaatttataaattgggggttttcagtcagagattttggaccaagacaccaagaactagggtttgccattctgattcctcaatcccactgggcctttattgtgctatagtcatttatacagtagtaagaatttctaagcttcaaccttttcttgtagtctggtgaatcatggtcatttatacttaattttcttacagtgttttcttatgtaatttttattgaaaatttctgtgacaactttttattgcctgattggagagggtgaccaatcatccttgtttttccaggactggagggtttgctgggacatgggaacttttcagcgctaaaaccaggaaagtgtccaggatgactggttatcctagattctaggccagtggttctccacccccactagaatggtctggggaacttttcaaacataccaggccccaagccccacctccagagattctgatttaatttgtctggggatagtgcccagtcattgatattttttaaattttctcaagtgattttcctgtgtagccaaggttgagaaccatcattctgcattctctacccaatttgaaacaccctatgcaacattgtattgtctactttgacctcctggaacttagcaaaacttgaatttgacaagcatgtgtttgggttcatcaatgtgaagtatttccagtaaatattcctgggggaagtcatgcacatctttcttgagcagattatgttatttgttgtttttgagtatatgtgttctcatgacttttcacagagttttttgttgttgattaaactgtcatgctttcattagtgacaactgcattaagctggtccatttgtccagttagcaccacccttgaaagtattcaagcttcttggtaacaacaaagtgttccagactcatcctggtttttcctgccacaagacatggaatcaactacttttcaaggatccctgtgtctttcactttttagttgaaagttttagagaccaaaatcttggctacccgggggcacatcgtgttgttttacaagagcattcatagtaggtagatcttggatccatgatcttatctgaaattgaaattcttaattctctcacatggtttttgtgcatccccattgtccatcctgtagatacttttttatccttattctttttttctataaatcaatatggtgttctttgtgtttttttcaagcattaaaattctgtcactcttttatttactttcctttcaaatttcaactgagaatcaggaaaactgtgtgtatagacttcatttattttctagtttattctgagaggcaaggggaagcaccctgttgtcttttccaggcacaaactctatttccttttatagtttgataatttcttcgttctccagtactcatattttctgaagagtcatcactccttagcttatttcttcataagttatagccaactgagttttatacatgaagtggaaagtggattttcctctgaaatgagaggaagtaggtattttgttgccttttaaaaagaggtagaaatgtacgagcaggtcaccctctcagtcctcatatgggctgataatttgtacctgagactatagatttaggatatggggcagaaattgagtcagaacagtacagccaccaatggcagagaccacaggccaaggctcaaaaataaaacccacataaatgttattttagtgagttttgccctcatcctgggttgttttgtagggaaagtgatgggagagagaagggggcatatcttaagaaggcagtcccttttgcagtgttttctgacttaatcttagacctaactcttaattttagaattcactctgagaagatattaggcaaactcttactatcaaaggatttccctcatttgggatcctgagtttcgtcaagtcacttcagatcagcaataaaatccccttgagagtttccagatttttctccacaatgaaccatgaagcatgctgtttatttgtggaactcccactcctggttcttcagaactccttcatttgccgatctaaagatagcaaaaaaggctcttaaaaatacacgccttattgattttggaatgttctggtaaatgccaatctgattgatgtcatttatgtagggaaggctttggcttaagccccaaagtgattttagccaagaggaagtaacgtatctaataaataatgtggagtttgtgtattcatccaccaaataataattatcatcactaaaaatgtgactagagatgccacatccacttctccattgaggtaaatttctaacagacaaagccaagtgaaatttgatgtccgtataagctgctttgacctcgttgtttctgactttcattacagatgaattttcatttgtaattttgttgttgttttttggtttccttggtactttgatttgtttgggcaaaaactcagtgaatctgtagtgatttaggagacagtttaatcaacacaagtgcccatgtttcagactcagacatgcaggtgatatttattctgggtaattttgggggatctacaccttttgtttattctaagatgacgaagctgcattattattttatatgtaacatgcactcattgtaaaaaagttgcaacgatagacaaaattataaagagtggattgtaataagaaaaaattctgagtacatggcaggatccatatactatgtgtattcttgccttattttattgggacaacaatgaaaataggccaatagtttatcacatgaagagccagccttcacaaatacagctctgtggaattgtatctgagcataaaaacactctttatttaattattattaatataacaattaccaataacctttatatctatctatttacttatttatcttttcctgtggtggggggttcaaaggtttctgggagtgatcaggatgcccaaacttcctctaactttaaaattttaataagtaaatgaagaaagctccatgttttcctcctagagtttaattagctactaatataagttgcttagcccaggatctatcctatggtggtaggtgttcattatgtttagctaaaatttccatcaccattatcatctttgtcatcattactgccatcactaccacaaccaacaacattacaatcaccaccactgtcatcatcaccattgtcatcatcctttaatactaggcttgaggaagctaaagggagccaaatgtacatttatgtcttatgtaacattaatgttacttgtcttattcctaatgcctcatcttaaatgtaaagaaagtaagaagacccagagatagttaactttgtcgtctcttgactcccaggatcaaaaatagttgttgctgcagtgtttggaataaaaaagcttaaaagaccttgtatacaaaagtggttcgtactgccttctctcgtgaattcatgccagcagatatttttattctggtaggaagtaactaaaagctttgttcaaccctggtctgccagcctctgtaacgcacgtctgacaaatatgtgtgactctgtgagaaagtttggttctccccctggtggcaaaaggaaaaactaacactagtgctccttatgggagtgtattgatagggtacgagatatgtaaatacagctttacccttttcaccagtgttgcctgagatttttatctcagcccccttggttacttttgttctttggacaacaactggtttatatcttctatggtcgttgggatgaaagggatttgacaaactgacaaagcattttgcttcagaaaccacttgaaaaacacatctatgtttcaaataaagattatttcaggatcataaaaatatgctcggtgtattagccatggaactagattttaagcttcatgatcatagagatagatattgggtttattttattgttattgcctctgaactgagaaaagactctagaattctaaatataacgcacacacttgaactaagtagacggaaacttacccttctaggtaggtaactctgcttaccttccaaacagagtttggatgatattgcctcatagaaagattttttgatacaatactcaggaaccgctatggactgctgctttggggccaggccccatgccacttgattaaatacatcctcacttaacctgtccctacaacaactctgtgagggaggcatactcataccgaagctttagccatgtggacactgctcccctgaaccacatgcgtagtcaaatggttagggcagatttcagctcatgtctcttttattcagaacccatcctttaagccagtagttctcaatgggggtgatttgactcccagaggacacttggcaatgtctggaaacatttttggttgtcatacctggagaggtgctactagtcggtagaggccaaggatgctcctcaacatcctgtaatgcacagtgcagcccccacaacagagaattacttggtccagatgtcagtagtgccaaagctgagaaactgtactcctaaccagtgctactcaaaatgtattccacggaacagcagcatctgcaacacgtgggagcttgttagaaatgcagaatcacgagccctgtcccagacccagtgaaccagaaactccatggttggagctcaggaacgtgtgtttctacaagcccccaagttcttcttgcacactcaagggagagaagctctgctctaaaacaacagatcattctgtgtctattgagctagacacaatcgtatggtttcctcaccactttcagtgttccgttgtcgcatagaagtatctcctcaagcatctaaaaggggaaagtctggcgtacactaggaacaaatgtgactcatggggaaatcagtgcaattacaaatccaggaaccacacccagctgaaaatctaggaaggttctttttctcttattttctctacttaagaagggaagtctcggagacttagtctaggttcaaaagatgtcaacatatacacaggcttggtttggggtttgattatctaaaattaaaccttaaattgaattaggtaaaacccattttggagagccacagaattctaaattagaaattacattgagtttcgtatttactggcccaaataagtaatcttctctatttgtgcatttttctaatcacaaattgtcttctgagagccagtgaaataattatttttatatgggtctctcttcaataattgctcatcacttggtattttatgtgatttttgtggggcatacattataggcaaggatgtattgtaaaggataaaaatgtcagataaaacatctgtgtttaggtagtttgtacgtcactgtcctccatcccacctcatagattcctactgcttggctataactaagagtagaatttaaggctgacacaggaaaccaggcaatcaagttcattaagtaccttaatcaactctggccagaggatgatctcagagctcccctatctcaagaagaaatttcatgagaaagctttggggttacttccagattaaagattatgttctggacagttcaagccctaaacaacagacacatgaataagtggagccatttctatcatactttttcagggactgaagatataaatattgctatttgttattaaaggattttgtttgttaaacctgatgatacttatttttatgtgagttcatagtattccagctcttcaaaacctaatttgtttgtagatccctcattgtcatctttgaaaggttccagtagtttctggaatactttcttttcctatgccaaatacaacagtgaccaagaaatccatctgaaggatttggatagtgtggtagcatgtattgatggacccagtgttccactcatccctgtatacatgctctttaggtaacatgacagtgccctctaactctgactctggagtcagccttttgactggctttggccaatagggacatggagaagtgatagcatacctgttgtaatcctagacctcaagagacctttcttgttcacacttgtccacttgtgcttctgccatggccatgagaaggacatgtctgagccggattgctggagaggaatgagagacatgtggcgtagagctgcatagctaagcaactccacccaagcccagcctagagcacagccccctgcagatgcatgagctagtccattcaggatcaaccactctccagcttccgagtaggttattacacagcaatagctgactgatacacatgagtagagaagaaaagaattttccaagtaaagataatagtattgataaaaccgtgaagagaagggtctatcaacatgttggatcacgagaaagttggcttgagtgaagtagaacacgcttattgagaaataatcaaaaataaaactggatagagagtgctgactcaaattatagaggagtttaaaagccagccaaaagaatcatagtattgtgtgaaagtgccatagaaataatctggtgccaggtcttcaactaagacaaagtgattagtggccaaacaataatggtacccaagtcttaagtgtttgtaagtgatgcaataggaagagataatggaatgatggaacagggattttaggaaggtaaatacaaccatgagttagaaggaatggtttggctgtccctagacatattacctgtgagacttttgtagtattatggaactggagtcatgaagctctgaagcagaggatggtcttcgggaatggaaaggatagttatggaagaatttttgagaaagaaaaaatattccagttatctattgatgaaacccatgtttctctcctgatcacacttgatatttaatgagagagttcttattaaaagtaaccatgtccatgaaggatcttattgggatgaagaaagtgttctaaaactggtttatggtgatggtagcaccacttggtaaattttctaaatgtcattgaattgcatgcttgaaattgttgaattttatgatatgtgaaatatatatcaataaagctgttaaacaaagaaacaatgaaaatccccaccagttatgttccatagtccctggagggggctgttttcatttgaatacccaaactcatcctgtcaagtacaggtagcatcctcctcttctttctcagatgacactatacgcagcgaaccattggggtgcccacatgtgccacacagcctagagccaccactgtgtccatgccagtggtactccatgtagatgcagggaagagcccttcttccccatcctggcccagactgtcagtgagtaacaatgacgtgctgcttgtatccatcatgaaaacagtccctttcatcttggccagaaaccctcttttcctagatctgagatctatgtcctgtgtttgggcccacagatcagttccttggctccacttctcaactgtcccttccagttgccatccttcttactttttctgtcctggacctatctctctcactgtcgtaaaccctcagcctcatttgaatgttggcaacgaatgaatggtagcaaattctactactaaaatcccgctcacgaggggactaatcaaaggtgacattgaaataagtcttctggattttaagcacaatatggggcaaatgaggaaattgatataatctttttaaaaaatttaatagcattattgagctctgattcacataccatacaattaactgatttaaagtgtacaactcaacggcttttagtacattcctctagttgtgcatccattaccacaataaattttaaaatattttcatcactccaaaggaaactccatacccattagcagtcacaccctattttccccatcacccaccagcccttgcaaacactaatctgctttctgcctctatagatttgcctattctaggcatttcataggaatgaaatcatacaagatgtggtcctttgtgactggcttctttcatttagcatcacgtttctgtgttcttgattcaattaaattaacacaaaactttgggatccattttgtgccaagcactatgctgggcactggttggaaaaagagcttacctttctgggaaagcagaacaacaaggaaacaatgaatcccattccatttaacagagggattgatcatttggagtgtgcaagttgaagcatgaggtatgggactcacactggaagaattttgctctgcaggccatcaaagcaccagagtattgaaccaggcaaattactttaattgtgctcttgagtttattagatgtgaatgtcttgctggcaatcatggttttactatggaagcaaactgaggtcttggagagctcattctgtccttaattgtaacatttagtaccaagaccttggacatggtacctctctgggccccccttgtctcatcaggaggggtagaattgatggtctttgcttatattccacaggtcttagaatgatcagacctgacaatatatgggaaagggctttgtatgctgtaaaatgacaaccaagcatgattttaacaattgtgctgcacaaaataagcattttgctgtaataatttgtgatctcataagcattagtcttctattgatgcaataataaatgaccacaaacttagtgtcttaaaatactacaaaagtattatattctagttctgtagactagaattctgacacagatctcactaggctaaaatcaaggtgtcagcagggttcctttgggaggctccaggggcagatccctgccttttgagctcctattaatagaagctgccctcattcattggcttttgtgcccttcttccatcttgaaagtcaacagtgttgcatctccctgtgcctttgtgcttttcttccatttccctttgacagactccaactggaagagtctcacttttaaaggttcatgggattagattggttttacctggataatccaggataatttctccttctcaaggtctatacacttaatcatatctgcagtgttcctattaccatgtcagtcaaaatattcacaggttccagggatgggtgtgtggacatctttgggaggccatctttctgccaatagatgagtttctgttatttctctccttatcgcatctcactgtgtttgtatgtgcacatgatcatcttgttattttctctcttctgtatttacagtcttttttcattttctcttttcatgctgtatcactgtttatccttttttactatttctttcccttgctacacatttcttttttcccttattgttactatcctttactgcttcttagtattttctttgtatttcttattcatttggctatttatggatattttgaacttcctttatcttcctggctttttctaatttaattttcttatcaccttcctttgagccctcttggtctctatttttacacaacattgagtcaatctctttttctgtccttcttagcttcctcttctaacccttgctctcatgcagaattcttatcttcatttacacacattgtttaacttttgtagctccttcagccctgactgtgcagtttatatcttgacaaatgggaggcgggaaagcagacatagcagggagaagccattggtactgagaatcacaatccacatctacataaaaatgccccatgttctgcagccaaacttgaaccttttggagctcctgctaaaatctcttaaggaaatctcaaagacaacagttacatgattactgattacacatgcgtaaatatagaggtatgtttaataagaaagatcagaatagaatttggagtgatctaaattacctaggatagatgaagttctttttggtgtaaattttcttacaattacagcaacaacaacaacaagcccttcaaatataaatgtttcatgtcattgctttttcaacttatatttattttgtatgattctaataaagtaagcatttgatcagttgcagaactttcatgtatggacattgcagagaatgatgttgctgataatgaaatggcataatgtgtgtaaaactcaggttcttagtctttttaagccccagaacaaatctgttcagaataagatctaagttatacatttgctctccagaggaatgtatatgaagaaaattttgtatctgctttctggaggtttcattcataaattcattctataagtatttactaagcatatataaagtgaacaaaaacagagatactgttctaggcattaggaatacatcagtgaataaaatacaatactttcttttaaagagattatgctgtagaatagggagactgacaagccaataagtatataatatgccaggtggtaatacagaagataaggggatagaatgatggaggggagtcagtaggatggtagggaagctttctcaaaaggtgacaatcagaaatatgacataaaggagacctgatatttaaaggatgagtcaaccattgttaacggcttgctatcacttaggttcctgtgtgggaagtcaatttagatagtcagacaaagaaagccctttttgtctgttaatgtgaagaacaggttttagtttaacttcttacgcatagcagtgagtaactagaaattagcacattccagggacaacatactctttcagatttatttgattttccaatatggctaagcaaacatatgattattcattgaaatagtagctccagaggtggtattagattgcctacttctgaggaattaagagaagaaatggttgcagataaattttaaaaagctaacactttaaatgttatagcacctagatatacagcattgtccaatagaaaattttgtgatgctggaaatatgtaatatctgccctgtcccagtgaatagtcttcctcagaggttttctttatagcttccacatctctgttgtttgagatgtcccaaggaccacaaagatggaatctccaccctagagcccacctgagagggagtgactactcaaagcctctttacgagcaaaactgtggctcctaagtacctggccaagtcaaccacagtcctccaggatcttgttttgaattttaaagctgctctctcttgggcccactccatattactaccacggagagggtagctaggccatagtgcttctgtgaaggaggaagagccccttcaaactccagtcctttacctcaacaggcttagctatagggatgtctcctcaggcttgtgtttgtatcttcagataatttccatgggatattggtcttgattattttattttatgttatatagtcaaaaggctgataattgcttggtctcaataataagacattgcctcctcactgaaatattaatcagaatggtaggtggctgctatctctgtagagtaccaatcaacttaatctcatttggataaattttgaaaatgaaggaaagaaatgtggctacaaacaccatgttttattttttagcacctggaatcccactccaaaggagataaatttatttcactaaccttagcaaacaaatcaaatttacccactaactccacctatgcccaccctgcctaggagttcacacttgttcaatcattccattccattgcagcccaggtgaaaaaggctggttgaatttgagatgtgacctttgcttaaatttcatccccaaagtgtgcccctcagaatgtcacattcttttggtaaatagccctttcaaagtgaagacacaattatttcatgttatttatatgcttgaaatgcagaccttctgtttttcaaatccacaaaagcaatgatttaattttcagtagttaggaagtacttgggtcaaattttagccaccttgcttcaggataaatattactatcatttgcttttttctctctctcttttttttttaaacaatgtcttttttatgaacttgagagggctggtgatgattttgttttgttttgatttattttccccaaagtagagaaaacaagatctcctgttttacattttactttttattttacttaccaagcaggaatttgtcggtctgttgtctcacctactaacatctgtgtatcctggcattgaagattgggaatcacaagctctttaaaaggctgacacagatgggcagagatttagcatcctaattttaaaagtatatatatatatgtgtgtgtgtgtgtgtgtgtgtgtgtttgtgtgtgtgtgtgaaaaaaatagaaaatattcatatttaaaaatttagaattattagaatctttagtttcatggttagggatttgtatgaataatttttatttcaatatttacatatggcaagcattctataaacattccaaattttttgtacctgataagaaagaaaagaataaagcaatattaattgtggttggcttttgaatttccaaagtctttccttaacctttcagcatcagtagaattgtaaatcattgtcccaattaagttaacaataatttcgtttcttttcttttctttttttttttttttttttttttttgagatggagtctcgctctgtcacccaggctgcagtacagtggcgcgatcttggctcactgcaagctccgcctcctaggttcaggccattctcctgcctcagcttcccgagtagctgggactacaggcgcgtgccaccatgcctggctaattttctatatttttagtagaggcagggtttcaccgtgttagccaggatggtctccatctcctgacctcgtaatccaccctcctcggcctcccaaagtgctgggattacaggcgtgagccaccgtgccagtcaacaataatttcttaaccattctgtacaattcacatagcatgaggaatatgagatcaatatcccaaagtgaacatgatttttaaaaaatccattctttattaatattcacttggtatatatttaatcactgactcattagtcaagaagtatctgtagtgagaaaaatgtttagctttaaatactggtttcatgtgggaaaaagttaatatataaacatatagtcagtatatactttatttactaagaaaacacaattttgctgaattttccatctgattataatgacacatctagatattttaataataaagctacagcaaatacttgagggtctttgaaaggagaaagcaggttctatatttcaaaagtagcttggatataaactgcaaaattatttctgcagatgggcttgtttccccttttgttttatcaactttagatatttatgtcttaaaattaactaaagcaggacacagaaataaccctcttctccatttaaatatatattttttcatttgggttctagattctcaaatgattacacatatacattgttaaaagcttatgagatacattaaatctagattaaaatgataatatacttttacagagacatttcctgtagtacttacagcagagtcgtggatcaactcatctattcctaattattatgtagatattaggatatgagcatgagctcaagtactagtatttattttatgatatactggcagaaatcagagctgttgaatatgtttacttgttatctttttcattaagtttccaatatataaaactaggcattatctttctcataaataatatttgattaatttgttagtgattaaccatataccaaagggatatttgcatagaaatttttattccaaatctctccattgtagcttttaattacctctattaaggattatagtaatttaaaattattaaagatatctatgaattcttcaaactaaatcactgaaatgtcaatgcaagcttaatggttttgttgttgttgtttttggtaaagtagcatggtcttttagttaagaccagatagtaaatattttaggcttttctgaccataagatctcagtcacaactctgccatttgagtacaaaaacagtcatagacaatacacaaatgaatgtgcatggctggttccaataaaactttatttacaataacaggtgatgggctggatttggtccatggattatagtttgctgacccttgcttagaggataaatagctgtgtgcttgtagaaccaatctggtgagggaaacacttaagggaccatgttaattttaatgttgcacatatcctggttgctgttctctaggaaatagccatccctccagtcagataatgaaaatatgctggtgatttctcttctttctgcatggaaatcttcttaagggattttgagaattatccatcaagtgagacctatcagtgctcagtgcaaccctggtggaaaatataaattagttattcctactatttctataagtaggccctccagtcattgtgatagttgggccaatctttgttaagaacatgttgttgttgttgttgttgttgttgttgtttgtaagcatactttgaaaatgacctgccatgtaagtgtcaagaatagttaactcaagatggaatcatgattgacctgtagagtgtgatgggcctcaggaagcatgccctggtagttctgtgagttctcactagggagagacattttattatgttcttcatgccataggtactatggtctaagcaagtgtacaatgaataagtcaatgaattaatcaatggaaaattatagtctatagtgagctttgaattgtaggaggtaaacctatagcacattgtcacttcaaactcaacatccagttttacaatgactaagtagagattttctagtaagaaaattatccaagtttctgatatcacttttattctttcactggtgactctacccagagagaaagaacatgggtcctacattaggactgacatcagaggaaagagaaatgtttatagccagaagggaccttgaagatgaggaagagaataacaattttgatgactgcaacaatgatgttgacgctataggtttaaatagtaagttgttatttacaaaatgctgtttcagtcctatcactttccatgagttaaaacgaaggtttagattatgtgacttttgaaaggctaaaataaagtaagtgaaactggaatacttggaattctgctacctgatacccaattaggaaaaagagaaggcaaagtttaaaacaaggtctaggttgatgagttggtctattaaacttttctatttttctaatattcattctctttcttctggtaattctgggttttagaagagtatatacaattgaattgcttctgactgctgctattgacgcatgctaactaaaggaggcagcctcagcccagggaatttaatccagtcaagtgataattaagcatctatgaattggcattaattgccaacttttggcccttcctgtagatctgtccaaaccttgattgtaattcctgcatgtactgacaacttgatagtttagcatatcccagtgtccatttttaaggcactatccaaaatatatctctgctcattaccctttgatatttatctaaacaagtaacttctgatgttaagctttgagtaaaacgggggaaatggcagggaagaactgggcagagaaaacgggggaggaattcaaactacacttgataactgtgatgatgacaatttcagctaccaccagttttgaacatttacaatgagggaagatagtactgttttatatttattatttcatttaatcttcacatcattcctctgagataattgttattctttgtatctcatatataagaaaactgagttttagagggatcaatacattgtgtaaggtcacaaaggtatgagtgatgagggcaaggtttgacctcagctctgtggcttctaaagagtatcctgttgagcactaagcaatgttatgtcataatagctgggctctaagtcatggctaactaggaaaacttggagacccttgttactcaaagtgctgtcctcagcccaacagtatcaggagccccattccagacctgctgaataggatctacattttcacagaagcccccagtgatacattaaagcacactaaaatttgaaaagcatggccctaggcttttcctagacaacccctgcccagtagtctgaaagtccgtagagatactttatcatcaggaaggggagtaggcaaaaaaacaaacaaacaaacaaacaaacaaaaaacctaccacaatgtcctgtaaaaagaaagctttctccagcttctgaaatgcacatgtagaattttacagaggggctcaagggacccgggagaatagtgattagagggtcattcaaactgggatacttttgaaagggaaaagatcactaggaataattaccctggcacattaggcatgaactggaactgcactaagcaaactgggacatatgggcacctaagtcttacttggtgagaatctaccaaaatatcaggattttttagactgtaaaacatgaaaccagagagacaggaaatttaaagtctacaaatttaaaagggtgacaattagttattgattaaattattttattccacaaatatttatcaagctctttccttctttgtcaggtactttataagctacagagatatgagatggacaagacacaatagaacttaacaggactaggtaataccctttaagcttgacaacagcaatattaggaaacataaaattagagttaacttcatggaagtcataaattgcaagcatcctggttctatttctatcctgtatcttaagaagtgatatagtctaatattttaattcatggaagatgaatccaaatgtgataattaaggcaggttgggaagttagaattggaggaggaataagaatgctattttagatgatagccaaaaccatgccctccctaatatgtcacggggatcttctgacagatatggaaccctgggccaaatgggccataatgaaaattagaacacatgtaagctttggagtttatcatcttttgtgtgttttagaaaagagtatttatcctagggctttgttcaccctgagctgtatcttgtaaatgaaaagtacaatgtgtgcatcttccatgccgaaaaataaacagcaaccttacccttttgtaaacagtaatgcaatatgctcaagcaagatttacagatgcatccgtttagataaacaacaagaatccttattaacaattagtcctcatgcaagacccacggcaatctgtgctacataggaaaactattttacgatcaccatgctttctccagtgcctaggacagagtctaatgcacagtatagatcagtcaaaacttgtgggtttagtaaatgagtcagacggcatttcagggatgctgaaagaggagaacagtgtagtccttcctgctttaattctttttgcagagtgcagaattggttgaaggcagttcacgtagatagttccaggtcagtgcaggaaaccaggaaggagagggcaagaattgaccttgttgctttgccaactgactcttctattctggttttgtttccttcatctggagaagcagatgtgcctgcctgatagggcggaagcctggaagtcccacaatctggaggtaacatcctggtctctcaaacttcctgggtgattcattagccagccacaagcacaagatctgtcacttccagaaacttagccccatcaatgttcttatgatatgagcttaagatccagaacaaataacaataattgggaaattttaaatgaccatattatttatatataatactttgtgaggttaaaacaagctcacttaaaactttaaatatcctttgttatagctagttccacatgaaagtactgggtcaatttgtccttgtagtcaaagattcatcacaaatgaaattcaagtatgggcagcacaggccccatttcctcccatctcagaggcaaaggcatctgtcatcctgtccaaatcccatgcagttctgcttcatcagggtcactccagatagcatcatgttaactcttccccagcttcaacttctacactctcagtcatcttgtcatgtcaaaacccttccttgagcaaacctcttctgaaagccatctcttttttgcaactaaatctctcataagaatagtttacactcaaagctagttcacatgctcatctatctactcctgaactctctgctatctggcttctaccccatcattcctttgagtcttctgtcttcagggttataggcaactttgctgcgaattcaggagagtgagtccttattgcatgttacctctggaacctctgaatccagctgttttttcctgacaacgtcttttcttcccttttccataactctattatttctcctcctacctctgggagtaatatgtcttgctctcctttgaaggcatgttattcctcacctgctccttaaacatacttccatcttaggcctcttctcctctcactgtagacacatttctttcacccttttatcaattctgtggcttaggctactactttgttttatgttcttccatgttgcaaggaacagagacacacttggttatttcaggtaggagatatccattgtaaagttacacaggaaagaacttaaaaggggaaaaacatcttagcccttgtgaaaactgaacaccaccccatgcaagactcaaaggaaactcatccctgtgcaaagtatgactctagtaacattcgacatttaccaggctgtagacttgatgctaactagctttctctctttctccccacctccctcacttacccacgtcgctctagtctactctcaaatacctttcgttgacttttcttctctttccctcatggcttctgctccttcatgacatctgatgtctcttggtttctgctatctctctatctacccataatttcttgatagatacaatttattctataacttaaaacattgcaataatttttatatttgctttccttctgctttcaatgccttctggaactaggtggaatctgaatgtatgtatgtataaacgaatgaatgaaatattgaatcagatctactaactttgtctttgtatcctcactggctgcccatgatgtcatagttgccagttaatgagtactatataactgccattatgccacttacacatttcttcaaccttcacacattcttaagaagagatggttttatggactgaatgtttgcgtcccaccaaaattcctatgttgaagcctagccctacagccagtgtgatgctatttgcaggtagggcctttggggagtgattaggtttagctgaattcatgagagtggggctcccatgatgggattagtgcccttataagaagaggaagagaccagaccttgctctttccctgccatgtgagaacacagtgagaaggtggctgtctgcaagccaggaggagatccctcatcagaactgaactctgctggcaccatgatctcagatgtccagcctccagaactgtgaaaagcaaatgatattttgttttggcagccaaggctgactaaaaccagtggtattcctctcccattttttaatgtataaaaaactatggctctcacagatgaaattgctttccttagatcacaatgcaagtggtaaggccaggaattggaaccccaatacctgaattattttatggttttctgcattcattttataaaacaataagccaaaagataaatgaacaattattttttaatgaacgtgaatatgacgtatttaatgaattttatctttttgttctgcttttctattttggtctacatgacaataacacatcactataggcatatacgttacttaatattgctaaggcattaatcaagatatattttgataatagtgattaaaataagaattgattgatcttctatgtctctagaatttttagcttgtgaaaatacaaaccaagagggagaaatgactgtctttaaatttgtaaggcctactggataggtcgaatgaatttgaagacatttgtctgcaagtaacagaagactccccctccattggaaataaacagtaatgaaatttccatctaagatgacaagaagtccagcatggcctacgatctgggtaccatacagaatgtcaggatgttgggtccttctctctgcaggctctgtcctgctctgtgtattgttggctttgctctcaggctggtaccaagatggctgcatcagtttcagacatcacattgagatgtgacactgatcagagggagaagtacagtttatctctttttgtttctctttcatagcaggagactttcccggaagcttcatatttcataggcgggaattgggccacatgctgtgacaatgactactagttgtctccccttctccttgcatttcccccaccttcctttcactacctcctgtatagctaactgtcatcatgtgactaagtcccctgcagtaagggcttcctgttggctgaagttgtccagggctcctagcagcagtgccggacctgagacagcacagcaaaatggcagaaaagtaagctagttgagagcctcatccctgatgcatctatctactcctgaacagggtgccccctgttgcctaacacctgtcttcttttctccagtatataaaatataattccccagggaattatatttgcatcttatttaagaccactgttatttttatttcttgctcttttttgtagttatgcaaccaaacttaatctgatatgcatttcccttcttaaaacattcctggcaaatggaatagtgtaaccacaagggaccaaacataatgaggatctatctttggagccgggatgggtcatctacccttggtcacgtggcggaaggttgaatagccaaataacattagacctctctttggaagaaggagggaaggggaaatcactgttgggtaggcaactaactgaggctgctaataaagttaattaagttttccaaggtcacatggctaattattggtggaaaagtaatttctttttttttttttttaacatttttagtttcaaaggtacatgtgcaggtttgttatataggtaaattgcatgttgtggggctgtggtgtagagattatttcatcaaccatgtagtaaacatagtactcaataggtagtttttcgatcctcactctcctcccaccctccaccctcaagtaggccctggtgtctgttgttcccttctttgtatccatgtgtactaaatgtttaactcccacttacaagtgagaacatgcagtatatggttttctgttcctatgttcctccacttatgataatggcctctagttccatccgtgttgctgcaaagaatgtgatcttgttcctttttatggctgcatagtattccatggaatatatgtaccacattttctttatccagtctactgttgatgtgcatttaggttgattccatgtctttggaatattatggatagtgctgtgataaacatacatgtgcatgtgtctttatgatagaacaatttatattcctttgagtatatacccaataatgggattgttgggctgaatggtagttctgttttaaatgctttgagaaattgccaatctgctttttacagtggctgaattaatttacattcagaaaagtaatttcgacttaggttgtctaaaagcaagttcagtggacttctgtctataagataagcttagtcaatgatttgtcattgatattataacagaaattcatacacagctgggagatgacacctagctgttaaacatttattgcttcatcaattccctcttactaagatacaaatgtgagcagttacctctacattgctgagaatcatatgcatacaggtcaatgttatactcatatggaaagaagcagaccgcgcagaccacctcaaagttatatatttggccatgggcaataaggtgagaaaaatctgctttgctaatgttgttggcctgagctaaatattgaaatagcatccagttactcagcatgtgaaccaggcagtggggagtcacgcaaactgggactgttttgtgtggtggaacagaggtgatccaaatgtgtgtttgtgtgctttttagagtttgaggccaatttaaaaaatagtctgcactgcaccatgcacgtgggtttctttgtcaacaccatctgggtgctgactctagaagtttcacttcccttagcatactgtggctccattaggagatggggcacagcactttgatttcaaaggtggttggcctcattagctatttgtggaacttagtaaccagcagaaatgatgctgttggaaaaatcctctaccttaactttaattcatatggttttattttttttcttctgcttttgaggggctttcaaatgaagtatcagaaggaaacagtgctttttatatgcgcatgtgtgtagtttttttcttagtcaactgaaaagatagaaaaaacattctgtgtttgtggacagtattcatataaaattcaaaggcaaattttatctatgtgaccgataaacaaattactaatgcctgttaatcccagtgaattttacaaaatgatttgactggtgccgaaggaggcaggagaaagacagcaaatctgaactctataaaatccctcaaggagtaccttcttagaagacaagggaggaaatactttttttcaaatgggaagcaaatcacaatatagaattacagtgtttattattattattattattattatactttaagttttagggtacatatgcacaatgtgcaggttagttacatatgtatacatgtgccatgctggtgtgctgcacccattaactcgtcatttagcattaggtatatctcctaatgctaaccctccccccttccgccaccccacaacagtccccagagtgtgatgttccccttcctgtgtccatgtgttttcgttgttcagttcccatctatgagtgagaacttgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatccttgttggacatttgggttggttccaagactttgctattgtgaatagtgctgcaataaacatacgtgtgcatgtgtctttataacagcatgatttatagtcctttgggtatatacccagtaatgggatggctgggtcaaatggtgtttctagttctagatccctgaggaatcgccacactgacttccacaagggttgaactagtttgcagtcccaccaacagtgtaaaagtgttcctatttctccacatcctctccagcacctgttgtttcctgactttttaatgattgccattgtaactggtgtgagatggtatctcattgtggttttgatttgcatttctctgatggccagtgatgatgagcattttgtcgtgtgtcttttggctgcataaatgtcttcttttgagaagtgtctgttcatatccttcgcccactttttgatggggttggtcgtttttttcttgtaaatttgtttgtgttcattgtagattctggatattagccctttgtgagatgagtaggttgcaaaaattttctcctattttgtaggttgcctattcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatgcagtttcagctttctacatatggctagccagttttcccagcaccatttattaaatagggactcctttccccattgcttgtttttctcaggtttgtcaaagatcagatagttgtagatatgcggcgttatttctgagggctctgttctattccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacggtattgattcttcctacccatgagcatggaatgttcttccatttctttgtatcctcttttatttcattgagcagtggtttgtagttctccttgaagaggtcctccacgtcccttgtaagttggattcctaagtattttattctctttgaagcagttgtgaatgggagttcactcatgatttggctctctctctgttattggtgtataagaatgcttgtgatttttgtacattcattttgtatcctgagactttgctgaggttgcttatcagcttaaggagattttgggctgagacaatggggttttctagatatacaatcgtgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgagatacgtcccatcaatacctaatttattgagagtttttggcatgaggggttgttgaattttgtcaaaggccttttctgcatctattgagataatcatgtggtttttgtctttggttctgtttatatgctggattacatttattgatttgcatatattgaaccagccttgcatcccaggaatgaagcccacttgatcatggtggataagctttttgatgtgctgctagattcggtttgccagtattttattgaggatttttgcatcaatgttcatcagggatattggtctaaaattctctttgttggttgtgtctctgcccggctttggtatcaggatgatgctggcctcataaaatgagttagggaggattccctctttttgtattgattggaatagtttcagaaggaatggtactggttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgttgaggaatttatcgatttcttctagattttccagtttatttgcgtagatgtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcgaaaaaccagctcctggattcattaattttttgaagggttttttgtgtctctatttccttcagttctgctctgattttagttatttcttgccttctgctagcttttgaatgtgtttgctctggcttaataatgcttgtgcaaagatgattaggaattttgaatacattggaatatggtgataggaggtttggtactgatacacatttttagcaagccttttattataggctaaataagatttagaagttgtattgataatacatatgagcaagactgtttggttacctttaatcttcctttaagtgccacttacagaattaatttgtttattaaacataatgtcctcttattatctaacaaagtttcttatcctgaaaatctgaataattgtgtgttcctgaatataaaaatgtttacatggaaaaacttgtttgtttttggtgtcactaattcagattgatccgtttgtctcatataagatgggtttggcactaccagattttacagtgagcagaaaatgtttctgtacagattcataccatcagctctcagaggacttgacattcacacaaggaagaaattatttgtaatacctagtacctgaggtgtttgctttataaggagatgccataacagataatattataacaaagagttattaatgaatggggaatttacccatttttttacatacagaattcttctaaatcaagctgaatttatttttaaggagataagtgcttaggatttaactttctttaggactttgcattaaaatgtttctagacatgggtggaggacctttatgaagataaaatggaataaaatataccaaaccaatttttctattataaaaaggcaggaagtcactaaatcataaaagaatttacagaagaattgagaccactcatagctacctgaggaaaacaattaagatatagttaaggccgggcacggtggctcacgcctgtaatcccagcactttgggtggccaaggtggacggatcacctgaagttgggagttcgagactgtcctgaccaacatggagaaaccccacctctactaaaaaatacaaaaaattagctgggtgtggtggcgtatgcctgtaatcccagctactcgggaggctgaggcaggagaatcacttgaacccaggaggcagaggtagcggtgagctgagatcacgccatcgcattccagcctaggcaacaagagtaaaactctgtcaaaaaaaaaaaaagaaagaaagaaagaaagaaagaaagaaagaaagaaagaaagaaagaaagaaagatacagttaaaacgtagaactaccatatgacgcagaaactccactcttggttatctacctaagagaaatgaacatatatgtctacatggaaacatgtacatgaatgttcagagcagtgttatttataatagctaagaattgaaaacaatccaaatgttcatcaacaaataaacaaatgtgatatatcaatacagaagaatatatttagccacaaaagggatgattcctgcgacaacacatgcaaacctcgaaaatgttatgctaagtaaagaatccagacccaaaaggctacatattgtatgactggatatatatgaaatgtccagaacaggcaaatccacagaggcagaaagtagattcatggttgctaggggttgagggagagggatgtgaggagtaactgttaatgggtatggatttctttttaaggtgatgaaaatgctccaaagttgattgtggtaatggttgcatgactctgaatatactaaaacttactggattgtacactttaaagtggtaaattttatagtatgtgaattatatctcaattttaaagaaagatataattaagactcaagttcgagaaaaagcagacctgactagtagttctagcttttctatccacacaacagatatttattaagtaaatcgctatatccctagtgtactgctgttcatgacttgtaggatacccaagataatttctgggttttaaaagacttattagcatgggggtgatgtcatctctcacaaaggcagaatctttgcagctggccagagagaccccatatccaaaaagtaatgcagctttgggggaagaaaggagaaaaaagtactacatctgtttgaatacaatggatagagttaggagtctgattaactgacccaaacacataaaatttggagaacaataaagccatgagccaaatcataagagtgtaggatgtaagtttccctaaccccatccctcatctaacttaaaaagagaaaacattttccatcaactgagtgggaaaaaagccaggaatctccatgaatcaggaccccctggatttcttccatcctcattgctttggaagtgattaagtccaatgatgagccagtgtctataaagaattatgctttgtgtatgagcctgtcattttgaaattatattataaaaggtaaataaaggaaaatgacttcccaattcaatgcagtttggggtcggtccataagcacaataccattgtaattaaaatctaaaatgaaatactcagagacaacaggatcaaaagccgtggcatttcaaattgacctgaactatcacttactggcaggtaatatggctgtgatgaaattcctcagcaagaaaaggtttcaatggattaaggagaggtacaggctcgggtagtattatgtgtgtagccaacatagcaacaaggaggtaaagaggatatttgaaaatgcactccctccattaattatgctctacaataatattctaaccttgctttaacactgtagcatcattttcctcatttctgggtccaggcaatatggatattttgtgttaaatatgaaataaattctcaattttctttagtataatttaatacataaatggatgtaattcttctagaaagttttgttagatattaaggtacatatatcaaaacataatgtatgctatatattttatattatatcaaaatatgttaaatcactatagtgttgaagcacagtctaacaatattctttaatgtcccatcagacattaaaaagtatattttaaaaagacaaattttaaaaattaacagtgatcaagagatttaagaaaaaaacccacattgacatactactgtgatatttttctcaaaaaaacagcaaaaatgtttatatcaccttgatgtcaaagtacttcaacttaggttgaggtcatatatcctagtgaaagtagtcaaggaaatagtcatcttgccaaacaagtttctttttgtttttgttttgtttgtgtgtttgttattttgctttaagttctgggatacatgtgcagaatgtgcaggtttgttacataggtacacatgtgccatggtggtttgctgcatctaccaacctgtcatctaggttttaagccccacgtgcattaggtatttgtcctaatgctctccctccccttgtcccccacccccaacaggccccggtgtgtgatgttcccctccctgtgtccatgtgttctctttgttcaactcccacttatgagtgagaacatgtggtgtgtcaaactagtttctactgttgactaatcattcctcattctttagcctgaactccctggagcaaaagtagaaagttaataaagctgctgcctagtgcctaaggtgtcatgaggactgtgaaaaagaataaaacatcattccagcatggggagggaatggattagaccatagggcacttgggcagctatctttgactcagttgtcattagaataggactagcattgagtaaaattccaaagtttggtttgagcctttattaattaattagtatgaattcatttatcatgggaactatgctacctgctacactcttcagctacccaaagccagccgtaaactgctctttccccatttccagccatccccttctcctctaacgaagccctccctcttcctcatatcactcattgacactttacacaggagaactgaattacagttgtggcaccctaacggtcatatgtttggccactcacccaaaacaggattcctttttaccacattcagaatggataatcagatggttatctgcatgaacctttaagtattaagaatccccttacccttaagtcacttatccttgggtgaatgttttctttagatatagtctccttgaaggaggcccaggcctacttcctgaaattctcattctgtcatttgaaatctgctctcttgaaagataggccagatctactacttcaccattcaaatattttaggtcagcatttctattactgcacagcctttgcaacttcagtctcaacatcagtttctttcatggatttcaaaggtttgtcaaatgaccaagctttcaccatcttcccctctctagcctcactaccctcttcagaacttgctggatgcctcaatgtctttcaaaggcgtatcctccagaccagagtttagtgctccatgtgtgctctggctggggtggaatccattgcgtggtcacttttctcttttcttgagttggattccaaagtttttttcatgcagctcaagtttccattgcctggtgtaatgcttttgtcagacttggagttcatttgagcttatcggacaattgttggctcattagaaatcctacctcttccttttcacagaattaaactcaagttgcctctctctgtctaattaattgttacaatttaaatgcaaatttctaatttcttgaatttttaaagtatcatcctaaccttttaatctaattaaattattatatataaattacaattgtattttaaaaccccaattctctcttctattatattatgcattcttcctagcttagttgtctagtaaaaatttgataatcactgcccatgcttttatgtaagtttctgatgaagatgttaaacaagatgggaccaggtacctgtggtggtagatttgcctactttgttaattagtacctgatatgcatagttcttcagtccatctgtatgtacagctgtatttgctacattttactgtctgatccacaaagtttccggaaaaatttgtccagcatgctgctgaaatcagtaatttatctaaatcttttggagtcagattccatggtaatggaagaaaagtggatatatggtttgtggggaaaatatgtggagactgatgaactctcaggggatccttctacatagagaactatgtattattgtgtttacctttcagtttattctatcatggatggtactcctgtcctaactaaaattttataatcagtagtcctcatttcacaataaatgatgacaatgatggtggtgatgatagtggtggtggtgatcatggttataatgattatgatgatgctgatgaacatatatatatatatatatatatatatatagagagagagagagagagagagagagagagagaaagagagagagagagagagagagagagagctctttccatgtgccaggtactacataagtgctttatactttttatctcatgtaatcattgcaacaaacttgtaggctaggtgttgctcactgaccctaactagtttagacattcacaactggtaggttctctttggcagataatggaaacactggagaagtgacaagtggtaaaagttaactgctgtactaccatgtcactaccaggttgtatgaaagagcaaattcttctacataaccatttaatagccagcaggcaccaaaaatccagcctgttttggtagcttggagataatcaatttatctgtctttttgggctttctaagcatttctttgcatgaaaagtttgcctgatgtagtcacaaacgattgttagctcattaaaaatcctaggcagtgacttttctagaatatggcttcacccactctatgagtacaccctttccaatgatgaggtcaaggaaaatgatcagaaagtacagagaggaggcagaacaattagggaagagagaactaaaatagaagtgacgggtcagacaaaaattcatttgggctacttgccacatctctaatttcaaactccttatcctaaatcgggtttgtttaactctcaagaaataggtgtggcccttgggacaagttggctcagattgacatactaccatgcatacacacacacacacacacacacacacacacacacacacacacacacactataagcaatactgttgcctgagacaggttgtttctgattaaataaggacaccctagcaaatagctcaatactaaagacttctaagcactggccaagttcagtaaatgtcctgaaaggaagaagtttagttctcagggtgacttgaaattagaactttttttgctgtttttgttttaaaatgctttgcctgggagagagcactatgtggaattaatatccccttctgtctccacagcaccacactagtcagcctaacttagagagggaaattctttgttgccttttttccaaatacctgttaaagaacttttgctggggcttacctctgtgtgttgatcaaactgaaaattttccaaggatctgaggcttctctggagggtaggttggcattaagatttcttcaatagtgcaaaggatgttgtttttcacaaccaacacagatgtgcatgcttacaatttaccttcagtctggaaacatgttagtgaggcatgaatttctaattggctacccacagatggatacggtactaagtatgcttgaactgaatcatataatttgaaggcatttctaaaggtcagttgacatatattgtataaaaaagaaagattatatatatgtgcatatgcatatatatgtagtatatatacctatacatagtatgtatacatcaatccaggtgaacagagtgtatatgcataatatatagtctacatatgtgtgtatccatatattatattccaactaaaatatcattctcaggcatttaagaaacctgctcttacctcatttcagattccccatgggtactggaatattttatccttggggatgattaagtaagagagatacaacaccaaagctgacttatcattagtgactcagtactggagaattgagaattattcagatgtgccgaaatctctcttctgaccccctacatggaggacaagtcactacactgaagttggcccttgtctgtccccttgtcctttggttaagaactttgatcaactgacttaaggcctcagatatgggagatcctctactttttcatgccctaatttggtcctcagtggtttctgtgctgtctttaagtagataagggaggccctacttcttactggtaaataaactgaagatataccaaaggtacctgcttcagcatgaccattgccttatttggaccagttaacagtgtgtacttaaggctcccaggcagtgaatatctttcatctcctagcagattacaatctgctactataataactccccatctctgttgcattgttagctgtctttgtgtgtgtgttgtgtgggtaaactatttgatcttgtatttcatcaacttttaccaaactacctctttgctattgatgagaacagtaacctttctacacgtaagttccacttattcaagaggactattaagtgatcatgtctctcagttgattagaacatggtgttactgaggtataatttatttttgtagtcgttttattaatgacaacagtaaaatatacacattacttgccatggaacagatcacatgctgagtgttggacttgccttatgtttctctgtgtaagagttgactccaatgatcactcaagtatttccagaagggaaaggtgagaagtgattggtcaatgcctaaggctctcacaacttgtggtctacaaccctgtttgacagtgagctgtttgggcctcggtaggaattttcccacagaaaggatgttctcactggcaggctcccaggaccgcccagaaatccatttaaccataacagagctgacagcactgtcaggactggagttggcttccaagtgggaagtcagcctagtattaatagcacagttccagctgcactgtgggtccagcagacttctgacggtccggcctgggaaccaaggcactctttgtaacatttatgggaaatggagtcctcgttgagaatggtgggaagacagtactgaggcggtacaaggcccatggcttctcacttcccctttctactctaatcacttccaacgccactatccagcaggacgagatggaggggaatcctagaggaatccttctctagccttcaagtctggggagagcctgccctgttcctggcctggctcacttgggtcgactgttctcatgtacaggatatttgtaagttgggtgtttctaggtcacgtgtatttagttatatgatatgaatgtttattttaatatagtagctcttgatccaggcacaaatatattagaatgtaaagttcatttttatttttaaaagatttttcttcattttgactaatttcagttctgattatgatctcctgcttctttaccagtttaaaggcatcatttttatgtaaataaaatgggtgtgcatgattgtagtaaaacattccgttttgtggttacaggaggaaatgagagaagtgggtggtgcactgtgtatgcatgcgtgtgtgtgtgtgtgtgtgtgtgtgtgtgtgtgtgtgtgtaatttgaatatgacctaaaggatgggggtgtttgttaccccaagacatacttcaaggaattaaaaattgtgttgtactaaagggaagtctttttcactaataacttagaagtattgcagaccatttaggtttttttgttggtcagaagtattatagttaacagatttttttcccccgggagctctttgaatacataatttctttaaaaagatttttaaagactgaccagcaacctgaaaattattttctgctaatcccaagtaaatgtctctgtaatgtaagtgctgctttaaagttatcttatggggtacatatgacccaaagggaaaataacttgtttattaagttgattttctttcttttttcatgattcacaaattgtcaaattcattctgtttgggacagtagaaatgtggaaacatgtaagtgagtaacaattttaaagtgtaaatcaactaaaatgtatatgaaaccctgctgggttcttaggcagtctcttgatatttctaagctacacttctctcttctaggattctgttttgggacatagtcataaacacaaaaggaagatttcagcaccaaattatattcatctttaaaatattggggcccttcagccccttccaaacactggaaaactctctggagtttggtttgccaagacatgggaaactttttttccgaatatttttaagggaaaattatattttagggttatgaatgtagaattataacacagataatttaataagcctctatagctaagtctaggttctctttaaaagatcttgttttttcacccagccccatagttacatatttgagggagtgaaactgagcatacaggatttttggagtggcaggtccatttgaaatcattctcgtccaatgttttcattttctagaaaagggaactggagcccagaggggttaagtgacttgagcaggctactgttggtgatggcaatagtaggagtggccatcatttactgaagatcttctttttctgggtttccttacgttttattttaccctcacaaccaccttgtaaggcagggggccatattccagttttataagtgagaaatctgaagtttgggaagtcctctagctgctcaaagtcaacaggtactaagaggcagagcaagaatccactgattctggatgcctggtggcttctgcctcagggtgttttccattgtaccagacatttcccaggcctaagtagaaatacaagaagcattccttctttatacatgtttacttctaatatatcaagagcatctgtatctaagcaatcaccctggttactcaatcttttggatagtagtctggggtattgggtctccttaccttagtttttctgacaaaaaataatcttcctcctactggatttcataatattccaaaatttgtcttcagtggatgcctcaacatatactttgaaatgtctattttatttagatctgaagaagagtattctttttttttgctctcattcagtgattcattcatttatttattcagtaagtatgttttgaatgcctactatgtgcagatgctattctaggctttggagatacagttctggacagaacagacacaaacccctgccctgatggtactttatttctagagggccaaaggatggccaatacatacacggtaaaaaataaggtaagtgagatggtgataaatacactagaaacaaaaaacaaagaaatttgtttaatgagtggaaggagacaccaggaagatggggtaggacttactcaaaaataactgagaggggaaattggggagtgcttcttatcacattgtcaattcagcaaaaaatgccagtgtctattttgttcagcaaattcctttccaaaaatataagttttcaatcccccaccaatagtaaaatgcttatcctaactctgtctctatccttatgatatcttcccatccaccctttatggaacccattgttatcactattataccaaaaaaaaaaaaaaacaggaataacaggagttatccacatatctaagggtaatacaatttgagagtaagagaagcttagtgcctggcctatttttcccaaacatctaatttatggaggagaatcttgaatctcagaaatattgaaatgttgggaggctggggcaggagagttgcttgagcccaggagtttgagaccagcctgggcaacatagtgagaccctgtctcttaaaaaaaactttttttaattagtaggtgtggtgcccacctggagtcctagcagtttgggaggctgaggcgggagaatcgcttaagcctaggaggtcgaggcttcagtgagccaagatcacattgctgcattccagcctgggtaacagagggagtccccgtctcaaaacaaaacaaaacagaaaaataaatgttcaaatgactaaatgacgacctcagatcaaatggcaaggtgcttattattttatttccagtaaatgatgtgctgagttcccatggtgagctaagtgattgagctggatccaggggcctcagcactgacttcagaggagatggtctgtggcctggaggcacagagaaagaactgatacagacaaagacttctgatcccaacccagtgctccttcccctatcccatgatggggactctttgctgttttccagggtctcacaacggtgagaatggggttcccttttacatttgtacttcccactctgtacttcacgtatgtcataggttaaatgagactacttgagctgacctacgaaccaaaaccactgtatctttatttctatgggaaaatgcatgtggactttgaaatatccagctatcttaacagactttcagaattgaggagtgtctgagttggaaaatataagcaaagatcatttagtgttcagtgaggcaaactctagctgcccagcctctaagatactgactatctcctagagaaaacacaatcctctgcagtcctgaaggaagcatcagatgagatacaaataagtagtaacagtttcttccaaattgtatggggaaagttttcttctcttcactatgaagaaaacctgatgatcataaatagtgaccattttttccacaaagtggcaatttgtgagtgtgtataccagccattctgtagtttgtcatagttcctagggctatggggacctatcacaggattgtagctcatttaatctggattcactactttgtgggctggacttatgtttctattaatggtagtagccagtatagtgtcccaaatgcatgttgaatggcgtggagtggaaggacatgttctcttagctattctgtatgctagcaagtgtcattttcctgtctgccttccataatgggaatgccatggacatttcagttcgtgttctacattcctatcatcacctgattgattggaatgatattgctatataataaggatttcgaacatacataagcattctgaggaaacatgaggttagattgaactgcagtggatgctctaccacagttcaagggcaagattattacagttgccttgacaaccatagctctgcactctctgttttattacatactcttttcctatttgggaatccttttgagaagaaacaaaagaaagaatgtcagtaaggtctcattttcaatttatgaggcttctggaaataatagagtcttatatagctacaaaaacgtctccatttcttaaaatttccccaaacattggaaagtccaggcatatgaaatgaactaaaaataagcttttacttatgtcaaaacacaaatatcatctttactccctatagaagtaattattttgtaaggactgaaagaaaagattacttttctatttttctctagcgtacagctgtgacttctatttttctataaaagggaaatatttttgcctataaattttcattagtatttttacctgtattacagttattcaactgcaaataggtatataagtaaaatagtcttactctaggaaatggctaggttgagagactatcaaacagtgatattttaacaatgtgttacattattaattatcaacacatcctcttttaggtttcctttgtagagcacactagtttgtttgtttgtttgtttgtttgtttgtttgtttttcaagagaaaaggtgacaatatttgggtctttataattgttttttctgtattaaagcaaaaatgtagtataaatgtatactactgtgtgactataaaagtcattgagaaatattattttttattttgtccacttgttattaaatctttcttttcttttctttctctctttctttctttctttctttctttctttctttcttttctttcttcttgagacagggtctcactgtgtcacccaagctacagtgcagtggcatgatctcagcttactgaaacctccacctcctgggttcaagtgatcctcccacctcagcctccccagtagctggcactataggcacccaccagcatgcctggctaatttttgtagagacagagttttgccatgttacccaggctggtctcaaactcctgggctccagccatcctcccctctccgcctcccaaagtgctgggattacagtggctctatggaacaaattcatatgttaataccctaggatgggagttagggaacttttctgtaatgggacagatggtaagtatttcaggcttttgaggctatacagattttgtcacaactactcaactctgatgttgtagctgaaagaagccatagataatatgcaaacgaatggactgggctgtgttaaattaatactgtattcacagaaacagacagtggactggatttgtcccaggggctgtagtttgccaactcctactctgggagaaaaattgttttgcttacttatctgtccacagtctacaggggagtgtagtgcttcaggcaaattgcttcttttataatatatgcctaaactgagcatggtggtgcacgcctgtaatcccagctacttgagagactgaggtgggaggatcacttgtgccccaggagtttgtgtccagcctgggcagcatagagaaaccctcatctcttaaaaaaaaaaaatgtgcctaaaagtccatcttttcactctgacttttgtgtaaaatgtccccattgctaccatattggttctattagagagaaaggcaggggttacacacttttgcaactcattagggagagtagaagcagatattgataataatttccttgttttaaaagctgttagagcacatgaaaaaaaaattcaactactaagatttccttacaccctagctgaactgctcagttagaactgctcttgaatatcaaaggctaacgtgccctgcctgcgtaaggtggcaatataaactgaggtagacactgtgggatgcagccccttggcccccagctggcctccccatccccatggggtctacatagtcacctggcaccaagaaaaacgtgcttttttctttatttttctttgaagtattcactggtgctttgttcaaactgattttagcatcctctttgagtttgaatcagatacttcaaagaaaaatatagaaaaacgaaaacaagtatctatgtatttgttactcagatttagtaactgttaacatttgttcttatttgctttggatatttttatcttttttaaaataaagaatccctttcattgacacaattgtaacccaagaattttccccattctttctaaagaggctattgtcagaggaatctgaattattttccacttattaaaattggttattgagaggcaaaagaatagaaagaatattgattttatagtatatattcagagcatcactggtgcatagtatgaacgatttgatccaatttgtatggttttctgcccatcgaagactgaataatatcatgaatctactcccaagagagacatagagaatgcatcacatctctttcctattgggaatgggatatgaatctaaaagacagtaaatataaaccatcctaattcataatagagagctggatatatttttcaatttcaatggcaactttgaaaagtacattatttttctctgctgcctttaacatactaattgccttgtggtataaatgctttcataaatgctctctcatctgatcttgtgtgatagttacaatagatggtattacagctctctcccaggtaagggtatggatgcactgggatgtctgtacagtgtttggcagtcttggctggacctttgtatcacctaccgagctttgaaaagatactgattctgagcctatccacagaggttcaatccaaccagtctgagcaacagtattcttttcttttcttttctttcttttcttttttttttttttttttttttttttgtgatggagtttcactcttgttgcccagactggagtgcagtggtacagtctcggctcactgcaacctccgcctcctgggttcaagtgattctcctgcctcagcctcctgagtagctgggattacaggcacctgccaccaccatgcccagctaatttttgtatttttttagtagagatggggtttcaccatgttagccaggctggtcttgaactcctgacctgaggtgatctacccacctcggcctcccaaagtgttgtgattacaggcgtgagccactgcgcctggccgggcatcagtattaattgattctactgtactgctgaggttgagaacccccaatggaccgaccagtggttctcaagtagggactatttgcccccgcaaggggacatctgacaatgggacattttttattatcacaactgagaaggggcatcccctggcatctagtgggtagagaccagggatgctgccaaatatcctatagcacccctacaacatagaattatctggccccaaaggtcaataatgcttatattgagtaaccctgatttaagctggactaaagtccctctgactctaagccatattgtttccccagtctcaagttgctagattattcaaattagtcatcctcttattattgctgctaataaaatatattttaattaggttgttcttcaaaacaacatttacaatgactttttagtttatcaggaaccaagtgatcttgtgtcataaccatactgggataggcaaaaatccttatattaaacattttcaattacttttatcagaatacaaaacaagcaagcaaacacacaaaaaacaacacaccatcaaaaagaagaaaagagctatttctcaacataaattgctctgtatgtattatcccagatgagcaatgtgtattatataaagcagtggatttcaaacttgagagtgcattgaagtcacctagagggcttgttaaaatactgattgccggcctcatctccagagtgcctagtcagtaggtccggggtggggttcaaacagttgcattttgaataagtttccagctaagattgacatttctctcctagggactatactttgacaatcattaatgtaaagaatttctctatattagcatttcaaatgaatattaaccctggggaccatctattaaggcctcaagttaatattcctaaaagttaaaaatcattttatcatagtatacaaataacttaaaatatgattcatcaagaaatatagagggcttcctaattctatagttacaatcaggacagccctatagaatcaaaccttttgctcccacttctaagagcagcaagagctagcaacagcaagctttgcttaagaacaagcctagtagttttatgaatgcacagctctctacctgatcggaaatgaagggatgccagttcactgagacatttttaaacgcatctggtcaatgagaaagttgatattttctgtttcctgatgtgtatccttcaaattatacataagtgcttaagtgaaaatgacttgatccaaattcccttagctttggatacattaacatatgctcatggaagggtggatgggatatctaaaattttattgaagtgtattgcctctctataaaataacaaaaccttaactccttaagtaattaaaatatttggcagaagtggctaaataatgttagattcaagtatggaatctgaagcccatttcaggtatttcaagaacaagtcaattattcatccagtctatcagccaaagacacttgacagagagcagtgacatggtgttttgtaaaaggcatttccatagtactagtgctctcattttgttgtcatccagtagaaagaagtgtacacatttgtgaagaaatgcatgaggtaataaaactatttaaaaatccacattttctcaatttagatggacttttcttaaactagtataaagttaggtgttaccatatattttgtaggcataaaaatctaaacctcaaagtggcagaattcaagagtacccatcccttattttctacaggagttcatctgaatcccttgatagtaaagattttctttctttctagaacctgacataattcctagtacataccaagtgataatgacactttcattgaatttacttaaatagctatatgagaggtccatgtatttctatatttcatgaatttcaaattatatatttcagtcccatttaaagttaggatctttataaagaaaatcctgaagaggatccagactatagcgtccaatgtgcaaatttttaattgtgagctagagattgagaataaaggaaagttattggaaaattttccaagaactaagcctttctgttgtgctggtattgatgatatatgtgtcagtcagcaataagactaccaaaggtgaactaaataatccggtgccataaaatgtcttataaaacttaagctgctaagaaaatctaaggattaaaaaatgtacctattcgcatacttctgctgttgtgtgtttaagagcaaactgagaggttgctatggcattacttatgcgtgcatggcaacagagcgaacttagtgattcagcttgataaaagaggaaattagctcaccatttcccctttccccaaatcagagtcagatatccaaatatttcattttgaaatggtatatccatcaacacgttctaatggatgaaagtcagtgggggtgggggtgggggaaatgtcataaggtgaaattcgtatgtcatgtgcttactttagggaatgcaacttgtgtctaaacagtctattcatatctctgcatccttctttccccctgataggatggggtttctcagtggcatctgttgggtgaatatacgatgatgagtaacactttggcaaaagacagcaatttatcagcccgtataactttgttctaatggaagtggatcatcccagaatttgagaaagaaacattgttcagctgtgaaactccaattccctgtgtgtaacagccctccagggaaggagtagattttgtcagcataatatgtgaagtttagtcattatcaactgcacaaagcagaggtcaggcgtgggcgtacatgtgggaggcactattatgaaatcaacccacagccactgccctgctggggtgatccaatacaaacagagccaaatgtcatgaataaatgctgacattttatcacatgattagtttaaatattattttactactgtgctttttcttgtattatttatctttcacatctttattttgtttccggtttcctttctttaaactgataaatgaaaaatagggaagtatgttttgagtcagtactttgaccatgaacacaggaagttaactgaaccctccaccaccagaacaacaacaacaaaaaaactctaaacctgtgaatcttggaatcttagatttgttctgggttgacatgggttttggaatcataattttattaatttattttttaatttacatagagtaaaattgaccttctggagggtatggttctatcagttttgacaaatacataaagttgtgtagccaacatcacaattgtgatacagaagaattctatatataccaccccccacccccacccccaccaccaaatctcttccttctgccttttcgtagtcaacccctcttttcaccctcaggctctggcaaccattgatctgttggaactgtattaatctgaccgtttttctccactctgtccattcatgcaacaaccgtttattgataatctatgctgagctccattttaggtgctagggatgaaatggtgaacaagactgacatagaagtttctatctggaaacaagataatgaacagtagtaaatcagtaattccaaattgtggcaaatgctgtgtaaagaacagaaatatttctgtgacaacagatatctgaaggcgaaatctttttttttttttagacggagtctcactctttctcccaggctggagtgcagtggcgcgatctcggctcactgcaagctccgcttcccgggttcacgccattctcctgcctcagcctcccgagtagctgggactacaggcgcccgccactacgcccggctaattttttatatttttagtagagacggggtttcaccgtgttagccaggatggtctccatctcctgacctcatgatccacccgcctcggcctcccaaactgctgggattacaggcgcgagccactgcacccggccgaaatctattttagacactgttaagaaggttactctgagaaggcagcatgtaatctgaggactggaggaggagaagaagccagctgtgtgaggtgtgggtggggacacatggggtaatcattccaggcggagggaacagtatgtacaaaagagagttgggagtctagtgagtgaagggagcaatgccatgaggtgctgtagatagataggcagagcttcactaaggtgtatgtacttcattgcattgcagtgagaagccattgaattaggatggggctctaatggggatggtttgattgatgttttgagctctgtgtagaaaatctgtggtagaccagcaagaatggatacaggggaccagttgatttgcagccaccatccagttgactgttaatggaagattgggcttggcagcagctgtggagatggagaagggatggatttgaaatatattttagaagtataagcaacaggactaagtgtttaattagatatgggtaaggggctggtgaaggaaaagggggaatcagatgtgactctcaagagcttgcttgagcaactgggtgggtgatgctatttactaacatgagtaaaatattgagagagaaacaagtttgtattggaaaatttaaaagctggggctttggacaggctgaaatagagaaacccattagacatccgtttggagatgtgatgcccctagatggggatatgcatgtagaattcagaggagagctcagagctgaggagagagaaatttgtgtcatcatttaacttttaattattcattatatcataaatatacaatttaaatatattattatattttgatatattaacgttaatataaaatctgtattattaacaatttattcactgatatttattgagggcccaccatgagggagacttagtgaggaaatggaggtatgatggtgagtgcaagcctgtatgatctgagacaggctggcagtagtcacacagatatgtgtaaaatttaagggacctcagtaccacaaaggagagggttctatgaaagggcacgagagggagattcgactaaatctgggtggaggtgagggtcaggaaaggcttccctgcgcattaaagaatgaggaagtgggagaggatatcagattaaggaaagaacatggataaaagtcggtgtggtagaagaccagagattttggttctcagatgcactgtgattccaatttagatgtccagaagggcatcccaggaacatctcaagcacttcaggcaattcacattccttcagcaaatatttgttgagcacctggagtgtgcctgagattctttcaggtgttgggaattcagcaatttatgtgcaaaagttctttccctcatgaagcttgtttctttctggtggagctgattcaggaggttcacaaattccagacacatcttcagaaggattgactaagagatgttggcctgcaacagagccatgaggagtgccagcatttagagctctaaaggagcagaagcagcagcaaagaacctagagcaagtggctagtgaaggaaaaagagagaaaaggggtgcgtatagcaaaagctgggggaggtccagatggcaaaggtaatgaatggccagctaggtttagtggtgctgagggatcaggtagaataaaagcagaatagtcgcccctcagctttataacatggcagcattgggaatttttaccaaaccagttttatctgaatagtggaagtagaaaacagattgagttgcttgaaggagtgtctgggaagtgaaaactgacaaagtgagaagatattggcaattgagaagtgaaaaattgctgatgactttagagaagtttgccttcagttcgggacttcattattttcctgcaggaaagagtcttctgttagtggggagattaattaacttatttttgcccaacttgtctatctaaaaggaagaaagtagtaatacattaaaagattgagactgctgaggatgaaatggggtagtatatgcatgcagtggatgctcactaaaaataagagcttgcatttatagtattttaagtttgccagtctcactctacctgacataaattttcagtaattatcttattaaatgccaagtaagattcaaattattattaactgatactcaagggaggaaatagggtaagttaagcaaattgccctaataacgctgctcataagccatggccctcggagaatttgaatccatattttctgtggtttggacatggtttgtttgtccccatcaaatctcatgttgacatttgacggtcagcatggtgatatcggaggtggggcatagtgggagatgtctgggttacagggatggatccctcataaatggcttggtgctgttctcatggcagtgagggcattctcactcttgacactagattggttctcaggggaattgattagttcctgcaagagtgggttgctagaaagccaggacacccctgggtttggtccctctttgcacatgtctgcttcctctttgaccttctcagacatattttaatggaacacaaaagctctgctgaaatccaagcagatgccagtgccatctatcttgtaaagccagcagaactttgaaccaaaataaacctctgttgtttattaactacccagccttagctattcctttatagcaacacaaaatgaagtaagacaacatctgttgacttggttctatgctgtgtttgctccacttggtgttgtaattttattcccctataagaattgtatctgcttaagtggagactgagtattcatctactttgtatccccatacttaccattgcatttagcccagtgcctggcacaaagtttgcagttgtgagtggcactgatatgaaatttctcagcccttggcccagccttcttgggctgctcttgtttttgaagctccagtttatactcaggagaaatgctttggacttcagacctccaaactgattcatgttacacatatcatcagtggagaaagtgggacagagtaaagggtggagatagctcttgaacacgacagtagaaatggtatgatgttagcagaaaattaatatgtgcacatcttgttgtactgagaaatactctaacattataaggaaacaaataaaactgatcattgctaggtgacgtattatatatatagtatataatgtaaaaatacatatatagtgtatgttgtatataatgtaattgaatattatattgtatattatatgcaatgtacatctatatatctatagatatctacccttgtgtatttttttcctacaaaatgaaatactttcaccatcagagagtaccaagtaggaatattcccaggagggtctgagattgggatgcaatctcggaacccattaaagagcctggggacaggtgggctgtaggagtcctgtggagagcttaaaaggtgtctcttacctcttgaaagaaatgactgtgaggggtgaagtaaactgacccggtgtacgtctccctgggatatattacttactaacttttaggtcttacctaggacacgtatataggaaatgttcctgaatcatgcttggctgcattatttccctgtagtggcaaaagtggcctgcagaagctgtgcattctgggtccttgctagaacccagatgaatgttgcttgggaattggagaggaaaaaaggaaacagagcactcccaaattctttcccaaatctcttggatcgaaacatcttaaattgccatttttatatgtccaagatggtcaaatagtaaccatttcacgcagctcaaccaaaaagtatgatccagctactacagagatgtggacattggaaggccttcttgttggtttcaagtttggccaattggtagacatctggggctgtatattaaggcatcttgattttgtgagccagagcaaaggccttcttgttcctgtctctatttgaatagtatctttggtgagagagtgccagcgtcatctatttattatccttcatgctcagtgactatgtgaaaagaaaggaaaagacctttaaagctggggtgattgtctagacagtcctaaaatagctgctccaggtgcaaaggaagccataaaatgcagacaaagcatgagactcctttggcgaaaatacagtgtgtttgaactctcataggctccctgtaaattatgaagtagaaaatgcccaggagactagattccaataattatgatcattagttattttaaattgccaccacttacttcacacagaggcattctctgtgtgctaaattaaatttaaaatattttaaaaataattatttgaataattcagagctgaaatagtccaggttgaactatttagcaggctgaaacacctgtgcaagctttaattcaaaatatacagagaagtgacttcatttttcactccactgtggaggtcttctaatacaaaacaagaccttcagcaggagtccatgccccctggttctgcaccttcttgccttctactttgtcctgtgcctacccactgcactctcaaggtccaccatgacccggccctgctccactccagccgtgtcctctaggggatcgctgccaccttttacctaggcctccccaccatggcctctgccagagccagctccttgtgggcccatgtggaaatgagacctccagatcccatcctgggaaccaccaaagcctttaagagggaaatcaacagcaaaaagatgaatctgggagttggtgcctaccgggacaataagagacccagttagattaccataaaaaatttagacaacagcaaagacttggaaccaacccagatgtccatcaataatagactggataaagaaaatgtggcacatatacaccatgggatactatgcagccataaaaaagggtgagttcatgtcctttgcagggacatggatgaagctggaaaccatcattctcagcaaactatcacaagaacagaaaaccaaacagcgcatgttctcactcataagtgggagtttaacaatgagaacacatggacatagggaggggaatattacacaccggggcctgtcacggggttgggggctaggggagagaaaacattaggagaaatacctaatgtaggtgacgagttgatgggtacagaaaaccactatggcatgtgtatatccatgtaacaaaactgcacattttgcacatgtaccccagaacttaaaatataataaaaaaatttagacaaggaatacctgcccatttggggacaagctgaattttccaaggcatctgcagaaccagccttgggtgagaagagcaaagtgttgaaaagtggccagtctgtcactgtgtggatcatttctggaactggggtttaagggttggagccagttttgtgcaaagatttttaaagtttttgaagacagagatgtctctgtccaaaccaccctggggaaatcacacacctatcttcagggtagctggcatgcaactacaagattatcaattctataaccccaagacttgcagttttgacttcacgggtgctatggaggacatttcaaaaataccagagcaaagtgctcttctcctgcatgcctgggaccctcatgcaaagcagtgaaaggaaataataatagtggcaaagaaaaagaaactgcgttctttgatatggcctaccaaggctttgccagtggtgatggtaacaaggatgcctgggctgtgtgcaacttcattgaacagagcattaatgtttgtctctgtcaatcatgtgccaagaacatgggctttatatggtcagtgtatgagagccttcactgtgatctgcaaagacagtgaatgaaaccaaaagaggggagtcagttgaagatcctgatccatcccatgtattccaacccttctctcagtggggcctgtattgcctctaccattctgaacagcctgggtttgtgaaaataatggttgcaagaagtgaaaatcatggccaactgcattactagcatgcagactcagctgatctccaactgcagtaaggagagttcctcacacatctgacaacacatgactgactaaattggcatgctttgtttcacaaggctaaagcctgaacaggtggagaagctaaccaaggggttttccatctgtatgacaaaggatgactgcatccctgtggcagggatcacctccagcaacacgggtaatcttgcctatgccattcaccaggtcaccaagtaatgtccctggtgtgagggaacaggtacaacttttctgtcttcagctgctgctaccgtgagcttcacatggaggataagggagggtagatggtggtgagtagatctttttttttttttttaaccacagtgcgtaatactgagtgattgaatgcatttctcagaaaagaacatgtagcgacattgggcagaggcatctgtggctggtatctggaactttgtgactctaaaccaaactctcccccatctttttatctccaacttttccgaaagggtttacatgtgtgagaaactcatagcaccaaaaaacttgtcaattatgccactgcaatatttcagaagctttaactgaagcatcttacggtgtcaggggttcttcatgagaaatagcacacattagaggctttgagagaagacctagttctgtcattaacagtcagcctcaagtttgtcctcccatgatggagcaaccttatcaacagaccatatcgcagaagttgtgttttatgaaaaccaatgagtttgctgccactgcagcaaggaaaataaaaggtgctttttcctctcatttaagaaaaagaaaaggctatctcttctcctttttcatgctattcttttccttatgcacaaagatttttaactatcctagattttcatcccattctactgctggattgaccatctaccctgtattagtccattttcgtgctgctaataaaggcatactggagactgggtaatttataaaggaaagaggtttaattgactcatggttcagcatggttggggaggcctcaggaaacttacaatcatggtggaaggggaagtaaacaagtccttcttcacatggcaggagcaagaagacttgctgagcaaaaggggcaaaagccccttataaaaccatcagatctcgtgagaactcactatcacgagaacaacatgagggtaaccatcccattgactcagttacctcccaccgggtccctcccatgacatgtggggattatgggaactataattcaagctgagatttgggtgggaacacagccaaagtatatcaagccccatcctacttggatttatttaagaataaagaacataattttctaatgacgccatagccttactgttctcagtggagaaggtaactgcaatttatctgagcatcttcttcgatgattgtgtaattgtctcctgctggatgttgcctctgcccagttggacatcctcccttcattgaatatggaaagcagattagtggttgctagatttaagaagatgatgagttgagagggaggtgcaaatagctgtaaaggggtagcaagaggaatccttgtggcaatgaaactgttctgtgccctgactattgtggttgtcacacaaagatacatatgtgataaaattgcatataactaaatacacacacatacacacattcacacacaaatgataacatgtaaaacttgtgaattctaaataagatagttgaatcaatgtcagtttcctggctgtgacattatactatagtcatgaaagatgttacaactgggggaagctgggagaagagtataggagatggctctatattatttcttacaaatgaatgtgaatctaaaattatctcaaaataaaaaagtttagtctaaaatgcattcatcaacatgaacttgagtcaaaccatcttggaagagaggcactttgatgtattcacttcacaaagcatagggatgaagatctctggtagtaccagcaagccaaaacacatgactttctgctgtctgtaccctgtggccctgcactgtggataagggaatgtatgtgtcctctagaacatttttgttttgattgctttgtgtttgtttgcatcaagaaaaaagttgcaaattaatgagaatatatgtgtatatctctaagattcatcagcacccaaaataccagagcaagccagacgtcatagggaagccctgagcagaatctacaaaaaaggattgaataatttgattattcagagaaagcatatttctaggggatggatctaagagtagcttgatcatgaaaatggtgggaaaaatatagcggcaagagggtcactaggtggaagtaatatgtctagtttttttgagaaccacacttgagctaaacctttaaaatccaatcaaagaatgaaaatgaatagattagtgtgaggaggtaaacgtatcatttgaaaatagccttggacttgggtactttgctctcattgatttagcaatatgccccattttgttagttgtttatacagagcttcacagttttaaagtaagcatagccagttatgtctatgatttctctgtattcagttatatttgcccaggaaagtctaatcaacaaacagttatcagttatcttacccatgacaacattgtgagatgttgtgagatgccaagaatagaccacaagagcctctttgtgatggtctcagacctccaaaaccaataaagaagaataacacagtaaatcagtaacatatctatagcatttgaattcacatagagaatttgtttagtgggcctgactaaatgccttcactttgcagcttacaggggcttgtgtttattctgcctatcttaagcatggttttactcatttagtgggagcagttggctcatgtcttttacctatttcatttactaactctaagggagtcaagaagaaacttcccctttgcgctctaaagggtcactgaaaatatactggcatgaggcagattgattaacagaagaaaaggcatacacgtttatttaacttgtatacacagaaaccttcggaatgaatacctaacatacaggggaaaatggacagttgtccatttttatgcttaggttcaacaatatgtggacagccatgtagaaatgtgattggacagaaagggtctgatttaaatgctaatggactgagtaggggaaacccagtaaggcctgtccatctagattattcttggcctctctgagaagcatttcttccttcttgatgtgagagaggaccctgtctggaacaggagtcttaggatctacagtcaaaccagttaggtcagatcatttcttcatggccagtttttacgtagaatatttttaggttttatgactgactttcaggaaaaggggttctgatttgtatgatctatcttggggaaaagggattctagtttccatggctatccttagggcaaaatgggactgagaggaggacaggagaaggtcaggagaaacttttgcttctgaagctgctcagcagcagtcttcattttgagatactgttttctgagccccaacaaaattcttctaacatgctgaacatgtgccaggcactattctaacatccatgagaatagagaggaaaggaagagagggatcctgcagctttccagttgggtgctgagatgatgacaccattcactgggtgactccaattgatttgctaaatctattctctgcattttgactctgccaccttcttaccgtgggtctatgagcaagtttctccactgttctattaaatatctgtgaaatgggagcaatggtggtgttgtgatgattagatgagtaaacacatctagagcatagagctctatgcctggcacaaacgaagccctcagttaatatttgcgggatgtgtaaaagattgtgtttatctggttttcaagaccatcctcctcagagacgccaaggagatagttgctatgcttcctggcgttctaagacccacatgcatctcgttaacccttgagaaatctagtgggctctcagaatttttaaaattatatattaataaattataattgtatttatttggtgaaaagtgatgttatgaattttgaatacaatgtggaatgattaaatcgagctgattaacatatacatcccaaatatttaatctttttgtgattagaacatttgaaatttactctctgtaattatgaaatgtatggtactcagttattagctatattcaacatgctgtgcagcagatctcaaaaaaaactcaaatgtcttcctcgtttctgaggctttgcaccctttaaccccattgctgacatcccccagcctcaccagcttggtggaacaccttgagatgtgcttataacagtagctgggatgtagtcagtgctaaaaaattgttagcttttgctgttgtgcatgtagttgttgttgttattgtaaaatggtggctggaatccacttgcgaatatgcagtcatgttacaaatgaggatgtttctgtcaataatggaccacatagacaacagtggtctcataagattataataccatattgttactctacctttctatgtttagatatgtttagatacacaaatactattgtgttacacttacctacagtattcagtatagtaacatgctgtacaggtctgtattacaggagcaataggctgtaccatctagcctaggtgtgtagtaggtttgtgtaagtacatgctatgatgttcacttcgtggtccactaggtcactagtaagcctttctgtacctttttgtatgtaactctttgtatgtctgccacactgtatgataatgcttaggtgtttgtataaatacactctatgatgttcacaatgacagttttctcaggatatatcctcatcattgacacgtgattgtactttaacagagatacaattcttgaacatcttgttagaaggagatgggagaaataacagaaataaaggtagtgtcttgcatttttcaattattaaactaatcaattcattaaaacagctgtcattaattacttaaagtcaggcaggtgagggaaagaatggcttgacgttttctaatttatcactctttcctgttgcccctgactaaacaaactgtggctgctgctacagctaagtatgtcaaactgttgaatacccaagccaggcttttgaaatattgaaaaatgactactcccatgttgatccataaaatctttaccatcttacagagagctgatgaatcatctctctagcaccaggttcacgaacttcccataatgatctcataactctggtgccaacattgcctgggctcggtaaccttcatgaaatttattattaaagtttgaaattcgttcttgtgtaggtgtaatgggattagtcgaattgcaaagatgatagggctgctatttacagaaaaagctcctttctaacacttgccttttctaatgagtcaccataatacctctgtaattattacattgattgtcttttgcagaattagatttttttgtaactctgggagattttgattagaacattcagttattatgtctgaagagtgatctagctacatgagttaatagtctttggattgaatgtgttgaaaattaaattgaaattagaatttttgtacatcaaggcttcaggtgccctttagcaactttgggagacgaagatatctccacactcagaaataggttttactgaaaagtttttggtggtgaaaaaaataaaatacctcaaacaagctgcagaaacaaagattttcccagaaattctcaacaactatgaggatagactagaagttctgcaagggcagacacttgtacatcattaatccttgacagaattggtaggaaacctttggattttagccagtgtggcagagtaccctgagacgtgacagaaaagagtggtggtggtcaggcactgaattcagttaactgttactggtttctaagaactcatcatgcattcacatagaatctttgtcaacttcacaaaaatcctagtagagtgagatttttatccccattttaaaagtgagccatgtaggtaactcgctcccaaattactcaataaatgctgcatctgaattagaatctatcggaggctggctcccccatctggacttcagcatgacttcattaatgttccctaccctctccagccctatgctggtccactagtcactggtgtaccttcctataccataactgtatctcctgtacagaataataatgctcagatgtttggagatgtatgtgcaaagttcagaaatgactttagacaacattttaccttccttcacgatgaaatgagaaaaattaacaccaatctaataccaaaacaaaataatttaccacaaaagtgattatcttgtaatgtgaaggattcaatatgaactatcactgaatatggtttgaaagggttccatattaatgcatgtcagagaagcaggccagatgctgactaaatcagcaatgtctttgttgatgctttttggcctgtaaagtacctgtaaagtacctgtaaagtacctttaaaaccctgtaaagtatcttgtaatggtgtagaataatcaaagacttgggataacttctgtggtcacaaagcctgttgtaaatgaataaccaggacttttgttttgataaatctaatctacattcctctgtagcacacgattatactcaaaagcaggttatgattgcccccaaattcctaggtaccattgtgaagtcaggctcagacctgactttttgatatctttttacctgagcccctacatccctggcaccaatagaggacatggtaatagtcactaaatgaacccataatatctgtgtttaggaggagtgacattttttggcttattgctggtattcaaatgcctctttactcacctatctttgacaacatccctctggattatggtactcacttagtatgcccttcccataggtgttcaacattccaaaattatttgatactttgcaaaacatccagcaacatcaaatattttccaatctttaaagggctgaatttagtttggccttagaacaaaacaatctgattgaagtaatgcatactaaaaagtgaatgacgaatatgttttgttttgtattatttgaaattttagacaaacttttcccttacaagtctttaaaacgaaatgtgtgagcaagattttcttttctttcttagcaggaatgaatgtcagatgtccttttcttacctcaacttctctttactaccccattcagaaacttgacacctttctcctgaagtgttgatgacatgtaatctaaagaatatcttggacatttaggaaaattaaacacataggaaacttttttttccttcctagcatgaagttttctatttttccttcctttgggtgggacaaaacattagtaacttatacagtgctactccctaatgtaaaattataaagtcatttgtatttagggatgtaggggttttttttagatttaatgtgtacttatcatgaaatcagtggatgattgggtcaagtctatgacattatttaactaagcggtctgccatggcattatttaatgaaataatttttaaaaatgcttttattttactgtaagccattgaagaaaaattttactcaaagtttaacaagtgtttagttcatgatgaggcatttgcagctgtaagcaatcatattactgtgccatcatttagttttatggaaaatgaaaacgtttacttaaggctgttaaaagtttgttttttaatagtgcctcctaagcaatacaggctaccacttacttttgacatcgagggaaaaagagttactcagattcattcaagctttagttatattgatttctacgatgggtttttcttagcatgtcaagtgattcctgttttatagtgaaggcattactttgagtcaatatcaaagtacatgatcccctcaaccttcaactgtgtttcctgctttgtgaggtgccaacaatagcaagaagggataatttaaattccgctttccataggaaaaaaaaaaaatcccagctgggcgcgatggctcacgcctgtaatcccagcactttgggaggccaaggcgggtggatcacctgagatcgggagttcaagaccagcctgaccaacatggagaaatcctttttctactaaaactacaaaattagctgggcgtggtggtgcatgcctgtaatcccagctacttgggaggctgaggcaggagaattggttgaacccaggaggcggaggttgcagtgagccgagatcatgccattgcactccagcctgggcaacaaaagcgaaactccatctcaaaaaaaaaaaaaagaaagaaagaaagaaagaaaaagaaaaattcctttggtaaaacattatatactctctaaacagggattctcttcacaccattttgaattgcgtgcttcttgccttgttgcacagattaaactgggaaacaattttatgtgtagcagggtttctaaacctcagctctattgacatttgggggcagatcattcttttttgtgaggggctgtcctgtgcattgcagaatgttgagcaggatgcctgatttctagccgctagatgccagtagcaccttcccctcagttgagacaaccaaaaatgtttccagacatccctaaatgtcttattgggtgtgaagtcatcctcagttgagagctactaatctagcaaattagcatatttctagcaaaatagcataactacttttaaaaataagtttggtctaggatgtttttctctttcaaatgaggtatattttagataattttcacttcaataataaataataattacagaaaccaaaatacaggtttcagatgttatctgtgtaggaatgtgaataacagtgacaacattttctgaaagaaaaatttgtatgtagagactaacaaaggtgttttttctcatttgtgcatttaattatgatacaataatttgattatatttagtggtaaatgaataatcttcattagaaaattatacaaagaaatgaacaattcagaaaaaaataatagctttcatattttgtcctgtattattgaagtaagcatgttgcacccacttgatatgcttattattcttaaaaatttcccacatttcttggtaaatttgagtaattcctgtattgtcagtgaatacattataattttaatagtgattgataagcattttgatctctagatttattatcattaaacaatgcagtcacacactttaaacagaattagtagaaacattttcttatttttcttatttggaacatttatcagactaaagaattttaagtgtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagtcgagattgcgccactgcagtccgcagtccggcctgggcgacagagcaagactccgtctcaaaagaattttaagtgaaaccaaccactactttgtgctgcatatatgagagcacttcaaaaagttcatgggacaaattaaatgaaaagataagaaataataaatagaaactttctcagcatcaagctcaagacacttttttgatcaatgatacccgccattttagtccatctctaaagaactaagggtcctgggaattttaccatgtcattgcaatcttttttattttattaactgaagacaaatgggtgccctttagattttttttttttttaagattagtaagcaaaaagaagtcagaaggagccaaatcaggactggaaggtgagtgcttagtaatttcccatagagactctcacaaaattgcccttgtttgataagaggagtgatccaggagcattgttgtagtcatttttctgctaaagctttggctaactttctcaaaatactctcatagtaaacagatgttaattgagttttggccctctaaaaagtcaacaaacaaaatgccttgagcatcccaaaacgctgttgccatgacctttgctcttgaccagtctgcttttactttgactggaccacttcctcttggtagccactgctttgattgtgctttgtcttcaggatggtactgggaaagccatgttttatttcctgttacaattctttgaagaaatgcttcaggatcttggtcccacttgtgaaaaatttccttcaaaagctctgctcttgtctgcagctgatctaagtgcaatggttttggtaactttagggcgtaaagtttgcttgactttaatttttcagtcagaattgtgtaagctgaaccaattgagatgtctatggtgttggctattgtttctgctgttaatcattggtcctcttcgattagagcatgaacaagatgaatttttttcctcacaaattgatatggatggcctgctgctgtgggcttcatcttcaatatcatcccttcttcttttttctttttttttttttttttttttgaaatgggggttttcactcttgtcaccagactggagggcaatggtgcgatctcggctcactgcaacctctgcctcccgggttcaagcaattctcctgcctcagcctcctgagtagctgggattacagctgcccaccaccaagcccagctaatttttgtatttttagtagagacagggtttcaccatgttggccaggctggcctcaaacttctgacctcaggtgatctgtgcacctcagcatcccaaagtgctgggattacaggcgtgagccaccacactcagccctcatcacttcttaaaatgagtttttcatttgcaaactgttgatatctttgggggactgtcctcataaacttttaataaagcatcagtgatttcaccattcttccacccaatcttcaccataaatttgatgtttgttcttgcttcaattttagcagaattcatgtttccctgacaggggctcttttcaaactgatgtcttatctttcttagtgcctcaaactagatcttgttaaggcaggttataacaagttagtaagaatttattttggtgtaatatacatttgaaatttttgtatagttctttcataatgcatattttctatgaactttttgaagtcccctcatactttctctttgttcattttactagcgtgtttgactaagataagttttaaggacaaaagtatgacttgtatggtttttataattaagtatttctgtaatattccacattattgccagttctgtccagggagaagtttttccagctcattcctgaataattgttacaaaccattcacattcatctaaggtatttctgataactaatatcaaaaccttcagaattcagggtatactatgcttagcaatattacttggagcttctattcaaacagcagaaacagattgttttcctttatccaaaatataatataagttacatcatgtaaagcagtgataacattttgggttaaaccccaaatcacaacttctgggtgagaatccttcaaattttaatataatcagcagaagcattctagtagagtttaaaaatgtttatacctaagaaatagtcactccagatttgtcaatctattgtgcttaaatatgaaaaatgtgtacatacaacacttaggcaaaattcacagaatgagttctgtatgaatataacattgtggacaattttatcctatttaccacatcaattgatcaaataagtttatgtgaatgtatgctatcttggaaggccaaggcaggtggatcacctgaggtcaggagttcaaaaccagcctggccaacatggtgaaaccccgtctctactaaaaatataaaaaattagccaggcatggtggtgcatgcctataatcccagctacttgggaggctgaggcaggagaattgcttgaacctgggaggcagaggttgcagtgagctgaggtcatgccattgcactccagcctggacaacaagagtgaaactctgtctcaaaaaagaaaaatatgctatcagtgtttttcactggggaaattttgtacctccccccaggacacatttgccaatgtctggagacttttgtggtcacatttgggaggggtgatttgctactggccaaggatgctgctaaacatcccacagtttagaggacagcaacacccaccacaaaaacaagtgatctcgcccaaatagcaagaatgccaagattgagaaactctgtactgtagagatgatcaataaaatgttttctttattctccagtgattttcttgagatgttcttcagatttgggacattttgcaaatgttaacttgcatcactgtatctgtgggtatgccaacagtcttactcacatatgtcacgtcacagcagaaagaaaagataatctcttaattgtcattttatcttattttccagagcgccactttaactgcaatttcttcacaaagatttctcaccaggaaactggcagctgtaatatttatgatccgtttcttttttatttttaatttgttttaatttttaatgtttgtgggtacatagtaggtgtatattaatgatgaaagtgcgccattcctgtggcaaatgtttttgaatttttgatgcagacttgttttgaacatctgctttgtgctttatttgtactctttagaatcttttctttttgaataatatgaaaattgctataatggctgtggctaaactatgcatttttggtgtgatggacagttacaacttcttttaacacaggcttatttttaataggataacattgaatttgaaaatgtgtgcgtatatgtgtgtggctgttgaagttctgggagctcagatctgagagccagcaaatttagatgtattattttattcaatcattcattttattgagaagttacttgtgagtagcatttattgcactatttttatattcaaaatattactatttttagaaaaggtacttattttgaaaaatgttcacttttcctgctttttatactaacttttacatcaaaataccactgtgcaactaaatttgtgcccaattgaacaaatttttaaataaattagaactacaggccaaattgttacattagaaaacacttagaaattgttaccatttcttctattttgttgcttccagtaaatttccttcatggcacaatttacaaaaagtaataaatattgaacatgtatttaacattaaaaacaccgcttacatccatatacagttatggctcttaaaatgcagacttttgtattgtagcagtctatgagctgtctcttttgcaaaatatttttctttgtagtaacagctttatttcaatgttggctgactatatcttttattcagggactatttgctgaagtatttgcaactaggggcattttggatgtttaatgggaacaaggagaccttatatataattagaattattccataaggtctgagtgtgtgtatgcatgtgtgtatgcatgtgtgtatatgtaggtgtatgtgtatatatatacacatatatgtgtttgcgtttatatatgtgtgtgtgtgtatattatacacctgtgtgtgtgtgtgtgtgtgtgtgtgtgtgtgtgtgtgtgtgtgtaaagagatattttctttgaattgagcaaaacacacatctcccttttcttcattagggcacaagattttttcctattcctttaactattctgttctgataccataaaagccattcacaataggttgtaggtggctgtaatttataatcatttcagtagtaaaattcatcatccctgggattattccctctcttgtcacacgttaattcctggctccagattgtctttgctgtgacttcatctgtaaagatttgcttcccttttcaatgtccgccttttgctttctggagatataacctttgtttctcaagatctgaatgcatggaatatgaaactttccccaactccaccagcacaagtgacctctttctctcaaccctgcagttgtttatccattaaaattaccaattaaatttccttttatacatgtcttgtctcccactaattggtagccgctgaggtctgagacagcacagcccatattctttaacttgaccctgaggagatgccggtctagcttttatttaggttagggttggcatctgaggaactgtgttcctattgcatgctgcagtcatgagctaacagaacgcttaaatcaaaagctgtcaacctaacatgaagaggcatccacagagctgtctctgagaagctttattctttgactcacatctccaatgtgagtaatgtggttgaaacctagcaaagtcaaaatttacttgaagtgatatggtggatccggtgctgtagatgatgattgtagacctgaaaaaaagaagttacgcgaataacatctgcttttctgtgtgatattttcccccccagctgtttagagaattagaaattgctctgtcaagggtttgtttacaaaagcctggccaatttcaaaatgaagctgcctttgagttgtccctgtttcatctcactgtttggaaaataaatctgaaccattaagatgtaaatacatcaagttagaagccaaaggcagtgaaaaccaagtaaaagcaagaaatgtaccacgatttaagtattctcctgggaggaaaaatatacatggtaataatttttgtatcttataattttattattaaattaaggggagagaaatttgaaatcagcataatatctattttgtgtagtatttaacactgtgatgtatattgacaattgataatgaatcaaaatatgtgcgggtaactgtatgttcattaaattagagtttggtaatgagatagaaagagagaatgagaggggtacaggtgtaagcagcagttctcaaagtgtaatcccggaaccatcagcagctgcatcaccctgaaacattagaaatgcaaattctcaggccctgttgaagacctactgaatcagaaactctggggatggggcccagtaatctgtgttttaacaagccctccagaggattctgatgcatactccagtttaagaagcacttctatgtagatggatggatggttggatggctggcaagatatgtgggtacaatgacacatacatatgtaagtacaagtataggtatgggtataaatacaaatatgaatacaaatacagatataaatacagatattttgagagagagatatatagatagacatagatatagatatagatatagatatagaaatgtggagttaccatcacaggacttttttagaggagcaaattatttccttttacttattatatgattgaataaaagctgttcttttctctaggcaatgggtctatcatttataaactgagaaaatctactggtggtccatttgttgaaccattttccattaggttcacttaaagtgtttgttccatcaagtctgccacctgggtggtttccttcactgcaaaactggtttgctcttccctcccctctgtcttcttggcagctgctgtctgccctggttcttatccattggtagatctgattgctttggggactggatcaacagttgaatcctcacaggattttgaagccaacaatatcctacatattggtccatttttcagaatttcttcatttgtgttttatccttccatttttctttctaagcatatataatttatttagattggtgcagaagtaattgcggttttgccatggaaagtaatggcaaaaaccgtaattacttttgtaccaacctaataatttcagccaactattcatatgcagcactgtttacaatggggatgaataagtaacagctaaatatctgataaaaggggatgttttaaatatagtagattgcaaaataatatgatactttttgagaagaaaatttcaatatgcaaaaaatataggggataatattcattaagacataatcaatgattgttggattatggatgattttaattttactcattttgcttatttttatatttatgattacattagttgtaagctcaaattgctgttataagcaaagataatgcagatttatatgtatatatataaaacagtaaaataaattgattgtattttttatcttcttcctttccccactatgctatgaacttaaagtccagcaattatgccagctgtatctattcatcatttttcacattaaaagcaatattgctggatagtagaattaaatgacaactctgcttttggaaatgacaggaagtctgctgtaaatagataattgatgtagacgttaaagccaaatagaatttccatttatggagaagggaatatttaagggtatgtggctataagaaaatatttccttttgcttttaacacaagatgtaacatgacttgtcatgctcaggatgtgttttgaagtggataatggcactttccctaatatttggaggcaccgggcttgatcctcttttgaaggccttcctttgaagataaacatagacattggttttagcttaattctccatccctaaaattccttcctgctctaaaattctataattccataacaacagtgtataagcaataattatgaaatggaaaaatgagccattctacttgccatccttcatgtaaagctgtactatggaatcctgctctaaggtggggccggtgtcatttctccaagcagtatgatgccctggaagaaagcaatgtacagtggcctgtgattctggaccttggatcactttgatgcccttggcttataataaaagcaaaatccatttaaaccaccttaaataattaggaattttagaggctcatgtcaccaaaatccataagtatgtagggtttcatccagtgacttgacctttttcctgcagtgctcttcattttatgtccctctaagtgtcacctctaggctgatagcaacagaacctgtggcagtttggggataaatatgacgatgtctaagctagtgtttctcaactgtgggtgaccaccccaggagacatctggcaaagtcgggaaacatttttggttgtcacaagtggagaggtgctactggcatcaagtgagtaaaagccagggatgcttctaaacatcttcggtgtgcaggacagccccaccagagagaatgatccaacccaaaatgtcaatagtgctgagtaactctggcatagaagaagaaaggtttcctctgcctataactcacttacattctaggaaacatttccaaaggcttccagccacatttccctcacatgctggtgcctatagtacaaaaggctttaggcctgggttctgagatcaatcgtgggtggggaacagtattaccaagatcagctcactgagccccaaaatgcatgtggcatgtccatgctatacactgtcaaccagaacaataaatacccgtcatataatagtactattttgttattagcaagagaggggaattcaggcatcattactattcagccctaaaaaagaagaaattcctgttatttgcaacaacatggatgaatctggaggacactgtgttcaatgaaataagccaggcacagaaagcaaagacaaatgctgcactttctcacttacatgtggaatctaaaaaagttgaactcatagatgcagagactaaaatggtgctttccagaacctgggggtggggctgagggttggagagatgttggtcaaaggatgcaatattttacttagacaaaaggaataaattcaagagatctattgtacaacatggttactataattaacagcaatgtattttattttgaaaatcactaacagagtagattttaagtattctcaccacaaaaagtgacagctatgtaggtaatgcatatgttaattggcttaatgaagacatttcacaattgtatatgtatgtcaggacatcatcttgtacacaataaatatgtacaatttttatttgttaattttttaaaaatcctgtgaactgctaaagaataaacatactctccaaacctttctgtgggatttggggaagtgtttcttcacctgtatttttttctgggttatctgcattaatatctttctagaaaaggatatgactggaagtggcttattgacaatctggattttcccaagagaaattaccttcaaccaggagagatgactactttaaagaagggctttgcagaacctatgtctttactgagtcattcagcaatccaagtgagagatgatgatagcttggaccaagatggaaccattgaaattatgagaagaggtcagattctgacatattttgaaggtacagccaacaagatttactgacagattgactatggattgtgaaatggacccattggtgatagagagtggaagttttggcctgatctactggaaaaattgagttgctattgacttagatggggaacactatagagaagaatattgagaagaagttgaagaactcagggaattcaagaaaaaaatgtcctagttggagatataaactaggtaactatcagtgcatagatgtcatttaaagatacaaggttggttaaaatcaccaaagaggaattgcagatgaaaaataaaggagattcaagaacagagccatggtgaattccaacattatgttacattcagagaggtgatagacactcaaaagagtgtggcatccacaaagcttattctcacatttgttaattgacgtcaaaaacatggctggttgttttgtttttgtttttaacttaagctctttcaaattctggaatttgggtatctttccctaaaagagaaaaaacagccttcgtcttttgagcaagccaggaagcctcttcctgccgtcaattattaattttcttaacatccacttatcatctaaaacaggggttcccgacccccgggccgcagaccagtaccagtccatggcctattaagaatgggactgcacagcaggagtgagcattactgcctgtgctccgccgcccgtcagatcagtggtggcattcattagagtctcataagagcgctaactctattgtgaactgcgcaggtgagggatcttggttgcaagctccttatgagaatctaactaatgcctgattatctgaagtggaacagtttcatgctgaaaccatccccgccgcactgtctgtggaaaagttgtcttccacaaaaccggtccctggtgccaaaaatggctggggtcagctagtctaaaacatagcgaagctatgggctaaggaacttaccttgcttttgtttttccatctgggcaaatggttcatcctgcccctccagggtgagaaatgcctgtccctttctctcaatctgtatatgcaggctaacaaaagatatttttcagagatgatttatttcaccagaacgattattgataatttgcatttatggacacttggtgatcttatcaatatttttatgttttctcttttttagcttttaagttcaagggtacatgtgcaggtttgttacatggataaacttgtatcatggggttttgttgtacagattatttcctcacccgggtattaatcctagtacccattagttatttttcctgttcctctccctcctcccaccctctaccttctgagaggtccccagtgtgtgttgttcccctccatgtgtccatgtgttctcatcatttagctcccacttataagtgagaacatgcagtatttagttttctgttcctgtgttagtttgctaaggatatataccatggaatagcatgcagccataaaaaagaatgagatcatatcttttgcagggacatggatggaggtggaggccattatccttagcaaaatgttttccctttttgtgggacattatcttgaatttctcagaaatcaaccacaaatttaaagagtgaacactggatatctattgcaaatttttctaaaataacatacataaatctagctatgagaaaaacagctttcaatttttattttgcataagagtttcttggaaagtttcttaaaatgcagattccttgacatcagaagttctgttatgatcaatttgggactggactccagctggtccatttcatccatcccacaccattatctgattacagggcagaggatccacaagctgttcaggagctcatataaatttctgcaagctgaaaaggaaattattgactcccaaagtaatgatgtaaatactcacctatatatctaaaaacatagcaagtgccaatttcattgtcaactagtatttttaacaatctcatcacatgtaaaaacaattcgtaatgtacattttgttctcttaacaagtattcctgaacacgcacaataattacttaaaaaatcacagccaaacgagaatccgatgaattacttattgccaaatcatgtcaaaatcaaaattgtaaaaattcttgataatacaaggagatgaacctcaaaagtaagtgcttaaaatagctcagagctcctggaactcacttttaacaaaaagtaaccccaggtgattctgtatttgatcttttgcccacacttggagaatctaaggtctgtgtggggatgcttcatatcatcaaagcgtacttgtcttccttcaatcatttatcaaaattcttagcacctaaacctagcatcttagcatgatgctagattataaaaatacagtgataaacaatctttctaattgtgaagcctccagcccagtaagagagacagccaatagacaaatgcacaaacaagtaaaatcaattataggttgagataagtgctaagaagaaaatcaacagtgtgttgagatcaagaagccaggaaacattaatatcagattggggaagtcaaggaaggctttttgagcagatgatatttaagcagagaccagaaaaaggaggagccagccctgtgactgacgccttaggaaagcagttcaagcaaaggaaacagcatagacagaaacccctaatcaggacccagcttgccttgtccatgagtgtttgaagaacaggaggaaagagaggaggcatgaaaggtgaggctaaggaagttggtccagaccctttgacataggcaagttctatgtggatggattttattctaagtgcaatggaagcccgttgatgatctttgcttgcttgtttgttgttatttttttaaggttggatatggtgtggtactttgtgtagcagttgaacacataactcgagccagactgcccaggcaggaattctggctttgcctcttataggcagagtaaagttgagcatgttctaacctctcttcactcacttcctcattgtaaaatggaagtaataacagtacctacctcttaaggttgtttagcagatttaataaatatgtgatatgctctatgtatgtctcaaaatgaagaattgtctttaagaagattactgttatttcccccatgaacaaattgagtaaggacaagagcagatggctaggttgtctggaaggctgctaaatttgtttgggagaaatgtgatgggggctggaattggagtgatgaaagtaaagatggagaggaggggtcagattcctgatttattttggatgcagagttgacagaagttggtaatagattaaaagtagaacatgcagtgaagaggagaataaagaaaatgacttagttcctggctcaactaactgggtggataaaaataatcattatttaataataataataatcatcatcatcatccacaacaacactgattaagcgagtgctgcataccaggcaggcattgtgataaatgctttgtaaacacctctaaagatgtgggaggctaggataccaaaacatttgccagaagagaaagtcaagagttcattagtggataagggaagtttgagatgaccctgagacaccaggtagaagggtcaagaaggcagctggatagtcagctccataaacacaaagatgattggtttggagatagtatttgagagtcctgaactttgcaatgggatttaccaccatgtttttttgtataatggcttgggctgttacgataatatttttgtcttttttggtctaattctttttagttcaagacctgctttgtaaaaaccttagtgtcaatcaaattttcagtcagttctccatagtgtaaaataaagtattgcattaacatttctgactctgaaacaactctactgaactaaactacttaatctgaagtttgtgttgtgtgtgtctgaaacatttcctcatcaaaattcaaagaaactttagttcaagttatggcctgaaatcaacagaattatattaattcatatggatatagaaaatcatttatttacagtatttaaattgacatttaaacagtttttccaatcccacacagttagtggcataaggtcttgagaaagcatgaaacattttttttttatcagcctcatatttcgttgagcttgccaaacacagttcattttccatagaaatttgcaaacctgagtagtggccaaattttcagagtcgctgaatgtaagccaatgaataaaattgttaaaccctttgatttccccccacttttttcccttaaaaagtaacatagcgtgtgcctgagttttattttttgacatctattacccacaacactcgagtgtgtttcagaatcagcctgtatggacatttcagtacaaaatgaacacagccggcgctttggggaacgttcatttgcagctttgttatccttagacaggaagccttctcctccacactttgatcgacatttttcagaaggcaatggcatcaacctttaaaaatggatactttcaagggtttaaaggttgagatttttaagacaaacccagaataggcaaaagttacatattggccaaaaatgtgactccagaaaccatgtgttgtagctaactggggccactagcaaatctttcttttgagacttctgtcctgttagcagaatgcactgatcgaactaaaccttgagcatgacacaggatagaactagttattgttaagaaaataatgttcaagggcattggtccattgtacccaggaatagtttggaaagatgaaggatatggaaacaaacaagcaaaaaaagaagaattaaaattaataattaaaatgtcagtaactgtaatgtatttctcttagtggatgataaaattacataagaatgtcgaccttttctttaacccaatgaccatagtggcagtctcttcattggactgcttccttcattggcatcgccttctaatttcatttttacttatgatagtgaaaatgcacaatggcccctggaggcaataccctaatttttttgtttaagtgctcaaaaaagtatatcctttccctgcgaaaaaggcagagggtcacaattaattactgaatttcagctatgaaaaacccactgaactgtgagagtccattgtgcttaagttgcatttaatctctttggagatgccaactacctgatatacaagagcaactgtaagttccaaaaaaactctcacagataggaaccatagacatggagagaagggagccactactcagaaatgaaggagttggggaggagtggggctgaaccatgaagccagaacagaatttttgtcagtggcctagaagcaaagctgagaagaagggtctgaatgtgctggggaccagtggttgtagctccacactgagatggaagcctcctctcactgtagcttctgccaaaacacataggtaaatttgcaggagtaatggtgacctcggaagagcctggtgtaattggggaatgattgttgcaagggaataagagccagtatttcatttggtcttttgtgtctggcatttttcactcagtataatgtccccagggttcatccatgttgtagtatttatcagtacttcatccctttttgtggctgaataatattctattgtagggatatgacacattttgtttattccttcatctgttgatggattatttgggttgttttgactgtttgactattaagaataatgctgttaggaacattcatatgcaagtttttgtgcagacttacatgtttttcatgtccatatttcttgggtatatacctaaaagttgaattgctgagtataatggcaaatgtatgtttaacatttggagacacattctcaccagcactatgtaagggttccacatccttaccaacagtttttttttttttttaaagctatcctagtgggcgtgatgtgataattttttttttttttttttttgagatagagtctcactctgtcacttaggttggaatgcagtggcacaatcacagttcacttcagcctcgacctccctgggctcaggtgatcctcccacttcagcctcccaagtagctggaactatgggcacgcaccaccacaccaggctgttttttattttattttaatttttgtacagacgaggttttgccatgttgctcaggttgatctcgaactcctgagctcaagtgatccgcccaccttggcctctcaaaatgctgggattaccggcatgagcctcactgtgattttgatttgcatttccctgatggctaatgatatcaagcatcttttcatatgcttatcagccatttgtatatcttcttcagagaaatatttattcagattttttttcttatttttcaattaggttgtctttttattattgaattgtaagagttcttcagattctggatacaaatctctcatcagatatgtgagtgagcatttttttcaaatgattttttccctccagcaatcatactgcatttctaccatctactgtaaactgccatatgtctacctcatttatctcaactttttaactttttaacttttacacttttcttcctagtgggtgcttgggggctttcagccttctgtgcctggggaggactttcagaactaagagctccccagggtgtctgactcagaggatcacagtgacccaaggctctctccctccgagatcctctagttgtgcattccagacagggagactgcctggccggctcctctagcactttgagcagtgtccctccctgcctcctgtctccttctctgttcccacactgcacaggggctctgcgtggggagtatgggggctcgctactgcctggagctgctgctattgctgaggtgtaagaaccctggagaggtaagaagatacggtgtgtgtatttcaggctctgtgtttcgtgcctactgctagaagcaaggtaggacccaagccaggaagacgtgaaagattccatggggtaataatcccagagcagcatctggaaaaggtgaacataagtaggaaagaaggagggaagtaatagcgttggagggatttgctcaatgtgtcctggcgcttgagtctcttttaacatcaaagctcaggtggttcaaatgacagtcacactgcctctgcctgttgctttaagagtaaattcagagtcttcaaaccaggcttattggaatattacataccattgccaagacgtgtatatttttattgaaagttcagagcaaatcatagtaaggacccaccatttcttctgcaccattccttttggctattttctcagtatttgaaaatcaatggaatttgactttaacatgcacattggcttataatgttactgttgcatgggtcttaatgttactgttccagtccagtgtttttgtgctagaggtaaggaaactgaagttcagagtgaatcaggcattgccaggatcaccagactaatccaggatgagccaaaacatcattgctatggagtgtctctttgggtctcaatcattgggtactatataatgactgacgactggggacaagggcataggttgcccttttccttagtatgatgaaggatcaagattctataacatcgataactgattagggtactaatgtggaaccacaaaatgtggttcagctctgtcctgtggccactccatgcagcaaagacagatggctggttcagaaaactttggttttgttgtttgcatacaataaaggtagcatctggtgcaaattttattttttttaatgattccagggttttttctttaatgatttcatagaaagaaccttaaaactcatcttttcagaatattaatttagattgttaccgaagtgttcacagagcctaattaaatacttgctggtttcatatagctacaagtaaaagctgctttgaatccttcctaaacttatattggtttatttggtgaattgtgtgttaacaccaagaaagtgaaatcattggcttttctacagattggtgatctattaccttaaacaatatgatcaggccacatcaattcatttgcaaatttcttcctctctctatcatgtgcacatgccaccataggtataaagtaattaaaatatatacgaattatttagtttgttaaaagccaagttgcttttgaagaaaatttgctgctcttagattatgattatttacagtttgttaagtgatttcattttgtaggcatagactttttattgtgattctgattatttacagtaatagcaactatcaaatcaactaatgtggtggtgattgcagatttttggatatctattactgtttatcgggaacattttttcactaccagaacggggaaaaaaaagccacaaaagcagtaaatcccattgctttccaagtgtcattgtaaatcctgctgataagaactgcacattttagcaatgtttaataagtactttaaaaattgagaattgtctcaaaagaaacagattttgaagttcctctgttgtacctacttccagattaagaaaaatcatttgtggaaaacaagttgatcccaagttcctaatcacagggagaagatgggattttgtaaacctgcagagcctgaatttgttattgcatgcagctgtgcaaatttgcaaacatttccttccctagtcaggaccctatggaaggagccagtttggactgctgccttgatagctaacatttgtagaggctgcagtgcaggaagctattggggtacctgaactttgtcatctattttaatctgggcattagatgccaggtagagagagtatgcaagccaattagttctgcttcaatgtcatggtagggatatatcagtagccttattattcttgtcattctcggtgaatttcagaatgctgcttgaaatgggctttctgtatgcgttgagtgtgtgttcagtgggctgtctgggaaggaagatagcggagggccaaggcctgggtctcctaaaacacatgattatttcattgaactaatcagtgagagaaagacagggccttgtggtttctacgagcactggacttgcgtttctttgttttccatccatcctttggaaccagagaaggcatgaggaccatccatgagcaggttcacactcaaagctggttgcccttaccctggttgccatggcaatgttgtcctagcgtaggggatacttgcctatgtttgtagctgtctcctccccatctttggcagtttagcacaagaggcaactccctcatgcaactacagagcatttaatgagttagggattcttcattttgagttacagttagctctctagtatatttttgggaggacaaatgggcaggaaaaattaagtcacaggagacaagcttcatgactctaatggagttgaatttacatttgccattaaaaatagctatagattgtttaattagaatcctagaggcggatgacgaattagtttatctttcaaatggtactcataaaaaatggggcagtgtgtgtgtgttttaaaagagcctaacttcttgttaaaatttaaagttcaaaccctcatttgtaaattggtgatagagacaattctataacgttgtgagaattaaatgagctaatacatgtcatgtgcttagaatagtgcctgaaatataataagcccagtaaatgttcagtgttattattatcattacttttatatgacagcatcctgggtgtttaatgctaatgatggctcattgagcagatattaagcatactgaccagtttccaggtatttttccaaatctgcctcaaggagcttgacagctaagggggagacaaaagtagaaagaagcagttgtttgaaatagaggcatggtcaacatatcctgggaaacctctgagcctgtgcactccagccctgtggactagcgagagaggtttctagaagaggtgacattgaggtgttggtcattgatggctgctcccagatgtgtggatatgggggcaaggagacaggggaacctcacttccaggagtgccagccaacgtagagcagtgagagaagatttctagaagaggtggcattgaggtgagggtcactgatggctgctcccggatgtttgggatacagcagcaaggaggcagggagatcctcacttcagaagtgccttgagttggttatttggacagatagggtgttcgatggcctgggtctgtcagatattctcagctgcccaaggtcagtgcttaatcatcttctctccttacaatacactgctttatattctccatggctgtaggggttttattctgtaacaattttgtaacaaaaacttcttaatcaaaagaatcattcttttggagagtggtggttctgaaaatcatgagaattaaggcatcttaaattactgcccactttatggacagaaccactcatttctcattattctgccagatccaagcaaatctcagaacagaacttatcccagactaattgaataaccttgaattcagtagttacactcatggctaaatttattattttctcctctttatcactcgggtagacacaatcactttcagaggttcttcagtctgatttacaattagctccttagcacatctttggaaggtcaaacaagcaggaacaattaactcacaggagacaagcttcttgtaacctcccaagaaacaaatactcacttctaagtaagttctgaagaagcaaataactattctaacttctgtcggacggtttttaaaaattttgttttaatttactttttttattttatagatttagagggtggacatgctttcttacatggatatattgtgtagtggtgaaatctgggcttttaacaggatagttttgatttagagacattagctgacttaatcacgggacagcactttctttattttgcaaattctccttaacacccctaccactccccaagctgttttgatttgtttagatccctgttgtgactccagacattgccaaaggtcccctaggagacacaactgtacctgcttaagaaccactcatctagaggaaaacggtttggtaaaggccgggtgcagtggctcgcgcctgtgatcccagcactttgggtggctgaggcaggcagatcaggaggtcaggagattgagcaatcctggccaacatggtaaaaccctgtctctactaaaatacaaaaaaaattagccaggcatggtggtgcctggctgtagtcccagctactcaggaggctgaggcaggggaatcgcttgaatttgggaggtggtgattgcagtgaaccgagattgagccactgcactccagcctggcgacagagcgagactccatctcaaaaaaaaaaaaaaaaaaaaaaaaaaaagtaaaagaaagaaaaatgaaatccttataatgtggaattagctgaattgtgccaatgccagagtgacaagggaagggtctgagttgggagtcactgtacacaaaggctcagccctagaaagaaggtaaaaggaagacatgcagagagaggtggtctcaagttctagcctccacttagtggagcgcccccatgacacttgcctggtgttgctctcctgttaccctcagagtggtgaattgaggatgaaggcttgtcttggaggcagcaaagaacagtgtctggggatatcaggtaggagaaggcaaagatcatttagggtcacaatcagtaagggaggtgttcaggtggctacactgtcagagtgatgcactgataaatgacagacatgggccgggcatggtggctcacacctgtaatcctagcactttgggaggctgaggtgggcagatcacttgaggtcaggagttcaagaccagcctggccaacatggtgaaaccccgtttctactaaaaatacaaaaattagctgggtgtggtggctcactcttgtaatcccctctacttgggaggctgaggctggaggatcacttgaacccaggaggcggaagttgcagtgagccaagatcatgccactgcactccagcctgggtgacagagcaagactctgtctcaaaaaaaaaaagacaaacgtgatgtacttcagtgcctgtggcatcaaaaacttccatgtcatatcctaattttgtatcactcctgcttccaactgggtagtgttctctttgggagtctacagaggcaggacaaagctctctttctgattacaagaactgtagctaacatttattgagcttggggctcattaacatgaaaagactcagagcagagcatgatattagtacattttatagacgagtgtactgagccatagagaggccaaaaaaattgtccaagtttccacagcagataggcaatggtcatgattgtgaatcaaacggtttggttatggaggctgcaccccctaccatcacactggaaagccggctttgtgcttctgtggacacttaactgacacccccagagcctgcacattccatggccaaatatgaagcatggaaaattatttggagaggcaaacaaaatttggctgtttggaggaattgagattttaatatcgttcatttttaaaattaatagtaaagtgaattctgggtcctgtggtgttttttgttgaccataggacaatgatatttgcaaatgggctttattaatttagattttgtgatagaggattcaagtgtgatttattgaggtaaatgtttcgaacccaaatgaccactcctttcttctctcttcaaatcctcaccactcccagcccaatcttattcctcaataattatttatcgtctggaagagtcaggtgtttcaaatgaggccagcatggacttttcccaacagggaggtattttttaatatctaaatgtcggcctatggcccttgctgttaaggctccagatcaaataggggcaaaaggaattgaaagccaaatcacaaaaataagtaaaaactccaactaacaagaatttcacaacagacataagctgatgactattttattaaagcaatgtggagtactactaaatgctactatgttctggaaatgtaggaaattggttgaagtcgtttttctcttgttagtctcatgttaagctgttcatactaggatctcttgggttattttttcccaattaatacagttgtctactaatttattttctttttaaaagtcttggccttaaactcagtcttggtattttcagctattgtttactaccaaaggaaaaacttcggatttagagaaaagtctgtatttttattttgtgtggagttgagaaaggggatggtaaacttgacattgcttggaaatgaaatgcacagcttgatctttttttcttgatatgatttttgtattggaagaactgtagtatgtcttggtggtgataatgaataccataaccacataatcattctctaaatgattgtaatggaaagaagttttatttaaaatttcaagttactcaaatggcacatgtctccacatgtgtctttttactacaggtaaacccagaaagcatgcgtggttatgggtgtgtgagtgtgtgtaacgtgaatgtgtgcctccctctatgttatgttgcactattagtttgaaccacaaaatagaaaagaatgtaaatatcttctgaactctggatttatctgttctaaatgaaagctagaggggaaaccattttagtatgtaaagtttggcctgaggaagagaatggcacttctacagttcttagaaaattctcatagaggatcaggattactggcatgcttggggaacaacttgctgtgggtagctgagattttcagtttcaaccagcaaatctgttttgtttcatcttttgtttaaaatatttgaattaataagaattatttttcaacttcaagaagtagtacatagagcaatgctgtctgataaaactgaatggtgatggaaatattctgtatctgtgttgtccagaatggtagccactagccccatgtggctatttagcgcttaaaatgtgtctactatgacggaggaattgaattttaagttttatttaattttaatttatttacatttaaatagccacataggacaggactaccatatttgacagtgcaagtattagagtataattaccagttaatgtatgtctctggtttgaaacattcctctgtattatcacactacgtatctgaattttgatttggaaaccgtggctgaatgctgggattgattccagctctgccaacaggaaaggagtggtgaggaaagctgttggacagctagccaaggatatttgccatatttgccagagtgttttgactgtacttctgtcatagtattaataccatttggcctttttaattgttatttgtgggcttattttacccctttggtagattctagattccttaaggatggggccttgctcttttcaccagcacatggaatagtgccttgccctagagtgtgcttaataaatattgactcaattgattagaattggtccatgccaattgattaaaagcttttctacctttaaaaaattgaatctaaattctttaaaatcaagttatttgtttgaatattgacaccctcccaataaagttatgtttattcattccagaaaatgattaaggggccttaatcataaaggtactggaataaagttaccatgggtttgtgtaatataaaccctgcaaagactgtttacaattctgtgtgggtgtaggaagaaaaaaggattcaaatataaatatgagtgagaaagaaaacttgttttgagtccattttatgcatttgttaacattttgaagactatacagtacaatttatcttaaagttatgaggtgaaagaaatgacttgtgtttaaaatcactgcaattctctatttgaagctccattgataacattttttgaggaaaacaaattacttgaataactttaaattcagtacattattatgcatatcacataatttcatttaaaaatcttttttccatagaatgagatcaaaagaccagattttgattgccagtgtggtgtgaagtgtaaagccagtgttccatgtcctattttgtttcataatataaacattcttcaaaagtttatctttcttaatgtaaagaatttttcatataaacttcccttcatttggttcaggttttagttattgtacatattcataaattttcattttatcaactgttttaactgatgtataaactttgttttttaaaaaagatttgagacagtataatttaaattttctctaaaaagaaatatattccttatttgcttgccaaatggtgaatttgtatgactaaatgagcagttcctacctgattcaagaatactcattcataatatatcatctcaaatgataggaaaatttaagtttcattcaacacaaagacatgaatgatttttaatgcattttattgtctgctaatggtacttttttagttacagaatttgctaagtaaagtgattataagcaaaaatcattgtgttcttgtgtcactcctgaaagcatctgaagtattcattcccctctcatcttctgatcttttaatcctgaaaaaaattgcaaaagaacagttaaaataatttacaaatgttcctagtgagtaccatttacaataacatgtctggcttcagttttgtcaaaacaatgtacaaccatttaagttgaactctataatttctgaagtttctttgttatttcgttgtcattagatattaggtgtccatgaggactgcttccaccttcaggacacttaaagcctattattttataataaaataacaattgctacctttttggggggtacgtcttgcatgtcaggctccaagcttatcacgctattttgttttccataaaacaactctaagaaactatcaatgtttatactcaaattttacacaaaaagaaactgagttttaaagagttcaaactatctgcccaaagtcacctttccataaatagctttgtcaagatgtgagcacattataaagttcatggtattaattattcataaagaagtaaatgcattttctatgtacagagagaacatgtgccttggactagaatagccaatgataggcaccgattacttgggattcaatcaattttcaaaaaattctgccccatattttccgtaaacatgctcacaattatgaagccatttatgacatatattatgatttttttaaattcagaaactatggtatttataattggacagagacttgaaaataatctgatttcgtcattttcccccatttaaaagaaaataaaacaccgatacatttgaagtaacttttacaatactgcctcgtctttgagggcaaagccagaattggaacctttgtgtcctggcttcttatcctggtcatttccacctcacttctctcttcttctcagtagcaaatcatcaataacatgtataaattggaattacagttggatacatatacatgataggatcacataatctcgtatacatagaagtaagactttatggatgtagattaagtttgttttgttgactattcccattcatttgtaagagctacctgtaatggaagatttagtgctaaattgcagtaacttcttgctaaaagcttaatcatctatagaaccccagtacagaaaaggaatctaacagtatgtttagtttagccgcctccaagttagattgaaaactactggaaatggggaatcttcctgtaggtttttgaagagatttcccgtctaccttttgtagcctgttcagatatttgcactctcaaaattatccgctccctcttgtcttaagccttcagtgcaactctagcctattcttgctagtcaaacctttgaaatataaggagaactgatattcccttatactgttgcccttaaaattcatggggtttagtaatatatatttctattaatgggttttggtaatacatattctggtagaaattcagtaatagtaaaattgaaacctaccataaaaactgtggtcttaattaccaagccatttagaggaatttgtctttaacataaaggtatagcatattgcttggactaatagaatcatagacctgtaactactacaactctagatccttggttgtcggagaccttagaactctggggcctattttgctgcaccattttcacaggatttgcattgtagtggcttcaaaatatactcaccacttcctcccgcttggtcttgtctgttgatggccaagcttccagagtcagatcaggaagcatgggaggcaggggctgcatggggaacatcggaggcagaggtggctgtggcggcaggggctgcatggggtgcacaggtggctggggctgcatgggctggtgaggctgtggctgaacaggctggggctggtagggctgctgggcgggcggagggaggtttggctggtggtgttggattggagtcatggagtgttggccaggaacgggcatcattggttgctgggggatcacgggctgctgagctggcaccactgggatgtggtgatgaggctgcagggtgtgagtcggggggtgctgttgggacagcacggggatgatttggtggtgcagccatccacccatgggctcgtaaccataggaagggtactggtgagaaacagagaggcaggtttaccattggctcaggtgactccaaccagagaagcagcagtgttttctttgccattatggctataggaatattttattcatttttcctttgcaaaaatttgtaactgtgtacacagatatgattttttacaaactaaatttcccattaatgtctgcatgtggagtagacatgatatttcacttaatatgggaattttaatgcatgcctaatattttcagggaataaggaacaaaatgtctacataccggtggccttatgctctggtaccacttcaaaggggtaagcaccttaagagaaaaagatattagaacccatttgatttaatttactttcatccaatatagaaactcactgatgcagtaggaaatatagactcactaatgcagtcctgtcaacattgatagcctgagaatgtgagttctacaaaagaaagaagaaggtaaaaatttgttgggtgcttcctgtgtgacaggcactgtgtttacatccatcacacacattcttcatcttttcttatatgctaggaggcaagtattattactctcactttttagataaggttatggggagttaaagagattcattaacttgactgaggttacacagggagtaaatctgtttaattccatagttccttcttttcattgtaagagcaaaacaaacacaaaattatgacataataatatgacatgatgttaatttcatttttttctttgatgtcacaatgggaaaaagagaggtgcaaacactgtccctcatcctagaaacacagattgactgatcagatgtgtcaatcttttcggttcaacagaaaatcttgcctcaaaatcttactaacatttgtcttcagcttttataagtaaataaactcatagattgttacctgaacctgtgagagaagtaagaatcttattcctttctgaacagtatatatacttggttagccttaggtttgaggattcttcatatagtaatacggcatttaatcgatacaaaaaataatcagtaaccttgctcatattatacttgacaaagcacttttcatattcattaactatattactctccaaacaatattttgaaatatggttattataattatttcctttctccagatgaggaaaccagggttccagaaagaggaaatgatttgcccaaaatcacaaagttagtaagaggttgaggagaacctcaaacccgacgtccaaaactcatgcattccgctgttctgcggagtctctcctataccacttagtcactaatatttcagcagaggcaagcaagagacacacatagagtgtgactatcttagaatcaggagttttttgagctggaaagagttttaaataacatcttacctaatccttacattttactagctgggttagaaccaagctggtcagagtttactttttgccctatcatggagcctccctgagtagtggttcatgatgggtaagcttacggccatatttaggaggacagactgagtcagagtggccaggcgggaggctgctgggacgacacaggcttgaggccaaccatcagagcttaaactgggaagctggtggtaggaactgtaaaatcaggaccacttgagaaacatctgggataaagaatcaacacactattctttacagagcccagggcattgttaacgcaaacaatggtcaaaattagtaaagagaaaaattacctcatagctgaagttgatataaccagggtgcccaggatgaggtggtagcttttacagggaggaggggaggagaatagaaagagagaggaagggagagagtgaaggaagagaagagagaggaagagattaagtcagtatgcaattgttcacattaaaggagactgaagctactttaaaaaaatctatatagtgcagaatatacttgaggtctgtttttagtttgaacaaatgtgctgtatagaagaggagaccttttattttaaagaggttcagaacagctaaatgactgttcctggggttatagccttatggctggagacctggaagcagaaaccagcacacatttattctccagtgatctttggacagcatcccacccccacgcccagtgttttcaatgaatcctaccctatcctgcccaacagtttacttgctgataaaactcaccccataatggggagagaagtgtgtttctctttcacaataaagaaatatcaacaaggagagaattgtctcacgaatgttcccttgtagatcaggaggtggtcaagtacttttaagtatcaaagggatttctcataattgacatgcaaagtaaacaacacttccatacaacaaaagaagccacaaaagaaaccacaaggtgggaattattgatgaatgccagaacaagatgggtggagcaaagtggaaacattataaatcccatggaaaatgaaagagttgatttatgacgtttaggccgatctttttttattattctgccaacggttttatggcagaaaaattttcaagttaaaaataaaaggccacctgaatgatgatctgaatcaggactgtctgtcctctcaaaagtggggcccaagtgtctggtgcctgtattgtggaactctggttgtgcctggggtccagggaggagagacggtcatgcagaaaatctccctcagacattggcctcatttaggattggctctattatattctttaaaaatgctcacatttcatgggaaggtttattctctctcatctggatgtgaatggttttagtcaggtcctataccctcttgaacaataccatcttagagagtgggaaaagggctgaatttgtaaggcagggacccctgaggaaactaggaatcgctgcaatgcaggatttcaggaagtcagagcacagaatcttggttttgtgggtgagagaggaagagaggaggcaagggtgcaagcttgctggcttctggttgtatcaactgctctttattccaccaaaaagcagatgcagcctgcttggcatgcatgtgatctaagttctctgcccttatgcacctgtgtccagacagagtgggtctaatgtcctgatctttaatacatttgaatataaaatatatcactatgtattgggtgtaggcaggatcccgggcaaccacaaaaaagtcacgtactcatcagatgtacccaaaggggtggggcctctgagaacaggaatgtggctcaaaaagtggattcctaacacaaaaatcttaccccctgaggggtaagagcagcaatatgtggagggcaggaagagatttggaatcttgagaggaattgggttttagacaaaactggcatctctgtaatatttgtccaaagctggttaagcactttctctggagacctttcaagggtcccttccaaaagcttcctccatctagagatgggtggtgatatttacaagctaacagttccaacagaatctcctggggtgcttataaaaatgcagagtcctgggccccgccccagctgtaccaaatcagaatttttggtagcggcatttgagaatatacctttttaaaacaagctcctgaagtgtttcttcaacccagagacatatgaagacatctgatctcatactgttttaaaccctaatttcaccaactatgagcagatttttatgtccaagtttgtgaaattggacactgacttatgcaaggggtgttttactcacaggcatggcaaaagctgctcccaggaggcaggcaaataaaatccaggtccccatttcttgatggttctgaaatgtaagtcaacatccacttttcttatctcttctgaaacatggatgtaatgaatgctccataaaacacacataatctacattagtctattgctagtaagaaggatggagccattgtttgtgaatttacttcagtcatatgtgatttccagctctcagcctatttcattgtttctggagtcacagtagtgataaagatgcatttaatttaggttgagggctaaacaagttacagggacatgaatgatctatcttcatatgactttgcatgccattttcctatgcctatacagcccttagtcatagaagctaaattgtatttataattaatgattaaaggaataaagttggctctaaaggttgggaagatcatcaaagtgcacagtattttataattttagaacaaggaggcacagaaatgtctcgtgcacagtctacctggacattgctactgttaaaaacaaggactaatcatttgagaaaatatattaatttgccaagatagattttagttccagaaattcctatctacagaacttcaggcaagaccctccagtaacatctctgagctccagattgtggagcaaaagatgtggctgaaccaacaggagaggatggtacgaattttatgtgattcttcaatgaattttgaatactttctccctaagaggtttcattttctttcaatggaatcttcattttgtttgatgttgcactgtaattattctataaataagacccttgggacattaagcaaaacaggtcctcctaaaatgtgcacattgatttgtggcacaaattactgggaaaactgtcagaagaaagaccttaaattttgtataagaagtgaatattacatgtgataatgctgtctatgaaaagtacactaaagttttctaactcctaaatttgttttttgtttgtttgtttgtttgggttaatgagaaaaaacacttcatggatggttctattttatgtaattaaataaaaagcttttcaaagtagtagatcacagcctgtgaatgtattatttttactttaatcgataattaattaaaataaatattttactgtgaaatgtggccaagaaagacctttggaattagacaagcactttgttgcattataaagttaaaaatcatttcagtaatcagagtctaatttaattatgggccaactaaaaagtaactattgatggcatatagtattagaaatgtagaatacatttatatcttttaaaagaaatgcagagaaagaaataagcacaataaaaaggatatcaaattataaataaaatccacatacctttgaatgtattcagtgcaagtttctgtttgaaactcagggatgcttgatcctttagatttcttccaactataagctcaatttatatcattcatggcatctgtaacaaccaatccagtttctaaaggaaaaatgtgttgagtataactaaaaatccctgtatcatgattttttagaagctatgatcagacataaggctgtatgttgtgattagtgcatatggaatctttcattatgggcaataataggtttaacaggcaaagagtttcatcacgctattttgaagtcagcaaattagttgactgtacatgttgatatattcagatttatttttaaaaagcttctctgccatcgccttttcctcagttctagcaaacaacgttgttctttacaaaaatcaaggtaggtggttgagattctctagtgtaatctggatatcctccaggatttttccagccctttcagatcaggagaaattgattcaaattcccatttgggtaaaaccccaaagctctctctagtttctctctgaggaattataattttgggatcaccactgctctattatctgcttccattgaaggtattttttctctgttccccttggctactcctttatcacccctctggtgtccaccaaaacaggggacaaagccccttctcggccccatgctgaaacccatctaccgtaaaaacaatcaggaacttaaggttcttgcagtagcaaagcttttactgatgatctatactacaaggcaaggagtgcacaccagacagcacattttaaagtaaattttgttttttacaagcaaactcatgtcacaggggatgttgtcctttgcctcccatctcacagagcagcttggcctctcagtatggcggcccttctttgcccatatccttctggcccaatcccactttctcatacaggcaaacccaaattcctctctatttttcagagtctcttaactgtctggctagctactttgtttccatgttctcagcagcctcccctttccctaagcaatgaccaaagctattcactttctaaaagaacctctgatcatctacctattaaattcatgtgtgttttacccctctaccttggtataacacatgggctttttctttcattctggaatttgattagattgatctaattgagcaaagttgtaattagtggcaggagctaactgacgagtcgtccatcaatattagatcaataaaggagatactgaatatctacccagatacagttgatgttatacttggatctctttgaatacacaagtaatacttataaagtttgtatatatacatatgtttatacgtatatatacaaattacttagcctgtctgagcctcaatttcctgatatgtagaatggaaataataacagaacctagctcagggaattcatgtgaaaagtagatgagtgacatctctggggaaatggaagtctatttattactctccccaaccctgtcagctggcatacagtaaatgtttaaagaatgctaataaacaagattccaagatgatctttggggataaatcagtagggatgaatattgcaaagaaaggtaagaccttccaatcagggagagagagattgcaaagaaggaagtagaagattataacaggtaaaatgtatgcatgaaaagaaacatagaatatgattctaaaagccaaatgtccccaggatttggctttatttatgaatatatttattggtgaattttatagcagagacaagaaggattccctttgaaggaagttggaaaatggaccttaggaggattggcaggggtgtacagcaaggtggtaagggagaggaaggaaaatgtggatcacattttattcactttcaatctttttcccccattttatataattacatatattggagtgtctgaaaggattcaggatattttttttttctacaaagttgtgggtaatctctactaatgaagtcaatgatgaattactagtagccttgtagttttagaaagattgatcttatactttttctcaccttctaagaatgagaggatgatatatttggccataatgatcaacaggatgctgccttaatgtggcattaattcctctggaccactggatagtgagttaccgctaattcaccatggacagttgaacaagctttgatggccgattccatagaaataattgattttcccctactgcatatcctgaatcataggacattaaaatatggatctctgtttgaaatctcttccactaatttaggccccacttacacagcttaaaaattggtaaatgttttgaggaaaatgaaatttcaattgaaatatttttcctataagcaattattttatttatgaataaattgactgcataaaatagttcttttgctcatttttttgtagtaggtattctttttcttgacttgcagcccagtacgttttgctgttctcacaatgcttatgttagcaacttccccacttctaatttgctgcttctaatttacagtatgctagaaaatcatatgcccaagcttgttaaaagtatgcgtgaactgaaagtaaaggaacactctaagtggggctggcctgggagggcctcgcctgtgagaaaagcaaatgaatttcggttttgtgacacttatttttgactgctgggagggtgtttggtttgttttggggttcctctccactggcttactgcctgggtttcaacagcactcggggtatgagggtggcctttggataagtcaggtattatgagtttgcaaagcctttcctatcatctgtaagagttcaactcttgagccttcttttaaagcatccccagggttatccaatattctggaataatttcaacagtgagtcttcttaagtagctggagccaaagctggcttttaaatattttctctgtagatgtttacttacaagaaaacatcattctctaggatagcttttttttttttttttttgctggggtagagttggagttgtatgatcttcagatcttaggcacaaaaccaccgatgaattccgatacacatcgtaactttgaccccaccgcaacccttagaaatcaggtattgtgtcttatactttcttgggagctccttggtacctagaaaaagctcttatacaaagtaggtgctagataaatgtgttgatgaattaatgaaaatgtagaaaagttttccatgacattgtaaacatagaaaatgtggattctgaaagaaatcctacagtgatttagatggaccttttcaatagctaagatggataattcagcattgctctcaactgctcctgtggacttctgtgcaaatgacctctgataagtatctgaaaagggagatgctgtaaaagcgctagaatctattatcctaacagtctcattacatttggctctgacctcttagttcaaattataatatactccaaacaaatacactatgatagataattttttgttgttgtttttgagacagagtctcgctctgtcgcccaggctggagtgaagtggtacagtctcggctcgctgcaatctctgcctcccgggtttaagtgactctcctgcctcagcctcccaagtagctgggattacaggcacatgccaccatgcccagcttatttttatatttttagtagagacggggtttcaccatgttgtccaggatggtctccatctcctgacctcatgatctgcctgcctcggcctcccaaagtgctgggattacaggcatgagccactgcgcctggcctatgaagtaacatttaaaacaaaatgtctaccaatagcggggctggttcaaatcgattatggcacaaatagcattcaagatgaggatgtcactctgcgtttgtcaacataaaaagatgttggtgatacattgttaagtggaaaaatagattttttaaagtccccttctctaatttttttctccctccctccctgctctcccttctctccatttggggagatattcgccaaaacacagtagttatctagggactccttgaaaatctctgggtagccgaggtttaaatttatttcttttaaataatctgtgaatgcaacaaatgcaggggaaatacgagaagtttggagtatgatatttctcactcatgttcagcaagagagatgagtaagtgatagtgctacttgcataggccctgggtatatccaatgttcattcttagggggaaaaaaggttcaacataaaatccaagacaaaaaaaaacacacgattttttaaagtgagagagcccttttaaatcatgagtaggaaatattttaataatataaacattcacagcaagagttcatacagcttgtaatttgaaaagtccgtaggcatttgctaaatatcaggtggaacaattttcaacaagggaaattatatgcagttgaagagtgtgttgtttggattataattaactggtaactgtcaggagtgaaaatggtacatctgtgttaaaagaggtaggacagtaatgtaaaaacaagcatttttattcctgtttattgggtaaaatataccaaagtaagttcaactttcctgctgaggttcagtggagacatacatagattagtagttttttaaaatattgttcagccataaaatggaatgaagcactgatccatacagcaacatggatgaaccttgaaaacattacattcagtgaaggaagccagtcataaaataccatatactgtatgactgtataggaaatgccaagaataggcaaaatccatagaaacagaaagtagattcatggttgccaggggttgagggaagggggaaatggggagttactgctaatgagccccaggtttctttttgtgatgatagaaatgttctggagttagacagtggtgatggttgcacaatcttgtgaatatactaaaagccactcaattgtacactttaaagtggtgaatcttatggtatgtgaattatatcttaatttttaaaaggacacatattatatatggtatgatatcggccctcaaaaaatgtacagcctttatacattatgtaaaatatagattaaaaggctaaacacggtgtaatggtacagaacaatagtgtaagtgttgccccacgatgataaagttgatgatgacgactatgatgaagatgaaactaacctttattgccagccatggttctaagcatttaacatgtttaaatgtttattggtcacctcccgcatgccgggtatattctgggtttatgttttacatcagtgattaaaacacacaaagactcctactcacagtctcacagaaagcaactatgaacaatggatataataaataaggacagcagaagagaaagcctatggaaaaggaaaaagtagagcagctaagaaggattagacgtgctgagttgcacgtttcaatagggtggtcagttttaaacaatttcttgaagaaggtgaggtgttcgcctgagcatctctgggatcagcacaaaggcaccagcatggaagtggcccagtgtgttagctagctggcaggaacccagcactgctggtgtggtgcaaggtggagggcataagaggagctgaaggccaaaaggtgacatcttctcatgcttccatgatcttagcaattaaatgtagaattccttgcctaaaataattctattgttcattgtgtgccaggggcttcaggctttggagatgtgaaggatttggatagacatagaggctatttcctcacagggctgagtcattggaagaaagagaaacgggaatgggcagagcatgcttggtgtgcagaaaaagaccagctaggcagcagcagaggttttaggtagaaaaagggcaatggcagatgggctgttgggaacagagagaccctgaatgttggacagggaaatccacttgtgtcccctctgcagtggcaaagcactgagcatttgtatccactgtccttgcttgctagggtttctacaagaaagttcgtctggaagctcagacttgtgtcaagaatgagaaggtagaaacacaaagcaatcagatgacttggctgtcttcacatcacattgagagtcagagcagacgcaagacccctgggctctggccctggctcagacactcttcacccacttgctcacagatgaatgaggcataccttggggccccagatcaaatgataacattataagaacaactggaaatagataagtctttaaaaatacagaacataatgtttttcctgtgaaatatagggttgcattcaaaaactgttaccagagaatattctccagagaaacctacagctattcaaaactgctctacaatataagctcttgtttagtaagaaataaaagctatttaatgaaaggtctataaaaacggatttaataacttaatacataattatatgctataaagttcatgtgttgaaagggtacacttgagtgggttttagtatatttttaatgtatttacaaagtttgccaccatcaccatagtctagttctagaacattttcatcacctgaaaagaaatcccatacccagtaacagtgaattcccattctcctccccttagcacaagacaactaccaatctatttcctgtgtctatggatttgcttatttggtacatttcatagaaatagagtcatacaacatatggttggaaaatgtgtctctgagaacctctacaaaaaggtttgtcggtgttagcactcttggcatttggggccagataattatttgctgagggatgtttagcagcatccctggcctctaccttctaggtgttagcagcaacaaccctcgctcttaagttgtgactaaccaaaagtgtctccggacatcgcatatgtttgatgggggagtgagggggcaaattcgcccctagttgaaacccacagatttacagttacctaagaactgagctgggtgtaggggtgtataaagtgaggtgggtgcctggacccagggtgctgttgtggaaagacaactatttcagggtctgtgaaggtccaaagtttgtaccccaagttccaaaactctgtgattcattttagcaaataggaaagagatgactaggggcaagaggcacaactgttatttagatgaagttattgttcaaacaatagctggtggggaaaaacactcattttttcggtcactaaaaaagatagagggtgatgggtgcaccaaaatctcacaaatcaccactaaagaacttattcatgtaaccaaatatcacctgttccccaaaaacctatggaaataaaaagacattttaaaagatagaaattgttattttaaaataaaattcaatagtatatgccagtggtctttaccttccttataaaggactggaatcatggtgtcaataattcaaaaagtgtctaaatttggatttgggctgttttatgttacaacagtaagaattaatggttctcaaagagccttacttaagtcagctttaacattactctgcagactataaacaccccttgagcagcaaaaggaagcatgaaatttgatttataccgtagctaacgaaaacaagtgggcaatcacaatttgatcataccctactaatctaatttagtctcaggaatggactaaaaagaggaagcttgtggactttagaaatatgtacatttcagaaaatataagtgtgacctcttttcttttcagaattgtgtaagtgaaggaagctgtcatcctccctggtaaatccatttgtaaataaacgggctaaagaaatcatgactgtggtcctttctagttcttaggatctgtcctgctcagagtgggaatcacaaagtgattgaggtaataactggtatctttgttgttctcagtttaaaggaagtgttctctcaaactgccttagactgcgcagccttgaccctctaggacttgatgccctgtgtatggcattgttatcagatgcaagttagtaaacccagattgtgtttacaagtaggttgtcattatacagtggcttctctgtaagtacaaaatgtatatttcctttttatttatcatggactatagcaattacagaatgtagctcttgtttttatcagggatattactgaggcccttaaactcaagctgacttacatttattttaaaatacatgttccaaagatgtttttaaaattttaaatatgcatatttttaagattttcccctttaacctgttctcccatcctgacatttaggatggggaatagacagaacatctgagggagtttgggtctcacagatcggctgtaaaattgagtaagagcaaaatgtttggaaaaaaaaaaaaaaaacaatctgtgtggttgttcatctggaaagatctgttccccactcagtagcttacagaaggctcaacatgatatggatcagctcgaattcattatctgaccaaacagcaactcaggaatcttatgtcctgtccaaggtgtgctgtgggactcaataatctctttccagatctattatatctacataaaaatatgcatgagaatcagataaactagtgggcctcaaccaggaatgattgtgcccttcagggtacattttataatatttggaagcatttttggttgtcacaattggaggatacggatgttcctggcatctagtgggtagaggccagagatgctgttaaatattctacaatgcacaggaaagccccccaaataaagaattatccaaccccaaatgtcagtagcattgaagttgggaaatcttgttcaaggaaattcccagtgcctcaggttgtcttatgagatgtggagcatgtcaatatccacagttgccagttgtgccatatggaatgctgcaaggagaaaatatagatacacatgaaaatgtgtttttgggatttggggaaatacatctatggatttgatactttggtgttccaaagatgtggctatttttgcccacaagtgttgcccaaaaccctggggctatgtggtgcctttttcacagagcaagtacataaagtacagactgttaaacagatcactcacctgctataaaatgtcagttaataatgaggtcctatcatggatattagttgaatgataagtgccacttctttcctcttacatgtttattagtgtcatctaaagcaatggctctcaaaatgtggtggctggaccagcagcattggtatcacctgggaacttgttagaaatgcacattgtcagccccctcccacacctactgaatctgaaacttttggggtagggcccagcaatctgtgttattttaacaagcttccccatgattctgatgaactttaatgcttaaatcggagaactgttggggaccaccagcacctgggagcttgctagaaatcacatgactaggccaggaccttgttgaaaggcagattctcatttagtaggcctgagaaagggatcaagatttgggactacagatatgatagcttgggtaaaaactacaaaatttctcctttttgagccttctatttccctcttcaaaaattgggaagacattgtattggttccctgttgctgctataataaataatcacaaacttagtcgcttaaaacaacacaaatttattatcttacacttccagaggtcagaagtctgaaatgggtctcactgggctaaaatcatggtacctggtgactgtaggggagaatcatttttcttgacttttccattttctagaggctgcccacattccttggctcatgtttccttcctccatcttcaaagccagaaatggcctggtgagtctttctcatatcacatcactctgacactgacccttctgcctccctgttccacatttaagttgctcctgtgatgatattagtcccatatacataattcaggacaatctccttattttaacagcatatgattagcaacattaatcccatctgcaactttaactcctctttgccaggtagcataacatattcacatattcttgagatttggatgtggacatattttggggggcattattctgcttcctacacaaataattttacctttattctccagcaaaatttgtgtcatagagaaaaatcttggaaggaatccagtcaggaccaatctcctaccaattcagaaatcttcctgcaaaatcctccaaacttggccatgtgatactagcttctcagctagactgtaagctgtatcctacagaagaccctatcttatagttattctccatctcctcagtgcctagaagagaatttagctcataatagatacttagaaaacattctttgattggtacactgctttcaggcacatagagcacgatatgactatatagactgtggaatcttgactttgtgaaactgagggattgatgctgaatctctgtcaagccttattaccctcctgtgtaaaatggggataatattacattctgtataggattgttgttggaatcaaatgaaatgttgtaaatagagcacatggagatatagatataatttacatgaaacgtctgaaaccataacatggtagaatactaccttgtgataatttgctaacaaaactgcacaagataaggacaggtggtattgagtctctttacataatgcttactgaagtgtcgcctctggcttcatttataacatcaatttagaagcagtgtttctcaacatagactatatttttgaaccattcgtgtagcttttaaataatatttttgcctgggttccattctacctagtttctgatttacttggtctaagcattggctccaactcttgctatgtttttgaatcccctggggaagcttttataaatatcgatggccaggtgccacctccagaaattctgtttcgatcaaatataatgtgtagccatggttgagatccattgaacacaacttattctaccttataaattgttacatctgccagacctttactgtatatgagaagttgtagttttatcaactttgcctgaatcagtggatgtttttctaatttccattcaatgtcattggtggaattaagaacactcaacataatgacatttgcaattataaaggtggtatcacatccccagagttttagcaggatggcagaaccacagtgagcactcagaaaacgtttgctaatgatgggccaaaaaaaagtgtcttttatggtctcttgatttattcaggaatattgcattgcagttgagtctctcacagagtccacttgaggctgctaacatgttgatttaatgaatgggtgcatttcatgaaccacccatccgagtgaattactttgggtgtagctgttttgatttttccttcctctgagtatatggttttgttaatttaaacaaattcagttgttttaccattttgtagacacattctttgtgtggccaagaatcttgtttgtggtggccacaccacaactggatttgaatgtagagcaacccagcaaagaagtgctaatttgaagcaattgttaacattgccagcaacaaaccaaagtgacctccatcaatgggttcagttagcaaccctgaaggcaagacactctgtttattccattatcgtttccttcatctatcagaaaccctaatcttcatggatgatgaaataataacaatctcaaacttaagatatattttgttcatcttaattttctaaatgtccttttttcccctcagtacaaacataatacatgtaaataaattccaacactataaaaattcattaggcagtgtcaaagtcccacaaatcccatcctccagtgatggccactaataaccatttgagaatatataaccccagatctccctgttaaattataataaacatttatgtccataacttgtgttctgcaacttctttgtttaactttacatatagtggatatctttccaaatttattcagagagaactactccactttttttcatgactgcccagaattccactgaatagataccccgtagtttagttagccagttgctcactgatggacacttaggttttttatgtttctttaaacatatatgcatataactaatatataataaaattaattatatataagtattaatatatatattttggtagattataatacacatgtagagaagtgcacataagtttacaacttaatgaatttctgcaaagtgaacacacctgtgccagatggagaaccatccctgaccagcacctcacagggatcccttggactcccttccagtcacttctccccaaaggtaacccctattctgtatttttgtagcatatattggttttatctggttttatagattacattactggtatcctacagcatgttattttttatgtcagacttctttcgctcaacgtgatgtctctgggattcatctgtattgttgtaggtggttggagtttgttttttcattcccattactgcatagttttccattatgtgatataccacaatttattcagtctactttcacgaacatttggataatttacagttcggggctgttttgaataatgctgctatgaacattctagcacacatattttggtgaacatatgctcacatttccgttgtttttattggtgactgggtttttttgctatcagatattgtactgaagtgaatgtctttgcaaatgtatcttgcacattttgcaagtattgctataaagtagatattagaattgctgggtcaaatggtattcacagaactgctccgaaaaaaattttgattttttttttttttttttttgagacaaggtcttgctctgtcgcccaggctggagtgcagtggtacaatcatgtcttgactgcagcctcgaaatcctggactcaagcagtcctcccatctcagcctcccaaagtgctgggattccagatgtgagccaccatgcctggcctaaatattttgacttttaagctaggtctggacctcaagtaacctattgtggatacacccctttgctattaccattatctgtgacacagacgctgctattgtgtcttcctgactacaaggcaagactaacaaaaaccagaatcttctggctcttttcagtcacgctctagtgagctagtgcctctttcatgtatccactgagggacaaaaagataaaatgacctagtgtcccaggatgccagcttaaacttttgagtacattgatgctatgataatatacaccaaatggactctgtggctctaagtaccatccactccagattgagataacctcctttcccaagtagagaaagaagattctaacctggaggtgagagccatttgcatgtcttaccaaaaaatgtcccattcagaatgagctgacattgggagacattaggttagagcagtgtttcccaaccttggaactgttgacatttagggtgggatcattctttgctgtgggggccgttctgtgcactgtaggatgttgagaagcatccctggactccacccatcacaactggcactttcctcctcagttgtgacaaccaaaaatgtctccaggcaatggcaaatgtcccttgaggggcagaatcaccccagtagaggactactaagctagtgcttatagaagaccccagctctaaatcagattatgttcagattctggctcagccactttttatgtgacctaggacaaagtacctaagttctctgcctcatttggctcatctgttaaatatagatattaatagtaatatttacctcaattggttgttgttgagattaaatgagattattaatgtgatgcacttggcatagtctttggcaaaaaaataagtgtcgaaagttgttaggtttattagtcataatctttattattattaaaaaaaaatggaggggtggaagaaggggtcccattgtgtatcctggaaaaaggatgaggataatgcatatctgaaaaaacatcaaaggacaaggggctcataactcttggaacacaggcaatgggaaatggaaatgtggagaaaacattaagtgctatgatggaagacaatggcatttggttgtctctctctgttccttctcaagttaacatttggaaactagaatttgtggaaaatagactttggcagcagaattaggcatttttaggaacaggataaatcactgtggggaaatattttattgtattactcttgttaatatgaagttattaaactttcaatagtgtgttgaatgcttttatcttaaataataaaatatattcagtgctaaagcagctgtattgtttttgatattattaagtagaaaaatttatctgttaggagctttgttgggttgattttcacctgataccctcttctcccaccaaagatctaactttcataaattctggcaatagaaaaacaagtcatcatgttaagctaggtctgaaccttaagaaacacactgtggctgcatccctttgttattgccattatctgtgatgcagatacagcaagacagagtggcatcctggacgggactccagatggagagtatgagtccagggttatgtctttgtgttgccaagctgcaccttggcttgtcacttcttcccattgtgcctcaggttctgagcagatggaattagtttagcatgtcccaactatattctggggaattcgagtgatatggagagatggtctgaaaattaaaaaaaaataaaaaatagaaggaggtgagattatagcaagtgtatttaggaggtactccgagttatgatttcccctctgcaggacttctctattattcttattgtttattgtgactacttaagttgaagctaccatgcacaactttttcaaatatatttgattatggaacagcttggaaaatcctgcattaaataatgtatgtgtcccttgcaggcataaaaatattctgatttcttttgaattaatctgtcatcatggctgtgacaaattaccataaatttagtgccatgaaacaatacacatttattatcttaaagtgctgtaggttagaaatctgacacaggttgcactggacaaaaatcaaggtgttgacagagctgcatttcttctggaggctctaaaaccacccacactccttagctcatggcccccttcctccagcttcaaggccagcaatattacatctcttagatcattattctatagtcacatcttcctcaaactctgaattctgctgaaaggggttgtcctattttaagggcctgtgtggttacgttgggcccacctggataatctagacttctgtccccctctcaaggttattaacttaatcatatgggcaaagtcccttttgccatgtaaggtaacacattcccaggttccagaaatcagggtgtggaaaccttaggggtgagagatattattctgcactacctatcctagtggcttcttccatttctcaaccctggagggtgtggggtcgtgttctgtagagccaggaagaagttcagcatttgttcatctgcttttgaccctagcaactcatgaaatgtgcaatgactatcttgtaaggggtattaaattcttctggcttttcctcacccagtaagcaataaaatcaaagaggacaagagtaattaaagcaagcctattgatctattttgtgtagcattctttttagcttctcttctgatataggcaagaatatctccctgaaaggaactaaactctgaactgtactttaacaagtaaaattgccatgctggatatcaacaattagtctttagagttaaaatataaacataaatgattaaattagttaatctactctttgtggtatagccattacagggctaatttttttttaaaaaaaaaaagaatactagaaacctctaaatttttcaagacactcatattcatcagactgtaaaaagcaaaagaaactgaaggattgtgttccttatcacagcttggaaaaagctctgatggctgatctatatgaagtggaaacattgcatgagttttcttgtaattgttgatatctcatgtgaatggaatgaggcggaaaacaagttttgcactaaaataagtgtttgaatcttgctatttggagtcatgttgtctacgttttttttttttgtttttggctacatagttaccatatgatccagcaattccacttctagttatatacccaaaatcattgaaaacctacgttcacacaaagtgtgtatgaatattcacagcagctttattcataccagtcaaaatgtggaaagaacccaaatgcccatcaactgaagaatggacaagcaaaatttagtatatctatacagtgaatattatcctgccataagaatgaatgaagtaatgacacatgctacaacgtggatgaactccaaaaacatgctaagtgaaagaaaccagacacaaaaagcccacatattatatgattctacttttatattaaatgtcaaaaacatgcaaaaccatagagacagaaagtagattagtggttcccaggggctggggtgagaggggaatggggagtgactgggtatgggctttccttttggtgtgatgaaaatgttttggaatcagtgatgatggttgtacactatctatgagtatactaaaaagaaacacagaactatacactttaaagtggtaacttttatggcatatgatttttatgtccaagctcttctattattttactataatttatttttgaaaatgtaaatttcaatatgcttcattgctcagagaaagcatgattttctatacatcagagcaaaagtatttacacaggtctgtgaaatactgtgtaatttatcattttaaaagtcgtatattgaggagaaaacatttttgaaaaataaatctgaaaagtggcagctagaaaatcagatgtgaaccagtaagtgcagatggcttgttttcacgtcatacctgcatttggtgtcatacttcatgttggtttctcccttttcaattttcccttttacatgtttgtctcttaatactaaaagtcaggaagcaagattttcttttttttgcatttttactggaagtgattttagctactttaaaataaatgtcctaaatataaatattccctgctggtcttgtttccatgctaatagacagaaatgattttctgtatagacagaattgctactctccttcaaattttctttcaaccagcaaatatacaaaagcacaaaatgttagtgctgtttctattcttccagaacctacagtctagccagggagaaaaggcacaaatatagataatcaaatagctttccaatgtttaaataagagtcaagaaaatagctgagatggggcagggtcggggggagatgagtgtgatggttacataggagggacgtatcggtgacgttagagttttctggaaaaatagctgacatttaaacattcccacccctcctctttcctccctcaatgagacatcacaagtgattgtctagacatctcaagtgtctaggtcatttggaaccttgaaagaagcagattcgccttctttaacaaacataaggtgaatttcctttggtcatgttttggtgttccttataggtccatagtaaacttgtttgtgttttagatggtatgattttcttgttaatgtgatgattcatttgtaatgtccctgtagggggacgacagggcttctcagaggaggtgatgctcagtaagcattacagggtgagtaggaaggcatggggaagccatttgggctgagagcacccctcaccctaaccatgaagtcctctgggctcttccatgtggctgaaattaagggatgtgaagtaagtgaggcttggtgaagcccaagagctaagcagtggccagatcttgagcgatcttgtgttttcacctcagagttgagaacttcatctggaaagctaggagcctcaatgatggctttcaaaagggaagggacaagatgagttttgctttgtagggagagacagcctacaagagtgtggaagtgctggtggacattcccagagaggaagtgttaaaggaaaggacagtttttaatgaggtgggatccacagaaactggtgactttctgagtgtgagtaggagagacataggaagcaatgttaaaaatgattttgcttcagttttcctgggtcactgcagggaacccatactgatgtatttgaaccacagaatcattgcccctaattttattgtgtgtattttcaaataattggtttacttaaagcaagatgcatttgcatacgtaccctttacccactgtgtattatcacatacctattataaatatttgtctatataagatagaaatatgtcacatatataattcatcatataataaatatataatagtcaagagatacatatagatacacatagatgtagagatagttaaatctatttaatatggagacaaatctataatgtttgtagtttttaattacaagtttctcaggccggccatagtggatttgataggcatcactctagtatgaatgtcttttctttcgagaatacttggaagaaatgctgattcctaataagtagctcataccaaatactaaagtccatgctactgatttcactttttctccctgagctttttctcattatgtgcgtaaaagaaaattagacattgagtgatctctgtggacccatctgctcatacatacagagatgtcacaaacatagttttaaaaacatgtggttcctggacacaggaaggggagcaacacacactgggtcctgtccggtggtggggttgggggagggagagcatcaggataaatagctaatacatgctgggcttaatacctaggtgatgggttgataggtacagcaaaccaccatgtcacatgtttacctatgtaacaaacctgcacatcctgcacatgtaccctggaacttaaaattaattaaaaaaagaaacagaaaaaaaatgtggttcctttgctgtttgaaatagtgaaatgctccaccatgaaatgtgaacattgtcatcccctatgtcatatatctggtgatttcttttcagtgggtccagatctggggtcggcaaactttttctgtaaagaatcagatagaaaacattttaggtgttgcggatcatactgtctgtgttgcaactactcaactttgctgttgtatcggaaaagcagccacagacaataggtaaatgagtgggtgtggttgttttccaataaaatttgattacaaaaataggccttaggctgtcctttgctgaccctgctttaagtcaacagttgccacctcaaggtcaaggcatgcctcagtcaatgtgttagaagtaatttattacctataataattaagttacaaactttagaatatttgtaagaaaactaaatgagagagaattagagatgagcctagaaccacctcatacagttattttgatgaattttcttgagtaggagagcaaggtgcagaaaagtagcataggatagtggttaagaccacaaactcaggactaaggtccctgagtttgaatttcagccatgccacttgcaatatgtgtcctgggacaagttacttgactgccctgtgctttgatttcttcatctataaaatgggcatattaataaacctcacattttaagattgtttaatgattaaaaccatgagtacaccataagggactggaataataatgggtacacactatatgtacaagagatgatagtcattccccacatatctaaatcttttggatttagatccaggacatagctctcagcttattttatctgtgctgtgagtcactgatgaataatccttactgtgcaccactaattagtagttgtggtgactacaaatttttatgttgctaatgggttgtaattttgtagtttctgaggttaaaaaaaaaatctacccatagatggatacttaacaagaaagaagcagcaaaactctgtgtagaaaatgtgaacgtgcacaaatcagtaatgcccatgagtgaaaatgacatgggaacatgttgttagggtacaacagttaaaattaccaaaaggtcaacaaagcgattatgtacttgaacattggacatcatgttctttatgttcatatcactgaattctggaattctgagtctactggttttttttttttacaaatgaaataaaatgtagctatgtttacagcatacccttccttgtccatcctattaatattaactggtggcatggaagtcaagaaaaatgactcattaaaataaaaatttttaataatttttaaaaatcagattaccatataattgatttttttgtaactgttttcaaaatggtcttcatattgccacgttaatttatcaaatacttggaacatgcttttagggatttcatgactttctccttcaaaagttggccccgctatttgctttatttaccaaaaaaaaagggtgaggtttggggaggggtgtagggaaaaagcaatcaaaacctgggtctatcagcgcatgtgacacgttcatttatcataagtgttacatgcatagctctctcctccctacaggactattttatctccactttacagagcaggtaattgaggcttaaaagcgttggatactcacatggctagttatatgctgaacttgaattcaaacacaggcagccagaaggagagtcctccctgtaaccactgtgctataacactgcatcccatttgaatgaaacagtggcaaaatgaacagataagatgaaagctgcttaactgtgctactgttcaaaatattccccatcacatctatggcagagctcatggaaagtgacatctggatcaagcctgtgcacgtgaaaaacaattttaaattatggatgtatgtgcttggagacttaatctcttaattggtagcattgttaagttttctttctgctgtcaatggaagagaaaggaaaaaaagaatctgagctttgagatgagggcacgttatgctctcggtgtgggagaaatctggcagaatcagtcaatgaaggaatatatggagagtgcagtcatcacatgagtatgtggaagggtgcaagaaatgaggagtggaggcaggagggagggaagcaaaggtacatgacaaattcttagtggaatttggagaaaagttatggatcctggaaaaagttcaaggaatttgtcttccctgatagtttcattaagctctggccattacaatggttctcaacctggactgcaccttagaattttggggaaagctttataaatatatcattgtctgagccccaaccccagacagtctaattgacttggtctatacctgtgctgtccaatacagtagccactatccacctgtggtaatttaaatttgaatcaattaacattaaatacaattaccaattcaatattcagtttctctggccatatctcaagtgctcattagccacgggtggctagtagccaccttagcaattagtactgttaacaaaaatgtccattgttatagaaaagtctattggaccatgctgttcttggggagagggacatggtcataaaaatttttgaaaactacagcaagtaattataatgtgcaatgaacttagagaactgttggtccttggagaatacatttgttctaaaatgtatcaccacttgtatctgaggtcattttgctttggaagatgattctgaaaatatcattaatgctagactttttctgcagcctagaaatgtagccgcatatatttttatttaaagcagcttgcttgctcatttactctacaagatttagatgagttaactaccagactgcaactaaaaatgaataacttgcttttccccacttagaatgaagtggtacaacaattcatgtagattttgaattacttattaaaagagtttaataggataaattatcttacagtaaaaccgagaggctcattgtccacagctcacattttaggcaacagattagaagcaacgtctatatatttgatgatatccaaaattaatttattaacttaatatgtttatgaagtcgcatgtaattttgaggaaattgttttcctttctcattagagaagaaccccactgagaagagacttttgcaaagtgccaaagtgcaattgatgaaacacaatgtcaccaaatatagcattgaaatgagaaagtggaaaggaattcactttggcattttttattttgcctagtttgtttggcctaagagttttcaagctcctaaatacgatattcttctatccttaaggcttgttttatatcctgctgatttgtaaatatctgacttgggattgggttcttcagtttgaggtgacagtacttcagcatccctgtatcttttaggtaatcttgctctgaaatccattccatgtttaatgagcagtgaatatacccataacagaataaatgacctgccctacaaagagttcacatgacatcttacctagaatgagtgccctcttatctgagtttccttcttatttcaagaaacctgaagcatccaaccttataactcagcgttcctcactacatgagtagaaggagcagctacaaaataagtaccattctctgcagtgtggtagaaccagcgatatacagatttctccataagaatcaagataaaatgcttttctctaggtcaaccctcctgggcacctaaaatgagatgcaaatttcacactctgtactcaaaggtatttctccagctataatcttgggcttaattttctggggatccatatttattggaaaaagagagggactctcataaagaaagaattcctagagtcagcttgttttattgctgcctagactcgcttcttatcagttcattccacaggtagagcctccgtttaccggttacattgtagactcagtttgcttcctctctttatccccttcctatcagttctgcaccactcggcctcattcatctttcctaaaacatctctttcatggtgttacacccctacctaaaactgagagtggctagttctacttgtaaaggatctggcatccaggaggttttctaacatggctgttccttttttctttaaatgaaatacctgtccctctccttattcctggaggtcattgccccatctattggctttcttttctctgtttcatcctggtgccctgcctctgtttctgcatatttctgtgtctcaattccacagggctttgagccctgagctgtcatctatgtatttaccaaaattctcccagttgcagagaggccttccagtctctgttggatgctctgtgtcatacttactttgtttataggtcttccaaggaagtgaataaagaaaaggttgctggcatgctgtgatattgcctaggggttaaaattattgcatttgaaaacagactgcctgggtttgagtgccaactctttacttgccagttgtgtgacttctggcaagctctttacgctttacgctctctttgtttcaactttcttatctgcaaaatagagataattctagtgcctgcctcctagaggatagcgtattcatggagacaataagtactcagtaaattttagttgttctttattgtggttttgactgtttcagattcatggtcttaaatagctttccagttactagatttgctttgatggtagagtttagatctgaaggatccaaaacattctctccgtgcaaataggtcacagtagcatcagaaggacgctagcaattagaccaaggtcagggtgctaggaatggggaaaggacggacagctacagttaaggaagcaaatggcagcaatgagagaatatacattggcttatcacctagcccctggaagttctgagcaatacaaagatagagtctgatggttaaactgatggtaccacattttcactgagcactgtaaggcagcagatgaactaaaatgtctctcacaatttgcatttttatatatagtcttaaaaaatattaagaccttacatgcgaactctatgctacactcaaaaaaggttaccaggaccaatggaaggtttatcagtaatgaatataatctaaatgaaatttcactgtgccattttatgagtcagtcatgattttgaaagataaaagcattacctatttctaaccattggctatatattattcaaaatctgaaggatgtcattagaaatatatttgtcttcttttatattaaagactttctacatgctcagcaaaacaatatataaagagcaatttttactttaccatccagttgatcaactactctgtttccaagtgagaatgtaggaagggacgaaatgagtcatgatgtcgttcagtggggagaagtataggaggagtttcaagcgcaagggctccagatcaggctgcttagatttattatctgtgttcatatgggaagttcaggaaagtgaggtcagctgctatatcagatacatccccaaatttcacaacataagtctatttgtcattcatactgttagattggccacaattggtgggacagctgtgctccaagcaatgattctgaacctgggctgcttcttcctttcattcagctggaggtagggtgggctggatttaggttgagacattggggcaactaaacctttcacgctggctatattgcctctccacgtggtctcttcaacatagtggctacacctatgtcatgggggctcaagggtcctatgaatgcaaaagcagaagtttccatgccttcttatgtctcaggtccagaatgggcttggcatccccttctgccacattcagttggttaaagtaactcatagagccaggcgggcttgaagggcaggggactacactaggcaaagaacactgaaaaatgtggtccactcctgggactaccacacatggctatgcaggttgcctggatgctgtctccaggtttttatggactggggctagaaatgaagcttgtcacttcctctgacattccattagctagactccagtcatatgaccactattaactgcaagagaggctgggaaatgtagactagctgaatgcccacgaaaaaggggctacgggcttcatgagcagtcagtgttttcctcactgtgcgccatccatttctgtgcctccatcacttcctctataaaatgaaattgttggaggcagtgaatacatggcacacatgaagtgcttagcacctaatacatgctcagtaaacttctactgttatcattcactattatgtagtggctatttgattttattccatctaagtaaaagcacaccgcactggataccaggctaaggaatttggactttgtcctggagctaaggaggagacatcaaagggttttaggcaaaagagtactgtaatcagaaatgtattcactcaaaaagtttgacagtgattctatgatatttttgccttaaatgtgcaaaatatcaccagtgatataaacagaaataatccagaataagagccaagaagaaggtggaatgaatgcttaatggcatagattcttaggctataaattgtttcttggtatgcttagatatggagggttaaatgggaaaaaaatgaccattgtgctctcagcactttttgtgattagcgaaactcttccacagatggaaccttttagttgcttcctgatatttatttccaaggctctttcagtgactctttggtctcttattggttttacttaaagagttgttatttaaatcttaaaaaggattccttatctttatgttttgtttttctggtttgaatgcattttccaaagaataccaaatatacacaccttctccattatttctgcacttcctcttaaggcctgccttgcttccactcttaaaacagactaggaatttcacaagatgttgtctctcgggattatttgagattattcacttagtcaccttcttacgaaacatttattgacctgacagtgtatgtctccatcaaataattgatttaacagaccactctagtgttaggtaaacattcttatttcatcactgtctcttccttattagatacttataacatggctcctactagtactgactctgaactgtggttttgtcttccagttaatttgtaagctcatagtggttgggatgacagccgcattacttatgagctgtgaatctttgagcaagtcacttaactcctctgcgcttctgtttcctcatctgtaatatgaggataataatgtaacctactgctaagaattattttgatggttagataagtcagtgcccataaaatgcctaaaacaatgcctgacacttagtaagtgctcagtcagaactacatgttgctgtcatctatttataaactaaaggatcatttgcctaataataaaaaatgaattacatatttatcaatttcatgtgaaataatatattaagatattagatatattgatattaagatattagatatctttaaatgaggatgtaacttccattgatgagtatccagtatgagccatgttgactgtctactggaataatgcgtattttcaacatcagtttttaggatagtggtggtggaggtatgtgcagtaacaggtagattttactctgaatctctgtttaagtttaatcattctagtaaagaaaaccacctggaatattttactgctttaaaattccttccttagcagcagcagcagcagaggctatgtgtggcttacatgattagtttcacagaatcctagtaaaagcataccgagtccttaattttgaatcagtaagatcttccatgaaatcatttcccggtttgtaaattataatcacagtgattcttttgttggaattcacttgagacccatgagagaactataacttcctattgactgggaaacaaagatgtcttttcgagttgtatttggttcagtgccatgtggaatgcatggagatcaaggtaattcgcgattggaattaatcttcccttttctctctgctcttcatggatgccacccccaacccccaccccaacctgaaccctcttagatatggccatgtgggtatattcactctgacctccacaccctctgttcaggaaatgaacaacttctcaaggactgctgtcccacaaagaggataaaatacagagcatgtgttatgcttcagtgtgaaagagaatgaaaacttttgctttttagtgtgtgtggctagtgttagaaaaatggagtcagtagttttaaaatataatttaagaactgagaatttgtcctaaacaaagaaggcatcctatgtgctttatcttgctctcaggggtttcaccagtggcttccaacattctttggttgattcctaataaggacagtttgcacagttacaatccaattaccgtttgtagatccctgtggaaaagaggattttttttagaggaatccttttctaactcgagtatatttcttcaaaatactctcattctttttgtcccttccctcccctctttcctcctccccaactctctctctctctcaccctctctctctctctctctctctcacacacacacacacacacacacacacacacacacacacaggcacacacgcatacaaacacacgcactcactcatttgtgcacttactcagggacacagcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatgggtaagcaatataaatatctatacttacactactttttcagaaaataattgtgataaagttttgtgattctttcacatccatcttgtgatttaggaagaaaactggaatgatcagtgtctgagatgtgtgacagctaaaaactgtctgtgtcaatatggatttatgagaaccttatttttagattaatgatgtggcagcttgaaatgagcaaactcaagcaggaaaggattgtgtcatgattaacagaacagcataattgagctaatttctgtaaaagattcgggcacaggctgttttgaagtctgaaagggtaaagtggtttatctttccctcttaacttcttgaatatgggtgcaacattttagttgctgtggctgtgataaatatgggtttaggggaacagtttggatattaaataaggctaataatacatcggatgtgcttgtgctgtcttttacaaaagaggaaactttaagcctctgaatttttaaacactgtctggctttcattattataagggtatgtctcataatgaaagggcttggtggtggaaagaggggaacatgaccctgatgtcccagatcccattatgccactgcagctgctttgctcatttgtaaagttagaggtttggattggtttatcatgaaatgttatgaaatacatatagtggttatgagtctaaattctagaacctaaagcctggcttcaaatcctaactctgccacttaattggtgtgtgctcttggcaagttacttaagttctgtgcctcagtttcttcatctgaaatatgggaataatgatggtaacatagtccttaggttgttgtaagaattaaatgagataatataaataaaaggcttagaacagtaactagcagagagcggaccatctataaatgtgagcagtatcttcaaggtctaatctatctccggaggtcgttctaatttcagtgaactaaatttaattagagaaagacaagtagaaccatcagctgctggccctgtcattaagaaatttctaattcatgccagtgtttccagtttttgcaaccctgagatttgtgcaggccatcttaccttcttcctcccatccaagactcgagagaagcttagaactgagaattaaattgatggccattagaaaagtccacaattcaactgggactacacagaaatgaaattgaccttttgctctgacgtttttgcccttgaggacttccagtatgtcccctctatgctaaccactggaaaggttctttccactggaaacaagatgtaagtgacatttgattttttagatggtgttagcccagccctgggtttgacaatgttcatttctacttctttagtttatcggtaacccaggtgaacaggccatttgcagataaccacttctatttcatgctagcatttgcatattttctaatatgctaaattatgttgtttgatttttttttttacaggctctctgggatgtttctcagagacaaaatcttaggagaggaggaaaatggtgatggcaaaaggcagatcctaatcatagatgtgtctttacttttagtccagtccaggggtcagcaaactttttccataaagggccagatggttacctttacggaagggcagcttcatggactgtgcagtctctgttgcaacaactcaactctgcaattgtggcctgtaggctgccacagaaaataacaatgaatgagtgtggctgtggttttcataaatcaataaaacttgatttatgaaaacaatcagtaggcagtacttggctccccggctagtcagcttgtatcagcaaaatccctgtcatcatccccatttcatagatgaggaaaatggggcatggggaatgtaagtagcttgctaaaaagccacatggctggctagtaagtggcaaaactgggactcaaactcaggcagcccagcttgccaccccttgcttttagccaccaggctatgctatacctatgtcaaccagtctctgcctgggctgctgggctcccaaaacctgcctggctcattccctcacctccttaagggttggtgcaaaaatcatgttctctgtaaggctgtcctggtagctcatgcagcactcctattcccctcaccctgtgctacctccttctctatctcttatcaccttgtaaaacttgctgtgtaattcagcacacatttcttaagagtttttggtgtctctaatacttccaagttaagatgctgtgttaggtccttcttgtatcaccataaaaatacctgagactgcgtaatttataaagaaaggaaaagaggtttaattggttcacagttctgcaggctatacaggaagcatggtggtgtcatctgctcagcttctagtaatgcccttgggtaacttgtactcaggatggaaggcaacagggaaccagcctgtcacatggtaagagcagaagcaagagagagagggaagaagtgccatgcccttttaaaaaaccatatctcacatgaactcagagcaagaattcactattgcaaggacagcaccaagatattcatgagggatccaccctcatgacacaaacacctcccaccaggccccacctccaacattagtgattgtatttcaacatgagatttggaggggacaaacatccaaaccacatcagatggtgatgcaaatttagagtggtgatgattaatattaattataacttaaatttccatttattcaggtcttgtgggagcttataagccttccacaagaaattcatttgtattgtctgatattatccctacaaactgagagttaagtcttgttcttttctccatcttaataatgagaaaaccgatgatcagagattttctgaatcttaccaaagaactgccatctatctgaatccaagtcttcaccaccatgccagtgagactcaacttttattatgcaaaaagtaagactcatctggggatgctgctttataatggaggtgcttgggacctattccctgtgactctaattctctaaatctaccttagagccaaaggaacctacgtgtttaacaatgatcattctgcccacgtgattccgatgccttgggtccacaaaccacattttgaacagccctgcctcaccccttgtttggccctggggagtttacagttggatgagattaaagagatgctgcagttagagactagccccaaggatgtaataaaacaatgtggtgtagaacaaaaccaaaattatttcaatcaattttatttcatgggaaaatcaagtctgtaaaggtgcaacttagctcaaaagaatgactttctgaataaagcatagatattagattgtttgggttttagtttgtcttttgcttctttttttctaaacatagagacatatacttctggtgggaaggaaatctctttagttaacacttttggtgagttgttctccagttaatcaagactctattgttttcaaactttttttggtttgcttcttttaattaggtttgtagtgtttgtacttattaatactagcttaaaataagccctatgattctgtttatgtgtataatacgtagaaaaatacatgtaaaatacacatagtaatgcatgatatataaacgaatatatagtacatatttttatgataaacaaaatatataaataattgttaatatttccagcaccatcattttaaggagattatatgtaatctgggcttaacagcagacttatttatgctaaaccaaggtttctcaacttctgcactgtagacaagttgatccagatagttgttgattttgggcagtagtcctgtgcattataaggtgcttagcagcatccctagcctctatcttctagctgccagtatcaaacgctgccccagttataacaaccaaaaatgtcttcagacattgctaaatgctcactgggggcaacattaccccaccaaggaccattatcctatatcattttatcatattgctgccctttattaatgctgtcacatagtaccctagaatagaaagatgtttttacaactgccaaggtctttagtctatccagagacattggatgaatttcaatttcatctacatttataaaatctaaacaaatttgaaatcatccattttcaatccttaaaaaaattccatgatgatcactcaaaagactagattcagaaagccttcaaatgagtcattcatttataagataaacagtcaccaaagaaaaatgctggtctggaccatgcatgtgagccttgagaaaccaccagaaacatattctagactgtgctggtaggctttggtgcccttcctgggtgcttgtttatcactttatggtccatgccatgagagtcaaagggagactatgacctttgtgttcatgtcttactgctcctatgaagtctgatgggtgggtataggtatcacggattaactcttccccgcgtcacctattatcacatttattttctcccctcatgtactggcatgggtttttcttggcttatcaacaggctatttcaaaagactgtctcttaatggtttattcgaatccagaatacagtttcccacatatatacaacattgtatgggttggttaggtttccaatttatttaactcatgatggggctggttcattagtccctagattgacaaatatttattcagtggctgttaagtgccaggtactgccttagataccgagaacatcaaaatgaataagccagacaagggtcttgccctcctgaatctagctgttgtatatggctgataatgcaaggccctaggactgggttgctggaatatggctgtagatgctacacaaatatgtgtagggcactacatgaccctaatctccatatcaggggttggcaaacaacagccagtgggccaaaagcagcctgatgcccgtttttgtatgacttgcaagctaagaattatgtttacatttctaaatagttgaaaaaaatttgaaggaaggatattttgtacacataaaattatatgagccttgacttttcatgtcatagataaaatttttggaatatttgtttatgtagggtctatggctgtttttgccctacaatggcaaaagttgagtaactgtggcagagaccataagacccacagagcgtaaagtatttactatatgtaattttctataattctattttatgggaaaagtgatttcagaattccagtcttgggacctctccagcacaaatcattggtgatggtacctgtagtatgaagcagcaccttagcatcaggtagcagggagataagaatctgatggaaggtcaaaacctacttttttaagtgtctgcgagcatgcccttcaccccaccaacttccttttctaatgctcccccttactcttgaattcatttcctattgctgccataacaaattatcacaaacttacaacacaaacttacataagtctcatgtgggcctcactgggctaaaatcaaaggccatgttccttctggaggctccaggagagaatccttggcttttcctgcactagaagctgtgtgcatttcttgtcttgtggctcctttttccatctgtaaagctagcagccaagctctttcaaatctttctctctcccacctctgcttccattatcacatttttgtctcgcttctgcctctacctctctccttgtgatgacattgcactcgcctggataattcagaataatctccccatctcaataatctgaaattaatagcatctgcaaagtcccttttaccatgtaaaataacatactcacaggttcctgggattcgggtatggacatctttaggggagacattattctaccaaccacaccttccacctgattacgccttactgtacttctctctacctccacagaacaaaatgtgggcagaggggcaactcacaagcttgcaacaaccagccagaatattgtagtggctaagagtggcttctgagagtgtcaggttcaagttaatttttttgttgagtgaaaaaataaggattatgtcatcacttcatttgtttaataaaagaaagcagggtcatgcttactctcagtttcagaaagtaacgtccttactattatgactgtcatagaaatagctttctttcccttggtagatttgtatctttctttgacaatggaggacttcttggattttctagacttactacatagcacttattatagcctaactgaacaatgtggatgcacactcaaactagaatctattcaagccttgagctcagtggttctcaaccctggctgcatgggagaatcattagggaacttcaggaaaaaaaatggacaaagaaaatgtggtacatatacacaatggagtattattcagccataaaaaagaatgagatcctgtcatttgcaacaacatggatgaaactggagattgtcatgctaagtgaagtaagccaggcacagaaagacaaacatcgcatgttcttacctatttgtgggttctaaaaatcaaagcaattgaactcatggatagagagtagaaggacggttaccacaggcttggaagggcagtgtgggggatcaggggaggtggggatagttaatggctacaaaaaataattagaattaatgaataagacctaccatttgatagcacaacagggtgactatagtcaacaataacttaactgtacatttttaaaataacttaaagagtggaattggatggtttgtaattcaaaggataaatgcttgaggggacagataccccattctccatgatgattattatgcattgcctgcctgtatcaaaacatctcatgtaccccataaatatataaacctactatgaacccacagaaatttaaaaagtaaaaataaggaaacaaaaaatacagatattgtcttggtcactgggtctgccataacaaaataacctcagatctctcttttggttaacaattccaaatataacaaagaagtttaaaaatccaagaagttaagaaccgtgggctgcaatatataatggactaaagtaaacttgaagcatcgcactttactttttattatgctaactgtagtcatttgtaaacagtttgaaaaaacatatattatttgattgtgttggaactgttttaattgagagtacaaaatcaaagctcaagaaaaatataaattggccaggttctgttttgccagacttagtaatgttttaattctgttttttcaaaagaaaataccattttcaccatgtccaaaactgggtgatcttccttctccccctgcaaacataattccctctgccattccccatcttggtgattagtgttactgtctgcccagttgctgaagctagaaactcaagagtcatcctagattaccccttctcttcccctcactgcatccagtttattctctagcatctatgtggttctaagtttctcccgtgtctgttcaaattggaatcagcatcccacttagcacggagtcttttctcatctccacatctttgacttgctctcccctttaattccttaggaaacttgtttccagtcatcttccctatatttcaaatctgctcatgttcctctctagctcaaagttcctgaatgactagccatcgtctatggaggaaaatctaatctggtttgcattgccaacagagacagccctacagaatctggccctgacttctgcttggcttcacctcttgcccttttcctccttccagccttgtaattccctgaacaagcctgttttctcaaactcatttgcctttgcacctgctgctaaagttgcattgctactgggcgaaccctgccccctcttactcaactttcaagcctccattgaaacactaccttctctataaagctttccttgatcctccagatagataacaaagccttgtctcctaggcattcattgcatttagtacttacttctagtaccacaatctctgtgttttatggattgtttgtgttcttcctacctgaaggttaactctgaggacgaggactgtgttgtcatcttaatagtcccaagcctaccacagagcttagcatctcatctgtgcttattaaatattgtttgaattaattaaccaggaggacttagtaaataagaacaaaatgtcccttctaggaattactttatttcagtcataagctatagttcacaggttgggaaactctagcccgccagccaaaaccagcctgctgtttttgtaaataaagttttattggcatatggccacactcgctgatttataaattatctgtggctgctttcatcccaccaagccagagttgagtagttgtaacagagatcacatggctcacaaagcctgatatattttctatgtggtctttacagaaaaagattgtcaaacccctactacagataattaagcccattggaggtcacatctttgattgcttttaaagaataggtatgtaattctgttttgacacttcaaataacagtcagctcccgtaggtacctaagcttgatatctaaaatttataaactcatctggggactttctatctgggagaaaataataataaaaaaaattccccaatagtgttccttgtagttctctaagcttagagggtgtgagtgaggggtacacccaaggcctgagtccccaaccataatgtctatatgtcctattttttcttagtctggttataccaaaaacataaaagaaagaaaaaattcaaaatacactggccccagaagaattttcttctgttcactgaatgtgactgcagcctcctcactttgactagatttgctcactcactcctctccccacatcccctcctgcatcaccctccctgagctcctcctgggttcctgctagtcttcatcattatccactggatataattcatacatgtcaaggcaaagaaactaaaagccataacttctttaacacttgctcaaattttgccttctcagtgaggtctttcctggctgctgtctctaaaactgcaaattcctttcttctacttccccttctttgcctttttctccttcctagcagttatcattatttcacacaccattccttttacttaccccgttcattttctgcccctaccagagtataatatattcatgtattaaatgagtgaatgaaatcccagataaagagggaaaatatcaaagaattaacatcatgccattcacttttggaatgaatacactagacaggaatttgtcaccagtgtgaaacaaagtgctatggcactttgttgctgggaccagtctttctgtctcccttctttaaggtgagtgacttcttttttatgtttttaagacagagttttgctcttgttgcccaggctggaatgcagtggtgtgatcttggctcactgcaacctccccctcccaggttcaagcgattctcctgcctcggcctcccaagtagctgggactacaggcatgcgccaccatgcctggctaattttgtatttttagtagagacgggcttttgccatgttggccaggctggtcttgaactcctgacctcaggtgatccacccacctcagcctcccaaagtgctgggattacaggtgtgagccaccacgtccaggcgagtgacttctttaagatggtgaagtcttatgggattctgttaagtgttccatttattgcaatgagtccctgcgtgggccagtacctctccttccctgatagaacttttctttcttgatcattgagcaacagtagctgcctcctcaaatctgttgcagcatgcctgatacatgagattcacaagaagtctttagtaaggagacactgggtttcagaggattgtaaagtactttttctttggacgtcactttcttactgtctgcattgagggtggagccatttaccctcagtggcctgcaagggtgtgcatgtgtacacatgagtacacttttaggattgtggaaatctttgctttgactctttgatgtggagtattttagcatcaaatgtctctataaatactgaacatcttcctgttgatcataactctaagcttattgtgttcacaataactcatgagagtgctacaaatagaacctcagtggttacaatattagcatagagtttaaagccctacattcttagcttgagtccttattccaaatcttataagttttatgatttggggagaattacttaacctcctcaagactcagtttcatcatctatattatattggtatatgttactatactattcatataatatgtcataagtataaactttactattataatatattctcatatattatactagattatattattaaattttacatgagataggtaaaaaatgttaaccacttcataaggttgttggagggattaactaaaaagcccttgactatggttaacagtaatatatgatctcaaatagctagaaggaggatattgaatgttagcaaccaaagaaataataagtgtttgagattagttactaattattagaaatatatatctaataaccatatgtatagaaatatcaccatgtgccccatgaatatgtacgatttttatttgccaattttaaaaaatgcccttggtgcagccgctggcacatggtaggctctccatacacactcatccccctatatctgatgtgtgtgatggcaattagcagcagcacagtgtttcacaaaagttagaagttcccatgtgttcccataaaaaggaggaagtaggaccctcacagtatctttctacatagtttcctcaggcctatatgcataatgagataagatcatgtgacccagcagatacttgagattttgacatttgcaactaactgagaaaatccacagtgaactaaaagaggatttgactttgggaattgagacccaattttggaacacaaaggtggtttgcttgactttattactaagagaggatgagatttgtgagaggtaagtgaactctgtaactcttgattttttttttttttttttttttggcctacagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaaggtaaggcctcttctgcctttctgccggggaacactgcaagtcaaatattggctctgccaaagccgtgagctgtgaactcttctcacacctaatattcacacaggaaggaaactacagcttcttggttgttggctggcattagtgtccatttgaaggacatgttcaagagggacaatttgcatgtcaggtaatacatttatttaaagggaaggtcaacttggagcattacaaaggaaagctgtgtgtatatcaacagtctatatggattctgaacaaccaattaaaaataattttcaggaaggtcatcttaaagggtcagaagaaaagctgtgtctatctcagtttggtttcaaaataacccatttgaaaagaatgccttaacactctgttaaacttgtcgtttgaccctatgccaactcagaatcagggattttaccgaacctaactcctttttagccagtttttcagctggtgtgttgtatgttgcactggagccagtgcacacctgattggctgatgtttgttttttaaacagatcctgattccagtaaagatgagacacatgtacttgaattccttgaatccataaaactttgtctctgtatgtttactgttgtctataaaggcactttttttttttttttgagatggagtctcgctctgttgccaggctggagtgcagtggcacaacctcagctcactgcaacctccacctcctgggttcaagtgattctcctacctcagcctcccaagtagctgggattataggtgcacaccaccacgcccagctaatttttgtgtttatagtagagacaaggtttcaccatgttggccaggatagcctcaatcccttgaccttgtgatctgcctgcctcagcctcccaaagtgctgtgctgggattacaggcgtgagccactgcacctggcctataaaggcactttttaatttgtattagtatgtagcagacagctactttgaggcagaatgaaaaactatgatgttatacacataaagtaaatctgccatgaaaagcaacattgggcagggtgcctgaaacttaaaggaaagcagaagagggataggaagcttctagaaactagaacatttccacggaggattttggtatctgcaaaacttctcttctactttgttttcttttggaggaggtcgaggggatgcttcatgaatatttattcataaatagttcatatatatatacacaacatatgtgcatatatatgtatacacatatacacacaaataggtggttctcaagcagggttgattttgctccccatgccctggggacatctggcaatgtctggatatacttttggtttttgcagcttaggggatggatgctcctagcatctagtgggtaaaggctgaggatgctgaccaacaccctataataaataggacagccccctgcaacaaaaattatcaggccccatgtgctgaagttgacctaccttgctgtacacacatacattcacattctgtcacccacagtgccagtggtgcagttctcttggctcagctgtggctaacagaaagaatgctggcttggaggtctaaagactaggacttgtgaactcatcctgtcactcctcacacctgtgagcttgggcgacttgcctctgcggtaggaggctcagttctttgaccagaaagagtagcacaaaaacactgaccagagtttttctttggatagtgagtcttagggccacgttttttcttgaagcagaacctgagactccattggaggttatgacagagttcagaagagagagatagacaaggccaatgggctgacaagacatgcatatttcactggcatatgccttgcacctttggctttcttgtcacggtttgttcactaccacaaccacagcatgttgtttccaagaggaaatccccaccctgttttattttttcatgctaatctcacacatagagaccctcagctcaaataagaagaaaatcacttaggcaattgtgaaaaatgaatactagtgactgtcaggccgtgtcgctcttatccttgagaaacgccctcctgccttacctggtattggtttggttgtagggtggagatgaggcctgttctccctccaacataactcacaaagtggcccatgtggggcccgggccaagagttttgtctccctttaataagcacagacattcttttcattcctaaggaaaaaaaaatggcaatattgttagcaaacttaatttgtagtgaagagaatgatgactttgaaaagtttttgaaacttggtttgaatgcacatcagataagatatcagggaacagatactctctgtggctttgtttttaaatccagttgatttttttctttgttcctgcttgttaaagagtccactaaacaaataacctttaccaaaaacaattttataaaacttgtctactagaggctctgtctccattaattatttctgaggctgtgtggttatccgcacatccagagaaagatttgtgctatcgaaatgtttgaagatattcccaggccacagcagttattttcatattttctgtcaaaataggaactaatgatttacaaataattttctcatttatagaggagagagggaattgtgtggctggtgaaagaaacaggcatcgcatgagggtttctgaagctactgaattgggcatatgaatatagacatcaaatatttactgagatccttggaatgtgtggctggtggcaagctctatgacagtagctttggtctaaatgtggccacttgatccccatgcaaaccttcaaatggaggttctcaacagggtcagattcactgtgtgaataattttcacaggaaaataaatactgtagccaggacctaaagcctaaagaaatgatgccaaacctaataggatataatgaaaatcatgatacaatgaaaatggacacatagtcaagctcacatttctgttctctgtcacattaggatgatcatagggatttatttgtggttatctatttgtagaaccctctcctgtgagtctggtgcttccagggttcaaatgaatgctattataacatgatcatcagctgccagaatttaccatagagaggaaagaattgaggatgggggagttgggaaattactgggtgatttcctagagtagaccacaagggtgggatccagagcacaagtggagggtttgaccttcttttacactataatgatagatgggcattagttatatggacactgatgcaagtgagttagaagatggtgggagggcacgtgggattttactccagattgcgtctcagcgtccaacaaaataggaagcaatttaatccactaggcgtgaggatggcgaagaggtcctggaggtttgaggaaagaggagaggagtggaagagagggcagctaacgggccagcaatgtcacaggattgcaggacaggccaaaaggtccgtttgaggttagtagctgggaattttaaatgaaaaataaacatcctggtatctaaacactgttaagctaaatacaccatatcggacttttaattccccagccttagttaatccaaatatcctcttttgagttaggacttttctagttcaattcaatgaaggtgaagagggacatggcagttgagaatatatctgtagtaggcaaaataatggacccccaatgatggccacatccacatccctggaacttgtgaatataatacctcacaggccaaaaggaactttgcaaacgtgatgagttaaggtccttgagatagggagattatcctggattgtctaggtgggctcaaactaatcacatgggtactttaaagtgcagaaattctcccagctgtaatcagggagatatgtgactatggaagcatggtcagagagatgcaatgttgccggcttcaaagatggagaaaggggccatgagccaaggaatgcagatggcctctacaagctagaaaagtcaaagggacaaattcttcccaaggggcctccagaaaggaacaaagctctgctgacacctcaattttagcccagcgagacccatttcagatttctggcctccagaactgtaagatgataaatttgagttgtttaagacactaagtctcttgtcattagttatagcagcactaggaagctaatacagtatccaaaggaatgattctaatcccacaacacagagtctcaactggataagaaaggaaattaggaagtaattcaataatataaagctgtaaattttgtcattaattatctataagctgaatgtgattccaaaataaagtaccaacagaatttttctttttgatgattttactaaattaatctaaacatcatctgggaaaataattaagtgaaggtagtcaggggaaatctgataaagagataaaatggagattaaccctgtccatttattaaaatgtgtcacaaaactgaagaattaaaaatgaaccaaaatacatatgaaaatttattacgtgataaatacggtatttttgtaaagggaaaaagatgggttattattgtatttgagataatgagacaatcatcattaagaaaataataaattgatatggaagaaagatttaaagattaaaaaatgaaactataaatgatgcaccagcagaaaacataggtagatatatatttttttacactagggaaggcctacccagaaaacataaacaaagagaggaacaagtttcactacattttaaaaaaatagaattatctctgacagataagcaaataactaaactttatagcacatttgacaaactaaaggctaacttctctattgcataaaactttattacaaattaatataaaaagaaaatctaaaatatagacaaattacaggtggctcacagaaaaatacaagtggtataaatagatttgaaaagatgctctccctcacattcattaaagaaatgcaacctaaacaccaaggagattttttttttctctcagagtggcatggctccaaaagttggatgatacacttcgtggggaaacaaacactctcatacactgttggtagaggtgtaaattgttgcaacagggtgcaaggcaatttggcaacatttgtctaaattgtatttatttatttattatttccatggttttttaggaacaggtggtatttggttacacgaataagttctttagtggtgatctgtgagattttggtgcagccatcacccaagcagtatacactgaacacaattcatagttttttatccctcacccctttcccaccctttctccctgagtccctgaagtctattgtgtcattcttatgcctttgcatcctcatagcttagctcccacctattagtgagaacatacaatgtctagttttccattcctgagttacttcacttagaataatagtctccaatcccatccaggtcgctgttaatgccattaattcattccttcttatggctgagtagtattccatcatacttatatatataccacagtttctttatccactcattgagtgatgggcatttgggttggttccacatttttgcagttgcgaattgtgtggctgtaaacatgtgtgtgcaagtatcttttctgtataatgacttcttttcctctgagtaaatgcccagtagcgagattactgggtcaaatggaagttctacttttagttctttaaggactctccaccctgttttctatagcagctgtactagtttacattcccaccagcagtgtagaagtgttccctgttcaccgcatccacaccaacatctattattttttgattttttgattatggccattcttgcaggagtaaggtggtatcacattgtgattttgatttgcatttccctgatcattagtgatgttgagcattttttatatgtttgttgtccatttgtatatctgcttttgagaattttctattcgtgtccttagcccactttttgatgggattgtttgtttttttcttgctaatgtgtttgagtttgttgtagattctgtatattcgtactttgtcaattgtatagattgtgaagattttgtcccactctgtgggttgtctgtttattctgctgacttttccttttggtgtgcaaaagctctttggtttaattaagtcccagctatttatctttctttttattgcatttgcttttgggttcttgcatttttctaaattttaaatggcccaaccattctacttctaagactgtatctcacagatacatacttgtatttgttggggtaggctaaccactcagtgccttaacaccactacaaaagtatatttcttactgaagcactatctaatgcaggttggcaatggggtgagaagggcaaactctcttccaggccgttattcagggacccaggcttcttgcatcttgtggctcctccctcctgtatatccatttagcctggagatgtacacactgaataactaataagataaaatagctgatgagcttaatttgttaccccttctaaacttaacatggttcaaaaagagacttttgaaaatgcttttgagaatctggagacatttttagtggttgaaatcaggaaccaatcattttccctgtgagcccaaaattactccatggaggcaagcatggactatctgattattcaaatggctactcttggcataggctcttggatcagactatctagtttgtaaatggccaactcttagtcacagaaccaggaaacaaatgtaaaaaatagtcaagaaattaagcaaaacctaatggtctacacaaacttttcacttatttaaaacacatccaaagagcactttttgtatatcaagtagtatgttaggtccaattaatattattttggtaacattttaatacaaatggtcaaaatcaggggttagcaactgaaccatggccaaaccaagcttaccatctgtctttgtaaataaagtcttactgaaacacagccatgctcattcatttacaattcgtctatgcctgttttcactcaatgtcagagttgagtagttgtgacattgtctcagaagtttactatctggccctttacaggaaaaatttgctgatgcctgatctaaggtaaaatgaaagaaaataacttattcctgccacaatcactatagcacgttagtgtaggcattatggcttaaccttattatattgtaaaccaatatttacagttgaatggttctataagacagaaatgcatatttgtgttttctttagagctgttttcttcttgtatcagttcatttctgatatcacaattgagaaaggctttgtttatgcattttgaaaacagtatcatggaatgaggaatagctgatggtttaagaaaatatggagaagagtctcataaaagagtaccccaatgcctcaaaattgctcaattatatggcttccttataaaatgatccctcgccattatcccttaggcaatgtcaaatccaagtacacaactcaatgaaataaggaaaattacattcttgctaggccaacactgcagctgtcttcagtttgtgatttaaatgttgatttagaaaataaaagtaacctggtaggcaaggaaattgagattgggtgtttatataacaacccttgacagaaaaatttaactgtcctatttctgttattctttctggcaatgcccagttgaagaggtgatgtgctagaactgtctgccaaagccttttgtgtaagtaaaaataaggttgaaacctggtgcagaatccacaaaatccactgtaggtagaaatgccaatgggaagcaaacaccaccaaatagggatgatcacggaataatgagaccactgtgcccagaggccctcaacaaaggtctctattctgtgaactgtggagctgattgtaccttctgtgtgtccacaatcaccttttctgtgatcttcacacaaaggatggtgacttcccatggagtagggctacgtcttattggtctttgatctggaacatcatctgtactgcctaatacacaagtggccctcagcaaatctttgagatgtgaatggatgcgtgcaggcatattatttaataataagcttttaaattaagctctttctctcactcttccccatatctctaaagagcatcgatcacctttctcccactgtccccagtgtctccagtaatgattttaaaacaacctcaacacttccttactccttcacttcatgctcagtttccagctttcattgatggtctcatagggttgatgtgagatttaaatgaaataataaccataatgagcttaaatcacttcctgacatcttatatactctccataaaacttatccatcaccatcatcatcatcatcattgtcatttttgccatcaccatatcactttgtcctgtatctcccctcaaccctatgtcactgcatcattatgcttgattttaattatagtcatagaacccctacctactttcctcaattcagggcttctcctctattctatctaccacacgtaaaatcaccagagtgaaacttcaaccacagtggctactcctttgttggaaaaacaaaaagcaaacaaaaatcccaaggctccctattgtctactgatcttactatcaaagccattttatatgagatactatctatttcatataaaagaagaaatccatttagtttgcagcctgttctcagaatgcaccacagacttttatttgtttacttgtcttagaacagcaggttgcagattttttgtccacaacctatctgcagtgagaagtacattttacatctcagcccaggaaatgcatgaagccaaacagcttatctttatcagagatacatttggatattctttataatattctctcctatcctcttctatctgattctctttcattttcaaaatatgttttcatgatccactgaattttcttgatttattaataggttataaaccactattcaataacacagtcttggaaggtatatggaatagagaacagggaatcacaaaggaagcaacaaaaatatcagtatggaaaaattagttgatctttgctgtggctctcagggccttgataaggtggacgggaacttctttttccatagggccatggtgatgaacctaaggctagagccatacctgagtatcttatgccttctctctctagagccaaactgagggagtgacacccagagggcttcctacaaggcctcacagctctttcctcataataccaagggttatgcaacctgaaggagatacatatgtggggctttaaggtctagctgcgatagaggattcaacactatgtcaaaaggagttcctatcatcgagtagttcctagtcaatagacagagaaaacacagatgcatcaattatattaaaagatagagcagtggagatgatctgtccaagttgactttggtgaccctttagatagaagctgcctcatccacccactctggtaaaagccaagaatgacaaagacattatcctgcaggttattttgtaattttcttcttggatgctcttcctagcaccccagggtttttaccatgtaaagttctcaagtgtctgctgccactatatgatgctatgttggtgccaagcaggtgtgggattctttaagccatgtgctttgtaccatggtattcacaaattacttcctttatgttctcagacaatatcgttttctatccaaggtcttgtctcaactggtcatatttatacatattcgtatgtcttgttggagcagcaaccactattgcacaagactttggcatcttgaccaaaacttctgtcactgcagtttctgaaatattctggcacctttcaaagatttcaagactgcactatattctcttttgggatcatagcccaaaataaacttgataattatgaagaatatcccatccttcaaacatgaacattttgccttttttcttggtttccccatgggcaaaataaaagcaaatacgtatacgttgaaatttaatgctgagtgtattttttaaccaatcagcctttttaggtcatttggaatcaagccctcaagattacttaaaaattcaactagtgggtgttactagagctttacatatggaaagctctggaagagtagtttaacaggttttcacttaagatagatgtgggcaaactaagctcatgggccatagccagtccattgcctgtttttatatttttattaaaacccagccatgtccatttctttctgtattgcctgtgactgctttagtgctacagtggcagagttgagtagttttgacagagaccttatggcccacaagatcaaaagtatttattctctggatctttacagaaaaaaagcttgccaacccctaatttgaaattaatattatagtaattcattgttattttttatgcagttgttcaactatactattcctgttcatttcaatttcttcattattttaatttcatgatgtagtaattgtgtgctttttaaggatcagacctttgttattcttagatgttttagtgcttatattacagtcatgcattgcttaatgacagattcatactgagaaatgcatcattagatgattttgacagtgtgcaaaacttaatagagtatacttacacaaacctagatggcatagcctactacacacctaggcgatatggtagagcctactgctcctaggctataaacctatacagcatgttcctgtactgaacactgtaggtaattggaatgcaatggtaggtatctatgtatctaaacatagaaaaggcatagtagaaatattgcataaaagataaaaaatagtatagctgtatgaagcacctccattataatcttttcagaccactgtcttatatatggcctgttgaccaaagcattgttatgtggcacatgactgcatatgtgaccaaatattttttcaaggtgagatgagttcctttggtggcattaagcaaaaaataaaagtcaatatttttatgactggtttaaacaactgatgccaccatgcagtctatagacacatgagttatgcattaaatgggtaactttaataagtcaatcttcattacaagttattactttcactattactatcttgtttgatgactgagaagttagcaatattcccttctcatgtcctagaattgcaacacctgccagtgcccaaatcaatactgggaagtagaaataaatcactgggattggcttgaactaagggttcatttcccgagtttggggtgataactcatcccaggatgagttgcatggaggatgagcaactgacaaaatggagcaaggaagaattgcagtgagtaggtggaggggagcaggatagagatggatttagattaaaaactactggtatacggaagaacattgtcatcttctgccattgcagacaagtgatagagaggaaaccattcttattttatttgctttagcgtctagcacagtgccttatacatacctacagcacaataaatatttgaaaaattaaatgagatacattaaaaattcaatcatagcacatttatgtatatagtgtttccatagcatatggaattgttttgaatggctcaaaggataatcaaaaacatggaatggataagaaaaggataggtagtataatagtttcatttaattgcatcatcttttcaggtactgaatcagagagagctgttttcatgggagcaactggcaggaaattctaggcatttccaagactttaacaagtaatgataagactcccaaaatttgggttttaattttcttgagttaaccacctagaatatttattagggaaaaatgatttttgtatttttgttctcctgcctacttcctttcatttacactccaggaatgaaatgtagcttaaaaaaatgacttggcaaaagccattttccctgccccgatatttggaaactcctgtctctacaaatacagtgcctacctagactaaactaaaagtattgtcctccatttaaggactgttcaatgaaagatacaaattcaggagcctggaaggacatactagctcctagatcatgaaaagtcagcagcagagctgcccctttgagacatgtgctgaaagctttgaaaaaaaaatcttctttaaaaaaaatcatataacttgactgtggaaaaatgaaagcaagtaaaagatccttctagggcataatttgatcattagcagttcttacagcaagcagtgattacaaagaacacctagttaaggaaaaaccatagttgagcctttaaagctatggcatctaaaccatgagatcagcttccctacctcatgttttgacggaacaaggagacgtgttcaacaaatcaaatatcttaatgatttttctgtaatagaaaaccacttgctttgaggttcgaggatccagaagttttttttctcctcttgaagatgatatagaaaaattttagaactaatcaccctgccagaataatttacacaaaacagaataggtttcttcttagtgtttaactgaaggcatggtgacctccaagagtcgactttctctacagcagtgagagactcacagaatgttcttattttctgaccacacctttgataatttcaccaccacttcaacatgtaaactgtggggattagtacatttcacaagtactttggggagcctcagccctaaggagaggcatcgctattgcttaagaataccataaaacattttcttctccagggaaacatagacactttggaaagagattttggaaatcctagcccacaaagtgctagcaggaaaaagaaagtgtttaattcactgggacttataccaacaaaagtgaaccaatcaccctgttcctatctgcctttgtctatttcaattaaagttagtggaagaactgttaagtataagttaataagcaaaaactttgataacatgagtttggttaaataaccaacaatctagggtatgaaagatttcttgaagatgacacacgcgcacacacacacacacacacacacacacacacacacacacacacgtatccagcattgcctgaatgatgggaccagtttgggcttgaatacgttttccattattttccatatagattgttttcttccacaattattattttcccctctcttgaaccctggttcccacttaagaaactagcaatccactcctgaatttgcaattttctcatctttttcaccaatagaatgcttagttggtaaagggttggattataaggaatcaaacattaaaagggatagggtaatcagaaaggaaggatgtcctaaactaagctggtggaaacccccaccaaaattcaaagaccccagagagggataacttcatcccttaaggttgaactcaaacattagcctttgcaagcagaactggaagcagtcttctctcttttgtcctggcacctagtaaatgtcttctcctcactgaagcatttcttcatattgcttttttttttttttttgtcgcccaggctggagtgcagtgacactactctgtcgctccggctggagtgcagtgacacgatcatagctcactgcagcctcaacctcccaaggctcaggcgatccccctgcctcagccccccaccccaccccaccccacccagtagctgggactacaggcacgtgccaccatgcccagctaatttttgtatttttagtacagacaggatttcagcacgttgcccaggatggtctcaaacttcttagctcaagggatccacctgcctcggtgtcccaaagtgctgggattacagatacgagccaccatgcccggcctcattttgctttaattaggtttccacatgtctatctctagcactgaattttgaatttttcaaaggcagagatagcattcattcatctgggttcatagcacctagctcagaatctcacctattgatcaatcaaagggtggatgggtggatggatagatcagtgtatggaagatgacatttaaacagataactattatattgtaaataatattcccaagccaagaatagtcatcatgttctatggtacaacatccctgggcagagaatacttgcttaagaatagggaagagatccctgttttggctcccttcctaaatctctgggattcatcccaggttaactcttaaaccagagcattgcattggtcccactgttttccctttcctggtcccactggtttcgctttcctagattactattcctcttttctatcagagctgctatccattccatttcttgggatagactttgaatatgaagcaggcaactcaaagtagaaggagcaattttgaattcattccactcggggtggcaatggcagtaagtggatcctttgtccagcctgacttgtcctcaggtaacacctgttttcctatgtaaacttactgggccaatttaacttatgttgctgggattaatcattagaaagcaccaaacatggagtacaggcacaatgaatggctcccaagtgccaggggtcattaataatattgttacttctttaacaaacctcctgttccaaactggaaataaaatatctggttcagtctttctcttgccttattttttgggaggtctgtggcttgaaagccacaaagaaaagccctcaaagtgagaaataatgagatgaaataatgaattttagttttaataaaggacaaaatatggtattactaaacctttttacaggatatccacagatcatataactcaattcacatttatatgtacatatatatgtaaagagatgttatattttattttaaaaacaatattttggtttacagaataggcattggagcttaaaaatagatttctgtactaatcaaataatcggtgttcatgaatgcaaatgaaaaatactgtctggataacttaagcagaaaaaggatttagagaacctaagatttagaatcttacaacaacctaataagccacctatgaaaaaatcaccagccccataaaaacaaatctggtccatcttgttagctgtccactccctttccagcaaacaggctccaccagaatggcaaacataatagatgtttcatgtcagcttaggcacatgttttctttcagatcaaggagatgcaaataggagattatttcactagtttcagcctggcttgtgagtcacctcccttcttgtcactaaactgagctttcagttctgtggagcacttcagtgagcaatacaggcctccattttctcacatgcttgataagtgagtttccaacctttgcttgaatacatctggtgcctgggagaaaggacttatttttttttaattttggaataattttagaattacagagagttatgaagatagtatagagttcccttatgccccttacccagtttgccctgttaacataataacataacctcaatgctattatggtaacattaataccataaatgtattaccttggtacatttatcacagctaagaaaccaacattggtgcattgctatcaacaaaactatagacttcactcagatttcaccagtttccacactaatgttatttgtctcttccagaatcctattcaggataccacattgcatttaactgggcatcttttcttatctttttatttttatttttcaaataacaaacatttatcttgtaaaacagcttctgtgaatagcttagcttgggtgttctggttcaggggctcctgtgaagttgcagccaagcaaagatggggctgcagtcatcttagggcttgattggggctggaggagcagttcccaggctcactagtatagctttcagctggagacttaccccttagctttttgcatagggctgctcctgacctggtttctcacaaagtggaggggtgcaagacagaatacaaccaaatggaagccacaatgaatgatgctttgttttgaggcagctcattccactggttccatttgctggctagactgtcttcctatgatatcttcctgaattttcattctggcccatggagggctggccagtaagtctcttcatccaccatgtttagtcctctaaataaaaggaaagaaccacaatgtctcctgagtcttctctaaatgctaaacatccattcatacaactgttgactatcagagggtgttccatacctgatcctgccccacccaaggagaaaaaaacagttcatataaagaaatacaaggctatttcctcaagaaacttggcttattcccccatctgtagtcctagaaatttggtagaaagataattatatgcagactcccatttcttcgtaaattaaagaaaattgctattgtgtcccaaagtcagtgtgatacataaaggcttcataatttgtaaacacttttacattgttctgtttaaaacagaaactgagataaagtataacttgagcattgtgacaagtgggaaaatgtgaatgttttgttcacatttacatgatttgggttcatagctgctctctaagttgagttatacatagaccagtggttctcaactggagtaagtttagtccctggaggacatttggtgatgtccagagacatcgtgtgtggtcacaacagtggtggggtgctctggcatctagtagataaaggccagggaatgctgctaaacatcctacgaagcacaggactattctccactgaaaagttatctggccccaaatatcgctagtgcctaggctgagaaatcctggcacagattatatgcagtttctaaagggccacttccctactctgccacccaagtgtatctttttaaatcattttcccctcactttttcattgagctctcctcattgcctatgaatttcattggtttgctttctccgagagtcaattttattggtccaaatacatagtaaggcagctgtggctaatgaaacaggagatggtgccaaaaagcattccttcagtcttttctcagcaggatttttttcaaagctttgaataagctaggaccttccttttaggctagggtaggttcacaaactctgaggcataccaggtaatgtaagtgggtacagtggcccagggttgggtgcctatgctgccttggggcacatgtgaggaatgtgggacccagtgttgccagctcttccactttcctcaagaggctggaactctagatatgtatgtgaactttccaagattttgcattaggacttaactttttataaaactttgtgtgggctaaaaaccacctgaatagtaggggactggatatggccattttgcacccatgaggctggaaatttgcctgtgtgtgtagcagcaccagaggaggtctttgtccccagcagacatttagattcttttccaccctcatgtcatatttcagtgcaggtgatttcctttcctttccagtaatgtaatctttattgagctctgcaagtgaagaaatttaaaagggcttaaacattgatgccatatcccacattcaggtgcacctgtgaattgaggctgtttacactcattccccatgattgcctggatgagaaatgagccttagcgcttcttgcccatcatccagacttctgggagggcagagtctaaatgcattgcacaaatggatgtccgctgttttacaaacacctcctggataggagagccctgaaccatctctcatgttgcaaaggcaaagtgaccttaaagaaggacttccagcttctcctcataggcatctgggttctgctcttagccacacctctcaagacagaactgcgcttattggaaagaacttgaatttggcattgaatgtcagccctgccacctaccagttctgtgattttgagagaatttgcgttaattctctgattttcagttctctcaattgtaaaatgaataaatcaaaatgctatcccaatggatcgtgtgttgacacgtattaggtatatgatataaatatttcatatcattaaaaaaaagtacttcttccagtgccagtgcatatttagagcttggaaattgttagtttttcattcccctccctctctaactctatgttaccttgggcatgccagttcatgtatctggctcttactgtcacatccctgaaataggcaccacatttcctccactacagcgtaaggtagaggttagagcatgatatggtttggctgtgtccttacccaaatctcatcttgaattgtagttatgggaatataatacccatgtgtggtgggagggacccagtgggaggtaattgaatcatggggactgttacccccatgctgttctcgtaatagtgagttcgcacacgagctgatggttttataaggggcatcccccacttcgctctgcaattctccttgctgctgccatgtgaagaatgacatgtttgcttccccttccacaatgattgtaagtttcctgaggcctccccagccctgcgaaactgagtcaattaaacctctttcatttataaattacccagtctcagttatgtccttatagcagggtgagaatgcactaatacaataaattgataccagtagagttgggtgctgctataaggatacccgaaaatgcggaagcaactttggaactgagtaataggcaaaggttggagccatttggagggctcagaagaagacaggaaaatctgggaaagtttggaacttcctagagacagagggctcagaaactttgaaacttagaaagtttgaaagtttgaaacttcctagagacttgttgaatggctttgaccaaaatgctgataatgatatggacagtgaagttaggctgaggtggtcttagatggagatgaggaatttgttgggaactgaaataaagttgactcttgctgtgctttagcaaacagactggtagcattttgcccctgccctagagatctgtgggactttgaacttgagaaagatgatttagggtatctggtggaagaaacttctaagcagcaaaaccttcaagaggaagcaaagcataagagtttcgaaaatttgcagcctgatgatgcaatagaaaagaaaaacccattttctggggagaaattcaagctggctgcagaaatttgcataagtaacaaggagccaaatgctaaccaccaagacaatggggaaaatgtctccagggcatgtcagagacctgcacggcagcccctcccatcacaggcccaaaggcctaggagggaaaaatggtttcctgggcctggcccagggccccccggctctatgcagccttaggacatggtgccctgagttccagctgcttcagctccagctgtggctacaaggggccaaggtatagctcaggctgttgcttggtgcaagccccaagccttggcagcttacatgtggtgttggtcccgtgggtacacagaagtcaagaattgcagtttgggaacctccacctagattttagagaatgtatggaaacacctggatgtccaggcagaagtctgctgcaggggcatagccctcatggaaacctctgctagggcagtgtggaagggaaatgtggggttgaagtccccacagagagtccccactggggcactgtctagaggagctgtgagaagagggccacagtcctccagaccccagatgtcatctatatagcaggaatcatacaggctgcagcctcttcagattggcttctttcacttagcaatatgtatttcaagttcctcttgatcattttgtggcttgctagatcatttcttataatttctgaatagtattccattgtatgaatgtaccataatttatttatgcactcacccattgaaggatatattagttgcttccaaatttttgcaatgatagataaagctggttaaacactggcatacaagtttttgtgtggacgtaagttttcagttcatttgggtagttaccaaggagtgcaactgttagattgtatggctcagctatgtttagttttgtaagactatgcttagtttttgcaacatttggcaaccctattctcaatgagttgcacctcttttgaagaggtaaagaacaagcatatacttcaatgagaaaagccataaaggacatctgaaagtcatgttcattcattcatacattcattcattcacttgatatttgagcacagtcatgtgctagaccctggaaatacaaacaaacattggcaatggaaaaaatgcatgctgtaaaacaaagcaaagcagcataacaagggcagtaggaaaggctccaaatatgcaagtgacagaacaaagatggagaaattttccctgcagcagtttcaagagaggctcagagaggtatgaactagtgaagtaacacattttttacccttctcctacactgggtctgaggacacagctatcgtgaaacaggtgaccccacgcaggatcctacagaaaaacaactaaatcacgtttgtgaaactcagaactacaagctcttcctcatgatttggacaatagatgctttcaaagagtggttatttttcctatattttccttcccttctcttaatggagaattccttcttccaccctgaaaaggaaatacgaccatcagtttcccaaataaaaagagggaaatacatatgtgtataaacggtggtgaccacctagtagaattttaagcctttgtttaaggatattttccccctaaggactgcaatttcctaagttgagtcaacattcagaacttcagttaccattgtcctatgtgagatttgtgtgtcttgtatccaatgtactagttaggtatttctttataggctttttaagatttacaggtgtacctgatcaaaaatagctggaaagatctgagatggtttttactggataatttattccatgtgtacccaacagccaagcacttggcaaatgaccaaaaaatatgattttaaaagccagaatagctcatgcaagaaataagtagctgagagataaagaaaaaatggcaacgttatgctttaatggcaatgtaaactatctagaagggacatttatcagttcaacaagaattaattttcttcactctcaactcctatgaacaagccttctccttctaaaaggtaggaatgtctgccccagtaattaattgtttatgggtaactagtacatcacgaaaatctctataagacatctttctctggcacatattttatctttatactagatggaagataacaaccaagtgagctgtttgttgaatagggcacacttcaaagccaggtatggatatctgatttaatgcgcattagcaggacatcagtgcaattgttgtgtgagtactgaggcaagtaggcaaatggcggggtgaacttcactccttaaaatagtgagctaaacagacgtgaactacctaagttgtttgaatttgttccacatgctcttttaaaatgatataagacaaaagagatttaactggttaattagtgaaaatctagtaacaaaaaatgtctggttaattcatggaaaatgggaactttgaataaatttcaagataacgtttgaattaggccaataaagttaattcttgtgtttgcataaacacaaagattggagaattgctgtgtattcaccatttactctttcaaatgaccattactttatttagtacgtgtgtattgtgcacctcctgtatggctgggaacataccagtttccaaaaataaaattaggactatgataaagtttttacactctagggtaacagttcagtaaataacagccacaatacagggtttgagaggtacagaaccactaaaagagaggaaagggggcacaattttgtttgagaactaacagggtccagaaaaggtgaagaactaggtggtctttgacacaagtcttaaaagagtaagtaggcacttgccacacatagaggaaagaaagtgtagcagacaaatagaccagtcatgattattaactatcaactagttcatcttttttattttttatttttttgttcctttttgagatggagtctccctctgtcgcccaggctggagtgcagtggcatgatcttggctcactgtaacctctacctcctgggttcaagcgattctcctgcctcagcctccctgagtcactgggactacaggcacacgccaccaagcccagctaattttttttttttgtgtgtatttttagtagagatgaggtttcaccatgttggccaggctggtctcgaactcttggcctcaggtgatctgccggcctcagcctcccaaagtgctgggattacaggtgtaagccaccacacccggcctgtctttaccatttacttgcttttcattcctggacaacactgatctcagggaggtagtgagtagaacggtggttaccagagggtggaaacagtagcagggttgacggggataaagaaatgctggacaatggatacaaacatacagttagagagaagaaataagttctagggttcaatagcacactcgaataactgtagttatcatgtatttcaaaatacctagaagacatttgcgatgttctcaacacaaaaaattgataaaagtttgaggtgatgaatatcccaactactctgatttgatctttacatattcatgaatcaaaatatcacatttactccatacatatttacaactattatatatcaataaaaatcatgaagatattggtaactaatagctaacatttattcaacatgtaccatatgtctaaccttctcaccatcattgtttcctgtgacacagtaaccctctgacacagataccatcatcactgttttacaaataaataagaaaaattatttcaatgtgctttgggtgagcagcactgagagagccctgattcacctggataagaatgcaatgtgcggcctggctcaatttgacatctcagagcttttgtactctgagtgcaataaatcaggtgtatgcacagaaatcagggcagacttaagctcctcctaaggagtgagtcaagtattttgtgatttgactggatcaccttaatttagatatcttcacaaagatataagcctaggactccaagatgaaattttaacatcagggaaatgagatggtcctttccctctgctatcaggagaaaccctctccaagaggcagggaggcaaaagactgtttctcttcagtttcagttgctgaaataaaggacttgccactggtctgtgggcaaaatttcttgggcactgtctttgcatatgacctctgaattttgttcagtacatcactgctctaaggatatatttagtgcttttactttgcattttaacattcagctgctgagtgagacaatattaggagacatgatgctcttgatatcagccattcttcaaagcgggtgtttattatggaataaaagaaaatacgtgcttcagtctagaatttaaaagcactaactgcaatttttcaagcatatgtatgtaaattaaagttacctgtcttaccattttcttgagaaaagtgtatctttacgtttgttttagtgcgacttgtttctgatatcctaacctaaaatttcatggtcacaaatatataaattaaacgttatcttaatgaaaaaataaaacaggggctatagcacaagagatgtgaggaaaatagtcacacacacacaaaaagtaaccaagagtgaaccctgaagtaatctatggacttggggtgataatgatgtgtcaatgtaatttcatggagtgcaacaaaggcaccactctggtggggtacatggatagtggggaatgctatggtggcagaacagggggtaaatgagaaatctctagaccttcagatcaatttgttgtgaactaaaaacaattctaaaaaacaaagtcatatatatgtgtgtgtgtgtgcatatattcacatatacgtatatgcatatatatatgcatattatctatatacatacatgtatatgcatatatacatacacacacacacatatatacgtatatacacacatttatacacacacacacacacacacacacacacactcctaataacttttaaggtcaaaaactttcttcccttcagaatatctgccagagtgacttcaagtacacagttactcatttgaggtactaaggggtgacataaatatcaacttttggccgggcgcggtggctcatgcctgtaatcccagcactttgggacgccaaggcaggcagatcacgaggtcaagagattgagaccatcctggccaacatgctgaaaccccgtctctactaaaaatacaaaaattagctgggtgtggtggcgtgtgcctgtagtcccagctactcgggaggctgagggaggagaatcgcttgaactcgggagacagaggttgcagtgagccaagatcatgccactgcactccagcctggtgacagagtgagaaagactccttctcaaaaagaataaaaataaaaataaatcaactgttccatcactaaataccttgtggtgtctttctcatccttccactgtagaatagtcagatagcccagtatgtataatagaactctcacatggacctctgcagtgcttattttgcctctgtaactactgaaagagatctcaaataaggatcttcttagaaacttgaagtagtacttagacttacacatcaacacatgctttgggtaaaaggaaaatcctttatgaaaatgcaagctttaagaattaaatgctccccataaggattcacttattcctgtataagtgactgtaggcagaaaaacagaatctgaatgaactttttttttctttaacttggaaaaccttgaaaagataagagtggtatataggggccaattaaaatgaaaagaacaagggaaaatgagagtaagtctctcctctcctcccaatgagggtattgtgttctgaacaattcatgaatggaatttcagaaactcagcaaaagaatacatttaactgacttattccaaatatattctgaatttcatatttactaaagtgtttccaaatgaacattttgtatgttatgtgcaaaaactgcacattaaaaaggaaaggtaagagagttcatcatacaagattttagatgcatgcatacttaaactaacttccacatactccacaaatactaaacttaaaaaacaaagcaccctacataatttaccttgccatagatgtgaagtaattgttaagcatacataaatgttaataaaatactttgaatcaatgctgaggggtggtatcattgaatggtggaccaaaacaaactaaatggcattttgatgtctttggaaatgacatacccacaagccaatggctcagcactgacatttatatatcctgctcagttgtctcaatcatttatagtagtttaatttttttcaagaacacagatgttaaggtaagtttaataattttgaaaggccatagagtatatctattttttgaagtcatactttcattggaattgtctctttaacctaatgaataaatacaaagaatgcacagataaaataagttttgtcttcttttattagagaaaaatgtactgttccatgcctgtgctttctacagttttggaacggatacagatccacagaggccaaacctaaaactaaattatctttaatgttaaaatttaactgaccatgtatataactgtgcaattgctgctttctcacagaactgtctagggttcattcaacagatcacagtaacgaggtctggcatttaacaaacaaactaatgatagaggagatacactaatttatacgagaattaactaaatactgtcatgtggtttagtgtagctcaagttatgcttgtatcatataacataggttcaagttttttcatcagccatcagaataacagtggttaaagagacatctgaataagtgccaactcttactgcagttgtctcaaaaaaagaaatttaagtaattgcaatatacatttctacaaataaaatattccagtgcttacatcaatcctgagtttttaagattaaatatgcagtacttatggtctccgacacaattttattttggaacacggtgatgtattttttaagttgactttcttcaccactttcttcaccaaaaagagggctttcattatactcttccaagtcctcaatactctaaaacaaaaagtctagttcactgacaaaccatcactttacatctcaggttttaaacagggtaaattagatgtcaaaggaaacagcttttaatattcaaaggatgctggttatttatttcaaatttaaaaactgtaatcaatacatggagctccaaatacttaaattttttaattccagatttcagtgaaatattattatagcaggtccaacagtcatgtagtttgcttgaataaaatggcttgatgaacatgttacagacaagatggaccaaagacagaaaaagactgtcagtcttatatcatggaataccatattttttcaccaggtagtgaccatttgttatcactaatagtccacataacgtggttttcattgaagggataaaatggtctgtgatatgacctaatcaagttggggaaaacataactacgtatgaaacatatactagtccctcaacaaatagttcagcagttcatagtccctaaaatgttgtatgttaatactgaggaagacgtaaaaaatgagtacacaatctcttccgtattcctgtgacatgagcaaatgcacgaataaaaaaaaaagtaatacaaaacttgtgttactgctatggaagagcaactcactcggacatgtagccaaaaatggagactgatgtcgacttagttggcacaagatttcaatcagtcaaaaaaaaaaaaagaaaaaagaaaaagaaagattttaaaagcatttggagggaagggcatgagcaaagcatgggagtaacggtgagttccttcagggaaggctgtcaatctggagagttgggaggaaagacagagggtggcaaaacaagcctaagagggggtcatgtaaaggggagagtctctgaatatctaagaactgagacatgggcaccactgacaggctgggaagagggaagggctaggaagcattttagaaaggggagagtgttaggaagatagtattgcccatcagtgaaggatggctcagaagagaagagataactcagaaaagagcttaataatacaagcaaggaagaatgaggtcttgaactagggcagcctcagtagggatttaaagaaagaaattaaaggaccattacagcggtaaacgtgcctcgcaataactgcatgggaaggataatggactcagaggagtccaagatgataccaaagtttctaccctaaggggtaacatgtagcattaacattgacaggataacttttctagtttaatgttcataccaattaataaatagtttctgaggaacattatagcaacatgttctcttctcgtgacttctatgtaaataactgtttgtgtacagatcatccttaagttgcttgaaaattttattttcaaacgcttttcctagtttatttaacacatctcagttagtgtagaggagtgacatatgagcatgtcttttcacaaggttattaaaaagaatacctcccaaaagaaaattacattgtttcctaaataatatacatctacatgaagaagaggtcattgtccaataacgattagctaatatgctatatgacagcagataattcacaattcacaaagtgttaataatctgctggctttcacattctgttatacatctgaaccatctcttatgattacaaattttcatgtaaaaccattactagtcactaatagttttgaaagggaatatgccataaaacactcctacattccagcaggaaataaaagagatactcagtagtcaacacttgcctacttcctatttaactaaaactgtttaaacaagacaagtaaaaaagacatccagtaaggatttatggacttcctgcattccactaaagatctgtcgctgatctcctaaaaactgaatatgaaatcttcattaatgtattcataaagtatcaattttatacacaagatttatatttccaggtaaaatttccaatttaccttttcctgttttaaataactcccacaaaactattcatgaatcctaaaaatacacttaccaattatgttaaatctggaacaatacaaagtgaaaatggtaagtaatttataatgtataaccaaaaggtctgtccacttggaaccaacccaaatgtccaccaatgatagactggattaagaaaatgtggcatatatacaccatggaataccatgcagccaaaaaaaaggatgagttcatgtcctttgtagggacatggatgaagctggaaaccatcattctcagcaaactatcgcaaggacgaaaaccaaacaccgcatgttctcactcataggtgggaattgaacaatgagatcacatggacacaggaaggggaacatcacactctggggactgttgtggggtcgggggagggatagcattgggagatatacctaatgtaaatgacgagttaacgggtgcagcacactaacatggcacatgtatacaatgtaacaaacctgcactttgtgcatatataccctagaacttaaaggataattaaaaaaaaaaagaaactctcggggccaactgaattttataaaaatgaatttgttgtttggtgaaaaaagtaaaaactataaatcctagaagtcagttaaaggatacctgtaaagctctgtggaacaaatattaataaagtcaaactgatcaaaaaaaaaggtctttccatacattcagaaacaagcagactgtcttctatttttgttcatgagttgtattttataagaacgtattgtgttaccaaatagaacagacctttgtgaattgctcatgtggcggctcaatctctttcagttcctttcccatcttgttgccgtctcttttgttgctcttgaaatattctctagaagcacaaaactaaaaagtgattaaaatcggataaattttaatacttacaaaacataattctgcattagctttaaatggatactctttaaatcaatacttctgaacactattagacaacatttatgaccaattttaaacagttgtgttcaccactcatatgctaaaacaacataatctttctcatcagtcatggagtaaagaatattctttcttatatatattcaacatgtatgtcctaattcttggtttcaaatgaagagtatttgatgacccttcctacaatttgttgaccacagatagttaatttctaatacagatctttcttacctaagaaacattcttttttactaagattttaaacacttggtcatttcagtatgcacatagatgaaccttccaacaatgattgcctttctgcaccttgacctaatctccaacaacagtgttctcctctcctctatgtggcactcactcacacagtcatcccctagattttgtcattcccaatggctgcaacatctcccgtaataataataatagcaatgatagcaacgataaagagcaaccatgggtgagatcgcatcctgaaaattttaaataaacccattacataagaaccctttaatccttcaaacaactctgaggtaggtactcttaccatgtctcctttcatagataaggcaactgaggcacagagataaataatttgcccatatttccaagctagcaatggtcaaactggagttggatcccaagcaatgtggctgcagagtcccagcccctgaccactccactcagctatttctccatcttcccaacatacacagccactacctccctgtcactgtaggtcactcacttcagtactacagctcaggaatctgtagggacccaacacccaatggatggagcacttttcactgcccaatgcccacccccatgtgctccggtaactcagtcccagctgaaattccacagccagtcatcataaccgccccccctccaccaacatatatgccctgcccaactctccctctatcaatgtgctcagctacaccccaacccaggaaattccaaccctaaagttactcttgcacaaatatgccatctgggctgactttaacttcttaatccctatgacactgacctcagttggacccctaatgctgcatggcaattatattcccctagtccatgagtccactaatgggccccgctctctgggttcatgctctcttccttctttgctggatttctgcatgaaccattactacctgagacattgatacaataggttaattgtaaagctaagcctgataccaacaattagttcttctccttcttctctcttcttcatctttctgctcacctgtgatgtattcttcaagggtattcggctccttcttctttcttcttcatctttctgctcacctgtgatgtattcttcaagggcattcagctccttcttctttcttcttcatctttctgctcacctgtgattcaaggacagtcagcaacttcagagaacgtccataactacatttctgcctgtaacacataataagtaacacggtcatatgtcatagagagatgaaaaattaatcctattcaaaccaaaactgacttcacataatttatactataaagtagcaagggagtaatggcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatgtgggttctcataagtaggttcaagaatatcatagccattcatcccgtaagatttcccaaaagaaatacttcacttaactctctctccactttggtacaacaatgattttctaaaaggaatagtgaaaacaatttaactaaaatagataacctatttacgacataaggttgtccctttctacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatacctcaattctgttaaacttaggttataaaacaaagaaacttacctgcttaaggaacaatcaagtaaacatattgttcactacagacaccaatatgtacaagatagtttttgaaattatttgcaccaatgaatacaaagaaatgatagaaatatccttattcaaaaaagccaacaatcatgcatttttagttgtattgttctcaaaatacgtttaattttgttgtttgtttcgttgcaagcttttgcaacgctttcaatcctttttctctttgcagcaagaccctttttaatgtcagctagacagtaaatgaaaatgcattaaaaattaatgttgaaaagtagtttatttgcagatattgaaatcaatatgggacatgatggttcagcaatatcagaaggatatttaaaatgcaaaatggaaagatcgtttcaaaaaagtaagatttaatccttttctgtaaaacctttcaggtattaataatagttttccaattccaattggtataacagcaaatcacttaattgacagatgatgaaaaaaagcaaataattaaaatagtttctattttttaaatgtgcagaaagggtaacaaacacagactttaatttctacatcataaaatgtccaacagttcaaacgacatgtttccatgaaatactgtcacaactcattaagtaaagcacataaaagtaagaccatcaaaagggtagacataacataatacacaataaagtatttttaagcaatctagtgattgatgctattaactgtattttaataaaagaagcaatgtccatgggtataaaaatttaggtttaagtagataaagaaatacacttaaaaacacgtttgaaatattttctgggagctttttatatgacatttttatccacaatgctgtttctgaaaactgtattactgcaaggaatgctttcctaaacatagtttcacatcagagatccaccatcaattgctaagaatagttttctgcagtcataaaagatctgcaccataatacaaatattttttacatacagtatccatctatagtggtcgatgtattaggcagctcacaaaaccagcactttgtcaccaccaagcagagcaaagctttccaaatatactgcttatatgaattattgctatagaagaactgaaaactaaagtaagctttttaaaaataagagtgttgtctccatcgtctctacagaaattttctcaaacttttttgaataaatggtcctataacagtcagtacaactaatatttcacatggcaatataaagtttatgagtttttggatccaattaattacatgtttctcactgggtagaaaagttgtctttacttttctactacacagtttattactggaataataatagaaaataatcattttagagaattcaattttttctcatactttaaagaaaacaaaatcagaaagctgtgacaatagaatagctaaattaggaacatgaaaaactcatattaaaaattctgagtacatatggacaggaagaggggaacaacagacaactgggcctacttaagggtggagggtaggaggggagggtgaggatcgaaaaccacccatcaggtactatgctataacctaggtaacaaaatacaaaataacaaaataacaaaagtatctgtataccaaaccactgtgacacgcaatttatctatataacaaacctgcacatgtaaccccaaacctaaaataaaagctaaaaaaactgatatgtgacttaatgtgtgtacactaaaaggaacgaatagagctgtttctcctccagtgtcctctaatatcccccaaacattaaatttccacgtgtatgaaagaaaagccatccctctcacttgcccattattagaagcattctcacattccacatcaacaataaaaaaggaagtaatacagatttatcaaacagactatgttaaatgctatatatgagaagaaggcatttaagacagtcttgtccactaattcgtacagcctattgtaacagttgtatgattgaaaacaattttcataaactacaaatagctcctaaaacatacctgcaatatcttctagcttctggatatcaaccctgtaaaaaaaaagttacatcagggaaatttatagcactaaatgcacacaggagaaagcaggaaagatctaaaatcaataccctaacctcacaattaaaagaactgcagaaccaaaggcaaacaaatgcaaaaactagcagaagacaagaaataactaagatcagagcagaactgaaggagaaggagacatgaaaaactcttcaaaaagcaatgaatccaggagttggttttttgaaaagattaacaaaatatatatttaggatagttagctcttcttgttgaattgatccctttaccattatgtaatgtccttctttgtctcttttgatctttgttggtttaaagtctgttttatcagagactaggattgcaacacctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagtcgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttggctgtaaagtattttatttctccttcacttatgaagcttagtttggctggatatgcaattctgggttgaaaattcttttctttaagaatgttgaatattggcccccactctcttctggcttgtagggtttctgccgagagatccgctgttagtctgatgggcttccctttgagggtaacccgacctttctttctggctgcctttaacattttttccttcatttcaactttggtgaatctgacaattatgtgtcttggagttgctcttctcgaggagtatctttgtggtgtaaaacagcatggtactggtaccaaaacagagatatagaccaatggaacagaacagagccctcagaaataaggccgcatatctacaactatctgatctttgacaaacctgagaaaaacaagcaatggggaaaggcttccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccggaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaagtaccatttgacccagccatcccattactgggtatatacccaaaggactataaatcatgctgttataaagacacatgcacacgtatgtttattgtggcattattcacaatagcaaagacttggaaccaacccaaatgtccaacaatgatagactggattaagaaaatgtggtacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagacgacgagttagtgggtgcagcgcaccagcatggcacatgtatacatatgtaactaacctgcacaatgtgcacatgtaccctaaaacttaaagtataataaaaaaaaaaacaaaatagactgctagccagactattaaacaagaaaagagacaagaatcaaatagacacaataaaaaatgatcaaggggatatcactactgatgccacagaaatacaaactgctatcagagaatactataaacacctccacacaaataaattagaaaatctagaagaaatggataaattcctggacacatacaccctcccaagactaaactaggaagaagtctaatccctgaatagaccaataacaagttctgaatttgaggcagtaattaatagcctaccaaccaaaaaaatcccaggatcaggcggattcacatctgaattctaccagaggtacaaagaggagctggtaccattccttctgaaactattccgaacaacagaaaaaaagagactcctccctaactcattttatgagtacagcatcatcctgataccaaaacctggcagagacacaagaaaaaaagaaaatttcaggccaatatccctgattaacattaatgtgaaggaaataagagaggacacaaatggaaaaacattccatgctcatggttacgaagaatcaatattgtgaaaatggccatactgcccaaagtaatttacagattcaatgctatccccatcaagctaccattgactttcttcacggaattagaaaaaactactttgaatttcatatggaaccataaaagagcctgtatagccaagataatcctaagcaaaaagaaaaaagctggaggcatcacgctacctgacttcaaactatattacaaggctacagtaaccaaaacagcatggtactagtaccaaaacagatatatagaccaatagaacagaacagaggcctcagaacaatgccacacatgtacaaccatctgatctttgacaaacctgataaaaacaagcaacggggaaaagattccccatttaataaatggtgttggggaaactggctagccatatgcagaaaactgaaactggatgccttccttacaccttgtacaaaaattaactcaagatgacctaaagacttaaacgtaagacctaaaaccttaaaaaccctagaagaaaacctaggcaataccattcaggacataggcatgggcaaagacttcatgactaaaacaccaaaagcaatggcaacaaaagccataattgaccactgggatctaattaaactaaagagcttctgcacagcaaaataaactatcatcagagtgaacaggtaacctacagaatgggagaaaatttttgcaatctatccatctaacaaaaggctaatatccagaatctacaaggaactgaaacaaatttacatgaaaaatgacaaccccatcaaaaagtgagtgaaggttatgaacagacacttctgaaaagaagaaatttatgcagccaacaaacatatgaaaaaaagcttgtcattgctggtcattagagaaatgcaaatcaaaaccacaatgagataccatttcatgccagttagaatactgatcattaaaaagtcaggaaacaacagatgctggagaggatgtggagaaataggaatgcttttacactgttggtggaagtgtaaattagttcaaccattgtggaagacagtgtggtgattcctcaaggatccagaatcagaataccgtttgacccagcaatcccattactggatatatacccaaaggattataaatcattttactataaagacacatgcacacatatgtttattgcagcactattcacaatagcaaagacttgcaaccaacccaaatgcccatcaatgatagactggataaagaaaatgtggcatatatacatcatggaatactatgcagccattaaaaaggttgagttcatgtcctttgcagggacatggatgaagctggaaaccatcattctcagcaaactaacacaggaagagaaaaccaaacactgcatgttctcactcataagtgggagttgaacaacgagagcacatggacacagggaggggaacataacacactggggcctgtcgggggtggagggctaggggagggatagcattaggagaaatacctaatgtagatgatgggttgatgggtgcagcaaaccaccatgacacatgtatacctatgtaacaaacctgcacgttctgcacatgtatcccatataacttaaagtataataaaaaaagaaaaaagttacatcaaaattttaacataatgctacacaaaatgccatgtttgtttaagaagaagaaatgtcttatgtgaaatggtgaaatgttctgcatagaacagtgattatatgatccaaagctgacttctctgcctcccagattcaagcaattctcatgcctcagcctcctgaatagttgggattacaggcacatgccaccacgcctggctaatatttgtatttttggtgagacagggtttcaccattttcgccaggctggtctcaaactcctgacctcaagtgatttacccacctcggcctcccagaatgctaggattacaggcgtgagccaccatgcttggctccaaagctgatttttcttagaagacgttatctgacaggcaaaactgacttaaacactttaccccttgtcttccgcatcgatttcagcaaaatggtctcttttccgctgcttatcaattgctggagtctttcctgcattaaaataaaaaagacacaccttttttttttttttaagaggaagacgctgttgtggacatttttttgtggagaaatgtactatttgtggacccttttggctctctgcccattaaagctttaaagcagcgctatacatggaatcactgggaccctgaccattttacagaggcatttttgcaagctctttgcggtttaagtcccagtaaacaaggcactacgtgtcagatcccttggacgtcaggaccgcatccatcgagaagagctgctctaagagtatctgtaaccctggtatgagggagaacctcccatgggaaacctaaggctcttgagcctgctttgaaaagcttgggcatcttagcacgtgcaaggtgaactccaaagcaacataggggctgggggcctcgggctgactgtctgctgcctgtgtgccccccgcgcagagagcagacaaaccgtccccttgggcgtgcaccttcttccggctcccctggactgtttttaactccatgctccatttcctggttggccgtaacctgagcctccactgggtgaggccttcgcaggcttctccatgagcttcctgcccacgggctccatggctggttgtcctcggatgttagaggtgactcctgaaccttgtgagtgcaaagatacagtaaggaaacagggtgtgtgaaaggagagctatcgggatggtgggttcaagaagcgtggggctggcccgccccgagtctcctgtgggagcaggagggatcgcggagaatatgtcagcatcccctcctgtcctggcctgtacagcctgtccctggggctggccgcagagctcgcagctgccgcgcacacctgaactccgcggcctctgggggatcctcgcggagccattgagacagagctcggccctgctcctgggtcccccagcgaccccgtgtggccggaagagctgtgggatgacagaggatctccccagctatctcagtgggagtcacccggtgtgcacctgtttcggacaatcaagggtgggcactgctactcgcccgcctggatgcccaggggacctccggtgaccccaagtgtcctgtcctgctgggcagccaggcaggagggacccacaccgactccccaacccctgcacatatgcacaggcccctggggctgctcctgggccctgggaaccacctgggcagctccagctctcagccctggcccaccccggcctgccctcagggccttgccctgattcaggccccagacaacgacactggggccatttcctcacaggtcagcctggggcagcccggtgcttcacacggtcatccccaaagggcctcatgccggctttccccgcctccccaccatgggcacaacacctgagggaccccccacattgctccctcagtggacctgcagacgctggcaccacaaggctcctctgagggcctgggtcctcggttctcttgagagcagccagcctgcctgcccgcactcctcgctgattggtcgactcagtgcacatgtgggtggtgggccgctggggccacgccccctgcaggcatgccctccccctcagggaccacccatggtagctgtggactcagggagagggtggctttctgaggtctctgtccccacgatattccagctcctcatcctggcaaaggaagcaaggacccaggagtggggagtgccaggggaccctgccctaaggaatggaggccaagtgaacggggcctaggaccttgcccccaggctcgttccagccacccctacccctttggatgcaatggccatcaccctgagggtggagcccaggctccctcccatgccctgtgtgcttccaacatgcccaactgcattctttttatcaatggattgtgcttttatgttttatctaacaaaattgaagttgcctttggagggtaaaaatatatatatgtatgtgcacacacacacgtgtgtgtgtgtgtgtgtgtgtgtgtgcttaagcaaaggttttccttttatattcatagattacattgcagaggtataatggcatactttttatattcatagatattttatatccttttatattcctttgtatttccttttatattcatagataaattgcagaggtataatggcataaaatgggcatatttaagcctttgggtacttcagttagagaatattcctaaggcaagaattaagatgtattcatgcatcatttctctttataattctgttgtcaagtattatagaaatgtttgtcggtttcatttttatcaccaggaatgattttaaccaaaagctttcaaaaaccctttaattttgacccagcaaaatcaaacatttattcatgtatttatttatataagtttaagggctacgagggcaattttggtacatggatctattgtgtagtggtgaagtctgggcttttagtgttcccatcacctgaataatgtacattgtatcctttaagtaatttctcaacactctcccacccttctgagtttccagtgtctatctttccactctctatgttcctgtgtacacattgctccgttcccttataagtgagaacatgcaatatttgtctgtgttttacttgtttcacttaaaataatggtctatagttccattcgtggtgctgcaaaagacatgatttcattctttttcatagctgaatactattccattttacatataaaccacattttctttatccagttatccgttgttgggcacctgagtgttgattccatatctttgctattgtgagtggtgctgtgataaacatatgagttctggtgtcttcttgatgtaatgatttattttcctttgggtagatacccagtggtgggattggtggattgaatagagtgacatatgctggggagaaacatttagtctatagcagggagtcaacaattttcttagataaaacataaaagcacaatccattgataaaaaggatgcagctgggcgtgttggaagcacacagggcatgggagggagcctgggccccacccacggggtgatggccattgcacccaaaggggcaagggtggctggaacgagcccgggggtgaggtcctagggcccatccacttggccttcattcctcaggacaggattccgagcactccccattcccggctccttgcttcctttgccaggatgaggagctggaatattgtgggaacagaggcctcagagagccacccttgccccctaggtcctcagctaccatgggcatgcctgcagggggcgtggccccacacggccccactacctgcatgcacactgagccgaccaatcagcgaggagcacgggcaggcgggctggctgctcttgcaagaacccgggactcaggccctcagaggagcctcgtggtgtcggcatctacaggtcctatatatatttttttatttaatctttattttatatatatatattttctcaaagtatgtaattttgtggctgaatttaattttatctttgtgcatagaaatctatagacaatcataatgcagggacactttattagcatgacctaacctttgaaatcttgtctaggtgagtcacgaatttagttcattatcagtcagttctctcctagctgggaaacgttcatgcagacacacatggaactcaattagactgggtcagtgtgatatctgcaggggctctagtgatgtgtgaaacacacagggagacggagatctaattttatgatcttcactgtcaataggagagaagaaaaggacttctgaataacatcaccgtcaactgcctcacaaaatctctgaaagcagtgctctaggagttacagtgattgcatcaggagctgcagttttgggggcaattgagaaggaactcctttctctgtataggctgcagagttcctgaaacttctccccaattagaaacatagaaaattattagccttacttaccagtgccatatgacctgggactactcagaggaaagggctgattagttaaagaaaatatgtctagaaagaaaccaaagaacattactcccaaaaggcaccttcaggaatccaactataacatttttgggtagattaatatataatacatatatagtctaatattctaataatatagtaaaacggatgaggtttagaacaaattaggagacacattctgtgtcagatgccaactgcatctgcaattttgggcaaggtaattaactacctggagtttctgctaaattgaggttggcaggggcactgggttgattaatttgatcttgaaagtgccatgaggtcatggactatcttcttatctttattagggagctatttcttacatttataagactcctttactaagttaaaggtgttttccttcctctaccatatacaatttttaaaaactgttcccagctgggcgaggtggcgcacacctgtaatcccagcactttgggaggccaaggtgggtggatcacgggtcaggagttcgagatcagcctggccaatatggtgaaacctgctatctactaaaaatacaaaaattagccaggtgtggtggcgggtgcctgtagttccagctactcgtgaggctgaggcagaagaatagcttgaacccaggaggcagaggttgcagtgagctgagattgcgccactgcactccagcctgggcgacagagagagattctgtctcaaaacaacaacaacaacaaaactgttctcataggccaggcgcagtggcccacgcctgtaatcccagcactttgggaggccaaggagggcggatcacgaggtcaggagattgagaacatcctggctaatacggtgaaaccccgtctctactaaaaatacaaaaaattagccaggcgggctaattagtgtggcgggcgcctgtagtcacagctactcgggaggctgaggcaggagaatggcgtgaacccaggaggcggagcttgcagtgagccgagatcgcgccagtgcactccagcctgggcgacagaggaaactccatctcaaaaaaaaaaaaaaaaaacagcagttctcgtaatttatctctatttctgttttgtatttgaatgaatgacacttaattcatcgagattttttaaagagcattgcagaactctcataagatgaggctggttgtatcatttataaaatatttacagcatctcagagagctctgaataataaatgacttccattcaaataatagacttttaacattttcaaactcggcttttcagtagatatcaacactctcaatctcattccatttgtgagtctactttaaaatacctttaatcaaatgtgtaacttaatagttctattgatagaaatataatttttctctatatgttttgttttgtttttcataataatagtagcaaaagatacaaaccaaaatcaattttctagattaatgttggaatctcctggtttcacttttgagaaaccactcctagtctaaaatgcattattacattgtttgtaatgatatttaaaagctggaggaacataaactccgcaataactgcttcatttttaaatttgacccatcttcggtttgtggaacgtgtctgaaattgcacagctgtttttatttatagtctaactggggaatttcacttgtgaaagatgctgtaacaaaataaatgtccctgtgtccgttgcattctgtggcattctaagccaacaaaatgtcaagaaataccattcaaatcctttcagctacaatgaggctgaattatcattcttttcaagttcttgtttttgagggactgttatagcagaaattcacatgcaaaagaattgctttaatttatgtaccatgctactatttttaacttagaaaaaaaagtcagactcctctttggacctcaatactgacaactttcatcagtaataataggctgtactgttattctgtactacctttattcagcaggaataacaggctgtactgatggatgtactacagtgatgcaaggactccagtaaactggcaggcagtgaagaggtatgcttcaggagtgtcacaaaagtggtgatgactttgcagagaacagagccacccgtttatcggcctgcctctgcttaatgcatgttgctcaaatgcctctatgaaaatactgccccaaatacaaaactatactattggactgcccttcctttataactttgagggatggtcattgccacttgctaattgccaagctctcttacaaagtacatattcaatttatttccctgcctgcaactgtatgatgtatagttgtttccaagaaatgatgactaagaggtactgagagatttttgtcattttttcttcaaaaaaagtcaactggtttcctgctcattctttccatttaagttggccatagaaatcccagtggtgaccctcaggttgtcaaaggcctttcttcttgttgctgtgaggttggcctgctgatagtaacagatacaccccactcacaattatttcaggatcaagtagatccattggccatggagtgatggtcttttcaagtaaggctattttgagaggtaataaaatattcatacacttaatttttcttttgtacttgcttgttttaaaatacagttctgtacataaatatttttgacaagatgagcaatagatctattttttcacattataaaacaaaattattataaagataagtcaaaaatgactaagtagaacattctatttggttattaattttcactggactttcaaaacacttttctgtataacatattcatatattttgaattcagcagtgcagtcagatgtttcatgtaagtggctgggcacagtggctcacacctgtaatcccagccatttgggaggctgagacaggcagatcatttgaggccaggagtttgagaccagcctggccaacatggcgaaaccccatctctcccaaaaacgcagaaaaaattagccaggcatggtggcacacatctgtaatcccagatactcgggtggctgaggcacaagaatcacttgaacccaggaggcagaggttgcagtgagcctcgattacgccgctgcactccagcctgggcaacagagtgagactctgtctcaaataaaataaaatatgtaagtgtaacatgtaagagtaaacataatcttacgtagtgattatctgaattattttttctttacttttattctacatgggtattataaagagttgtgtgttcataataaaggctcccttttctacatagttggtcttcccttcttccctcaacattttaaaaaaattctacagaatttacacaatcaacattcttccttttaagctacattattaatttctccccaaaagaattacagtttttcagcagctgggaaatggaaccaaatgatgtttaattctcccagcagtgaggtgaggaaacatgcacagagcattgctgcccagggagctcccccaaccctggcatccagtatggttttggggcgtgtagtcatggcagactgtctgcatgactgaactcagttgccagcccctccagaggtcaagactgatacaggtggcccaaagcttccactataaatcacattgttagcattaactatctagcataactcaaagctccaggtaaacaaagacattattatcaggcaggatattccaagggcttagaggttatctcctggaaggctgtcaaagagcagatgttctttggaaagtgcagggtttggacaacacagatctgctgagctaacctactactgcactcttattcagctcttattctgaattctctctctctcttcctaaaatgtgcagatccttacggatggatgggaaaatctgggaaacacagcactcactgtaaacacaccatgcctagaatttggctcctcttcaacaacccgggcttttgaactgggtcgaagtcactatgccaggatgacatttttttacgttagaatgaattcccccctggtggctcctcatcctccaggtatacaaggctcctggatgacccatggcctccacggggcacaccacagtctgaatcacagctgattttctggattgcccttggactcagcaggatgattccacatcttccaaattctagatatcctgatatcgcaatattttttatccctgtttcttaatgaaagggtaaatggaggtagaggtgtttctcaacaacctgcaacaacacatgtttctttcaattattcagtacttaattggaaatcaaagcccctttctaatgtatcgataacattgggaattgatgactattgtgtagttgtacttaatctacaccatgctaattcctaacatgggctatggaggcagcagagcggcaggtgacaacatatgcacttctctccctctctgcccaaagctcctggtaactgtcaaatgagcagaggacggggagacaataggaatattttaaaactgtggttttcaggttgggaatatattaatatcatacaacctaattatttccttactttgtctatattgttgtatattacccaagcttcagagctgtcagagcaaacctcaaagatgaggagccagctggcaggtaaaaagcaaaacaaaaacagcccgttgctcaatgactaggatttttagttcaattacatttccttgccatctaaatagccagatgcaatgacccatagatagagccagtgtagaacagatgcagtgacccatagatagagccagtgtagaacctaacataataatgtctaaaggggttagtaattgttctactcaatttgtttcagccattctattggaattcctattaattggaattgatggtaagtatatggaatgtcatgtagtgaaacaaacaaacaatttagagcacaccaagtttcatggacaacaaataacaaatcactttttaaaaatcaataccaaccaggccaggtgtgatgactcacacctgtaatcctaacactttggaggctgaggtgggaggattgcttgaggccaggagttcaagaccaacctggccaacatagtgagacccccatatctaaaaaaaaaaagaagaagaaaaaaatgaataacaacgagtacagtgagatcaaagaacactagctaccatctacccttggtttaatactcttgagaaggctggcatatgtggagtctctccaggaagacatttgaggcagaaaaccagaataggggcaggaaatgtattatttcatcatctgaaatggggactttattaactctcctgagtataaagtcaagaaagaaggtatttttcaggactgtttaattaaatgtcattctgtttatcaaaacagagaaacctggcaggcatttctaaccatatgggatttttggaaatacatgagaaacatgtgattacgtgtttagctgaatattatttaaaatgtatgcaaaatcctgagagggcttttgaactaagttcctaaaatcatcctctgatgcatcctatttgatatgctgctgtgtgcctaaaattattccagtagaaataaagcagagcctcaataaaaccagccccttttaatgagctgcttcttgtaattataattatccataatcatttattttgactgtaagtaatataacaaggcaaaacctataattttctaaagtaatataatcaatataaaaacaaaggtgtttcatactactaacggaagataaatgtatcctgcaagctgaatgttggcagatcagcttgtgctcttctaaatcatctaaatatcatcagtgcctttgattacagcctcgtgcccagtgctttaaaaatcaaagtttgcttttaagaaatgtaatttaaaaactgctgatcatctaaatcttgggaggtcaagggcactcttatttcctttatacttacaagtttaatttgatgttttccaaaatagacttgggtataaatttcacatcaatatgctaagcagagccccatgcagaatatttctgagtgggatttattgaatataaggttatttttatgactgggacattacagttgcaatcatcaatgaataaaaaataaatttaaacaactgtctctagcatcaagttgaaactcaagtctcaatagagcaagtttcaggaagaggtgggatttcaggtaacatggagaacagcagctcagatccttttcttaaaggacgattcccccttgacatgaagccagcaactcactctgcatgcagaacatgcaacacatttccatgccggggagagaagcatgtgacgtcattcattcactcattcagtcattagtcattcccttattcgtctatctaatagctgtcaatactcctagtatgtgttgggcattgtactacatgctaaatatatagaatctcttttctaaactcaaaaagttataagtagatggtagtagtggtcagggtaaaatacatttgtgaaaggaagaaattacagtgacaagtcctataatagatggcaagtgatgtaggatccataaggaagaaggacaaattatttatagtatagatagggaagactttacaacaggagaaattatctgagattagtttggaaggataagaacaaaaaggtactccagtagaaaattgggacaaaaagtagaaaaatggggcactttagtctgggagtcataaaaggtggggtatacttggaaagaataaactttttgtagaactataagagatttcagggtctgtgtgagttatagtttcaggagattaagttgaagatatttgggtacaatatattgaggtatatcataagccaagagagaatataggttttatttttgcaggtcagttgttctcaactgggggcaactttgtgccccctccctgggatatttggcaaggtctatattttgctgttacaactggagaagggggcaggctactggcatctggtaggtggagaccagggatccactaagcatcctacactgtacaggacagtccccacggcaaagactctgccccaaatgttgacagtgctagggtgagcaaccttgctctagataatggagagtaactgaaagattttacatatgggaaagaagtaaagaggtactttctaggaaggtgatgcaacacctcctaggaggtttgccacatcacggtggtcatcaaaacactgggtgtcaataagagaaaaaatattcgcctgcagggagaaagatcaactaacttcttgagcatctactctgtgctggacattcaacgtattataccaatctccccatgatattggcaactgctactttctgcagcaatggggactaccagatgaaacaggatgagactagaggctgggagaccattatagatcaatgttcactctcacatggaaacagtggaggtctggactgtagcagtgtccatggagatggagatgtgagagcaaagaggaaggtcaaatcaaaaggagttttttaccaattaaatgtgagaagggtttaaccaccaaatggaaggtttacagaacgactttgaggtggctggttcagaagactaagtaggtagctggagagactgcaaaaggaagtctcagaggacaggtacagggctacccatacttgtgacctttggggtgcccatgggaggttcagatgtagatgcctggtaagcaaagggaaaaataagtctccagttgtaaagagacctcaaacagatatgtgtttaagagtttgcaacatcacaatggtcatcaaaacactgggtgtcattaagagaacaatatttgcctgcagggagaaagatcaactaatttattgagcatctactctgtgctggacagtcattatgttatcgtctcagtctccccatgatattggcaaggagactgaatgcagacaggcccagggaggtgctcaaagtcaggcagccagtcagaggcagagccaagcttggaatagtgtctcaccaaaaccaatccccatccattcattctttcaagattatttataaagtgaattgctgcgtggagaagagaagccacagaacaggttgagaaagaagaccctgagataggaaaagaaaaagtgaatgatatcatcaagtccaaaggaaggaagagcttcaagtaatagtttcagttctcaattgtaaaaagattcagagtcagaccagaggatgcttctgccataaattgctatccaaatgatatcaagtcatgcacacacacacagagtttatatcagagttagaatgtgtacactgcattagacactgagcatcatcagggtcttgctggagggcaaggagcaaaaaacagaccataattggtagaaaagtacttagagtttgaggaagtagagccaggaagaacagaaggaaggtagggtggttgctaaagggaagatattttacagatgaagattcagacttgagcgtagatgtaggctgaaggacttgagtggaaacaccaaagtttgagtatgtaggagtgagggtctaaatgagagaatgaaggagtttggccttggtgtggagaagggtccactgtttgtttaaaatagtggtcttcaatcttgttgggccagtagactctcttgagaaccttgtgaaagttttagatgtcgccccagaaaaacatctgtaaacatttacaaaactgggtatgatcttagggagttcttgctaaaatctcctaagcataaaatttaacaggctctccttgagagtgaagaggtgctattaatgttattacagaggacaacagcctccatctaagcttcaagcaatcccagattggtgaattggaagtggctggagaatgtgatgaactggatttcctctgtgccggcattgattattgtggcgtgactgaatcacagtaagagttcccctgaaaagagcagtttgagtttgttagaaaaatggcactctggaaattgatttctttcaaacaattcaaccctgtgaaatccttgcaatatccttgtgtaaagccagggttatgtggatgacctctgaaagccattgatgtggaaattcctaatttagaaaagttatcagaaatgtttctggaaatgtttacacctagaagagcaatttggtatatcccgggggaagtatccagagcgaggaaatcaacaggagcccaaagttttgcattctatttattgagtaaaaatatattgattgctagccacatgacaagacctgttccaagtgctttatgaatgaattcattaaatcttcatcacaagcctactaggtaggtacagttattatcctccatttcacagagagggtaatggaggcacagtgagatagcagggttgatcttggtttgggtcagggagtagatttggaacaaggctgtctgtttccagagtctgacctcccacttttactctatattgagaaagtttacatattataatatgttcacacatttactcagtcagttcttttttttttttttttttttttttttttttgagacggagtcttgctctgtcacccaggctggagtgcagtggaacaatcttggctcactgcaacctctgcttcctgtgattctcctgcctcagtctcctgagtagctgggattaaaggcgcccacaatcacacccagcaaatttttgtatttttcatagagatgggatttcaccaggttggccaggctagtctcgaactcctgacctcaaataacctgcccgcctgggcctcccaaagtgctgggattacaggtgtgaaccaccatgcccacccaattcttataagctttcaaatatcatatttgtttaaacacctgtattctttagtgttgtaaaggtaactatccatcctctgacagggactgtagatgagaggaaatgcatccaggaatctaatttatcacaccagggtcctatggatagatttagggttatgggaacagtacctcatcaccggttatagattttgagagccttcaatgagccacctctgaagcctttttaaagatggctggacatgcttaggcagaaggtctctgatttgtgtgctaaagctccttcaaatgaagaagtttcaagtgaacagaaattctcaggtgttaaatgctgctacaactccggaaagactgccaactcctgccaggtgaccagaaactcagtcaacttctctgctaactgacctccaagcaactttacccataatagctaagaataccagccaatacttgctgagtatttcctgtggaccaggctacacacacacacacacacacacacacacacacacacacacacacacacacacacacagatccagatgctcagtttgcacacagtggtacagtagtggagggtcataaaaataagcatgcaagttgaaaccacctgatatggttgggttatattccccacccactctcatcttgtattgtagttcccataatccccatgtgtggtgggagggacccagtgggaattaattgaattatgggggcagttacctccaagctggtattctcgtgatagtgagttctcacaagatctgttggtcttataaggggcttttcccccacttcactctgcacttctcctcgctgatgccatgtgaagaaggtagtgtttgcttccccttctgccatgattgtaagtttcctgaggcctccccagccatgtggaactgtgagtcaattgaacttctttcttttataaatcaccgagtccgggtatgttcttatggcagaataagaatggagtaatacagaggacctgctttgacattggatagtcctgtgagcaagttctgaatttatcatctcacagctcctgcccatgtacaagttacttactctgtcctaatctcagtctccttatctgtaaaatggaaagaataataatattggcttcatagaattgctgtgaggatgtaataggattttggatactaagcacttagcttatagtacttactcaataaacactatttattactactgtgtgctgtatcacagggaagttgtggtggtcagatgagatcattggcattcagatatttagaaaagttaaacacttcagaactttcttctgaaggactttgttgctgagttttcagccccattcagtgaatgtaactaactctcatattagtgcgtttctgcaaaaatgatgaggtcttttgttattactttcattgaggaataacatatatagtaatgtacataaatatgaatgtgcacaaatacagctcgataggtttttaatatgtgaatggcatgttactaccaaccagatcaagatgtagaacatgctcagcaccccggaagagtccctcataccctctttcaggtaatatttattcctcaaaggtaacccttactcttccttctgtcacctaaacaaatctttccttggacaatatttctattattatctctagaattaattgtaatatggaaaatactgttttataagcctcattctctgaatctgatcactttaaaattaggaggtatgcacttcattgctcagacccaacccaagagttccatctgacttcctggctttggacagtgctgacaagtcctcagggcatgccccatgctgggctattcacttggaaggagacaaatgcctaggaggcctggtttcaccctcagagagctagtctaactagagaaagaagccttaaaatggaataccatccctaacagcaaatgaatccataaaaatcatgtctcagggagcaatctcatgttttcttgttttcgaccgtcctgaagacactgtttggtattggtctttcccaagaggatgcccagattaaccacctcccacacagttgggtcctttgctttggggtcactaggatgtggaaagcttgctgccttgccatctgctattgtgtcacaggtgtctgtgaggtctctcatgtaggacatggtttcctcttgacacattagtgaggacttccacaaaagagggcaaagggaggccaatccctatgtgcttattccaagatgtattctatcaggacatgttaccccagttgttcctgcaggtcactgttgtctgtaagacagtgcacacactgggagcagttagcaagcatgcactcatcaccatatgcaccatgaaaacacttctgtgcagtattggtagttgtggagcttgcatttctttaaaagacagaatggcatttaaccacacttattgccatccaaggagctggtggaacataaactgttctgtatggttgcaagcacataagcctcttgagcaagttttctatgctttatgagaacaaaagatgagacattttattcttcaaaaatgggggactccaagacaaaccacagattaatcacaaaggagaagaggaataagcagttgcattgtgcatctctggtcattttgctgaggattttaaaagagaaaatggtgtgctaaagcaatgcttcatttcacattattgcacgtcatccatcattttgtatagttacctattcgtaacattcaccgctatctaattaagtgaaaaaattttgttgtaagtaattaagtgttttttaataggccagcattctcaaagatcatactttgcctgtaaggagacttcaagatgttgtctggagttttggagtttaaagtatatattatccttgtgagattatgtaaactctcatatttgtgggaatacaaatgagcaaaactattttgaaaagcttgattttaccaaataaagtctgagattgcatatacacagatccagcaatgcaacttttacatatacaccctggagtggtggttccagactttaatgtgaaccagactttaatgtgcaccataatcccctgaagggtgtgttcaaacacacattgctgggtgacaccccagagttccagatttagcatatctggagtgggaccatagagagtttgtacctctagcaggttcccaggcgatactgatgctgctggtcccagaactacattttaagaaccaccgtctcagggagacttgtgtacatacacgctcataagaagacatgagcaaaatctttcaaaaacattgttcctaataaccccaagctagaaacaactcaaataccatcaacagttcaatgaggaaatgaactgtggtatattcataccaaaaacccctactatatagcaatcaaaaggaatgatctacagctacctgcttcaacaggatgaatctcatgaagtgttggtgaacaaaataaacaaggcaagaaacagtatccataatgtgattccatctgtatgcatcccaaaacaggaaaaacaaaatcatattctttacaaatgcatgaacagatggtaaaactatgaataaaatctgataattgatcattgcaaaagtcagactagtaattatctggggctaggaggagggaagcatacaggtagtttctcaggtactagcaatagtctacgtcttaacttggcttaacttggctattagatatgttggagttggacttacgattattacttagacagaacatttgtatttatacacatctacatagaatacataagttttaagtatttaagaatcattttatcttttaaaaataatgtcctctatctggtatgtattctgacttttggcaacttgtttgaattttaggatctgcccattggttatgaaaaatcaaatcttttaagctttaatagatggtttagttattctgctgggtcaactattgaaatgaaagaatttttgttactgccaaatacatttgagatatgaactagctatgaacaaagtgttacagagtaaaagacctgtaaggcctaattggagaacagattagaatcttgtacagttagcatgtttatggtctgtgtaataagtcatgacaggccctagtagatcatcttttagatgttgttcatatctatgaacacatacataatgggagagattgacggctgttgccatcaattacattacattaaaactgatttacataatttccccaatacaaattgcgtgactacaagagtgaagattcttatgaactattttcttttggtggcaggagagtcatttttgaaatctttgaaaagaaggaaggattgaatgtgcctgttgattatattgtgatgttctttttccttccaaaaatgaggagtgggggacatctgtaactctgtgaggataccaggaatgctcatttctgtttcataatgcttactctgttttatcctgatattatagtcttgcttttaaatgtattgggctgaatctctttctttacatttttagtgtgtcctgtacaaacaattcttaatcatttttttcaccatatgtttccttgtggcatggtctgcatgtcccctatttgatcacagtgtggattctgaatttgcacctcccacatgctaagttgacagctgcataacctcaaaacgcattctggcaatgatgaatgccaatattttatgatgacagcccaagaatttgattgcagctgcccactgatataagtggtatctttattatttggtgagttaagcagacacattaagtacatttgttgcaaatactagactgtaaaagaatgtatttctgacttattatagtaaacagtaagaaacaaccaaaatgttcatcaatggaggaatggttaactaaattgcagtatagctataccatggaactccccacaaagaaagtagcctgaactgtgttagactccctatgaagagctttatatgtgttgtttcatttaattctcacaacaaccttgtgatattcccattttataaatgaggacacaaagacttgtccaaagtcacatagtaaattgtgcagcaatagttagacctaagttctatggacctccaaatccattttcttatccagttatactctcctagctcgtaaatgtcaaagctatacatgctgttgattctcttctcatggagattaggttcaagatgaacattaagttatgtaaccacagagaagaggaagagacttagataatagtaaaattaaacctatctaaatgtcaaagctaaattacttccaaatgaggtaagtttcctatcattccatgactgaaaggaaattcaagaatatacaccaaaattctggtaatatgtggtatccaagtcaggattttcatgtattctcagagctgttactctgcttaaaatgtcaaattataagtgaagtaagagaaaagccatgcttttgctcaaatgtaattatcgatactgtaaaatatcacttatatgtttatctttataacttctccttttaatatttacagatggacaaaagagaaagaaatctttaagaaagaaactggattcactaggaaaggagaaaaacaaagacaaaggtaaagggtaaagtacccaatgtaaatgcatcttccatggagcataatggttaaatttggtggggttattgaattgcatagatatacgtggttcaactctgttatgaaaactggatttctacagtggaatgtcattaagggctgttttggtctactcttctgtgtttgagcagccctgtactgaactgatgaattcagctggtttgaggagagtgtgacctcggccaagtttgtggttccaattattattttgaccaatcagctatacataaagaggacctgggttgagaagctatggagagcatctctaatgctaaccagctgtctggcaaatccagacaggcagggttagtttaatgagagtttgaattcacctaccaccactactggaaagaaacagtctcatcctcatgggttactgaagataggccattctcagcattttttttttcacccagttgaaaaatatttatttgcaactaacctgaatgcttacattttactttgttacattgcctcagccaagataggttaaagcaaatgcccttaatattttgggggtcacagagccctttaagaatcattgacaatgatgatgctctatcaaaggcctgaaactcacccaatgcccaccctaccaccccctaaattaagaattcccagattagatattcacttgagttaacaagtattttcctttttaaagatccaggaactttagggaatagtcagtggctattagtttttttgttttgttttgttttgttttgttttgttttgttttgttttttgagacagagtctcgctctgtcacccaggctggagtgcagtggcacgatcttggctcactgcaacgtccaccttccaggttcatgccattctcctgcctcagcctcccgagtagctgggactacaggcgcccaccaccacaaccggcttttttttttttttttttttttttttttgtatttttagtagagacagggtttcaccacgttagccaggatggtctcaatctcctgaccttgtgttccacccgcctcagcctcccaaagtgctgggattacaggcatgatccatcgcgcccggcctagtatttttttttaactcttgttttaggttcaagggtacatgtgcatgtttcttatataggtaaattgtgtgttgcaagagtttgttgtacagattatttcatcacccaggtaagcaccatagtacccaataagtggtttttcaattctcactttcctcccaccctccaccctcaagtaggctccagtgtgtcttgttcccttctttgtgtccatatgaacatgtttagctcccacttgtaagtgaattctcagcatttttatgttagatcacagtatactcatcttttgcttcatatgttttgggaattgtttactctcatcttactgttttgtgtccccttgtgcatatatttaggaaactaaaactttagccactctctgaggtatttatggtcatttaaaactgatattcaagctcacataatggacacctgagccccattgacgcagtccaattttttgtgccttttttttttttcaagacagggtcttgccctgtcgcccaggctggagtgcagtggtgcaatctcggctcactgcaacctctgcctcccaggttcaagcaattctcttgcctcagcctcccaagtagctgggattacaggcacgcaccaccatgctcagctaatttttgtattcttagtagagacgggctttcaccatgttggccaggctggtcttgaactcttgacctcgtgctcctcccgcctcagcctcccaaagtgctgggattacaagcatgagccaccgcactttttgctgcttatttttatagtctgttatgaagtggttgctgaatggtatggttgtatgcatttattttcactttatgtgacacagtcaacgagtcttgaatgagaacagccatacacatctcatcttggagtccttttatataatgatagaatttctgctttaaaagtaatggaaggcgatgaaaccaagggtattaaaacatgcattgggatcagtattggacaagagctattccataccattgatctcagtctctacacctatatcttgaacagtcatgacatttggttctttagactaaaaaaaggtgaagaattctaaagaatggaaaaccattgttttacttcctttggagtgaggttactcaaccttgctactgttgtcattttagactggataattatctggggtaggggctgtcctgtgtattgtgagatgtttagcagcatccctggcctctactcattagatgccagtgacaccaccctcaacccaaatatcttcagacatttcaaatgtttatctcaaattggaaaaaagaaggtgaaagtgtcagtgatccgcacccctgactacacaatagaatcacttgtggaacctttaagaagtccaagacccacaccccagggagtctgagttcgtgttcttcagggatacctcaggcatgggtgtttttaagagcgtctaaagtgcaacttctagataagaattttgatccatattaactaggatactcaccaggccacattctgtcacagcagaatctgctgctggaataatgagggctaagggttgtccagctagctattatagtctgataaattgtgttatatttaattgttgatatgtttgtgcccttatttttgtaatgacctaaatattaatagccagcattgctcttttaaactagagtttttgctcattctattcctgcagtagagcacttttatgtctccagattagagcaattttccatatgtatagagcatattaaagggatcactcaggttggtattagtaatgtattctcttttaaacttggtttattctaggatgatgatattgatattgggattcaaatacatctaatgtggactttaggtgatttttcagaaagtgtccatttggctagactaagcagaatgagcatttttgcaggaggttccctcaacagaatgatgagatgttccctcaacagaaggagatgtatgtttgcttgcatgtattatatatacaaagcagcaggaagcaagaatttgaattaacatggaaggaagggctagggaagtaatcgaacaatacatactgggccattatagattttttaaactaaatcatatttacataggctcagtgaaaactctgaaatgttctatagtgcctcgaaggtagctaagtgggaaaaggaaggcagatcctggtggttccaaagaaaagacatatcacccacccaactaaggggagaaatatcaggcttcatggcaaaacaaaacaaaaaaattttaagtagctttaatgtttaaaaacaaactaacctaggcttaagtgaaggttaattacatggcatcttttcagaacataaagccctgtccatgtcaacactgagagtcattacatggatatcctgggaaccagggtgtgaggaggacggggtgccggtctggcacagatgtaatctattcacattatttccttccagttgcgtattagcatttggatttgtaacagctgcacatgtgaaaaacgatcatttgaatccaagagtaaaagaaggaaaacaggaaactctaaatgatctcttgagttaggtcatctaaaaataaatagaagcagccttttagaatcgaattgctctcccaatagtgattcataaatggttgatatgctaccatattaattgatttcatcagaatgaatcatatcctgtatgttatttaattgccttgatatacagcagatcttgtgacactcctatgttcctcatgccacttaggcagtgcccatgtgacttttgatttacatatgggaactaattcaagattgacactgatcagaaaacatattttcatacagaataattccaagtccttaatttctcttagttatatttcttggcaaccaaaagtgtttttaaaactttcagaacttcagaaaatttctgtgtcaaaagtaattttaaaattaagtaattttaaaaatagctactttgttttattaatgtgcttcctaaactgagcacatggggaataggttttactatgatgtaactctgggagattgtaccccccacaacccctgccaggacattttcagattatgccatatatgtatctacatacaatctggaaagagttcaattctggcactgttctttttggtgaaagcatattgtatcatgttttcttttcctcactgtctaggtatgtaactgtatgtgagctgtgaagtaacactatatacaaatagctcatacaacttttaattttgctccacattaaatagcagaataatcaagttatcagttatcactatgtagaaattctcaaagaacatatattgaatgttgtcattgagtgctagtacttctaggataagaagagaagaaagaaccagggagtgtgtggtttctgagaaggttaggaaggggccagctcacacagtactgggccacagcatgacttctgatttggaagttcaggagaaagataatggtaccttaggctagggtgggagtgatcgtggaagtggagagaagtaaatggaaaaaagagataatgtgaaagtgacatgataaagatttgatgacggagtgaaaatgagatgtaagaaggaatgaagtatcaaggatgactctcagatttctggttctcccacatgaagaacaggcaaacttttggaaatctgagtaagacctgataagggaagatgaagaataagaaatgcctttgggacatccagatatgaaggtggaagaagtggttggtgctcaaggaaggggtctgagctagaggtagcaatgaggtgtgaaatatctatggatggaagtttaagttacgggcatcgtgctgtcacttacagagagagaccagagtgatgaggatggttaagattgagctctgaggaccttccacattgaaaacccaggtagaagatgataagccagaaaaaggggcaagaatgtagccagagaggtagagaaaaacccagttagtatatccaggatgcaaaggacagggagcatttcaggaaatggcgatcagggttaaaggctgacagaagggcaaatgaaacagagctgtcaaaaacactgaatttaatgaccctgaagacagcaatgatttagagggagctgctttagaatctaatggaggtaccagctagacgggatgaagtgaggaaagagtggtaggtgagaaagttataagctagaaagtaaagggaacactttagacaattttaactgtggcaaaaggagagggggtaaaccatggagaaaagaaaagagtgggtcgaaggttgtttatttttttaagaaatagctgcttgaataaatttagtacaaaatatctagtagaaaaaaagaggttgaagatacaggcacaagaagatgtaatttatagcaggggtggcccaccagccgtctttgtaaataaagctttactagaacacagccatgcctattcatttacttactgtctgtggctgctttcctgctaaactggcaggtcgagtagctgctacaaagactgcaacctgccaacagtgcggaggctggagtgagacaaattgagcccctaggctacagaattgaaagaaatgccaagtctgcatgctgactctgcacttgccccacgctgaatgcgagcaccttatcattttgcatcctagccattctaagccccagccgtatccacaaagcctaaaatatttactatctggccctttacagaaaattgctgaacgctatttatacctaagagtattaggataatttttttgagctcttgagtgcagtacaccattatccatggtttaaagttatccatagttgaatggcaggtgggaaagcatgggaaccagggagaggcagaaaggctggcaggatgccaagtcacacctacatctcatgcaaaggagggtggtggagggcacaggtacagcaggtgtgaagagttggagcctttgcacctgctggttgctcttctcctgaaacaggaggcagaattatttgctggtggggaagatctgccccagaggtataagaagtctctaaacgagtctggttggttttccttagatggaaaaaaatgactgggaaagggctcagtagtccctatcttatagtaaatccctgccatgcatatgcccacctgagcagacatgtcacttgctacatttatcaatgttcttttcactcttattatcccctctgtttctgttatttcatgtagctgtcagccttaccatccacatgtttccagactcttccaaccttttaaaagtaatatttgatcatttctacagacaagattatatgtatgtgtgtgtgtgtatgtatgtgtatatatagagatatatctatatagatatatgtatatatatatatatatatatctcctcagggtacataacaggaggtctggtactatcccctttggtttctaattttgctagtagtagacacagcctattatcaatagtgagaattacacctcactacactgtctaaattgatcactcaaaggagaagtacctaattattttttattaccatatatcacctagcttgttgctaaagaatggcaagcatcctctgaaaatcccgaaatactaaagttttgacttttttacttcaaaacaaattgcatgctttgatagaaccagaggtgcaggcttttcaagtagcatttctgcttttaatgtagacttggtcattagcccagtgatgtttgaaatattgccatggatcaaggaggaaaaccttttaaagtctctttctacctgatttaatgttagctttttctttcaaagaacaaccaaccttagaattattttcccttgatcattttagtttcattcatagggcttataaaaacaatggagaggttagattccaacttactgctgctaggagacctaatttggagtctaaaaagaataatacatttgattacattatttagtgcctttcagcatgaatctaaaatattgccaataaaactcctggccctaaggatccaaggtacatgtatacaaacagatttacgacagaaattcagaaaggaactctatgtatgtctccaaataaagccattgatttctgcactatgcccctttccccaaattctccttactaaaggatttaacaaattgtttcctgggcctcccaccagatatttagtggctgagtccactctgcatgtggccagtagaatggcttgagtgtagatcacgagagtgacagccccaacatagctggctggaaatagaatgtagggatgaggaacacaacgaaaacagagtggacttcttcccaaccagttcccaagctgctcctctgcctgtcaggttatcatttcacatgctaactcttactgggaacctcaaagtgtattcagttaactaaatttcagccttagtttcatgcatctctctaacacctgatactcactctgttatcatgatttgcatttctgattatccactccttcaccccaacccacactctgaacacctcaggagaaaggactgtaccttttataagctttgcgcctcccattgcctagcttgttgtggcatgtagtaggcattcaataaatgcctgttgaatgaatggatagacttgaaacatggagaaaaactagagacctaaatgtctaagatgtgtgtttataaatactagttttctttattgaaatggaaacttgggccattctgattaacacaaatgtcacctttttgattgatgagtcaattcttcagaaaacattcctttgaatatgtctgttcttacttaggtctgaaacataaatgagagtgttcactggaccagtcagtctctgaaagtgaatgtctgttttttgattccagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggagggtgaggtggccagtatttgctctgacaccagtgctaggaaaactgaagatgtacagttattctttgcgtttttgttcatgtgaaaactggatatgtagttggtgttcaggtatctgtcaacaatgccattaatgaagaatgtgcactgggcacgtggcaccttgcatagcctcagaccttgtcctgactcctcttgaagctgttgggtgtccctcctttgtcacatctttgctccatgctctcctaaacattcggcaatatcaccattaattctggtctcttgtaatctgtcagtcttgccatacttgcccactagactgtgaggctcgagggcagggcctggtgttttagctattaatactttcttcatcaccagtctgagaacatgcctggccaaatgaattggcggtgggtcttcataaacaatgagctttttctttatcaatggagcatttctttttctcaaacagaaccatagaatcctctatatatcctctttcaaatactctaactatatggtaccaattgttaagtactatgttctaggtactgtgctattatttgaattgttcatgcaaactggttggtgattggctgagtcagttgataagcatctctaaagcttccaggtcactggaagatcttctctcccttttgtaaaacaaatctgcattttatttttatcttttattttttgactcagggtcttgctctgttgcccaggctggagtgcagtggcatgatcactgctcactgcagcttcaatctcccgggctcaagtgatcctcctgcctcaacctccccggtagctgggactacagatgcgcaccaccacgcctagctgttattattattatttttagtagagatgtggtctcattgtgttgcccagactggtcttgaaccttcgaattcaagtgatccaaagtgctgggatcacaggcgtgagccgccacgcctgaccctctctccctttttcctctgtcacgtggagacctgaaatttttgccacctccagctgttgaagactgccctagttaaaaccccagacacttcccacttaaaaccaacatttttcaatcagcccctaacatttagggcttgtccaaggtagagggggacctgatccattgctgtttttgcagtattgactatgtttaaaaatgaagaaattacaaaattatggaattcctgaagttgcatgatggaattgttcttctaattctgtcattgtgtctcagactgtgtattgtcgtacaacaataacactaaaactctaaattttagctttctgggaatgtaggactcaggcaatggttttcccaaatgccctctcgtctgtccaggcctggctagccaactgctttctcagtgcttcatcaagtatgggtgcggcaaatgcgactggtgccctgctccctttccctgaccctttaccattcctagcatgccagctcatcttccatctgccaacaccttatttatttgctgagggctttctctgatgccagaggcacccagcctatccaaatggcaggctgtaagtacttaggagataatattatctctctgcccccaccagaggctacccttaagcagtgattcctgaggcctggtgtataaataccccagctctctcacttgatagggatagctctaaggtgcatgatctacagctgtctcctagagctccccagaaagattgagctccagttgcccacaatgataataggcttgataatgctcccttcatcagctgcctttccttccttgtctcatttcccccctcccctacaggtgtttcccaggaccacttctctaataaagcactttgtgttgtttctcgggaaaactaagctaaggctgttttgtggaatcattctattttaaaaatatacttcctagagccatagttgagttttttatttacaagacttctctgactacctcattgattgagtatgtaatttttttcttgtttcaagaaatgaagtggttgggccaaaatactttaattatatgtttcccatcgcttgttcttccatttggaaaatgttgtctattgttgaaattgtaactgccattagcttgaggaaatcttgtagaggttttctaactttttcaaaaggcatcttttttcttttaatttacaaacagaacaattaaagaaatcaagcagtagtatttcaagtgtgataaagagtcatgagcaaaagtatgtattggttagcatctgggggcagctgggttttttggctatctgtactttatgttcacggctctgtgtcacttgcagggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggtaagtagacttgtctgtctaaagtactaaggactttcatttattcaagcatcattcactgaagtacccaatgtcaattctgcttgatcaaatgatcaagctctgaactgaaatttactgtgtgaaagtgtacagatgtgagtgtttgcttaagagattgtggggctaaacaagattggagaagagggtgaatcaacttgatgatattcagactgcttagctcccagtagtcctcagaagttaccttggaggccaagcagtttagggaatgatcagatctgttgggctgggtttgtcaccaggacctctttcaaacagaccagagccacttttattgtttatacataaaagtagcctaggaggttactcacaaagtttcctttaaaaagtaagagtccaacttaaaaaaaaaattggggaatcattgcttaagtgaatagaaaatacatcatttttgacaacaggtttacatattgctatttgcatttttgtggaagctgtccacttaaaatttctccaagccaccctttgcaactcaattctagttactaagttgacttaagaatgatatacagttcttcaaaaatgtttctgaaatttagacttctggcttattaactgccattttcataaactaagtttgtatgctatagtgtttgttagcacgtgttttatatacatgggaaaagcttaattactttttttaactgtaaaaataatatgctcattgtaataaaaaagtaaacgtgaaagcaaagaaaattctgaggctaccatatagatataactactgttaacattctcatctatttccttctaataaaaatggaactttattttaaaatcattaaggatatatttaaatttcttaattcattacaatggaaatcataggataacatatggatgacctaataaaactaatgtagcaaaatcttatttgtttatacaaaattttaagtgtaggttcttttaatttttttcaccttatctttcacttgcctgtgtatcacctatgtatcttgaatatacatctctttctctatacacacacatacacacacacacacacacacacacacacacacacacagtcatgcaccacataatgacattcccctcattgactgactgcataggcaatggtgattgcataaggttataatactgtatttttactgtacctttactatatttagatacacaaatacttaagattttgttacagttacctacagtattcagcacagtcgcatgctgtacaggtttgtaatgtaggagcactaggctctaccatatggcctaggtgtatagtaggctataccatctagggtggtgtatgtacactctatggtgtttgcacaataatgaaattgcctaatttattgcttctatcactttggaagcttgaaaaccggataatcacactatttagaataaaatacaggattatatttcttcatctgcaaaatgaacgtaagtacccacctcaaaagttgtgcaatgattcaattaattaatgtgcatacagtacttagaatagtacctggcatatattattatatagagagaaatagactctgagtgaactgaatgaatcttctatgtacgaaatagaaaacttcaatagtaggtcacagtaattttaattttggctgcatttatttttttattttcacatggtttctgaataattaaaatttctacagaagcaagatatcacataaggacattttctacacaggtgggactattctctttctaccaagagatagaaaacacaactaaaacaaattgagatgtttactttgtttctggatgtaaagaaataatgttataaagatttaaggctgggcaccgtggctcacgcctgtcatcccaacactttgggaggccaaggcaagaagatcccttgagcctgggagtttgagaccagccagggcaatatagcaagaccccaattctatatttaaaaaaatacaattctttctgatttaattatatattgtactagtcataaatttttcagtggcaagagaaaggaactcagaaaaaactagattaagcaaagtgacctcccccaaataacaacaacaatctttatatactgggagcgtgatctagatttaggcacggctggatccaggattcaaacgatgtcatgagtgtcctctgtttgctggctttattctcagacagttctcttcatgtggcttcaaatggcggttagcagctccaatatcccatcactctcataactgattgtctcaaatgaagagaaaatgagccaccaatgaaagaattaatatacatgatgctcatcaatggcaatgatcaatgactggcatagaaaaaggagagccattcagacgtttcatgctcccaaaggaagtacacaatactttttgtgaagtattcttgccctataaaatcacaccgcaatcagagtaatgtctggctctagctatctctttacagaaaataaaagagggagaagaacatacaaatgacactatggagtgtccaaatccaaacaatatgaagatctacagtaggaaatcactgagatttcttcaccaaaacaattataaggaaaaaggagacagagggaggaaacacagattaagagactaaaaggcacatcgaccatatgacagtgtgtgacctttatgtggatgttgactggaaatttaatgctattaaggaactattgttgaaatttctaatatgtgatagtgaaattacttgtgtttttaagagacctaattttttagaaatgagtttctcaacctcagcactgacactatattttcacatctaggacatgatcctaggaaaagcaatcagaaatgtgaacaaaaacgtgtgcacagaattgttcacaatagggtcatttatagtagaaaaataagcatgtatattttggggacctgtgcaccattcagaggggaatatggagtaaattatggcccattcatacaatagaatattttgcatcttttttatatctccatagattttgggggaacaggtggtatttggttacatgagtaagttctttagtggtggtttgtgagattttggtgcacccatcacccgagcagtatacactacacccaatttgtagtcttttgtcccttttaagtgacatttataaggaattgttactagcatgagtgaaaattcatgcgacacgatagtgagggaaggcagtaacattctctctgtcaatagatattatatatatgcagtgtgatctcaactatgtaaaaatacctacattcatgtagaaaaggctggattttaaaaaatgaaagattagctaggcacagtggctcacacctgtaatctcagcaattttggaggttgaggcaggtggatcgcttgagcctgggaacatggcaaaaccctgtctctccagaaaatacaaaaattagtcaggcatggaggcatgtgctggcagtaccagctaccctggacgctaaggtgggagaatcactgcagcccagaaggtcaagactgcagtgagccgtaatcacgtcactgtactccagcctggacaacaaagtgagaatctatctcaaaaaaaaaaaaaaaaaagaaaaaaggaaaaaaaagaaagaaagaaaagaaaagaaaatgaagagtgattatttctgcatcaggtatttctaaaagtatattatttttacatttttccgcattttctagattttctttaagaagcacactttaattatgatcagacgaacaagaaatatcttttagaaattaataaagagttagaatccctataaaatgtgtgtttaggtaataattctggataatggacaaaagctcattttctctgataaggagaagattagaaatataaaatatcacaagaaaaatatttgatcagaaacatttaacgtaaaattctggtgcttaaagggctgacctttaagtatctggataatagaaatagtgtgagatgaaagaagcattactgtatgctgtcaagttactattgctctacatgttacggcactgtgctggcattctgctctgtattttgatttcctccagggtctcaagccatgaaacaagactgttcattttgtttgcttatttgcaggcctccagacagtggggatattccgagttggaagctcaaaaaagagagtgagacaagtaagtgaaaagtaaagattatattttgtttcacatgactttcaattgaattaccttttgcaaagttcaagtttatgcaaattccattttgattatctttttttttttttttaccctccaagctattataatataattgaattccaggaggtaaaaggcaacaactcagaaatgttgttacagttaggatcaaacacttgaaagcaaaatgtctggatgtatctgtgccacgtgcagccaaacaaaactaatttataaacatcttattgaaaattgcaaaagcaggaaattcagagtgactgatcaataaatgatataaagttgtatgtagcacccgcttttactaaaatgtgatatgaaaaatgccattaacattcccttcacataagatgctatgtttatagctttactttatcaaaaataaataattcttatgaagtttccatagaaccattgacccccagtttgcttttcacatagagactgtgctcctttgtttccttcagccctgtgcaacattcctgcaactgaagtttgatattagaccttcaacaataggttcctgtgatgaggcaggtatttgtgttcatgatggcttcataaaaggcaaaccatcctttgagaaaagagttcatttgttggtgaaggaaaattaaagcattattttcttcctgttgttttcaatggaaggagataaggaactcagcaactcaaaaatgaattcaaatgaaaataaattttagttggaagaagctgaagaaatgatatttgttcatattattgaaagtaattgaaataaatacctcatttatcttttttgtcaagacaaaaaaggctttcaacagaaatatgttttctgattggttggttggtttttattcttaatagttacacaagaaacattaaatggatcaacatttaatgtttcacaacagaacttgcaggaagaaagatagtacagtaacatttctgtgcagaattgcagaatatttttacaaatattatctcactgaatctgccaaccggctgtgagtgtagcccctttgacccacttctgtcaaggcttatagagattaagaaacataattcaagatcacacagtttaaccagtcaccattaacttcataggccaaactctttgcatgttccattctttctgcatgtacgtatactcagaaaagaagcatggtgtgtttgaatgatcacaagttggaggagtgccagtggaagtcttctttgttttggctgcctgacacacgctgatggcgtgctgtctggaatcaatgagtagttcaggacagtgatgggtattcattctcatcaggtggacaggtagcgagtgccagaaattactcatcagttatatcgggatccattaaaggggaaacctttgcatggagttgtatttaaggattacccaataaaaatataattagtgtttacttagaagtagatttcaagtatgaaatatgccctaactcactcatcattttactttgttatataaccccttagcaccctgcactttttccttagatcactagccacaatgttaagagtgaattatttgtgggattacctgcttatcacattgtttctctagagggactttgcctctttactcactagtgtattttgtgagcctgtaacagggtctgacacaggaaatgcgtagtaatctttgttgaatgaatggatggatgaaagattgaaaacaaatgaactcttagagaagttttttgcatagtgtaggtttatgaagttacataattatttctacagcagagaacaatgcatacgaaaagttgagctgctagagataaaagtagggtgtggagttattactcccttgctactgtgttttcttgctgctgcaagtgataatagacctagtataatgattaaggcagggaatccttctggtaattgttaataagactactttgacaaatctaagacagcttttatttagttattgtcatcttttaagtcttagtcataaatgtgttatcagggctcttaatttcatttttgcagaaaaaaaaaatctctttgctttcttatagagtgactcagtaaaatatcaacatccaaacatggcaggattggtgacacacagaaatgctgtgtaatagattaattcctccctcccacatttatagctgacctaaattgtcttctacctcttaggtgttcctcctaacctggttgtcattaccaagcccttctgcatacatcattaacaataaatccacagatagttttatttaataatgcttatatatatatatatatatgtatacatatacatatatatgtatatacatatacaatacatatatatacaatacatatattgtatatatgtatacatatatacatgtgtatactcatatatatacatatatatgtatacacacacacacacacatattcatagctggactgtgtcaactcggcagatcaaggtgaggatgttgtttgcttccccttcttggggtctgtgcagtcttaattccagatgctacgtgtcacagcacttctcctgctgggcactgctcattgaggtatggtgttatgtgactgccactcgaaccattgttcttccagttacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctctgtgcgtaatacagccatatgtgggaaagtggccctggaatactaagatgtccaactcattcatcataactttatgcatatgtttcctgataactttttgtccttatttatcaatctctaaagagtgagctatttgagggaatttctcagatttaccctgggaataattagcaagaagaaagttacaataaaacaaatggaaatagccaagaagaatttgagatgctttcaaataacccaagaacagtaaaaagtactatgagttagtgcttagagtaccaacaagagttcacattgagtctgtgcctaaaaatgagtttgtgtttctggtacgaagaaggagggaaccacgagaacccagagtgagaaaggagggcagcaacattccaggagaagcaagatgccatagcccagtgccagggctttcaacatagctgcttctgggctgtagctacagatcccatgaagaagaaaaaaaggaggaggtagaggagagataggccaaacctgggtcaacctccatacatttcttcctccaatgctgccattcaaataggatcacaacggagagagaagacattggctttgctgtatcttggttattgccaacaaaatatctgtcccttgtgaattgctcaacagaaaagagccttaaatccattataaactcaaatttcagaatgttcaccaattttcagccattgttaataaatatttaccaaaaatggaagactgaaatccttaaactaggtgatgagtaatgccagggaaggggggagaagaaagtaagggaaattgagttaccttttttttttttttacctggattacagttatttttctaggtattacacttctcgaggtctaatttggctttatatctttcatagaatcttgctggtaaattgctaaagcaatgggcaaatgagtgaaggcatgaaatgggaattgccttgataatccctttcttaagacaattgagaggaggcctttcctctgtgcctgaatagtatgggctccccttttatttgagtacctctttttgccttgcttagtgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtaagatgcctttgctgccatagatgccgtgactcttcctctcccctattttaaaagggcataccaccaaaatggccattttgcctggaggtaatgatgtctccccttctccaacctagctgtctctgtaggaagagactaatgcagggccttctctggaggcacagttcctaaaagtgcatgggccatgagcctccttatatgtttcaagtatgcttccaaatgaggctgtcattttccatggtgaggctttactcaagactctgaacttccgtttgtaaagaagaaaaacagtgaactacagaagtgcttgcaaccatgtaaaagtggaatgatgggggtgggaggagattgttatccttataattgattttacctgcttctataacttggagcccaaatatgatgtcacctctttattcttccagtttatccctggagctcccatctgcactatgagcaagaagtctagtgtctccctttcaagggatcctttcctttcttaaactctccccccaaaacagggacttgctcgatgcaagggagggtcagtcctgcttccaaaccaggtgtggaggaaactgggtctgatctgctgaccattgccattgtgtcttgatgtcacatggtatcaactgctcaaagcaggttgtacatagtcccacagactctttagaaatgttcttgttggatctgatccccactcaggccccagtgtgccccccccccgcccaccaaatctaagatcttgggttctggttctctttggttacactcatatatttcaagatttttttttttgtttcacccttggacaaatgagatgctggcttgaattttaagttgcttacttatgggcaacgtatttaatcttcaccttaacaagagacacccccttccctctttgataccatgcagttatacctctccctgacctcggattcctcaggaggttttagactccttaataagctaacatgcactgtaaatcaataagaaggggccagaggcattccaaacttacttaaccacagaaacttttttgtaaattcttgttaaacaaagctcagctgcactgcagcttcagttctgtgtttgtcaaatttctttcccaaagaacgtggttatgtataatttttttcactctaatccagaaaggcaattctgcatttcttctcgtcctcctccttacgggtgtgagaatggaactctcctgacttagccatttatctctatagcagttataattagtgaagccccagatggcttcaggtttcataatgtggcactgacaccttatttcagcatacacagctctttgatgggcatactataattctcataattgttaagtagttttattactcatttggatgccaacctctatcaactacagttataacagaagctgtagcatgatctgcctaattgctgggggaaagcagagctctgtgtttaaaggtactccagttacttctctgacatttcttaagtactgtgtgagaaggagaaaattgggtctcaggtaattaggaaggcattgaggaaagcaaaagttccaatcgaactcattgttgcccttttagaatcattttcagacattctttccattcaattgctgaacaagtctccattgcctatgccaaaaagaagaaaatattcttggacaggtgtaaatgaaacagcatgctggaatattagctaccatttatgtctctccttccatgagctggctttgtgctaggggagatatatatatatatatatatatatatatatatatatatatatatatatatgcatgcaaatacatataaatatataaatatatgcaaatatatatatatatatatatatatatatatatgcaaatcctcttaacaggcaaaagagatatcactgtctccatgtttcagaagtgaaaacttagggccaggggagctaagtaacttacctagcaacccacagagagcttccacttaaggttgtacgagtggcatattagtgcatttcacaactctaggggaggtgccatggaccccatagtcactggagatttgcagagttattaggacagtatcccagtggatgatagaaaaagatcttgaagaaggacaatgtcgttatactggttaatgggttgggttggtccccttactagcaaagtccaagctgtgcatagaacctgagccagtctaagagaaaagacgtacagaataggaattagaagaaaaaaaaaatgtactggggtctaggtcatggtttctcagcctctgcacaattgatatttggagctaggaattctttgtcatggggccgtcctgtgcattgtaggatgtttagcagcatccccggcctcttcccactagatgccagtagcagtacatctcctctcccaccaagttgtgacaaccaaaaatatctccaaacatttccaggtctcccctgaggagaagggttcaaaatcacccctggttgagagcgcttgatagctctttaattcactgaccatgtgttgttagaaaaatctattaaccttcctatacctgggtctcctcatctgaacttgaggaatgaaaattcttcaaccagccttgaagagtggttgagagacctagtttactgtaaggaatatggaattatcctggtgacagtgaagttgtaaaaggaagccagggtttacgagggtttctagacactcttgacctgaacattgcatcaaaatgaaagactaatagccaaagattaaagcagcaggagaaatataaggaaagcattgcttccgtgaaatcgttagcagtgacaggagagcaggcagctctcacagccattgtgaactgtagtaaaggctacggagcagtgaagtactgagggagacaatgggaaattgggccatgttcataaattgctgaatgcctctgtgcagggcaggtggttgattcttttaagctgtgaatccttggaaggattcaactaatgggtgatatgatccacgttgtagattggctagagacaaagggagagtgagttaggaggcttttgtatcaatagtaatatggacaacagcaattcctattataaacatttccatgtaagaatggccttggcgggccaggcgcggtggctcacgcctgtaatcccagcactttgggaggccgaggtgggcggatcacgaggtcaggagatcgagaccatcctggctaacatggtgaaaccctgtctctactaaaaaaatacaaaaaaaattagccgggcgtggtggtgggtgcctgtagtcccagctactcaggaggctgaggcaggagaatggtgtgaacctgggaggcggagcttgcagtgctccgagatcacgccactgcactccagcctgggtgacagagcgagactccatctcaaaaataaataaatgaatgaaagaaagaaagaaagaaagaaagaaagaaagaaagaaagaaagaaagaaagaaagaaagaaaagaaagagaaagaaagaaagaaagaaagaaaaagaaagaaagaaagaaaggaaggaaggaaggaaggaaggaaggaaggaaggaaggaaggaaggaaggaaggaaagaaagaaagaatggccttgggatttgaatcatgcatgtcctgagcatctaccctaggttcctgtaaaccaacgactattgctcagaaattttctaatgactggcctcaggatacaatggcatctaagaggtggaggaggtgaggacacaaggcaaatatagaattagggaatgcactgcagagtcattgcagacattcggagaagtgatgagcatgggccagaaaagttaggaatggcttcatggaggaggttgaatttaagatgcacatcaaagggtgtgtagggattgagtacatggaccacataagcacagcattgggatgggagttagccaaaccccttctgttagaagtcaagggtagagggagaggatcaagagaggagttatttattattttttagttgatttggcatgagcaggtagagaatatggaatgggcagactggagtaaaactaaataccaaattgtaaaatatggtcaaaaaccaatatttttcaacttcttctcttccctatttttttagtatgtattatctatttgttagggtgttgtttggggggattgcaacatagatgaaacctgaagcagattgtcaagaagcttgaaagctcacacaggttctgccagcaccttgctgcataacttgtctttatgaaagagaggaagaggaaggaaaacagagttgggatggggggtggtcttagcttcctcatctacaaaatgaacataatattttctctttgatatgtgcttaaaattcaatgcatcattcactggtgagaccttaaagatgtctaaaagaagggcatgagaaaaattgttgaccaatcagtgcttttttgggaaaaaatagcagtattttattgaattgtggtgttttgctatcttgtgtttgttttgttttcttctattttgtttagtttgctatttgctttgctccttagggaaaagagaaattcccaagtgtaagaaacattgcatttcttcaagaaagaatatagcaggaacaaaattgaaacctcctgagcagtggtttttcagagttcaagaaccccctggcactgcctggaaaatgtggtgtgaatatgcacttgtttggtgagagtccgtagctggcattgagttctcaaagggtctatgaggcaaaaaaagaagttacaaatcaccagtgtagggccatgattactaatctctgaggaggtacatgcctctaggaaatggtggttggctttggaacttagcaagacctgtgtctcccctcaccctcattcagccctgttttaaagctcgttttcccgtttccccatgccatggctgggtctgcccagcaagaggaaacaggaagagatgtagcaatgggatgaagagagtagggctgcctagagtggggccaccagcttcgcttctttctataccatctcctggctctgagctttggacatcacttccctcgtctataaaatagggacaacagcagcagctgtttcttaagcttatagtgagaaagaattgaaatggccagtggaaagcccctagcctggtacctgtacatattagacttttaacagatatgagctattcatatgaagcttagaaatgatctaggatgttcatttagtgaagataaaagttttcttgaattgctagctaattaaaaaatgaagtaatggcctggctcgagtgtacgttgtattacctagacacagccgtatagtatatatataaatatatgctgaaacacatggagaaaaggtggatgttgcctgggagcaactcttctttccctgttaaaaaacaataaaacaaaagaaaccccaaaagtgttaacaaaccccagcagcttggtctgcagctggaatctgtgtgcagttttacagatgggttgtattccattcccagaatagcaacaggagaaggaaagagcggaaacagagctctagattgttctcgtatgaaacattcttttaaaagaaaacaaaatcttccatttgttaatgttttttttaaaaaatgagaaaaccctaatatgactttacaggggtaaggggaaacactccaaatacctctgagttctaaagggaggaatttgaaaatgacacgtatttgattttcaccttaaccatgaatttccaggaaaagaaaaattaaatgaaaacttgtcaatgaaataaaaaacttaccaatgaaataaaacaaagaaaaatgattggacgatcctacataaagggcactttctttgaaattgtcagtgtttatcacatgaaatgatatcccttggaggccaatcattcacctgaaaacagccttgccttctaaaaataatacaactcgtgtaccaagctgggattgcagggcagggcagccaccagctcatgacgccacaggatgagagtggggttcagagggctttgtttcagctgttcattgggactcctgaattctatgctgggcacccaggtgtttctcaaaatctatgtagatcttcccaggcaaaagatccccaccaagcagacgcagttcccatacttatcctgactctcaactgatattgacaagagaaataaaaattcacatagaccagtggttctcaaccaggagcaattttaccccacaggggacctgcgaccatgtctagagataattctggttgtcacaactgtgggttgagggcaggggtgctcctggcatctagtgggctgaggccaggggtgctgttccacatcctgtaatgcacaggacagcccccacagcaaagaatgatctggtattacatgtcactagtgtcgaggtagagaaaccctagcctagagaaacttactcagactctcccgttcacctgaaagaaagacaagtagaaaaaattcccaaacctttgaaaacgttcatattccttattacaacaattcaacttgtaggaatttactcctaaaaagtgctcacccgagctcacaaaatatcttttcaaggatattttttgtaccattgcttataataacagaaaattcaagacgacatcaatgcctattagttgactgtggttaaaaaacatcatggtttattcgtgcagtgggattctaggggccaatgaagcctgaagacaggattttttttttttttgtagtggaaagattattgtagcatgttgttaagagatagtaagcaagttacaaaataatatatggatgtgatcccagttttaaagaagaaaatatcaggtgtacatgtatatatgtgcacaggaaggcataggaatggctgattcttggcagtggtgaaattatgggcatttttttttcttttggcttacctgtgctttctaattattaatatattgaatgtgaataattttttatgcttcaagcaaaaaatagttcccttccttcaccccgtactcccctttagctcctcctacatttcttcttcctccttctctgtgatatcttttgaagaaagtgtctacattcactgtttccacttctgcaactgtggctcattcctgccacaccactgacatgactcttagctgggacatcagaaccatcagagagtccattctggagggaagggtcacatctcgatgaccctctgccacagttgataactcacttgaaactcccctgtcatttcttcttggacacaggtttcttttatggtaacttctcacccattattggcctccttcatcagctgctccttaagggtgctggagtctccaggaaccccttttcagcccttcatgttcctcacttaactgtccttccattttttcatttgttaaaacacaagatccttaccctctgcattatcctcttcaccccctccgtaactttggaagctgctcttcatccctacttcttccttcctagttcagatgctagctgctgtggcctagactgttgtggtatgtcccaggtagtcctacttccttgcatcccccatcccctgttccatagattgctcttcctgaaatgcagattccatttccattctgctctgttcagaatcctcttgcccttagatcacagtttgaattccttggtctgacacatgaagatcatctcacctggcccttgcctgcctttcctgcagaactccctaccacactgagcttcctggggctccatgacgtattttagatgtttctgtctttgcatgtgtggtgctttctccattgtaaaattaccccctagcccagatcctttgcttttcagcctagcaaactctattcttcttttgagagtttgtgcaaatgcttccgcctctgtggtagtgaccctggggcctttggagttgagagctttatactttgtactcattacctgtaagtgataggtttatttcctccctagaatgagagacctttaaaataaggactatgttgtaatcattggaaaaattttaaaataattacaatatatgaaaaatgcccagcctatgataggtgctgagtggatggatcagtggtgagattatgggttgatgaatgaagggatggatggagaaatggatagatggatggatgggtgtcaatatttcttaagtgcaaacaggatagaaattttatgtagtacccattttacaataaacaacttagagttgcaaatttttattcaatatgctattgagatgatcactgaactgtgagcttcaatccaagatattaaagcaaaaggaaaataatgatgccctccatggattctgacagagaggatggcatccttgcaggattaaaaaaaaaaaaggagagtaaaaggtttcattgattgttgaatcacccagtatcttgaaaggcaaacataacaacagtccttgtgttctgttctcttataggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggtaggtggcccttctgtggcaggacatcacagcaaactgcctattggtttcctctggaggcaggatgaaattctagtagaccaccctctggggtgcagtgctgctcactgaattcattggaagtcaggcagtttcagcaggagtagaaatttgcacaactatgatgtcattttgagtttgtgactccatgtttaaacaaacatgccaaattataattttcattttgttgtcctctaaaccatggtcacattttggagtcacttaattataaagcagtgtccttgctcaagacattaataaaacccttctttatggaattgtgtccctcatgaattcatgtattcataagcatcctcagtggtttcacctcctccaaggtcaatcttgacattttacctcctacatgaagcttcacctctccttcctttgtccttcccatgccacttctctgtcccctgaactccattactgttcttactgatgtttatcttgcccaacattgtgtatagtaatttatgaccatttcccctagtagagtataaatgcatttaaaacaaggactgcaccattgttatctcctctccatatcctctgtacacttttggaaagccctccatctggcaggcactcaataaatatttttttgatttgtattgaattaccagttcctgttttccttcatcaaactgcattgcttgctacaacttcccttgaaacattaaaacaaatgccaactctcttctatttctgttcaccactaatattgcatgtcaaaatttacaggaaccttcttcatgttttttctcccatttctcttgtcaatttgcaaacgctataaagcctgcctattccactagagccttttgtggctccttccttcaaccgagaattctagttacctcttttaaatttctttagtagtttgtctacacttatcaagtgctttgcattagatttatgtccatgcttgtcttatactaattactttttgtaaatttgagacccagcagtttagagtatttgccctctgtgtcttacctatgtgattgtgaccaagtaattcaatactcattatgcatcaattctagctttagaaatgggaaaaacaaaatgatgatgtaattctcagggtggtgaccagaatcatttgatacgtgaaagtattgtgcaaactgtagcagtttatgcaactgttaattagtaattatattagttgggtaacacgtgctgcctcaaaagtcagtactttaacacaaacataaatatcactctgacataaagtttaatcaggtgttaagtggacagccttccaggtggtgatttaggaatcccagctccttgtattttgaggctctgacattttttagagttttacgggcaaccccagaaaggtcatccatcttgtccactcaaatctcattggccagaacttatgcacaagccacacttaacttcaagcgaggcttgaaaatgtatcctggttggatccccaggaggaagagcaaatgaaaagttcactgaggtagaatggcatcttgttcctgtttgtgtctctgaagcactgtccctgggttgcacatgctaagctctcaaaaaatgttgaattaataattgactctatataaaatttacacatcagcctaaatcctcataattaactacatatttggatgaatcaaatgtctgaacttttcaacattttcatcaagtttaagtcacatatcatcttgccaagtagtcttggcattacttcatgttctctggatttttttaacaaaataatacttctcatcaaacttaattctattatctaagcaaagttctcctttatatgaaaccacatatcatcgagcatttcttttcaactcagataccaacaaaagttttcctggcttctttgaaaatatagctgctgccattttaattgtgccatccctcttctttccatttcctgccacctgaattactaagaacagtataaaaacatcagtattctaccttttccagcttttcccaaatctgatctttgtttgccattctctgtagggattgatgtcggcattctctcatatttttggtctccagttatagtctttacttctcatagaggcctttcctggccaccttgtctaaaatgcacctccaccctccatcacacacacacacacatcatcactccctatttcctttccctgctttttccccttagcactcaccactgttaacattgggtcttacaaatttctcgtttatgttcgccactccctagaaatgtaaactacatgacaggatgatttttttggtccatttctatctatagtactttctttactgcattacccctgtgcctgggacatggtaggaacacaataaatattggttgaattaatgaatgactcaatggttgttctgtgacatatgatttccatattaccaagccttactccttatacgtatgaaaagatttgggcatggagaaattaaggatacctttcttggagtaagttaaccattaatgtaatcattcttgacctctttagaaggattctggtaatcatatattcagaaaaataacagtggagtgggaggaagagggagacaaatatctcaagtcttggtctatgaaaagaaactgactctggaaccagaaaatttactatcgtcctgtccctgttatatattggctacatgacctcatcttcttctatttctttagttatcaaatactagatttgaatgaatgatagccaagaccccttctagttgtaaaatctgcatggtgctatgccctagcactgacttcccttccttcctttttataaagcacaggagaaaattaatctcatcacattttagattatcttggcatatttggcagttgagaaactagtcggctataccaaggctggtggtttgtcagcaaagctgatctgcatgggtggacaaaaatgtaatcttgtatgtcgctatgttgttttgttttgtttggctttttaaagaagctttcagaattattataattccaaacaaagaaggatgaagctagtcagggcctgatggttaaaagtagttagtaattgtgcagtttcacagtccttgggtttaagagctcggaaagggaggtgtcacttctattagcattagaaaggaagacttgttaggaaaggtagctgtgagcttgtcctggaaggcagaacagacctggaggcagtgattccataaaataactggtggaagggatgtagaagctcacagaggcctggcagggacccaaaatttgttctgggtgttctaacatccttcatttcctgatgctgagactgcctctcccaagtggccactctctgagttaatgggaaagggcggaaaagaacctggcttcgtcctgtaatacagaagaggaacctagatgcagaggttgacacacaatttaagagtctggctaggacagtcttttgcattggttgtttgcttttcaggtactggtttggaaatccttgagctggaaatagatcataatagcagatatcatgaccacagatatcaaaatacgaaggcagtagattataatggtggttctcaaacttgagtgtgcagcagagttgcaaggaaacttagacattcagattcctaggatgcactcccgagaatcagattgagtagcactgggatggggcccagaaataatctgcactttctagtgaagacctccacagagttctggtagtttcctaaccacacctttggaaaccatatcttgggaaacactggtatggtagaaagaccatgtgcattggaatgagctaccaaaattcaaatccctgctcagccacttatttgctatgtaatcttgggccccacagttaacttccctagccaaaagatgaaacaatgtgacctaatttacaggactgttataagaattagaaatgacattttaaggcacctagaacagaattaacatatattaggcattaaaggaagatttctgctattattacattaaagggataaggtgcctgctctatcaaagcgtgtttgggtgttttcttggaaatcaagcccactctgcccactgtgtataatgctgtgacctgatcccacacatatatactcctaggcccttactctgctctttttattccatagcatttattaccttttaacccactatataatttacttatttttatgcttattgaaacctaacagaatacaaaccttataaaggcagagatttttgtttgttctgttcactgacattcataccacctagaaagtatatggcaaaagatgggtgctcagtaattatttgttgaataaatattgcaattctgtattactagaaaaaaaatgtatttttgtttcgattttgtccagtgtccatactgcttatattcccttacctttaaatcatgaccctccacttctgatatcaacacctgttgaaaaactggctaacataaaatgatactctgtgggagcactggaaatcaaggataagaatcattaatatctacacaaagtcattggtattatcctaaccagaaagttctcactgactaagtcattgatacatgaattgttctgaaagttgttacttctgtaactaatattgggaattccagagaaaactcatcattgctcttgggattagtaagaacttcagagcagaatggagaaaactgtcagcttcttctaagggctgatattaaacgattcttactaggacttcttcttaggagaggggcaagaaagagaagacaccacccttgtaagctgatgaaaagtccggagtgcagtggagacgtgggaaagccagtgtgttcccaccccactgagttgtcagcctgaactggggaccagcttagtgcacgtgggaaatttcaaatgagcactactgggagcaagggtcagaggctgtgatgaggattccgagtcagaagccaagctttgctttgtgttctcttcattccctgatgaaaatcgcattttcttaaagccactttgcacaccaagtcaaagagtcaagcattcatccaggtcatcaagcaagaaaccacccctcccagtatatccacataattatatatgatttccatttccttttctatatatcacaaataccactgtctacgtgccagggttgggctactcattacgtacattattggcttgtttaaatctcactaccatttcatgaggagtaagccaagtttgtttgcccaagtgatgcagtgactaaatgaattatttctacagcatgatgcctccttacacaaaagaagaggcattttgatgtggtatctcagatatggagtccatttgtggggaaagaacaagaaaatatgttttagccaatctggaaatgaggaatgaagacctttaacagcagtaatactgctggactaatcatagcacccctgatgttcaggccagcagatggcttccagagccagcaaatgttctgctatagtctgctcacttggccctgtctgtaaagacagaacatgtgtactgtttgtgtcccacaaaggtggaaggaagcagaagcaaattatgcctgaacctttcccactccctttaacctgttgccatggagcaaagactgctgatttctttcatctttgcttgagttatcctccaacatcgttccatgagccctggacccttccactgtatttgttcactaatgtacctgaattgccaaaacatgctgcctgacatgtatcaagcacttgagaaatatttgccgaatttaatgcatcttgaccctcccgtgcacccagaccccttaaattattaaaccacctgtcacaacagagccacgccaaaggttctaagctgggcctgtccttgtttgagcttttgctcccataaacagccaaagtgatttcttttagtgtgtttgttaactacaaaatgccatcatgatttccagtgctatttacttttgctgggttttaaatgctaaagcatccttcttggtcaagtgcaaagtggtggattggtgtggaacatccagtgacaagtgcagtagggctgggtcctgggaatagctcttcaaaaagcccttaatggtttattgtggtgacttagtaaatggagaaaactcaactcataccacttttctctctcagtggtttatggaataaactacctcatagcagttataccccaggcaataattcaaggtttcatttttaatttgatcgggtagattttaattgtgacagttttattctttcatatgtgcagtgtttacatttttttctctgaagcaggaggggccaaagttcttttgatttttggaacagcattatgctttgaaggaactcattaaaatctaaggagttgagtctccagataaacaagaccataaatggtacccttagaaaatatctagaattgttacaaggttgactaaagcccagtagagattttgatgtgaaacaatgaattgtaaatgaagaatcactttgggctgggtttcgtttcttctttttaacatgcagaattgcttgattttttaaaaaatgtaatatgtctttcactacccttctccttagttcccattttgctatatacaaaaatcccagaagcagaaaatgaaaacgttgtttaattattgagctatctttttcaaaaagttttgaagtttttgtattgataagaaaaatagcttaagaacttagaaaaaatctgatgataatcagttgggaaagaaaatgtattttcccactctagaaatgaacagcaagaagactgtgctgcagcatgacataggtaccactgataagtagagagaaacatctagacaagggcaacgtaacacatgcagtccataatcctgggtgattttagattattattatttttagccatttcagcaacattcactgcacatccactgggtagaaatcaccaccctagcttgtattctgaaagagcataaaattgagcaagagagtgtgtaagtgaatgacggggtgagggtcatagaagtgcaggtaagaccttccagagaggaaagagtaggaaggcaaagttagaggaggaaaatgagacatcatttaggaaacatttgactggcaaggagaacaataatcaactgcaaatggctttcgacatcagcatttattatgtgacacagtaaatatgggggggggggcacagtttcagtagctgggtagcactttgctctctctctctctgctctgccatcttcagctgcaaaatggctacagttgataacagcatctcttccagccatcattgcatcaattaatgaagagatgatgtttcttttcatgtacccattttcaatagggaagataaccttttccagaagctcctacatgccccacttcaggtaccagcatgtgcatacgtgatcttgccctagctttgagggaggctagctgaaagaaaactacaaatttctgagcctgtttcagttctgggtaaacaaatcagataatccctgccttcaggaaatttaccttctaatgacttgaatggtgggaagattcaaggtctagccaaaggaactggaagggtgaggctacacagagtctgacttcaagaccattgcagttgaagggccaagaggtcataggctgtaactccagaaattcagagggggattagaagcagaggcatagcaagagaaaatcccataactgagttacccaaaagaagtgttaagcaaaagagaagagagtgcttcttctctgaaagcgaatggatgactgttaataaaaactaataactgcagaataaatattgtccatctccatgttatctgcttttattttttcaagtgtttaacttacttatttcatctatttctaataaaacattttattactagatctctttgcaattggtaatctattttcatttttttttagcgcttttgattcccgtaacaccccccattaagtaaaatgaatatgcatatgttttcagatgtgggaacagaatcctaaagaaggtgattgatgtgtccaagtttatattaattataaacagcagagccaaaactggatttcaggggctgttgcctcagtcagatttttttttacagcatcctaattcctgaaaaggtatgcttaagtcagtggtctacctagatatttctttcttacttatttcaagctgctgtttcctatcagtttatttacttgacttttatttctccattaagtacctaaattaatagagaaataagtgttcatccaatataactgagccagtagtttgaaatttttattaaatgttaggaaacgaaatgtgcagttatagccaaagattagaagaattataggaaaacagtactgggtgctgttgtatgaacattaaaaaatcagtttcaggcatcatttcaaattttttacctcattttcccactgactccaattttctgaatcattcctttattttttagaatgtggtttaatcacatacattttgaagctgccttaaatcactctgtaacaaaatggattataaataaactaatgaattatatacaactgtagttagttttgcataatacataggaaaatattatttgccttcctgtaatacatggatctacaattttaaactatgtcttttttatgcatttgtaaatagtgtctccaagccaaaatggtaccatgggccttttaaaaggaaactgtagatagatttataactgtgacccttcctatttgcatttgttaccaagtaagagtcacatatgctacataaaatagacctcagtaattatgattgctcgcctagttgaatgaggaaaacctctgaattgcagactagcttgacaaaaatttatggaaagttattttttaagtaatgatacttctgaaacctattctaataatgcatccaagttgataatttatcttagacatactacatactctcaaagaattaatattgtcatgcttgcaccactctgaagggcttgcactctaactgtttattctttaattaaatccaagaatggattagtgcttggagcgaaattttttttttttttttgagacagagtctcgctctgtcacccaggctggagtgcagtggcatgatctcggctcactgcaagctccgtctcccggattcacgccattcttctgcctcagcctcccaagtagctgggactacaggggctcaccaccacgcccgactaattttttttttttttgtatttttagtagagacggggtttcaccatgttagccaggatggtctcgatctcctgacctcgtgatctgcccacctcggcctcccaaagtgctaggattacaggcgtgagccaccgcacccagccacgaaattttttattacatgtcaaagcctagcaagttttaaattaaactaactggatgaaaatgcaagtacttttcctaatttgtttatggaattttcttctaaaaaagagatcgggacatacatttttgtcctatattattttttgctctgctgttcattaaaaaaatatgagttctctttcctctcattttcaccctttaggtgttacgtttttaaaaactgttataatagcacatggctgttgggtgatgatctttggaaaaaatacagtaaaaatgatgtctttctgtttaatttatacagtaagagaataatctcacccttgacctaaatatcctgccctttcccttctccccattttcatacccaggccactgcagctggtcacagggttttaaataccatctatatgtgcctcttaaatgtctatgttcaacccagacctctcctatgaactctgaatccttattgccaactatctacaagatacctccttcatttggatgtcttgcaaacctctaaacattatcatatcaaaaccacactccaaaacttgacccccaaccttctcctcctgcagcttctccaaaccagtcaacagcaactccatctttctagttgcctaggccccaagcattgaggtcatcctttcttctccctctccctctcttctctctctctccatccaataaattaatgctattacctctatcctcactatgtccactgtggaaatatttctcatcacctcactgccctggttcaggacccatcatcttatctgggtagatcagcaggccctctctgctctccttgctttatctctggctccatgcattctactctcaactcagcagccagagtgatgctgcttcatgttagtcatctgttcaaaatctccagtggatccccacccactgcaagtaagtgcagaagtccttattatgacccataagactccatgacacctggtcctggccctatgaccccttcctaccacccgcctcctttcctactctcttccagcctcacagacctcctcatcactcttgactcaagacctttatcattggctttcttttccttccttctacctggaatgattttctccaactccttcatcagtttgagttttctgctaaaatgtcagcttctctgggactgacaatcctattgaaaactgcgtcttcccaagcatttctcattgcccttctttgccttgtgtttctctatgtttttcttgtatgtttgtttaatgcccgtctttccatatttgttaccagcttcatgaagacaaggattattgtctgtttggtttgtaactgaattcccagcatccaatacctggcactcaggaagcattcactcaacatttatgcaatgaatgaaaggaagggagggaagagaagacctgagggagaagcacagtggtgctgaagtagagcttgtgtggaatgactgctaggggagaagatgggaaagacagattgaggacagtatgcaagtggatggcttcagccatgggaataaaaagagtttccagtaaatgagtgtcttgaccatggcattctgacaaccacatagagaagaaatgtgctgcacatgttaaggaaatagcagacaaatttgaaagctgttgtatcaaaggttcatcaagtacgtatttttctttgcaatgcaaaactcaaactagcttaagtaatttgaaggctcacatagctgaacaatccacaagcaaatatggcttcagacatagcttgtcccgggactcagatgatatcaagacatcccttttatctctatttcttggtattgtttgctcaattgtcagcgcaatcatcaggcctcatatggatacaggccctgtatcctctcttagaagtctcagggaaaacctccagggttttcattgcctctgatggagtcacatgcccattgctcaggcaactatgatgatctgggaatggaatgctcaatagactttgactacgatacacacttcacccttgagctaaggcttgggtagcagttggtttaccagagggaacgtggggtataactattataagaggagggaaatggagacttttaatgatgaacagatgaccactacaaaaggctaatgagggcttgaacttgagtctctgcagttggaatggaaaagggagaaaagaagtaacagagatgaagtctagtaggcctcctggctctgaatggagagaggatgcagagaagctttagtacaattctgagatcttgagcttgcgtgattagaagttggcaatgtcattaatgaaggttcacgataaagtaggaggaacagatttgtaagagacagaacacatttccttgctttctcatccctgtttttattaataaaattgtttccagattctcagagctcaagaactgtagagttctgcaagaggcaagaagcaaattcttccaccaaccacttattttcagaagacttaaccctgcagttttaaaaagtcttctctctgagctcatgtgtgagagaatcagactgaaattttattttctctcaatagttttgagtttcctttggttgagctatcagcttctatggaataagaaaccacaagtcagagctgggttcaatcatctcttatagaacatttccacacagatgacttagggttgtgaggccatcttctaatgtactgtggatggattaggcttagagaaatatatgatgctcatctatagaactctactggatgcctaacaaattacaaagtgagaaacttttcatcactgatggaccaggtgcaagaaaggagtaaaggcaggcaccgaataataaagtgacatatgcaaatgtagtagccagcaattttttgagtatttaccattgaccaagtactgttttaaagtctcaacatataataagtcatttaatcaccatagcaatgcttcgtggtgagtactgttgttatccccattttacacgtgagcaaactgagatctaggaagatccttgtcgatgtacgttgtcaagggtcccacagctagtgactggcgtggctaagattcaaacccaagcagtctggctcaagggcctgccttcttaataaactgatcatatattccagaactgcccaatacagtcatcatttctgcctgctgccttggcataattataaatgtgaactctagaaagtgcccccattgggcaataaattatggacactatttctctgaaccatgatattttccttattcaaaaccaagaaaatctaacctgagcaataaaggcatccaagtggttcagttgtatctccaggcatatgaggggtgacattttggattgaatatgactattggtaatcatccagttggtcctaagaattaaagcagctgcatgggttggcgtaggtttggttttaaccagcaaatcattctgctgtcttgcagcttttagggctctgttttgtgctacagtaaaattgtcagtgaccatatgttgcctgtttctggaatggttttatttatgcctcaacatttggctccttcaggttcccccagatctccagaacgaagtgctgatcagcctgttagagaccgatcctgatgtcgtggactatttactcagaagaaaggcttcccaatcatcgtgagtattccagtgttccatcttctaaagccgcattggagatttctatttccatttctgagaaattggaaaggtttacataagtacatgcagggtgacctgaagtggaattttggcaactctttggcaattctgatcagtccatctaaccagaaaatgcttcgggtcccatcaatccacttaccaaattagaaaccacattacaagatttttctgttttattttcagctttctctagcctctcagggtccttttgacttcatttacagggaaaaagcacaaattactggcaagggactataatacacgtcaatgattctacttctagaattctgataagcgtgcataggggcccttaaggctgcgcctggatgcatcttgcttgtgcagctttaccagtgggattaacccattatcaaaccacaagacagaccttagctgaggcctaggtgcccatttgaaattagaggtgtgcaccttcttggctctcccactttttatagctagtattattttgataaaaatgcacatgggtttctacatgcactcatgtttgcaattagtaaaatgcaagccatgctgcaggctatggcttgctgccatttttgctcccaaaagaggagcacagagtttttgcattagtcagattttatggttacttccaatctttgctgcagaggcagagggtgtggggatgctgagcatttggcataaccagttaagggcataatatagcatcattaaccaggagtagtatcatcaccaggacaccaaacaataaatttgtgacaggaaaagttgttgctatgctcttacaaaattatcacttttgttatacttttaacctactaaatttcagcaattctaagatacgtttctcccatgacctatgatctctgaaattgagactaatcttataaccaatgataagctcctaacgtaatcccgtacctgtaaccccagcactttgggatgccgaggcgggcagatcacctgaggtcaggagttcgagaccaacctggccaacatggctaaaccccctctctactaaaaatacaaaaattagccaggcgtagtgacaggtgcctgtaatcccagctactcgtgaggctgagatgggagaatcgcttgaactggggaggtggaagttgcagtgagccgagactgcaccactgcactccagcctgggtgacagagtgagactctgtctcataataataaataaataaacaaataaataaaataatggcatgtcttaatcgatggtgtcttataaacagtaacacatgttaagttattcctgtatattggtgttgaacttgataaattaattttcactcatgattattgcagatacttaaaaagttatattatttagaaaaatttggtgaaaaggaattccatgttgttcaacctccttctttcccaggtcattacgttgatagcacagctaaattcagcttcactccatttccagcttagcagggaagaccttttaattggattatcctttcagatctactttaaaaaatctgtgtctgggccattcattatcaggccaaattctgattcaaataggaccaaattctgttgaaagtaaggcctggattcaagccccaagagccatgagtgaataaaattatattcaaattgtatagatgagctagtattttatggtcttgcttttcatatcagagaattaggcttacatttaaatttttcctagatttctaaccctcatcaaggtataagtcctaatttatattaacaaatggcttttcttttcagcagatcatgcaccaccataattttgataaactcatttatttccctcccttgtacagaaaagagacatgctggcatttccatttatgagcccctcatttaaactgcacttataacatatggttggtactgtgtgggaaagctacaaaacacacacttttgaggaaaaccactgatttttgcctggccaaatttctgcttttgtgtggcattatgagatagataaatactatactttaaagaacagttgatagaagtttttttacatggttttcaaatacactctttgcatataaatgctgtggtaaaaagcgaacctttctttctcttctattaggaaaaggaagaagcacacatattaagcccattccaagctgtacaattgtccagccccttctgttccctatccgtaagagtaagaagtagaattttaaagtgtaggtgagcagaccctagaccaagatcttaggtgagtgtcagggcttccaagaaaatagcaaagacttggaaccaacccaaatgtccaacaacgatagactggattaagaaaatgtggcacatatacatcatggaatactatgcagccataaaaaatgaagagttcatgtcctttgtagggacatggatgaagctggaaaccatcattctcagcaaactatcgcaaggacagaaacaccaaacaccgcatgttctcactcataggtgggaattgaacaatgagaacacatggacacaggaaggggaacatcacactccggggtctgttgtgggatggggggaggggggaggaatagcattaggagatatacctaatgctaaatgacgagttaatgggtgcagcacaccaacatggcacatgcatgcatatgtaacaaacctgcacattgtgcacatgtaccctaaaacttaaagtataataataataaaataaaaagaagaatgagcccataggagctctgtgtatgtcagagactagcattatcagtgaacagaaaacactgggggaagacttacttaggagaagaaagtgtttggtttttgtttgtgttcctctaggtacaggccaaggaacagcccagaaggcagagaatgatgtcatgaagtaaaaatgcatatgttaataaatgagtgtttacttttagtggtcttttgaggcttgagctccagagtgctacccctctagctgtagttgcctttttttttttttttttttttttttgagatcgagtctcgctctgtcacccaggctggagtacagtggcacaatctcggctcactgcaatccccacctcccgggttcaaacgattctcctgcctcagcctcccaagtagctgagattacaggtgcatgccaccacacctggctaatttatgtatttttagtagagacggggtttcactatgttggccagactggtctcgaactcctgaccttgtgatccatccgcctcagcctcccaaagtaggtggtctttttgtgttttaaactcactcactcatgcttctcaaactttactatgcatgggtatcaccagatcttgttaaaatgctctttctgaatcagtaggactcggggaggtagtctatgaatctgaatttctaacaagctcccaagtgatcctgatactactggtccatgatccacactttgagtttaaaaagcttaaaatatcaaagtatattcttgcttttaggagctttcagacttgttggaggaggcctccaagggtagaatgccaaacaataggtgctggcccactggctgtcagactcaccagccccttggaatcacctgggagcctgaagaacaactatgcctgggccacccctcagagattctggttcattttcataggctgcaatctggacattcggatttttgtttaaagtctcttgcatgattttaatgagcaaccagggttaagaacctctagcttagatctaccacgttggatatcacaaatttactatcatgtgggagtttgagctgggtgatttttgacattaaaaaggcatccttgtgttgacaaaggaagggaatcaatgctccagaccatgaatccacttggagtttggagaaggaaaagaggtgtgatttgaagtctcagagatagcttctgagaagaggaaggatttgcagtgaactttgaagactgtggaggatataaacaagcctggatatttggggagcttgcaccaggacctggacataacagtaaatatgttggctagctggggtcacaataaagaggctggccagcagtgaaggtagaagcccttaaatggcaggctgaggggtggtgcttaagtcaagaagcagtgacaatagattactgtaaggctaaattatagtaaattacagtaccctaaactgccagatggtgctggctgcattggcaagtcaattatccatcagtaacacatgtttgtgtagtcagttatctgtcaataacacatgcttgtgtagtttaatagactggttaccatttcagatccagagccagattgcctacgtttcaattccatttctattgctattatatatgcggtctattagttaagagttaatatctgttaatacatagatagatctctctctctagtttcctcatctgtaaactagagataaaaagtagcaccaacttaaatacagaattatgctcttagtgtatagtctggtatatcataaacatcaccaatttgctcatttacaactacttaccaaaggcgtggccatcactagattctactttggttttcatgagatagcaaccttccaggcaatatgacacaagagagaacccgttcactttaagttatagcattgtgtctaaaagcaaacactatatttgcttctaaccctttgatttttttttcctgaagcttctgttctctgccaccagttcacatacctaaacaaagctttacattcctgtgaggccaagtggaaactgcacaagattttatttggaggggaaaagaaacaagtttcaaaagagtgtaaaaccaagaacaagaaaatattataatttctgttttgaaagagcaaacatttagtgatatttgggaacttaatattttgttttgatttgggtttttcacttctttatgcaacatcggtattggaggagttaaaggataattccttgttttttctcgtgcttgtctgcttaagtatttggcttcaaccaaaacgggatgccagagggggattagaagagatttttatgactaagaatgcaagaccaggagtctgtgaccagcctggtcaccacagcaagaccccatctctactaaagaaaaatttaaaagttatctgggcatggtggctcatgcctgtactcccagctactcgggaggatgaggcaggaggatcacctgagcccggggttttgtggctgcagtgagccaagattaggccactgcactccaacctgggcaacagagtgagaccttgtctctagggggaaaaaaaaaaaaaaagaaagcaagactttgatttttaaaaatatatacttgtcaggtatgtttactagcattatatatgctcttttcttcaaaggtacttaaaatagttcccctaccctttgatttaaggatgtgaggaaatagggaatgagaatgggaggttaatcaaacaggacaggatatgttgaatgtgaatatttgcaacaaaacaaaggaatcacagtaggactgggacttagtgagaggcaagtgagacgcttgcctagacacagaatttaagggaatgccagaaaactcagtcagcaaaattgattatattgcaatgtaatattttttaaaaatccaagctaatgccaaaaatgtttgataaagaaaatatcaaaattttaaaaagactagccatgcttagtcatagaacctgaaacaaaaggtaaaatatgtgctgctgccttaaatggaagcaactcataagtcatatttattttttgagacagggtctcgctctgtcacccaggctggagtgcagtggcacgaccatggttcattgcagcctcaaccgcctgggctcaagcgatcttcctgcctcagctcccaaagcaagattttcaaaatctactttgtttatcttggttccaactgagagaattgctatgtttgacagtttctcttgaccaagtgacaatcttaaataagttctaactaaattaacctgaaataaaataataaggaaattctgtttgggcatacataaaacatttaaatttaatataaatattataggttcgaatgtatcttcttttcaatttttcaattttttcaactgctttgatgttctgggaaaaaaaaatatacacaaaaccatgtatatagaggtacacagttttcttttgcctgaggcatctcgggcccctaagttccgcataagggatgctttgcagaactaagcatgattaatgtgaaaatcccccataaatccagagctcaggagagctcagcagagctcagatcatctgtgacacagtaactagtttcagcaacaggtcttgtaatttttaaatataggcttgaggaaacatataaagatttgctcttattctatcaaacctcaggggctccccagaaatagaatattaattaaataaggctaagtaaagtatcttcccttctatactctggaaacaagatcaaaatagaacaaatttaactgcatttggagagaaggcagatatggatgaactaaactcaggtatatatatttaaatttcattgtggttaattctattagtagccttcacaaagtttttactggaaaaaaaattaaactaaaattaattttaaaaattagcaaaactggtgactagtgtatcaagagcatggttgaagatctgtactagtctgaaaaaaaataaaatttcagtactgaaaaataattgtattgtttagctagatgttcatcttattgaatgacaaatctgccttcttcattctgggggagcattaggctttcttctaatttaaaggtatcacatttaacttaccaaatatcacatagatcatttcttttaatctttcaaagctcatcattaaaaatatcttttttcacaaacatggagtgttatgtgacagattataatttctgtttttcttttactaggatttttcatatcagaaagggtttcaggaaattttcagacaagaaatctaactttaccagtacaatgtaacagcaaagagtcctattgagtggcggtagctgttggcctcaataccctggaaattatgaagcattaactgcccctgcccccctcccccaacacacatactccattcaagaaagtctttccagccagatagttttagaaaaagcttatgtggaatagagaattccataatgaaaaattctaaaatgtgtgcatatatgccttctatggaaaggcattcaagatggagggagaatgtatcacattaccccttccttcctcacaccttcactatgattcacagcttctttataaatttgcagaatgttaatttgaagatgtttttatcaggccctctgtaaataatgaaaacaacactgtctgatcttcacctgtcataagtgctccatttgccagagacattaggagggaattaataaggactaaaaatgaggggaaaaatttcaccaaaggcttatgcccagggtgttagcttcatcatccagtggagagtttagagccatgtcagttcctctttgaagtggggtacctttatccctagcaatctgtcaaagggaggctttgtagaactgatggtgattaatgtgcacattcttcatgattccaaagctgctccagcagtggattcctttcccagtaccattgatataatccaagatggatgatacaatgctttcagttccaacagactggaacttatcagtcatatgattaagccaaggatgaagccaacacacatttgaaacctccacagttcttcttgctggggtagctcagcaaggtgctgggcgggccccatccggtgattgaaccggagttttccatttgtccccagaacaagttctgtgcttccggctgcagtgcaggcctgcccacagtaccctgccagcatgtttacgccctgacctggagggaccagctaagggtgagaatgtgactcgctctccatgcccatcccttgcttgtctggttagctgagattggccatgcatgctgtatgtagatggtcctggggtttgggggtctaacggggaaaccctccatgcatggaggcaaacccatgtagactggtgacctgtccacccaacctcaatccatgatgctctgagactggaaagagaagccaccaggcacttttggatgccaacttatgtcaactggcaactcattcacccaacattctgaacctcaatccatcaaactccaagacatacaaagagatgtcactatgtgcttttagactattcctcatctagtgaatcactgatcagagtaaaaatttcatgtaaatagatacatgagtattttaatgcctttatttgggaccctgaactcaaaactatcttcttagggttggattatcctagagtcaaatctgagagaaaacattgtggttgcttatctcatttttcggacatatccaaaagatggtatggttttctagatttgacactgagtgtcctgtggaaaatcactaaaacctcccctcctgggcccatttctccaccagtgttcagaaattagagtgctgccaattggaactggtttgtaggaaggtaatgcccactcaagaagctcccagagctgactcacaatgatgggttttagccaccatcaggcaccctggtcctggcagacaaccacttctctgacagttgtagcctgaaaggtagtttttctttcttttctcacttttatctctaggtttcagggtcagagaaatttcctttcctataaacttttaccatccacatttccactacactacacccggatttattcacaccctgtcttcttgcagaatttctggattataagaatttgttttttgatttgtgatttttatatggaaaatcttacagaactttatagattttacctgatttataaatttgacaagctgcttttacaatagcttccataaacttagaaatgtttcagaaactgggatagaatagaaagatttagaagtggaaaatggaaaatggacagacacaggaagcacaggtgtgtaatgaaggtatccacaatgactggatgcccagcccccattacaggagagacatgctctgaaaggccctcacaattctgcttccaagtctctggaaatttctccggactccagcctccattcagcaatcctactctctctctgttctgtgtctttacttccaattgtatcacctaagtgggtgtatgtgtatatgcatgtgtatatagttgcatttatgtgtatatgtaatatgtgtctgtgtatatgtgtacatgtctatgtcatatttgtgtgtgtgtatatgtgtttatgaatatgtatatgtgtgcatatgttgatgcatgtatatgtatgtgttcatatgttgatgcatgtatatgtatgtgtttatgtctgaatatgtatatgtatgtgcgtgtgtgttgggtatgtatgtatatgtgagtatgtgtatatatgttgatcctggatttgcttctgacagatataaaacaatagaatgacactatttttttaaaaaatctatgaactgcctatgttgttatgagagttctgaggagtgaataaaacagcttttttttttaatcggtgtgctttcatgtgagaagataattcttggacataggttcttaggcaaatttggctgccacttcctgacctctgctaagacaataaaatgatagggaaatattttaaacattttaaaaggctattaactctaagtaagaaagagcattttactactgatttgtaataatgttgaacactatctaccaaataaattctagaagaatcccaaccctaactgcctctgctgctagagagcatggtattcagcattcagtcagctccttgtttctttcactcaatcccagactcaggtcaggaaaaaggagagttgttaacagtagcttagtacagtgcctgccacataattaactctgtataaatattaacttttactctcctcacaggccaaggggatatttcacataagtatatttcccaaactgcttgccatgtgtactcacactgtatctcctcccatggctgggatacactggggggtggggaaactgtgaaaagaagacatcgtctctcattggatgccccctctgtctatgtccctggctgtgaccccagccatcccaaggaggttcagagcctgtgtctactatgagacacctcatctacctctacctccagggattcgcttcagccacccccactgtttcctccctgatggagggcccagctgtggtcactttgccggcttgacttaggagactgaaccagaagagcagagaacactacactggtacttcctacccccctttcacttcaaaatgttctgatccacaatgggactacactacattcagttgtctggatcctgcttaaggcagacagaggaggtccaggaatcggctgggatggggacacccttcctccttctcctaactgtggcctcagtcaccccaaggtcaggaccaccacattcactcccagggcagccaatgctgcagttttggctaccatctttggtttccctcctgatttggctcttagcagacctttagcccactgtcacatctacagattgagagaggaaaataaggtttggttattagaggttcccaaacatccccgtgcatcagaatcacctggagggattctttaaaaaatttgctggccccaccctgagtttcccttttaataggcagagctgactttcagggctgtgactccacactcagaagaagcccacatttggtttactgatttgcagtggccatcttgaaatgcttaacgctttttaaacacggggcatcacatgttcattttgcactgggctccacaaatggtgtagccagtcctgtcagtaggtccagaatggagctgtagaattggcattgccaacaagttcccaggtgagacagatgcagccaccctgggatgcacttcacaaccactcaatgagatcttgcagacctggaaaatcatcctcatagcagtcctctggctccttcccataagattacgtgatgagagttcaaagaggaggcaaggaaggggcttctttattccatgttggtaggaaatgtcctcagcaaaagggttcaggcccgtgtttgcctcagttacggctgtggcagtatcacagaagctgggatgtttttcccggcgatattaacccctgctggaaacctcagaggaagctagatccctgtgaatgcacttcctccagtttgcatgcacaaaaccatttggttaggaaagtgttgttcaggcatgtgtttaccttctttaagaaataaaaaggatttgttttgaaaaattaagccaaaagagagcaaagactagtaaagagaagtgaagtaagggggaaaagatgtaggttctggaacttttaatcaatctgtgattgtttcccttcaagatgttgtcagggccagttttgaggagggtagaaaagaaagatgtttccaggtaagacttcccatgctcttttcacgttgctcaagttctcatttttctgttccacatacattttcactgttatttctgtttctgtgacaactcatgaacacagaactatgataatggtatactaattagtacatcatatcagtttgtaaaagcactagtgccttgtagaatcattttagatgtatttgaataaaatggagtctagtgagggtcatatatttattgtttttgtcactactttatacatgaaacacttattcccaccggtggcatcaacatctttatcacatgaaggatggatttatttacactaagtacagtaagtattttggtgggatggaaaagttgtccagaaagccataatgaacttcaagcaaagtgtcaaccatagttttatctgaattatttttaatgcaggatattgaggaaagtgaaagagttatctactagtgtatccttacctaatagatagtgagcatcagactttcacttaaaaatggaagcaggaatgagtccctgaggcacttagcgatgcccattggcaaatgcagggctccttgtcggtttcattctcaccgtgccttctccatcattgccttttcctgttatatctgttgggttttactgccctctgctggtcatatcgttgaaaccctttcacgtcatggatgtacatgtcttggaacattgctcaaaatggtctttttgtttcagcccgtgtccacgcatactcctccagtcatttgtgtaatagccatattgtttaaatctggtcactacttgttaacaaactcacgcacctgtaattgtctcattgtgccagaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataacagtatttaattcattgagtttaatgaactaatccatgtaaagccctcaacgcagcacttcaaatgtaatacgcactcgataatacttgctgtgtaatcttgtgtgcatttcttacctgctccttacgctagttgcatcgtctgtaaaatgatctgctgggaacctcctagggatgaagtgagataacgcatgtgaactgctgaacacgtggaggcacccagtagacgtctgctgctataaatcgtaattataatcccatcatgggattgtagtgaggattaaatgagatggtgaaaaagcctaatgtagtgccttactccataaatattgatggataagctaaggggatttatgagtgaatgcatgcatgaagaaatccagtgataccaatagcaaagtattcctgaggatagtacagaaactctattgttcctctagttctgtgttaatgtgtttagcacctataaagctgttgtcacccatcacccttctattcatttcctataacatgcaaacttattattttatggttctggaggtgagaagtctaaaatgggtccacagggcctctttcccttctggacgtcctagggcacaatcgttttcttgccttttctagcttctagaagctgctgcattccttggctcgaggccccttcctccatcttttaagccaacagtctagcaacatcttctctcctacccctctcttataaggacccttgtaattatattggccccatccagataatccaggaaaatctccccatctcaagaaccataatttaatcacacctgcaaagcccttttcgaaaataacatctttgtagatttgtgggattatgacacagatatctttgggggggcccttattctgtctaccacgagcatgatatagaaagggcctttttgtaaatcccaagtagaatgaacacgctgaaaggtggatctgaattgtattctgttttgtatacaacaggatcttgaatacaatactttgcacagaagagatgttattaaaatgttcattgatttttaattttccttttgtgttatatacctttttatacactttttccctagatctgtcagaggagcctttcgatatctggggaacttggcattcaacattaaaaagcggatccaaagacccaggaatgacaggtgaagtattaattttaaactttattgcatttacttttaaaattattttctaaagttttctttactatcattatattacatgcttgtcaaacattacttgggaaatgctgaaaatgggaggggatgaaactatccttaggctttccacccaaatatgccaatctttgactatatttttttccatttcctttgcaaaggttttcatagttacagtcactctgtctgtgcaactttgtattattttctaacttccattttccagttactctccattatcctttttaagggccaggggtattccacagagtgcataatcatagcttacaaaccaatactaagtcatttgaaattttttgttattgttgtaataagttacactttcaggagcctcttttatgtaattaatttttcaaattattaatagattcacaaaattttggaaagcaagtcaaaggttataaatcccaaacagggaagtgcgtcaaatataacaaggctttccaagaatctggaggtacagtcacctcctgtgctgtatgggacccactaccttacattctgtaaactgtggatggcaggagattttacactgctgtgtgcaaatctcatcagtattgcaagttagtgggttttcacttttgctaacttaaaaaacaaaattgcatttgttaatttgatttgcatttctttcctaccagtatttttcagtgtttctattaatttgctgaacttccccccattgaattgttacttatatcatttcctatttatgtatgccagtgttttttaaattcttatgaactctttatataataaagatgttaactctttttccatattgtttacttacttgcattttctttttttacataattaattttatcactgtctcttctctgtgaattctttcataaaattaatcttcagttcagcgttggatagtcagtcatctgtatgcgtttctttttaatgtcatttcattgtttcaaccttaatttttttaatccatctggaatacatgttatatatggtataaaatgtgtaaattatttgtttggttgttttatatttatatttatattccctttctcattgttttgtaatatctcccatattacattttaaaagcacagtgcatttttaaatgtaatgccctctagtgctgattccttttctaactatatctcactgtatcctgtgaagagccttactccattttccttttccagtttcagctgtcacctgtttcagctatcatttgtttctttgtaaatactcacatcccccactcccctgtccccaacatggccttgttcttgttccttgtctgctttttaagaagtggagggcagagcagattcataggaaaatggtagtctgggtacacatgccccaaggactcctcctttgccttgcaaaatgcactgttatttctttcccttcagtttcctaaagaaagttgtatcctttagggaaagctaactgctgtaacaactccgaaatggggcagtggcttaacctattacaactggatttctccctcactgtcccagtacagtgtggactgtgaggggtgaggaggggcgggagtgtgtgaggggagggaatgctgtcttccacatagtcactaaggggcccagcctaggctccacatatccagtggctccaccatcctcagagccccgggagtcttccaagagtttcagagcctagagagtcttcatgctgggctggtagttaagggaagggggaaagcaaagatcagtaggaaggcattcgtttagttttttttttttaatttttttttttttttttgtgacggagtctcactctgtcacccaggctggagtgcagtggcgcgatctcggctcactgcaagctccgcctcccgggttcatgccattttcctgccttagcctcccaagtagctgggactacaggcacccaccaccacacctggctaattttttgtatttttagtggagacggggtttcactgtgttagccagggtggtttaatttttttttttatttttttttttagttcaggcctagaaatggcttacatcacatctgtccacatttgttgcccagacctcatttctgtggccctcctaactgccagagaggctggaaactgccatgtaggaagtaaaggggaacgattgggtgatcaccaagtcagcctttcctgcattgatggtaggagaatatgcatagtggctggcctgccttctggcatggaatggggtacttgagattcaagtaacttcattgatgcaatagaaacatgaaaacattataatttgtatctctcctggattacagattgcattgaacaagaagggaatgcttctttcaccttctggattctgaaaagttttcccagccatgtagaggggccctttcctgaaacacaaattggtggcaaagccaattattaatatagtctgacgtctcagctaacctgtcagagtctaggcatatgaattgagccgataatcaaaaagcatttgtctttttttgttttgctgggaaggttgttttcttcaggtagcagcagctaagagcatactgtgctgtttcagttttagaagtccggggggacgtcgtagaagtgggaaggaaataacaggatttgaatccccagcaaggattctacaaactgattccatttcttgggctttctctctggcttccaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaa

SEQ ID NO: 3027 - DNA, 528157 bp, human; identical to SEQ ID NO: 3026

SEQ ID NO: 3028 - DNA, 522304 bp, human
ggctgggctgcgaatagcgtgttcctctccggcggaacacacacacccggccttggggctgtctcctgagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggccgcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccactgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgaggtagggaccagcgctgcgcgtcccacggcccaaggaggaggcccccaggcagtttcaggagaccgcctttaattccattacatttacagagcaaggcacccactaaggggtttccgtggtgtgggttttcctcttctacttgctaaatggtgcctggaaatgggatgtccctagtggccacccgcttgtgcgtcttgtaggacttgttggctctactttggagcagtcgtgggagctggagaaagagatggtgttctggttttctgttagtgctgcaggcaatttcaaagggtcaccttatcccttcacccaatgttgatattttttccaactcaaatatctattgctaagctgtttgtaacgattggatgaaatatattttgaaatatgtctgccatcttgttctgtagagaattcagaaacattattttggagggtgtcattgactgtatgagtgagtgtgtgtgtgtgtttgggtggcaggggggacaagaattctctagttttcaccttttctttccctgaaggggcaatttcagaaatctatggtactgagtattagtttaacctaggagaagaagaaaatctctgtgtaggggtgtgaaagatcatggaaatatgctgatgcctaaattccatttagaacaattagtagtttagtgaagaatcaacaatacataggggactcagagggagctatcagatacccttaaaatatttgctgtccagttaagaaaaatagtgaattgacctattgggaaactgtcactgatgggcgctttgaaaataacacactttcagagaatagtaattgttttaaaaatgaacagcccctatccccttcggtccacaaactctataggtttgccttggatctgtttccataagggaagggagattccatcagttgtaatttaatattttaaagtacagttagcattacagaaatgaaatgaaataccatgtaattgctggagatttaggctaaatacacaaccaaggaaaaccgtttgaaaatagcatctgagatcatactcagctgtgttaatgtgagataactgttagactttggctttagtaaaccgccttagaaaaataagcatcatttatcagaattattagcatcacatattattaatgttagttactgtgtcaaagtaactgaggctgttaggtgttgggggtgcagattacaaaaaactaacaaattttgctaggtcttttgcccattttcttgagaaagataggcagtagaaaggaaagtcgaggcagagggcaagatgttacctccaaaccagggaactcaagattagaaagagcatcaaaaattgaaatgttgaatttctcttggtctttaggaggggctggattctcattgtatttcagaagcacacattatcagattaatctgtacaagttgagagaaagagaaatacaaaagcaagccagcattttggattagctagctaacattcgtgcttaaaactaattgcatcattaagaacatttctgcttttcttagcaaccatatacatacttggaatatagtatacagatgctgctcattactgttatgaccaaaaggcatgtggctgtagatgatttcacttgttgcaaattatcttcttatccattagcatctcataattaatggacaaggatctgaactgcagtgatactgggtggcttctattccatacagtgggcagtctgcacaaaactcatctaccatgatttttaccttttcatggtggttaaaactaaggatgtagccatctagcaaaaagccagaattttctcatagaatatgtgtgtatgtgtgtgtgtgtgtgttggaaattcctttatgcttgaggcaggcatggagtgattggatagaactctagcatgtagctccaaccctggttttgtttaataaaggccaagatatcctaacataacccttggatctctaatttaatggcctggattacctttcaaaggtttaacgccctggaaccctctgaaaaaccaagaaaatgtatcctattgggcactgcctgtccttttcacttgcaggcaagctgagtctttggtccttaaaggagagtctttactaatgacatcaaaatgtcagccaatgagcatcttgcaaggctgcttagaggccctggagggaatatctggttcatatagatttggttcttgaacttttctggttgctctggctcagggtttctcagccttggcactattgacatttgaagctgaatgattctttgctacagagctgtcctgggtattgcggggtatttagcagcacccctggcctcttcccactagatgcgagtagcactcctccagaccagtgtgacaacaaacaatgtctctagacactgctgaatatcctctggggatcaaaatcgccctaactgagaactgctgcgttagtgaggttgcccatagtaccccatgctggccatcaagagagtgcccacagaagtgtttacagctggcctaaactttgttggcgccttcgtttgattccaaaaccacgaggatccctctggagtcatgtaccccttacagtctgttcaaattttctatttctcttccattgaatccatatgaaatcctaagaattcaccttcaggtttagccattgatggatctcatccatttcccactttgttctttcagaatcttgtctgcttttaacgtaaattgtccatacaacagcccctgctcccaagactctcacaaatgcctgcagctttgttacttgtgctcgttcaaagcttacaaatgaccattttatggcctaaacctgggaagtgttaggcaaagtcagctacgatcttgttagcatttcctcactacgtgtttcaggattgctttaacaaaatctgattcctggacatgctgggtagatcatctattgagtagaaacatggaggagacaaagggtaaatggtacgtggtaacacagttggaacgtgtttctcaacttgtgttcttagcagccaagctctgcccctgactctgatcacaggcaaaggaataaagtctcatttcaatcctgagcttctcctaattcttgtggatcagagctgggattatgtccatagctaacctggagtttgccaacttttgcaacccataattaaaatgatttctatatatcactggcgtctatacttttcttcattcatggcacaagcatttcttgagcatacgcatttctgtaggtactaggaatgcagagaggctaaagagctcatagtctaatgaggggacaggtgagttaactgatagggggaatacagaagatcagcagaatgagggaacagagaggggcgggtgatgattcactgtgctttggggggccttgaaaggcttcactgtccagagaacatttaaacttgatcttcaaagatgactgccatttctaaggagaagaaggaaagtgatgccttcatgaggcagaaaagagtggacaggcaaaggcgcagaggtgttggtgattctacagctcccaaaaaagaagacttagagggccctaagcgcaataatttgtttggaggagcaggttagggcacctgcagtttgatacacgtacaaccacatggcttttcatgtaataaaagcctgaccgaataaagtcagaaatcagacctgttgggttttttttttttttttttttttttttttttttttttttttttttttttgagagagagagagtctcaccctgttgcccaggctagagtgcggtggcacgatctcagctcaatgcaacctcccatgttcaagcgattctcctgcctcagcctccccagtagctgcgactacaggcatgcaccagtagagactgggtttcactatgttggccaggctggtcttgaactcctggcctcaagccatctgcctgcctcaccctcccaaagtgctaggattacaggcatgagccaccacacccagcctctactggggggataattatgggtatgaacaaaaatgagagactggtcaaagcacattactctccaaggagcccctgggcatcacaactgcagagagtgaaggcatattgagtgttgcccaagtgaagtttggggtgcctggagaagaggatgtatcttgctgtgtgcaggataatagtgttcaacaggtaggatagtggtaattacgaagcgtctcactgtgctcatctcaggagtttggacttgtgtagagcagtgattcttaacctggaggtgactttgtccccaggggacatttggcagtgtctgaagacacaactggaagtggtggtgtattaatttcctatcactgctgtaatgaccacaaacttagtggcttcaagcaacacaaatttattgtcttacagttctggacctcagaaatcccaacaggtttcactgggctaacttcaaggtgttggcctgactgtgttccttctgaaggctctaggatctgttgtggttccttttccagtggcccccttccttcattttcaaagccagccaagttgcatctcatccactcttcttgtgtggtcatttctctctctcgctcttttcgggactcttgtgattacattgggctcacctggataatccaggataatctcattattttaatgtcagctgattagtgacttttaattccacctgaaaccttaagttccctttgctatgaggtattcacatgttttagggattggggcgtgggcatttttggtggtatattattctgtctaccacaggggagttcctaccggcatctagtgggaggccagggatgcttcttttaaataccctgcagtgcacagccccacaaggaataatcatctggcagtcaatgttaggagtgtggagactgagaaactctgctgtagagagtgggagaaattggtgatttttaagcatgaggtgtaacatgatcagatgtgttttagaggtaaactggtgtctgggggagcatgggttagaagcataaaacaagtggaggacagatcctcagaggaggtgggcatggggaaatcatgccaagcatgcatcctataaataactgggagttggcatataaacataatacttttatatttcccacttctctgttttagtaaagtttttcttgctctgttgaactccttgaaagcagaactgttactcatctttgaattcttaaaatctggcccctgtactctgggggttttagagagatcatcataaagaccagtggttctcaaccaggagaaagtttgtaccacagtgtacttttggcaatgcctggcagcatttttgattgccagaactggggcaggagtgtgctactggcgtctagtgggtataggccaaaggtactggtaaacatcccacaacacacacaacagcccccacaaacaaatacttatcttacataaaatgtcaatagtgctgaggttgagacgccctgtatacaagaaactgaattccaggttttgcttttcagtaccattttctctcatgcttgtggctttactctttgtcattttcctcttcttatctagtatatgtcaaccaaggctttgaaattcaaaaaaatgactttctatgggtattgagcatatgaaaaaaaataagggatttctaaatatatctatagggaagaagtgaatggtaaatatataatgatggaaactggaattaaattttaaaatgcagcagagaaaaatattgtgtttaaaaatagaggctcattcatgtcaccaaagagaaagtaattagaataagacagcttcaaaaagaaattgacaaaaagtgttttacaaggatttttgtctgaaatcagtataatgccttaaggtttttttaagttaggaaaaagagttattcaactttcacacatacactctctctcaggctatctctctgctagaattccttctgaaggcaatttttaattttaatggagaatactgtgaagatagcttctcagatgacttagaattgagttttcaccaacattttgagatttgagggttgggaagagcaaagtttagactcagaaagaaccttgggtagcatctagctccaaattgcttattttacagttgaagagagggactgtaaagcttaagccactcaaactcaggcaaagagccaagggcagaaccaccctgaaatccttcttgactctctatataaactgccaagcttctggaaaaagtaagtgaccacgactgcttttattctctggtgagcaccttaaaccttggcaatcagtttttatcctgattacgtactgaaactattctctcaaagttccctaagttccaagaatcttcttagactcctttggctagacttctgggcaaaactgagagtaccacgtcccctccctgctcctcctatccccatcacacacagagaatcttggtttcctccttacctttcttcccactcctctgactctgggattgtcttggccaaccctacagttctgtgtttttccttcaggtcattgtccctcctattgtctcattcacttttgtgacttcaaccatcatccctctgggggagactcctcactctgtgcctacctggaatcttgtagttgagctcccaatatatattttctgatttcttcctagatatctgctcatggatgcccaatggactcaaattctacatgtttgaaacagaacaaatcacctcccatttcctctgaacatgtttcattttatgtattccttattttggttggtatcgctcttcttctgcttgcctaggtttaccaggccagaatgcctttactcctcccttttttgtttcctcctttattcttccataagttttcgaacgctgcagtgtgtacttcccatttgctccactctagaaaggatttgaagtggagtgtgtctgagttcttacatctctctccagctgttcattcacaatgtcactgcctagtttgggttctcatttgctgtgacccccttcttggtcaccctgccttcagtttctccttgttgccatcttggacttatcctcaaaagatgcaattgtaatcatgttaacccctgattgaaaacctttgatgggtctcagagtgtacagaataaaatccaaactacttagctagtcatttcaatgccttttacaacatcatctcagcctgccttctcccaggaactctagtccagcaaagccaagctggccactcacacagatagtcatcaaatatttatcgcatgccagctatgcaatggacactaggaatgtaggtggagcaaataggtatggctctgcaaggtgcttccagtttatgaaagcagtaacttcaaatcaattaatctctatagttttttcagagtgttaattgcattttgacgagaggactgtggtagacagaacaatgtcccccaaagatgttcatgtcctaatatctagaacctgtgaatatgccactttacatggcaaaagaggattttgcagatgcgagattatcgtggattgtctgggtggggccaatgtcatcacaaggatccttataagagggaggcaggaaggtcagagtcagataaggagatatgaggatgaaagtaggcagagagagagaaagagggagagcggaaaggagggagggatagggcaatgagagagattttgaagatgctacacttctggctttgaagatggaggaagcagccacagcccttggctgtagcagcccctagaagctggaaaaggcaaagaaatggattcttagaaccttcaggaggaatatagctctactgacatcttgatcctagctcagtgagacttctgaccttgaggactgtaagagaatatgtcagttgttttatgctacaaaatttgtggtaatttcgagcagcgataggaaactgatacaaggcataaacaggtctgggatgtctcagctgaaatcattggatgaggaggcatttgccaaacaaaaagaaagggcacagagctcctgcgagaaggaatggcgtgtatttaagagggaacatagcatgcttcaagaatttagagaaatccaactagaatggattatgggattgggaagatggtgaagaataagtctcgctggactttgggcttaatgatatggattttaccatttaatgtaaagattccccacatagattttgtttcctctccttctcactttacttttgataacttggtcccatatctacctgagaaggctccatttgtactttatggctcagccaggtgcctccaaataaatgagcttgactctggtacatgtcatgacacattcaggatttgcagaaacagaagctcatgttttcatagtgagattcacattcttccaatctggtgcttgaaaaagagaaagtgtgtttcatatcaaaatctagtcaatgactgagggagtctgcatgcagatagcagttctcccagattcccagaggcttgcctttggggcgtgacatcttgttctaaaatttactgcatcctctctgagccattacttagataaagagagtgagactgtgattgtaactatgttacgacatggcagaaaaacccttggaatgtaatgtgtgaaaaaatgaaattagttgtgttatctggtaaagaacgatgttttcattagctattagggaaacgtgaatcaaaactacaatgagatatcatttatacccactaagatggccataataaaaaaagatagataataacaagtgttgacaagatgtagaaaaatcggaactctcatacactgctggtgagaatgtaacatgacgcagcagctttgggaaacagtttggcaattcctcaaaaataaaacagttactccagagctcagcaattctacttctgggtatatacctaagagaaatgaagatgtatgtccacaccaaaacatgtatatgaatgttatagcagcagtattcataatagccaaatggtagaaacaattaaatattcatcaacggatagatgaatggttaaacaaaatgtgattaatgaaaaattactcaacaataaaaaggaatgaagtactgatgaatgctatgccttggatgaattttgaaaacattatgctaagtgaaagaagctagtcacaaaggtccacatattgtataattctatttatatgaaatgtctagaataggcaaatccatagagacaaaaagattacttgttgtcagaggctggtagggagggatgtggagcgacagctaatgggtataaggtttcttcttagggtaatgaaaatgttctggaattagatacaggtgatggttgcacaatcttgtgaatatatttaaaaaatcactgaattgtatactttaaaagggtgaattatatggtctgtgaattttacctaaaaatgatatttataattttcagaaaatatgttgttgccacatcttgttttcaataaaacataaatataaatgtagaagagtagttatatagtcagttgaagcttcatgtattcaacatgaaactagggaggtagtaacggctctgggagattgaacagagtcgtcggcagccagccatgggattttctgagattggttactgtggaaattcgatgtcctgattattgcactttgaaagcaagcacagagaagctattaaaagattgctttttcagagaggcagagattttaaaaactacttacaatcttgaaaaattgcctggccttatctcacctgaactattaaaaagcctaagattttcaggagccgttagaagtaacagtaattctagaaaccacctatcgaatgatatgctgatggatccaagaggagaatgctgagcctgagaagctctcctcatctttagagaaattggaagtgaattgaattatgtggcttgatggaccaagaaaataacatgttttcatttctgtagaagtggacagctcatggaaataggtgaattaataccacctataggagctgaagtgtcaataagcattggatcagttctcagcttgtattgctcataacttcatctctcaggggtttgaaaaacaattgggcaagctggtactttgaggcccagatatagatggagtaggggaaagagaagccttaggcaacaatagccatgctgcctcagcgtttaatataacaagggctttgatatagctagtaattttgtccagggaaatcctggactgggccagcagactttctgagcaaagtgtaattctgctcaaattagaacctccaggtgatttcttgttcacttatttcagtcaaataatcgttgatgggtgaggatgatgatgatggtgacaaacaaaataacaattagtatttgtagaatgcacgccagtttagtgttcttagaacaactctgtggggtgatagtatcaaccttcattttatgagtgaggacactgagactcagattcagaggtaggcagatttagctgcagagaaaatgaagtgaatcggttcagctagactctgaaccagactgcctaggtttaaatcccagctctgttttgtgacattaaacaaattattaagccccttttttgccttagtttcttcatctatcaaatgagaatgatgaaagtgcctacctcaaagagtttttgtgaggatttcatgtcataattacctggaaagtgcccagcacgtaggaagtactaaaagatgcataggagtgcaaggctaaataacattagagatgtggtcacacactaggaagcaacaaaggtaagacctaagctaaagaattactttagtcaaaaatagttatcgtgcacctactatgtgtgccagaaactttggtcagtgagttaagcccagctgcatgagacaacagcaggaaacaagtggaactttattttgcgagctgttaaataaggtatagttttcatggtaggcattggagtgacagcaggctgtcactccaggcattttggcctagtgacttggaacacaggaatttgtcagacttgtattgtggatttggtgtaacccaagacatgccaataggccaaggggctgccttcattccagtacatggtaacttcattgcatttagacactttttagtagaatatttagaatgttggaaactgaaaagttcttagtcgagccctgttctttaactggtaaatggcagtgtgcttctcatttcaagccaggtgtgtttttatttccacatactacagtgattacatgagaccaagttgactgcttttcaaggcccatctcattcaacatctttccagggtaaaaacgcagcagcactaagttaagacaatcctatctacaatcagattctctttttgctcaaaatctaaatgtaaactccattagcatttctagactgattttagcattctacgagcaaatagaatattaggaagaaaaagtccttgaaggtcttctgtctattccaaacatccatgtcgtgcttaaatcccatctatgacacccccagtctatgcctagctatcacccacaaacagagaccttcatggttctgcctttagattataatagacataaaaattctccatggaactgtgttcacaaccagtctccctgaaactttcatcatgttacagacaaattctgcctctctggttttccagaaaatcactaatactgaattattattgttgctagggaagtacgggttggcctagcttgctttctgagcatcaacacaaaagtttgggtcatattttctttctggcagatgagaattgtgaatatatccaactacaactggaaaatattttaaacgaaagttaaactcttgcccccaaaggtattttgcaaactgcttatagaaactaggtttaggcagggaatcctttacccattgcttgtttttgttgggtttgttgaaggattccctattcagtaaatggtgctaggataactggctagtcaatatgcagaagattgcaactggaccctttcctttcaccatatacaaaaattaacttgggatggattaaagacttaaatgtaaaaccgaacactgtaaaaaccgtggaggacaactgaagcaataccattcagaacataggcatgggcaaagatttcatgacaaagacaaaaccaattgcaacaaaagcaaaaattgacaaatgggatctaattaaactaatgagctgcacagcaaaagaaactatcaacacagtaaacagcctacagaataggagaaaatttttgcaatatatgcatctgacaaagttctaatattcagcatctataaggaacttaaacacatttacaagataagaagcaacgctattaaaaagtgggcaaaggatatgaacagacacttttcaaaagaaggcataaatgtggccaacaatcctatgaaaaaagctcaacatcactgatgattagagaaatgcaaatcaaaaccacaatgagataccatctcatactagtcagaatggctactattaaaaagtaaaaaaataacagatgctggcgaggttgtggagaaaaaggaatgcttatacactgctggtgggagtgtaaattagttgaaccactgtggaagacagtggggtgattcaaagacctaaagacagaattaccatctaaccccagcaatcccattactcggtatatacccaaaggagtataagtctttcttttataaagatacatgcacatccctgttcattgcagcaccattcacaatagcaaagacatggaatcaacctaaacgactgtcaatgatagactggataaagaaaatgtggtacatacacaccatggaatactctgcagtcataaaagagaatgagatcatgtcctttgcaggaacatggatagagctggagaccattatccttagcaaactcacacaggaacagaaaaccaaataccatcatgttctcacttataagtgggagccaaattatgggaactcatggacacaaagaagggaacaacagacactggggcctacctgagggtgagcagtgggaggagggagaggatcaggaaaaataactaatgagtactaggcttaatacctgggtgatgaaataatctgtatagctaaacccccgtgacacaagtttacccatgtaacaaacttgcacatgtaccccaaacctaaaataaaagttaaagaacctaggattagtactcacagtctctagattcccgctgctgatgcaatgagtcaggtttctgcatttcatgatttataagagagctcaaagacagatacagttttcatatcatatcagagtgttactctagatatttcagcaagtcctcaaggaggtgtgttgaatctggcttctaatgttttaatatattgtcaataaatgatattgtcagaatgtgtcaaaatgctgagaaagtaaacatgaaaggtgatatgaagattatccacaggcttgaaggtcacaaagtgtgatatgaatcccagaccagctccagacactccaaggcatgagctcagcaaatatattgttgttctgctgcaatggcaatattttaatcttctaatttatgattgaattgtaaatatattactttttctcatgtagctgaaagtgtatggtgaaagataggtatagtgttatggaagtaatcaaatatttaggtttttgttcagggttctttagctgaaattagttattcagagttacaagtttaaaaaatgtgaaatagttcattttctttgagctattctgttttggtgctccctggggagagccggatgcaggagagtcaatggatcttgattgtctagtttgcctttcctcatcaagaaatagccttttttacagaaaatgtttaaaatcctactgtgtattttactctccttatgaggttatcatttctaatttatataaagatatagtagatgctgcttatataaatgttcattgactgaatctaaaaccaatctaaaaataaagttattttttaaaaagttcattgaataagaaagttgaatgattgggccaggtgcagtgactcacacctgtaatccccttgaaagcaggctgaggcaggaagatcacttgaggccagaagtttgagaccagcctgggtaacatagtgagaccccatatctacaaaggaattttaaaaattaaccaggtgtggtggtgggtgcttatagtcccagctacttgggaggctgaggcaagaggattgcataggcccaggagttcaaggttgcagtgaaccatgatcgtgccattgcactccagcctgggcaacagagtgtgactctgtcttaggaaaaaaaaaaaaaaaaaagaaaagaaagttgaatggtcaagaagaaaattaacaatatatttgcaaagattccttccaattaattaattaaatgtttctatgcaatatttttataatgcagaaagttgattttttcattttatttaaaaagacttcttacagagttttagatcacactctattagtataatttccctgtctatatgtacatacatgtaacttttaacttaataactgctttataataaaaaatgaaaggttggctattaccatatataattggagcaatgtggttacattatttttatgaaaatacaagtttttaaaactttgtgaagaaaagataagagtggcaaaagctctgtttcttagtctgagttttcccaaaggcaggatctgggtgaaagcagtttatttgggaggtgctctcaggaaggagtaatgaagaaaaagggataatgaaatggggaaggaggggaagtaaagctgtatcttggaagttgtaattgtggaaaaagggatgattcaagttccaccaggactgctggaaaatgtgtagaatgtctatcgagatgatctacccatgttttagttctctattgctgcataacaaaccacctccaaacttagtggcatgattctgtgggtcaggaattagatcacagctcagctgggtagttctttggctctgcatggcattggctgggctcgctcacttggctgcttccagctggtgtctgggatgcctggaaagttcaaggtgtcttcattcacatgtgtggtgcctcagtgatcctccatgtggcccttctctctccaactgactagtttgggcttcttcactgaatgttggtctaatggtatttgatcagagtgagtcacagggccagcccagattctagggcaagggaaaaagagtctaccccttgatggaagaagtgacaaagaatttgtggtcttctttaatctgccacgagctaaaggaagggaagctggagaatgtctctgttggtttccatcttccattttttaagattgcttctggggttttaacttccacatgcttcttacatatgatgaggtgtgcactagagatgaatcactagcagcacacaacgtcagtccgagcttgcacagaactgcccagcacagttgtagcagaactcaaaaactttagcacaggctcatgggaagtagcatttagaatcagtcacccacaatcttagctactcaaaaacataactgaaggacaatatgatcttagacaagcctaggatcaaatctcagtgccactatttattaggtgtgaatttcagttttctcagttgtttaaggggagtataacagtatgtactttgtaggagcttgtgaaatgaattggttgagggtacacaagctataaggggtcatgtagaagtatttattgtttattactttaattcgttctcaaatgttataggaaggtgtacatcaattttataatgcttcagcgggaagaggaaaggcaacaatactatggtaaatgtaaagagcaattgtaagatgcaactttaggttttttaaactgtagggaaaataagtagtagttgaagaattatgatacaatgtagtttatcctctacattcatgggaactaagaaacaaactttggcaacaggtttattactggggcaatcttggtaatgtttttaattaatactttaacaaaacttataattgatacataacagttgtacatatttatggggtacagtgtgatatttcaatgcatgtatacattgtataatgatcaaatcagggtaattactctgtctaccactgtagacatttattatttgtggagataacattctataccttctagctatcttgaaatgtacactttattgttattaggtatagttaccctactgtacaatagaacatcagaacttatttttcctgtctaactgtaactttgaaatacttttaactgaaatatagaacttacttggatttttatcagtttttccgctaatatccttttcctgcttcaggacctgattgatgcagaatctcacattacatcaggttggcaaggcttcttggtctcctccaatctgtctttatttatttttcgtgagcttgccacttttgaaaagtattggtcaggtattttgtagaatgtccctcggtttcagtttgtctgattttgcatgattagaatgggatacttggaagaatacataaaacatcatttgaacaccaagtgtcactgtttatctatgttagtaaaatacaatgtttcttttattgatgatgcttttcacccaatcagcccacattctcctgtcctgtctgcctggtagcatggccatatgcgtgttgataagatgcaatactgaaggctgtgctgagggactgaagaaagccaccttataacagtgacctcattagcagccaactgacttcattggcccttcagctggattctctttctctgtaatttggattcgcctgcccttttttttccattacatgggaagctctctggcaggctattgctttgtctgtccttattgccgcctcggggcatcaacagcatgtctttgggtgctgcatttgttaatgtgggaggctaagagaaatccaagatgaaaatactccttgtcattcccctgtcagaagggggaggaagagctaagctttgagtacatattcatttacatcagcagcattcttctgtgctcattggttgcttacttctctcttattaacagtgctagaataaacacacaaatctaccaaaatattagcagtgtgtgctgttttctttcacttgccaggattgttttataataaataccattggaaaaaataccactggcaagcatcctcagcaattacgttaacatctctagagaacaaagtatggtatcggaaggtgctttgcaaagaggagcagaacgtgtctggtttatactgcattccttgaatatactgatcttgttacctatgagtttgattttaacttaggtatttctcttgattgacaaaaattgatgccatcattttgtatgatattcactaattaaatatattttggaagacaaatataaaggttcctttaaaatgaagtgacactaaaacagatgttcataatgtgctttcatggtaggaatttgtagattaaatcagatattcatgtttgtcaaaatattttagtcaaatggaagaaatgagttttctcaacaattttgtttgtttggcttatgtcatgtcttagtttatttcaactatcatttctatcctttagaggtaaaaattgttatttctctccccagttgaaccctagttccatatttctgtttgcaaacaaaatgtttctacttgttgattccaccatcacttcaaactctaaatatttaaaataattaccaaccctttcccccaacaaaggaaaagtaaatacatgaatatacaaaccgcaaccagttctttctctaaaccttcctgttttcttctgtgataaccatttttgtaaccttggaatcttgaacacatttcttattgttcctcagcgtttatattctgtattgaaatgacccccaagacttgtctcctgttctaggcaatgttcctatttagccttttctctctgttccaccgggcatggcccttgtctctcatgctgggtgatatggtttggctctgtgtctccatttacatctcattttgatttttaatcctcatgtgtcgagggagggagagacctgtaatacccatgggtattacatggagagaggtggttggatcatggaggtgatttcccctatgctgttctcatgttagcgagtgagttttcaagagacctgatggttttataagtgtgtggaagttcctccttcgcttttctctttcctgccaccatgcaaagaaggtccttgcttcccctttgccttccaccatgattgttagtttcctgaggcctcccagccatgtggaactgtgagtcaaacctcacagcaatgtgaaaacagtttaatacactggaccttctaactactttcctggatgatgggttaaccttgttttaatccatgctttcctcttccttaagcattaataacatcatttaataataattaacaacatcatttaatttcgttatgaagtccctgttacaatcaagacaaaatctcatctgtcatatagacccttcctaccatcatcagccccttgcccatccttttctagtaggtcttctttgttcctactcctctccttctcctctttcctaattccaagcttcttctttgcagtcttcaacaaccttattcaaatttcacagtcatctctttggctctaaaagccaacgagggagagcacccaaggactttatttgaaagtttagagacaaataactttatttgaaactttatttgaaagtttagagacaaataaaatacgtatgtttgtctaatttctgagacaatgacttaaaataaaaccattttccatgtaaactgtgatagcatctttggggttgggcaatcatgaattgctgagaaccttggtagccacttcatattgttgaattatagtttctcttttttagaaatgaagtaacgtttcccccagaagctactgtggatgagatgtttggagcattgagtagtccatattaatataagggatagcaaaaaaaatgattttttttcttttggagtataattctatggattttagtacatgcataaatttgtgtagccactgccacaatcagaatacagaacagtttcagtgtccccaaaaaactgtcttgaatgattgctttatcattcctaacctgcccctactggcaaccactgatctgttctccatcactatagtcttgtctgtttaagaatttcatagaaattgaattgtacagtatttagccttttgagactggcttcttttgctcaatataatgtctttgtgatttgtccaacttgttgcattatcaatagtttgttcttttttattgctgagtagtaagttccatgatatggatgtccaagtttgtttttccattcacccgtcaaagtaaatttggcttgttttcaatttgagggcaattagtatggctataaatgtttatttacaagtttttatgtagatacaagttttaatttctctagagtaaattccaggagtaggattgctgtgtcatatagtgagtgtatggttaactttatgagaaactatcaaactattttccagggtggttgtaccattttcattcccatcaacaatatatgagagtttcagttgctctgcatccttaccagcacttggtattattagtagtttctatttttttcactttaataggtggtatctttaatgagtggtatcttgtcatggttctgcttggaatttccctaacagttgatgatgctgaccatattttcatgtacttattggccatccttatatcctctttggtgaagggtctgttcaagacctttgcccattttttaaaaatcaggtagatttaatttttgtaagaaaattcttcctagatttctctaggtaagaacataatgaaggcatctattttctagcaagggtggctagaagcagaagtttttagcttttacaggcagcagtggcagcaaagttgagtttctgatgagagtggcatccatctggtaacagtgtggttgtagtaacatttaggtttgggaggcaacataaattatagcatctggagcttgaagatggccaaattcagttaaattaccagatcagctccattatgtggttttgaaaatttttctcggaagcttggttctgggcctctccatgatccccttagctagctgcccaatatcttcacaactccatttttcattaggtggagttagcttctaagaacctaaagtacaacattgaattacctactgcaccagttatctatgaccacgataaagttgtataacagacaaccacaacacttggtttcatgcaacaatggatagttaattttgcacatggatctgtaggtttgtgtagtctggttgatgtggaaagagtgtggcggatctctactgggtttgctcatgcatatgcggtcagctagcatgttgttggggataattcatgctgatccctatggcctcattctccagcaggctagctcagatttgtactcatggtggaagcagagttgtaagagaggaagaagatgctccaagcctcttgaggcataggctagaaactatgcactgtcacttgtgctatcttctattggtcaggctacatggcagcccaaattcaagggattgggccatagactctatctattaatggaaatttcttccacaatgtaagggattgattctgtaatcaatctcctttatatataaatggtttggaattttgaaatgagtgcagtataaaaagagaacccagaaaaatacatcaaaatattataatatctctgagtgaatttaaatcctcttttgcatttttgtactttaggttttctaaaataaacagatattacttggtgtaagttaaacaatagttgtaaaaaatttataaagtgttttggaaacaaagaagagggagtgattaattctggcgttagaaaggtgctaacattttttcccaaattgcaagaattgtaaatagtagtccttcagggagtaaacttgtccagaatttttttggcataaaatattaaatacactatttgtagatgggaacctctgacttttaccaaacctttggatattttagacttatttttttacaatagctttgtgctaagaagaaagactgtagaagggaagacaaggctctggtgttatcctcttaaatttggaagactggaatcatgcaggggaaaggactctatagtatgaacttttgtgtgtgtttgatgttgagtagacagcttggtggtggatctatggatggggcaatggctatagaaaacagcttttcttcctcaatgccttctgacaaatctcaaatgagttgttcacaaaaacaaaagcagggaaatgctacaggagaacccatattaagtagatttcagttatacccattatttcctttattgttttaaaaaaaacagctttattgagatttaattcacctaacatataattcacccatttaattttaggacatttttatcacccccaagaagaaaccttgtgcccattaagcagtcattctccactgttccttgccctcagtttctgtctaatctactttctatctctgtggatcttccagttgtggatatttcataaaatggaattatacaatatgtgaccttttgtgtctagtttattttacttagcaaaatgttttcaagattcatccatgttcatgttatagtatgtatctgaacttcattcctttgtatgactgaatgatattccattgtgtggatagaccacatcttattgatccattcatcagttaatggatagttaggttgtttccactttttggttattatgaataatactgctatgaacattcttgtgcaagtctttgtgtagatacatgttttcagttctcttgggtatatatgtagcattggaatttctgagtccattgaggcttaaacaaatttattgcttaggcacgtttggcaaatatgatagttgatttttctaggaatatatattttttggcctaaacacagtgaatataggacatgttatgagtaatcattctaggagagttcctcaaaagcagagctgtagatacgtttaagtgatggcacccaagttggaataggtctccagcatctgtagctaagtattttgaagtgattgtgcaaattctgtggattgtttccaagatgtactacatctattaaaaattaaatcttatagttaatattcaatatatgatgtattgcatatacttggtatcagcatgcattcaaacgtgaattgaaaaagagaaaatggatccgtacttatggtctgaaagaagtaaaagaaagggtaaaatcggtctgtcaagcaatgtagaaaaactctggatgtttgctatctttttaaatggtatttttttttccatggggagaaaacacatgatgagaaaagaagagaaagcaagtgatgatgatatgattgataattaaatgcagctgagcagaaacaacgtggacacgcttagaatttgctttagtactttctatgcttccttcccgggaggctgttaaaactcttcagcataagagcatttaaacaaagagaatattgccttttttccttctactgcatctattcaaacatgcagaatgtatgtcttggtgaaatgctccaaagatagcttgtggaaatatttataatgcgtgtaccagcatttttcacataatttaaatacatgcttttaaactgtttattcttctctgaagttttgcaatatctatatgaccaaatttattgcatcatctgctaacttgaccgagctgttaatgtgtgatgcgaccttcttcaggttgaaagtgacagtttagcatatcacaaagaaaaggttatccttaaatgttgagactttgagatactagccaccgttgtcaatatgccaagtcccaggctacttgctgctcatacttaaggacaagataagtgtctttggaaaacattttctcccatttgggccatctttttggaaccagaaattgctctgcttctatgcaagggaagagaattttgctctctccattccctgtatcattttggcaaatccttgttactgttaattcagggggactgccaatttgaaggatgtggtgaatgtcaaagtaagaggccatatttgccccatgtttctcctgaggcagaatataatttttacattgtgatcctttgtgaaatcagataactaaggaccactggttccaaagacaagtcttctccctatatttttttcccacttactagtccagaaaaaaaaaatgggttactcaatctctgtgccagcaagtatttgttaaacacccatgcccctgtcacttacacaggcttgtgatgtaaaactgccttaaccttcatacagcttaccattctaggtaggtaggacacagggaaatttacagaataacacatcaatattaaactgggataaaactatataaggatgcctgccaattccatatatatttagataagggagaatttgggatgactgagagttaacaaagaagacctcacagatgggggtactttgagctgcctctggaggtagacagaacagaatgtcaatatatgaattggagactcttctgggtgtttgaggttggggaagaaacaaacaatgcctccaggagagaagcagcctaaacagcaactccaaggaagatgggtatgaaattcaccgtgtgtgtgaaattatgacaggagtcccagttataggataaagcagcaaaaccagaaagcaagtgtttagacatttgagcaaacctcttattttcttatctgtgtttgccccgtcacataatttacagtagaaagttatttaaggcgaggcagcactgttcttcatcagacttgcatttatgtattcaattttggaaacactatgacttttggaagcaaagaaacagagttaggctgaacgcccaactccagtgtacgagaatttttcttcaactcactgaataaatgagtattttggggtttttgtaatgttcagatgggaggcaaaatgcagacacaagcctagaaaataatgcagatgccaagttgatgtgttcttgagcaatggacattgaatcaacaaatagcctgatgagagagcagtgagggtgaagtagggagtggaatattcatgtttcctttcccggggcactgttcttacatctcctttacattttgttagatttaaaactaaggaatcagaagctgataaaaaattactgtaagagaacacattgaataaaagagtggtgagaggattcattcctctattaacatcagcagtcatctaaacatgtactttttttctggcacaaaatcatagctgtagcatgaccttcttgcttactaaagatcacttaaaatttttaacaaaaaatggcttaagcttgaaaggaggcttttaaaatgttaagtatggttctgatctacttttaaaaatccaatggttaaggccaggggcattggggttagaagttggtggggggtcaggagcaggttggtgattatctttctctctctttctctctctttttctccatgtctctgtccctttcaatctctctttttctttcaatctttctcaatcccccatctctcttaatttatctatttctttttctctcacagatatatactgtaaagtatataacaaaaatgaagtcccatgataatttgttgctaaaccacagtgcagctgtctaatcaagaaggcatatttttttgtggcacatatacaccatggaatactctgcaaccataaaaaaggatgagttcacttcctttgcaggaacatggatgcagctggaaaccatcattctcagcaaactatcacaaggacagaaaaccaaacactgcatgttctcgctcataggtgagaattgaacaatgagacaacttggaaacagggaagggaacatcacataccggggcatgtcgggtggtggggggctgggggagggatagcattaggagatatacctaatgtaaatgacaagttgatgggtgcagcaaaccaacatgacacacgtatacctatgtaacaaacctgcacattgtgcacatgtaccctagaacttaaagtacaataaaaaaataaggcataattgtaaaataatttatactcttttcataatctgccccaatgtcccttgtttcagacttatgttttttcccttgtttcagacttatgttttttctcccttccattcctactgccttgtcactttcttaccctttcacattccttagactctgggtttaaattcctgatttttggcagtcagaaatcccttcaaatgaggctgtcaatccatgcttcttgtagcctccaattttcagattagctaaattataaactttcccatttacaagtgtggcattcctccgcagcctaatgtttatctaaaaatggtgttcattatccattaggtcttattcactctaatttataaatttagtagtttgaccacttttactagtgaatacacttatttaaaaatactttttacatttaatttttgtggatacatagtaggtgtatatatttatggggtacataagatgttttgacatgactttgtatttaatagtcttgggctatatataatttttcttttatctgctagaaattactatcttcttcctttgggttggggactaaaacttgcatttaatatggaggggtggtaataatttggccctgttttctctgtatgcttgttgactccttgttcttaggacacatactgggaagaattatttttgcaactgaaaacaagtagagattttaatagggggtatagaatgaatttcagatgacagtaatcactaaaagtgtctaaacagttcaaattagttgtgtgtcttgtggacaactcatctaaatacctgaagtttggttatttgcacatagaacctgaacactatttcaagcttcaggttttaacgtgtgctgacttgtaaacaactttcaaaaatttaaggcaggcaagttcacctcaggccactgaattttcattgcttctgtgtatatttttcagcgttacccttgttcttttttgactttgtcattttcttcagtccaactgaaaatgttagtcagaatttattttacattagagtatatattcctagatgctaaatccctgagaacaaccttttctacccacttttgtttcttctggtgatacctatttacattttgctttcaaagggtgcccaaccactggatgccatacttgtgttattagctatctctatctgcctaagcctctggtttgcttcctcttgggaattaaaaataagatttctcttgatttcattgaaaaatcatcattctttcagctttgaccatattgttttgataaaaacagctgatttgtattattgaacatctttctcatttttctttctccataaggagaaattcatcacgatttattacctgaacatttgtgaaaccaatttgagagaatcccaaaagaatcattttaattgaagccacctaattacttgtaattaagaagacttaaaatgccaaaaaaaaaaaatcaaaattacagctaacaaattcagaggataggataaaatcaattactgaaaaatccaattaggtttggggagaagctgaacagaattttatttaaacccagtaaaatgtctttgagcttttcacatggacccatttgagttcaaactctttattattaagagttaattttatctttgttttctggtagtgtagtaggtttgaataggagctcttgaataggagtgcaaataattaggttaatggtttttcttttcatacgttattagaggaataatacaggaggaatgaaaatgaaagcaaaatttagaataaaactttaaaaagtttatgaattgttaaagctaactgttggactcccagcagtggctgggaaaatggtaggattttatgccaaatattattattgttgccttttgccagagtttagtggaattgccctgaacatcaacttggccatttcaactctcttatgtttgaggtctgctgccagtagtcagaccatgataaaaacccatgacatgctaagtaatggatgctgggcaataaggatctttctaaaaatggctcttaaaaaaatcatcatcttgcaactgtaaatggcctgtttgttaatagattatttttctcctttcagtcaagattttctgcgtaagtttacagcctataagtttataaataaagtactacattgaagcaacatttttattagtaggtatttcaacttggatgttgtgagggccttttaatttcactttgcacaaagtgaaattgtagaaatattttaaacaaattgatcatggcctaaaattttctgcaacatatttggttgactgaagttattgttaaatttggcctgaccaaaatttgaatttcatattttatggttaccagtgtactctttgtaacaagttgtgcttctcttgtgatgacaagaattctgaaagatggttgatttagtacttcgagtttcacattatactgaaaaatgtggatgcccacctgagccttgatctgatgaccagggaaacagcagcactttttcaaaatcttaattgattttaaacaagcaaatcatttaattctgtgagccttacactctgtttcttaaaagaaaactggagaagaaaccctatctcaatccttgtccttgagaatcctagaaaatccacataacccttttccccaagtcattggagaccttttttcatcctacaaactctagataggcttgttaccgggaagctttaggagccttcctagtacctactgtagtatcttgctagctctacagtaaagaaagaaaataatatgaaaaagtgctctgatttatagcccatatctctaattggctattagtctgcgctgacagtaaaaatattaaaacaaattacccttttaagttaaattcacacccaatgaatgaacaaataatctgaatgaacaagcattctcttgttgatggtgatagtaattattatctgttgagcaggttgacttaatttagtgaacataaatggcctctacttagggtgttcatataatttgttgtcaaaattgtagcattttggaaagtgaaaagaggcgctattaataattacactaaaataacaggcataacctgaattgtccctgttaaccctcacctggaatgtattgttctccttccttccatgtgtagtcaagtgctacccacttttgacggcccagatgaagttttctctaagaaggctctttagagtactttgtttatattttacctgaattaaggcattgaggtgccagcatgtcagaaattaagatgttttatatatttcaaggaaacaattgttgctgttatttgacatgtatttgttctctcttaccaagtagaatgcaaccttcttgagcacaagggatatgtcctatccttctgtcttgctgaagcacttaggtatattgcaacgcccaaagtgaagagagaacacattcttgctgagttgctttaccttcatagtaacattcctctctatgtttgtgaataaaataatggatattggtgccaaaaatgctggttatttaaagagatttcttctgggtttataatcttatacagtagaaagggataagaatcaagccaaatatagttaattatggcctgagtacccatttagtcacccgatgtttgaaagtgtccactcagatttagacattttaacaacaaccagacctttactagcagtactttatcatagaaaggatcatttgagaatatcttaattgtagcattctgagcaaaattataattaaattttactaagtatttattaaaaatataaagtggatatttttctaattataaaagtaatatatgctcattttaaaaaaatctcatagaatacaaaaaaatgtagaaacaaaaccaaaaaccactcataatcctttattatagagataattacttggactatttgggtatgtttccttgaagtagtcttttgtgttatttatatactatacagtgatccttgccttctggcattcacagccttgtgtaatcccctccgtataacttgcttataaccaataagagatgacaactttgggaggacatcacttacatgatgaggtcacaaaagattgtgaagtttgacttgctagccggttctatcttgctggatttgatgaagtaagctgtcatactggagaggtccacatgacaaaaaactgagagtggcctctggctaacagccagcaaggaactgatttctcagtctcataactcttaaggaattgaatcctgccaatgaccatgtgggtgagcttgaatgtgaatccttctccagttgagcctccagatgaaacccccacttcagtgacaccttgatcatggctttgtgaaagtctgagcagaggactcagctaagctgtgcctggattcttgacccacaaaatctttgagattacaaatgtgtgtggtttaagctgctaagattgaagtactttattacatagcaataggtaactaatataattacagagtgtctcatttatagtttaatagcatttttacttaacattttcttattaaaaatctcctgtgtcattaaaaattactgaaaatatgatttttcttttccaggtggaaaagaatcacatagtaaggatatgccaaattttaattattcttatctaattggatatttagattatttctaattactggctactatgactaccactaaagtgaacatcctcatacatccatctttcactacaatgactacatatcttattatcccaacaaaattcattgccataagataaatgatccaaaaggtatgcataattttaaggatttaggaatattgctaaattaccttccagaaagttaggctattaaaatgcctctgagtatttcaatgtaccttggccagcactgaatggttaaacaaattagtcaacttgagaaagagtatctctttgtgattttaatttttattttattatgtcttcatatgattattagttaaagcttattaagaatttaaataaaaataattaccagcctgggcaacataggcagaccccatctctacaaaaaattaaagaaaaatcagctgggcatggtggtgcacacctgcagtcccaaacctttgggagcctgggagacagagtgagaccctgtctcaaaaaaaaaaaaaaaaatagccaagcacatggcttaaaccactcaatccataagtaaatatacacataggagaatgcttttcagtgaacatttatcaagtgctccttatttgttttacaaatattaacttatttgatcctcacaacaactctgagtcaggtaccactataaatgctgttttacagaaaataggcaaaaagcaacttactgagagcagcacagctagcacagagctgggagctggagacaggcatgcccttgactgatatgtaatagacacccccatttcaaacaaaaagccacatccattcaccaaattccaaaggaggcatcaattccttcattatagatcagaaaaatgaagctcaatgcatcttgtctagtgaatggttcaaggttgtgcagcttgtcagtactgtgatttagaactcaaatgctagtctgtccagacgccttccacttccacatttcctatgaggaataagcacacaaagcaggtgctcagtaaatataggttgattgaactccaacaggctacatgcaatatgaaagggtgatggaatgtcagtgaattggaaacagtgggtatagtggagtgatgctaaaaatgacccatcatggcaggtcacaggaggtctcccagtggctcagtccctcagaagaaggtatggagaagtaatgggggaggtagagagaaacaaaaggtaagtttaaagagatcctactcataggcaagcttatgactgtttctgcaaaggcattcatggcactgggacagggagggtgtattgacacacagccaatactataagggaaaaggtaaaacaaaaaccaaggcatgtttgtccaggtagccgtagctgttaccagcagcatttagacaattgcatatgttttaggttgtattctccacaaagcagacagagctaagggtttgagtgctagtgatttgtagggaagagctttagaaagaagccagaacagtagtggagtaggaaggggaagaagccaagcaagggtgtagttttgggtggagtcccagggtcagcctagatcccacggggtgcttgggagggtaaattatacctcagagtttgttccaccatgaggcaaaggctctgggcattggtactcacacaccagtcaatggctaagtgtctcaggcacttctggcatgtgtgagctggcttcagcacaaaggggacaggtgccagtcactagcagcaaagcccacaaaagccaagggatggacacacaaagttagtaaaagggatcttagaagatgtggtggctaccagcagtgcccattacagcatgttttaaactacatatggcagggcatccacttaaatacatgtatttgtgagaactggaaatttctaatttgacaattctaatttcctcagttcctgctgggtcttaatgtaccagacagaagtagaaattatattatgttctttacactgtgaccattcatgcggaatctgtgggagttataattacgtcaattaaagctgcaatttgctaaaggaaaataaagaatagaacaaataattccaagtctctaacttagaggattagtgttcaaatcaaattggagctttgcaaatgttaatagttaagctatgtttaaggtatttcaattctctacccataaaggcaggttttaataaagtcacataaatggtaaccccaaaggctttctagcagcaggatggcaagttgttatgtattattgggaaatgaagtatatttaatacctttccaattgtcatcactctaaaacacacttcaacaattgattaagctgaaaccagaagaaaattatttccccttacttttgttttcttaatctaatgtctttgctagaaaatgtagatattagctaatctgtgtctggcagcaaatacctgcatgttttaagtattcacaaatttcactaatagagtagcttaacaatagttcttcatttctaggtgaaatattaaatattatattcttaactcttactgtcagattaggagaacatttacatcatatttaaggcaaatattcctgagtccttaaagcactctagctgggtatttaaaaaccaccttctgtagaccaggggtcagtaaactatggcccatgagcccaattcagcctttcatacatgcatttttgtacatcctgtgagcaaagaatgctttttatatttttaatggtggaaaaaatcaaaacaatattttatgacatgaaaatgacatgaaattcaaatttcaaggtccaaataaagctttattgggacatagctacacccattttatttacatattgtctgtggcagctttggcgcttttatagcagatttgagtagctgtgacagacactggatggctatcaaagcctaaaatagtttttatttgatcctttacagaaaatgtttgctgctccctgctgtagacttttgtgcctccctttgcccgtagtttgtgatctcttaaaataacattggaacacttagaacttggggagtcgtgctatggagacactggaaataaagtccattttactttttttttttttagacggagttttgctcttgttgcccaggctggagtataatcacgtgatcttggctcactgcaacctctgctccccaggttcaagcaattctcctacctctggcctcccaagtagctaggattacaggcgcctgccaccacgcctggctaatttttgtatttttagtagagatgaggtttcaccatgttggccaggctggtcttgaactccagacctcaggtgatccacccggctcggcctcccagaatgcttggattatgggcatgagccactgtgcccagcccattttacctttttgagggaagagttgattattttgatgagcattttacttaaagacatatggctacaacacagacattgcacaagatcttttatctatgcatatttgaaatgattgtagatttccaggggcctgaattatctgaactattatctctgttccatttacatgagtgacatgtcctttggcatagagacaatcatcaactctcttcaatttaccttgtcccagcattttaaaaaaaacagtgcctggccaggcagccaagcggccgctttcattgttactccatcccatcctctcgataatcctacaaataaattttatttttcaattttagcgatgaggaaatcggacaaaaaaggtgatgctattcatattaacattgcatacttaatcaaaggtcgcttcaggatccacactttgattcatctaacttcaaagctttgctcagagtattttgtcttattgccagtcaaaggaagaatgtcgttaacattggtcagaaatcttttcctaaatcattgattattctctacccctactcattctccgcctgtccaggtaactatctgcattcatctgcttttctgtctgtccatccatccatccatccatccatcctttcattcatcattaactcaaacatcaaatgtttattgagtacatgccagccatcttgctaactgcactaggcagtagacatacatttgtgaacagaagagacatggtccccaccctcatagcatctttttgacctgacagaactgcacagaggatggattttatttgtccacagatttatagggcccaggcatctatatcataagtgggatttgatgtctatatgtttcataatctgcccttttggaaatcatttgacttggacctcttggatgtcttgcttttacaagtagcctaaatagtgtattgaagaggttataatcagatttttaaattgaagggtggaaaacatatgacactgcatcttttctttttaactgaatgtaacgctttacataaacatttccctcagagctactaaacacatgccaaattctactaacaactttctatctatctatcatatatatatatttggtaatacatttttgttgatcctatcccaaaagctttccacccattgcttgtcactttgagacaacagaaactggcaggaggtaattaatagacttgacctgtagggtgaatacacacacacacacacacactagttgggggagcttcgattcttttcaaaggactttgctggtgagacttgaaagtgccatatgcctgctgggagaagttttgttttggtagtagttactggttaggctttggaaatttttcttttggaaatctggctggttctcaaaaattgcctttaagaattgtattttgtaagttaagagcagaagctattattagctgtgtgtttgtggttgaaacatgaggtcaggtttggcagggaactcttaagggtgtgtgaatgcgagcctcagcccagccatcctgtggccactcagtgccttggggagcggcttattcctggatacagaggcaatgcctttgtcttacaattcgtgggagtatgtgctttaataatggaatgcttcctttgtgatttaagagtgacttatagtaaatttttattaaggattcaatgtcctattgagaatatatatatgaatatatataatatttatattcataattgctttattagatcagggatcatgtttgtcttgtttatcattttattccatgttccaagtgcagtgcttggcatacattataaatatcaatatttgttaatgaatgaatgcataaatgaatgagtgaaaaatgaccacaaagagcacatgtagaaagattaaagacatatgttaaattgaaggatagaagttggtagtcagagaacatttgtaggtcaagcacttccaagtgatggcagatatctaagatggggtgaccacactcatgaattgcaaatacagaattctctggacctaagagaactgtggaactgtgaggtaattgtatgctctgatgttgaagccactaaaggtaatggcagatgaaggtggtggagatggaggaaagtaggcaggttccctcctttcctagctgtctcttggaatgaactaagtaattttgtatagatgtgtaaagatagtaaagatagaagatctgtaagactcgagctctagctcgtgtatacacacacacacacacacacacacacacacacacacgtatctgaagcatggggatgatcatatgacagtaataataattaaacacttactgtaagcagatgaccaaaattagctgtggttggacattatggaatgattagtacacataattattttctgctaataacaagacaggaagtatttatacccacatgaaatatttaagcagggagaaaacaattccagttttgccaaacgtttcttatatccattttgtggaaaagactccgtactagggaaaaggagttgatctgttcattgctcacttgctttcacgtagcagatttttagcgacacttagatggtgagctctggaggaaatggctattattattctagttcacagcagtacctaaaattgtgaatggttagaatctcttcatgctctgatgacccaactagctgtagagtatcacagaaagaaatgttgtcttgctaccatttgcacgtatgcaaaatatgcagagaatatagctgttttaaaagaaagctttgtaaaaagaaactagtaagctttcaataagaaatcctttaaatcctcagcattacacaataatacaattccctctttacagattcacttatacctttactgaatcagaagatgatgttgggggaaaagttgcttttcaaatgtaaccataatagaattttccctgtatctttcaaataattgtctgtgaaatcactttgtgatgtctatttcagaagcttagccatgacagcacaatcataaatattttcctctatgtcaaccattttagatgacagacagatctatctagtacattttgttttcttctaaaatctcaaatactacccaagtcagctgtttttaaagctgtggcctaataaacaattggatattgaattgctttattgcaaataaaaatgcctcatctttgtttcaacttattctcaaattaccagtgacattcacttttatattacattgttaatgaaagtttacctgtgggtctaaaaatagagacaaaaagcagtgaattgactggaaaactaaccattagggatattaattttttggaaacagtagttttattctgaatagtgtacactacctgaaggcttgaaggttgcatataccagtctctgaactccatagtggaaatgatgtctaccatagcaatcatcacttaatgagaaattactacttattacgccaggtactgagtgaattagattagtaattgcattttatctctcattaatctcatgtaaataatgttaattctccactttacagatgaggaaactgaggaccagagattagataatatgctcaaaatcacacaataagggcaaagctaagacttgaagccagatgtgggttcctaatcactttgacctaattactgggagaagcataataataaagacaatttattgtgacctgtgtattatgtattaatgactaaacagcatttttgcatgtttaaaaaaatctctgtaagtggtattatttgataggcattattctgcaacatattttctttactcagcatagttctaattatccattttaattgttatataatattccattttatgagtataatatcaattattttatctcttttcctattgatgaacagagtattcttcaaaattttcttggctattcttcaacacttcttcatttacataagttctatggtatgcttatctagttcctgattaatcatgttggaatattgtgtggaattgttttgcatttgtatattaatttaggaaaattggcacacatatgatattgagacttcatgtcatgaaatggtatatctctccatttactaaagtaatattatatgttattagcaatattttaaaactttttcaacataccctgtatgaattttcttgcatgtattcctaggaaccttaggattatcattgattttttttgtatggtatgtttactttctaatttgttattactctgatatagcaagggcattgattgaatgttgatcttgattaaacaaccttgctgaattatctaacttgttctaatagtttttctatgaatttctgagattttctttggaatatcatcatatttttgccagtatgggctgttttatctctttctttccaattcttagacatcttaactcctttatttttgttttgttttatttacattgattgtggccttcagaaaagtttggagggaaagtggtgatctaacatcttgtcttagattttaaaataatgtctatcaagttaaaaattgggagttctttaatttttgttaagagtttttaaaataatgagtaatgaattttatggattttttggtaaatacaatgagatgcagatataggttttcatgtgtaagttactaatgtggtgttttcatttttagatttgcttttccattgaaccatccttgcattcctgatgtacattttatgatgcattaagaaatacctgctatattttcttccagactttaacatctgtgttcattgtcaggtagttctcatattttaattttttatacagtccttatcaaattagtataaagaacattttagcttctttcagagaattgggtaatttttttccattttctgaaatagtctgtacagatcataaaaccctgtgagcctggatatcattttcaaggcagacttcaaattgacaattgaatttctctgatggttatttatttgttctggttttatgttttctcttgagtagtttttgtaatttatatgtttcttgaaaattatccattttatccaagttttgaaatttattatattacattcatattattctgatttaagattttattgtatttgtattttttgaattcttaatattgtgtatatgtatattttattttggcatatctgacttacaggttgccattttactagtttgtcagtaaaaaaactagcttttgcttttacatatattttattacatcttgttttatatttcatcaatttttgcttttctcttattctgttttttcatggtattttattttatttatttgtgaaaatgtgttgagaatatattatagaccaggcactgtttagagatttggcatacacttagtacaaaatttcagtagttattggaaacttaatgactcttttgtaatttttttcatttttcattttcatggatacatcacagttgtatatatttacggggtacatgtgatattttgttacaagcatacaatgtgtaatgatcaaatctgggtaattgggatatccatcacctcaaacatttgtcatttatttgtgttgggaacatttcaaatcttctcttttacctattttgaaatatataacaaattactgttaactatatttgtcctattacagaatacctgatcttattccttctatctaactttatttttgtatttattagccgagccctcttcattcctccccactacccttcccagcctctggtaaccaccattctattcactgtctccatgagatacacctttttagctcccacatatgagtgagaacgtgaagtatttttctgtgcttgacttacttcactaacataatgtcctccagttatatctgtattgcttcaagtgacaagatttcagtcctttttatgactgaataatattctattaaacacacacacacgtaaacatatatacatatacacacacacacacacacacacactccacattttctttatccatcaatccattgatggatactatatcttgactattgtgaatagtgctgtaaaaaacatgggaatgcagatatatctttgacagatgcattttctttcttttggatgtatatccagcaatagaattgctggatcatatggtgttacagttctatttttagtttttgaaaattcatattgttttccataatggctatactaatttacattaccaccaacagtatactagcattgccttttctccacattccatccgcatttgttattttctgtcttttggatataagccattttaatttggttgatacgatatcatattgtgggtttgatttgcatttccctgatgattagtgatgttgagtattttttcatatacctgttggccaattttatgtatccttttgagaaattcagatctttggccaggcatggtggctcatgcctgtaatcccagcactttgggaggctgaggcgggtggatcacgaggtcaggagatcgagaccatcctggctaacgcggtgaaaccccgtctctactaaaaatacaaaaaattagccaggcgtggtggtgggtgcctgtagtcccagctactcaggaggctgaggcaggagaatggcatgaacccgggaggcggaagttgcagtgagcactccggcctgggcgacaaagcgagactccgtctcaaaaaaaagaaaaaaagaaattcagatcttttgcccatttaaaaattggatgattattatttgctattgagttgtttgagttccttatatattcaggttgttaacgtcagatgaatagttgacaaatatttcctcccattctgtatgttttctctttactttcttgattgtttcctttccactgcagaagctttttagcttgatgttatctgatttgtcaatttttgctttggttgcctgagtttttgaggtcttactcaagaaatctttgcccagaccagtgtcctgaagcatttgccctgttgttttcttctagtagtttcatactttcgggtcataggtttaagtctttaattcattttgattttatttttgcatatgatgagagataggggtctagtttcattcttctgcatatggatattcagttttcctagcatcatttgtggaaaagactgtcctttccccattgtatgtttttgtacctttgtgtaaagtgagtaggctataaagtgtggatttatttcagggctctctattttgttccattggtctgtgtctatttttatgccagtaccatgccgcttggttgctatagctttgcaatatattttgaagtcaagtagtgtgatgcctctagatttatactttttggtcaggattgctttggctattctgttttctattgtggttgcatacaaattttaggatttcctatttctgtgaagaatgtcattggtattttgatagggattgcattgaatccgtaaatcactttgggtaagatggatatttttacaatattaattattgcaatttatgaacataggatatctttccaatattttatgtcttttatgtcctcttcaattttttttttttttttttttgagaccgagtctcactccgtcgcccaggctggagtgcagtggcgcgatctcggctcactgcaagctccgcctcccgggttcacgccattctcctgcctcagcctcctgagtagctgggactacaggtgcccgccgccatgcccggctaatatttgtattttttttttttagtagagacggggtttcaccgtgttggccaggatggtctcgatctcctgacctcatgatccacctacctcagcctcccaaagtgcttggattacaggcatcctcttcagttttttaaaatcagtgtttcatagtttttattgcacagatcttttgctttttggttaagtttattcctaggtattttttggtagctattataaatagctttcttgatttcttttttgagattgtttgctgttggcatctagaaatgctactaatttttgtatgtggattttgtatactacaactttactgaatctgtttatcaactctaacatttttttggcagagtctttaggatttttttaaagagtctttaggttttcctaaatacatgattatattgtctgcaaacaaggacaatttgacttattcctttccaatttagatgtcctttatttattttcctcgtcttattgctctggctatgacatccagcactatgttgaataaaagtggtgaaagtgggcatccttctttttccagatctcatcttttgcaattttatcagcaaatggtaaaggtaacatagaacatggttctttgacttataaatattaagattttacttaggttgttgataattactatatttttgttccatggtctttattgaatatatactactaaaaacttggcatagagccattaaaaaaatacaaaatgttttcttggaaacagcaaaatttctaatccatatacacatttcaaggttaatattttatacttgtgactactagatcatttatgctaaatagtacagcttaaagataccataatgataaccttttagattaaccaacatctttgatctaggatcaaggaaatttgatttccctcaatcccttatttttcagattaagcagttaaagtaatcagtcatttttgtgacacagcagggtccaggttacaatagttctccccattttttatggttctagacccttctcctacctatcttcccccaaccccctggtttggtaactatttctctgaacagtctttctgtttctttggtacatttttttccatgtataattgatttattctggtcatttacaattcctattaaattctctaaatgcttttccttgcccaaatttattattcatctcttcacttgaaagtagaattttctttcatagtgaaattaaaagcaatatattaaagtgggaagtatgaggtaaaatattagaacaactaaactcaagggcatttggcatttctgagagtgaagcagcttacataccacagcaatgtcacttgtttttcattgatgagacacacaaaattgtttcctttgtcctatgcctttcccttgaattcacatatctttttgctgaaatgaatcctttcatagttcttttaatgagtgcctgtgggtgttaaacagtcttaatgttttatattttgtaatatcattattttaacattgcatgatggtttctctgggagtagaattttatattggcagttatttttcctcatcactttaaaaggcattgcttcaggttcttctaccatttgttgttcatgatcagaaatctgtgtgtatgatagtaacttcttcacaggtcaaactgtattttgtctctgctaaattttaagactgatattttgcagtttgactaaaatgtgtctaggtgtaggacttatttgtatttatgtttctgaatactcatagggtactttcaactgaggattctcatttttttctgattctggaaaactcttggatattaatgttcaaataccgttcttcattaaaaaaaaatctctaaacataagttctaaattttaagtaagcctttgaagctagaggctctcaaaccatctgccctgattcttaaatgctcctttacaagttttgattactttttctctttttgctggcttctgggtaaattttttggtatcaaaatctaattcactaaaacacttaccagctgcctcaaatctaaagtttatcctatcttttgaatttttccttttaaaacaccattttttttcaaatcttatttatattcacctattcttatctcctttctgcctgattttgtgtcataatttgtttgatttttatacatgtgatttcatctatcttcctgagtattttaaacatgcttgttttgaagtctttgtcaagctattttataaaattaatttcaccacagtaaactcatattctggatattgatatattggctgtcttcttcagtgttatatttcttcacatgttttgggattttgattcacaggctaattttgagtgaattttttgtttgtgttcttctgtctcttgctctctgttcatgtatgtccgttctctctctctcacccactttctctctctgtatgagcttctttttgtggctggtatttttcagttgatgtccaccggggtccccaggacaaaaccacattttaggtgatggtttggagctcctgccctatagtaaaataatgcagagccagtctccaggccaggagcagcttgtttcagatctttgtctagacagaggctgtgttgacgtcttttaaatctgtaggtttttaggttttaacttcatataaaccaggttttctcagtagggcactgttgacattttggaccggatgattctttgttgtgtagagctgtcctttgcattgtagaatgtttagaaacatccccagcctctactcactaaatgcaactagtgccaacttccctccagttatgaccaccaaaaatgtctccagacattggccaaatgtcctctggggaagaaagtcactgactcccccttgataaccggtggtaaaacctgtaaaccctggagtcaattggcaatgtctgatgttagcttcctttatcaaggaaagggtgccaaatccagtccagctttaagcctaaagcctggcttcagcctttcatagtaagtagaggacttttcgtctcccattggaaagagatttctctgtctcactgcctgatttggggctcagcacccatcaggctttggcttcaaccacactcactattactggtcctgaggatgtatatcttaatttatattctggcattgtcttttcagtattcttttgttatatttcacttatcacaattgcatgtttcgagcaatggggacaccatatagcatgaacttaaaattctttcttaaccagaagtcatagaaggaagtttttcaaaaaaagtttgtttttttaattgcacttcttggtagttcaacattttagatgccttattaccttatgccctgacttgattatgcttttgcttcttctttatttgtgattaacaaaagcctccataaacctgctttatttgtagtcaaattctatatttggagtattgatcagactaataaaaattagatatttttgaatgatttctacagatatctctatgactttgtgtatgacctcattggaattgagcacaggcattgcatttgggaaattaagacaattaggagattgtcctacaaagtcagagcaaaggaagcctgtagttagttataatacagagggacagtgaagactgtgagggagaggagggcagcaggaggcttagaccttgctggaaaatcctcaggaatgaagtgaaatgtagccaatttggaacctaccccagccctttccctccatgttaaagttagttaaatcaattccagtgcctatttatagttaagccttggttttgattaatgatgttggagagagataggaaagcggggaggacaactgttaggaggaagggaggaggcaaagctgctgaggctgatatgctcatctgttgtttgaaccctactctttgtcacacacagatttctggccaaatatgataaaaaaatatttttgttagagggcagtaatccatgtcaacattttcactgtatgccaagtgaagaaatcaaatacctaaaccctgaattaaccatatgataaatcatggttccctttttcattgagtcatccagcatgcatcatcatggacacaacctaagacttaaatgtctttagaagttatgcttttatacattaacaaaaatgaaattattaaaacaaacccacattaatggttaagcatagattgcttttgagctgcaaagagctttagagacacacaactggtccaacatttaatattgtctggagaaaaccaagatttgagagtcctaaggacttgcttaaagctgcacaatatcttggttgcagaacagggactagatcccttgtcttccctccaatccaaagatctggttacttctgcccaaaagataatcaattttaattttggtagctagccataaatacttttctggttgacttattctctgcttttaatgttggaaatagatgaaagtttatagttctcataaattagcttcagttactaaggagattagtgtattattaatccctcctattttttcaaaaaaacttttactaaaacccactttccttgaaaactgatattttctaaagatttagctctccagctatgcactcaaacagaggattgtgaatggggattgtctgcattaaaaaaaaaatcctttctttcttgttaatcatgaatttaaatattatagaaaggtagagggacatacagtgactatgctcctccttccacttaggtggctatgtaaaatgtcttttccttgatatatgtaattgttgtttactcacagtaattttatgtcagaatctcaacagcatgggttgggtaatgactatccatttgtttatctacaggaaaatggtattgtgtatgaagcaagttcattatataggacaattgaatttttatttcataactttatcttctttttctctttagtgatttctctttgtggccccatgcatattgtgcagattaattaatcatgcatgagctcggtacaatctacaatgattcactgggtaaagcagttttagggaatgcattgtattataaatgtggaaatgggatagacacctagaatatatcagctatcagtgaatgtccttaatcatagtcatatagatttctacttactaaaatgaagtcatatattttggtagaatccttcattttgaaggaaagctgacatgcaacgtaatttatctgtgtatgtgtataaagctgtattaatttcctgttgctgctgttacaaattactgcaaacttagtggcttggaacagcacaaatttgttatcttacagttctggagatcagatgtctaaaatggatttcactgggctaaagctaaggtgtttgcagtacttcgtttattctggagggtctagggaagaagttgttccactgtctattccagcttctattacagaagctgcctgcattccttagtttgtggccccttcctccattttcaaagccagcagtataacttcttctattttctctctgacaatgcttctgttatcacatttccttcttgctctcctgcctccctctttcccttataaatactcttgtgattattgtgaaaccctaaggagtaaaaagaaaattagaaaatgggcttacctggcaggaacagaaatagataaggggagcaaatgttttgagaaatggggtcaaccacaaaaggctcactggcacccatagcatcctgttacgagcattcagctcatggcccacctgcattcaagcattctgtctgcaagcattcagctcaagcagcacgaccttataaaactccccttccagcccctgactctgcagatagcagacagccttctttctgctgtcttgcaatgtatctccccttctcctctaaataaatctgcctttctaaactcattactatcttggtaaattcctttaccaccagtgcactggcttcagataatcatcaaccatgacaattatattgagcctacctagataatccaggattatccctcatttcaaggtccttaacttaatcacatcttcagagttgcttttgccatgtaaagtaacacaatcaaaggtttagtggaaatctttggcagggggttattttgcctatcacaaatgcgtatgaaattgggagactattttgaaatagcctgtactcatgctactttgcatgatgaatatgacacatactatttaaactatgtattttctatagcagcaatctctatagcaccaatggtcatagaaatataatgtaagctacaaatgcaagccacatctggaaattcaaatgttctagtagacatatttaaaacataggtgaaattcatgttaattatatattttatttaattcagtagatccaaaatattatatcaacatgcagtcaatataaaaatatcaatgagctattgatattctttgttttatactgtcttcaaaacccagaatgtattttacacctacagcatatctccatatggattagacacatttcatgtgctcaatagctgcatgtggttcatggctctaactttggaaagcacaactctgtagccaaggtttttatagctccacacccatttaagagttatattgtctactcaaaagaatgtgatatgatggctaagacattgaataagacccgggtttctcaacactggcagtattgacattctagaccaggtagtttttggttgtgggaagctgtcctttgtattgtgggatgtttagcaatatctctggcctctaccactagattccaggagcaaccctccagttgtgacaaccaaaaaagtctccaaatattgccaaatgtcccctgggtggcaaaattgtgcctagctgagaactactaggctaaacatagaaagtgtgttagtctgttttgtgttgctatgaaggaatgcttgaggcttggtagtttattaagaaaagaggttggctgggcggagttgctcacacctgtaatcctagcactttgcgaggctgaggtaggcagatcacttgaggtcagcagtttgaaactagcctggccaacatggtgaaaacccgtctgtactaaaaatacaaaaaaattagctgggcatggtggtgggcacctgtaatcccagctacttgggaggctgaggcagaagaattgcttgaactgggaggtagaggttgcagtgagctgagatcacaccattgcactccagcatgggcaacagaacaagactccatctcaagaaaaaaagaaaaagaaaaaagaggtttatttggctcatggttctgcaggctgtacaagaagcatggcactggcatctgcttggttactggcaagggcttttgtgctgtgccaaaacattttggagagggtcaaaggaggaatcagtcacttgggaagggggaccaaacccagggtatactagttataacaatccattcttgccagaaataatccattcccttgagaactaatctgctgtcactagagtgagaacagcaccaagccattcatgaggaacctgcccccatgtcccaggcacctctctctacgcttctcctccaacactgctacactgtgggccaaatttcaacatgagatttggcagggataaagaaactatatccaagccatagcagaagggttgggtttgaattctgttctccatacattactgtgaccttgaaagaggagccactttaaattgttaacatagtttcatcctctttacaatgggaaaagtattatctaggctgcttgagcctcaaaagagacagtgtagataaaacagctctgtaaactgtagatactctgtaagacaaactcagcattgtctttatttgtttatgttcagcacttgaatgtaagtacagctatttcagtactgatgtattttctcataatatttaacttattttttaatgccctatttataatgattggactacagtgtagacaagatgttttaggtgttttgttttcctgtctgtgggtgctcatgggagtacagaaataagtagaactgggtcttttcaatgagttgatcaaatttgaaataactgggagttgttctgtggccttctcagctctgatagggtacacctgcctaaggaacttgcagagatattctgcaaattactttgtttgacccaacaattattgaacacccattcctgttaggaatagtgctagttcctgggagtagaaaaaagaatgagacaagattctatccctcagagtgcttgcaagagtagtaggagaaaaggcatagacattaatggaaagtatttggatggaagtggtgcttggaaaagagtcaggagaatgcaaagagaaggttgcaaaatgacgtttacaggaaggtcagagaaaggcctgagaaaggtgcagaatgaaaaagtgcatggactggtttgacattttgggaaatggagcatagcatgaaggaaagagagagaaaaggagaacataggagtatagtctccctaagaaaggtgggtccccttttgcaaaggccaattcttgggagaaggagtaagctaggagttcttagcaactgggaatgggtccaccagcagtaagggtctgtggcagcaccacagcatccactataggctctaatgtgtctccaccttttttttttcattattgccccctcaaggaagctttttaaaacattttttctctaatctccccagcctccacccatgaaatttacatagcacagatatcctatttatctgtttgtgttgtgtatttctgtgctttatacataaaaataatacgttttcttcgcctctcccagtaatcgatttttacccccttggtggcgatattgcctagttgagaatacatgtgctacgtttgtcactcatgagctgtgttattggctttggttcccttgactcaaaaatgttttaacagtcattctgtgtttcagggtgatatggtttagctctgtgtctacactgaaatctcatgttgaattgttaatccccagtgttagaggaggggcctggtggaaagcgattggatcatgggggcagatttcccccttgctgttctcatgacagtgagtgagttctcatgagatctggttgtttgaaagtgtgtagcagttccccccttggttctctctctcctgctctagccatgtagaacgtgcctcttcctcttcaccttcctccatgaatggtaagtttcctgaggcctcctcagccatgcttcctgtacaggctgtggaactgtgagctaattaaacctcttttctctgtaaattacccagtctcaggtagttctttatagcaacctgagaacggactaatacacaggggctacactgaaacaatccctttctcaacacttgggggagaaggctggagtaagagtttctgagaggtataggggtgtgatcctgcttgtgtgccacatgtctgcccagcaggtccttgaggatagagttggggtggaagtggctaggtgggccgtggaaaaggtcctatttactgaatttgccatatagagaagtgggtggtgcccgcacagggaccatttgtgccagtggtctgggagccctggatgtggtgccatgatggtctgcagaccaaaacccttcctggttcctgccaagggttcttggcctcatctggagttattgggaaaaggcccagctaaaagtaaagtacaaccttgttttctgttttgctgtttttctttgtacatgtaactcttccaggaacctgtgggcaggggacagagggtgaatacagtcaggatttagcccaaagctatcaaacagcaccaaccattgactcttcctaagagtgtgagtccattttctcttttccaaagaatggcagcctggtcacaaactacattgccagaagaatgatgggattgatactcaaaagatttatagttgaattatagacagggaatgccaaggaagaaacgctgtgagaaaactccacatttgtcctttatcatttactgttaaaaagctctgtcagagcttcccagaaccttctatattagatagggctctggtcgctagtaatctaagctgattgaactagctaaaggacactctgtgaaagtgtgtgggaatgtctgtgggtctcaaaagtagagatggagccagatctcagaaaaggctgaaacctaaagttagaattatatatgcatcattccagaatctctcattgctttgtatttgctttattcatctttctctgttcactgtccttctcagattctcaatttccatggtggccaaaaggtagcctatcctcagaggttatatcaaatgagccctgttcctcacagagccgctaacagttcttcagctttgcagtctcaattcccagatgcaagagtgtgattgaccctccttgggtcaggttaacgcttaagtttggtcacacataatggaacaaatatggctgctatgggccaacctttggaatagggatagagcgagtagattagtagatggaaggtcccagagaaaataatatcatattgttggcttctgaagctatctgctacaggcagtgatcactgatttttccagccagaataaaccattcaatttcaataaattatgggcattttagataatggaaaccttagtgtttaaacaatgttctttccttattctaagtttacagctagtaggcttagttggttggtacataaacaaggagtgataacttaagagtgagaatgtagaaggactagctggatcataatgccacttactgaaagaacactgaagaacactgaaagaacactggagttgtatcactagggatgctgagttattatagacctctcctctatgagaagtgttatttcttcccatcttagttcaggctgccatataagaaatgtctttgactgggtggcttataaacaatagaaatgtatttattatggttctggaggctggaagtgcaagatcagggtgtcagcatgtttgggatctggtgacggtctacttcctggttcacagatggacaactgtcttcttgctgtgccctcacgtggcagaaggggcagatgaactatctagggccttccaaaggctccacctcaaaataccaccacatcggggactgggttttaacatgtgaatttgaggggtacacaaacattccgtttatagtatctcccatcccaggtaacagctgtttagatcagaagtggatacctgacccaaatgacaacctggtttttctcttctgaaatttagaattgagattggaagaccttagtcagtttggacatctacagtgtgccagaagctagcagttgggtgtacagtatttaacaagagagaagttgctgctcacttaaaacatgcatttcagctttatgttcagctatgtgcaggcaaacagacacgtggaattatgatgattttcacttcctcctgaagccagctgtacatgtggcccttccaggtctgtgagattgagatcacattatcagtgatcacactaggaagattaagctaatttgaggtgaatttttattacttaaaaccaagaatgtgtgtgtatctttgtttatgaaatgtttttgataatttatttgattggttgattagtctccatctttttaaaaagaggttaaattctttgagggcttttttttttttgtacttttctgtccccagggtgtgccacccactatgcttggcatattatagtcactcagttgtcactgcatgttgtctggtgcccctgagcactcagtgatatggagtgagagaaagaatggttataacttgggggaactccaagaaaacttgatggagtgagtagccttgaaggatgaaaaacttttaagtggaaatgcaagggcaaggagtgagacaggctattgtaaagaggggatttactgcttgttggtttgaattgaaaaaaattcattgtgcgcttcctttggaaggttttttaagattttttttctcagctgcagagtgaatattaggcagggacatataaattattagatcttcactagatcccaactagtgattcattccttggaaagataagctttagcaactacatcttttgtcctaatggaaataatcctatttgttcctcatcatgcactaagtcaaggggaaagaatgctggataactttttctcattgttgtgttcagaaatgtagttacactccattttagcaagcacattatgccctagcttcttgccgtttttcttaagagtgtgtttcattccctacaaggtcttctattctcttgtaaagtgtcttttattatgggttcttagtaattgttcccttcattagttagaaaagttatgttttagagccctagctgtagaactctttcctctttatgctaagatggattatatgaaaacaatctgattaaaactaatgcatatttagaattaaaacacaaaaagttgcacacaaatgtttatagtagcaatacccataatagtcaaataatagaaacaactcaagtgtctgttgacttgtgaatggattaataaaatatggtacatccataaaatggaatataatatggcagtaaaaatgaagtactggtatatgctacaacatagatgaactttgaaaacattatacgaagtgaaagaagccaaacacaaaagaccacatattctatggtcccatttatatgaaatgcctaggacaggcaaatccataaagacagaaagtaggttagtagttgtcagggcctggggagaggttggaggaggggatggggcatgaatgctaatggacatagatgggatttctttgtgtggcgatgaaatattctaaaattaagtgtgatgatggtggcacaaccctgtgaaaatactaaaaacctctgaattttatcatatgtatcatatgtgaattatatcatatgtaaattacaccttcataaatctgtttacaaaataagacatttctgtgtgtgtatgtatgtatgtttctttgtgtatatatttacatatgtttatgatgtttcagatgttggcaagtgcagcaagcatcattaccatgggcacttcctccatatgaccgctggaggaatttagagtgcatataacaatccagggctctgccattggctgtgtgaatttggatgggtcatttcatctttctcagcctcagtttctcacctgaaaaatggggataagaaaccacctttgcacagtccctataagaattaaatgaaatggtgtatgtgagatgaggtgactcactcattaggcagagcaggcacagtgcctggggctcacagtacttcaagggcccatgaaaatgttttaatttcttttaaatgcagaagaaagaaagatgtccttttaggtccaataaaaagttttaatgtataatactaatgtatttgtctttacaccaatctggtcatacagcatattttgtatttttttttttttttttactggaggaagaggcccatgaaacaaaggtaactcaggcccatggaaggcatcatggacacttgaacgtggcagctcaatgacacaggctgggtttatcttattgctctgcaaattcaacagaaacctcctctaaaatcataccaacaatttagcaacagtgtaagcagtctgtgttgagcagctcacctgcacacgcctggaggcatacacctagaggagaggaggaacactgggttggccagcctgggttactggcaggttcttccatttagtagtgcccagcctcctctttcttctagggcatctttgccaccattgctcccatttgttgagtccctgttatgaaccagacacttcatatttcttatctctgatcctcacaatctcctgtaaaggtgagtagtgtcctgaatgtagcagatgctgttgatgccctttccacttttcttctgcctgatattccctgcagctttacagtgtgcagtttttggtatgctgataggttgccactgcaaggtcctgccattgtcttctttgccatagctgcctctcctgcttctcttccttcttaaactctgcctgagggcttcctctggcatcccaggagcttgctttattgtttatagcggcaacctgaaaatgtcaagcggggttaatgcctcagagaatagccctcaagtaatagtggacagaagtaagtagaaaaatgccatagctccctcctgtctagtgagtgattctgaggtgtgttccttctggtttctcagagagtgctttacaagattgagccccacctgtccatagcaggaacctattcatctatgtactttttgacttttttttcttcttctcacatttcacttcctcccttggacctcttgagatcacttcctatgtaaactccctgcatccccatacttctccagggtcttcttttggtggaacccaaatttaagataatgagtttgtaaatgtaaaaactaaggctagggagaagttggggaacttgtcccaggaccactgcccctaaccaatggagccaggtttgcaacctacatctatctagtcgcggggcattctgtctttcagccattgcagtaagtactattacaagccaggagttgcttttttagttatgacggaatctgccattcctggtgccccataggtggttagccatgccttaggtgggtgtattagtccgtttttacactgctgataaagacatacccaagactgggaagaaaaataggtttaattagacttacatttccacatggctggggaggcctcagaatcatggtgggaagtgaaaggcacttcctacatggcagcagcaagagcaaatgaggaagatgcaaaagcggaaccccctgataaaaccatcagatcttgtgagacttactaccatgagaacagtatgggggaaaccgcccccatgattcaaattatctcccacggggtccctcccacaacacgtgggaattacgggagtacaattcaagatgagatttgggtgggggcacagagccaaaccatatcagtgggcagagaccatacagctgaaaggacacagagtcatgatgtctcatagccagacttgtccagcttcaaagtctgggtttcttctccaaaagcctcatgcttcatggtggttatgatggtagtgatgatggtggcgatgatgataatattgatgatggtggtgacagatttttcggttgtcagagtttactaggcacctattttgagcctgaaaatgtgcaatgtaccataaccatgtcctcagatttaataatccaattttgcagaaaaaattatttttatattttgaacactaaaatgtaccagaaccatcattttctcattgatactattattccattacttaaatttatttgtacttgaaggaaaagtatcatttcagtcactgtgctcatataatcctgccatgtttgccgggttaccttagggttacttactctagagttgtagctgtgaattatcactttgtaaaactgaaatatatttatgcaatggtagtaagtgggagagtaatgaaaaccaggctttatctatttttgtccagtaaggacaaaacattcttaaataataatctgctgtatccacaagatataattgcatacagattgcagacttaattcttaaatcagcgtttttgaagaatatacccaaagaaaaaccaattatgattatttccccttatttttcattgaagcctgtagtatcagatgtgctgttaggcttttgcactggttcgctcaaagctttgttgaaagaagccagaagattacaaattatttgttgccccagctttttggctacaatcaaacataaatttaaagtagactgtaaggtcactgtcacaagctatacttttatacatggcataacttaacagtaaccaagccaacaataagaagttgattacattccttcacggctattttaaaaatacatacttacaaaagaagatggagattttaaaccctgaacataacctcagattctcagttactttgtctataattctgttagcttcatgaatttttcctctgagtaactccaacatcatctaacccatctctgaacactaaataatggtggaaataccttctcagtttgctttctattagggaaagaagtatggaatcaactattgtgctgtaatcaccaccagggatctgtccttttatatccattcatttctggatctggccttttcggggtacttcagaaacaaaatcctgcctctagagaagctccatcatttgtacattgtcactgttcaacatctctttggacctctgttgatatcattgcttgagatgacagactatgataagagaaacaaggttctctataaggcagcattgactgcaggaagaggtgagaattgtaagttgtcaaaatgcaaagggcaaaaaagtagtctgccaggaatatgttcatacagattattatatacacttactgtctgtaacagctaagcattcaaagattacaatgaagatgtttccaatatttttaatgggaactatgaattagttcatgagttggcaactgtaagaacaaaatcctacttaatcaaattaatactgactgaggcagaaggatttgagcatcttgttatgagaaattggaagaatgaaagaaataagaaaccgacttgagagaatgaagtattgaatgaagtggttttgtaacgtgggatttgtaatcactacattttgagcaacatttatgttttgtgaagtggtcttcctaatgtatttaagcttttaaattacccctcatatataggtttcattcaaaagtgaaagtggtacctaaattaaacaatgtctaaactttctattgggttcagatgaagttttaagattttaaagagtaaaactgagcctcaagagacccaaaagtaatttaagaaatggtatcctcacactaataagatgctcccactgtgctttcccctatgtgttccctggactgtgtctaagggagatcctggccattgatttcattttcactttaactaatgatgtgaccctatcaggatctattcattcactctcacaggcctcattgatcctgtttgccacaaggactgctaagacccttggatctgcatggacaaaccttgccttcagggagatcatgaagcatgtacacactatcaataagtggaaactgcaacaagagcacattcttggggttctcagaaacagataacatagcaaagagtttaataaaaatgcgagacaacccttggagaaccattacaaggagttccactaagtgtagcagctctatcctggcaaatctttattaattccctcagttcatttgtataacttgggtaaagctaagccacttcctatccagtccaagtgggtgtcacattcaaaccaacacaaattcaataaactaaatctttgttgctatcttctttatggtgaaattaaattgcacaacacacagaaaatcatcctgaaaatcttcaacagtctgaactcccaaatcctattcatcacagcgaactgcctttgcataatttctttccttcctgttctcctcttccctcccttctcttccttttccattccccacctagcttcctctctcacagcactccatgccccacaacttactttctggatctattcttttctccccgggatggggttgctcttggctctcatatagctcatactctcttctctgggctttttttcagttcacctttctacccattaccgagatcatacaaattaaggccagaccctatactctcaataaaaaaagactccatcttttttgggggctgatgtgaggctgtgaatattcaattgttgttattaggattttcctctgtcacatcagtttcatggagtatttctgggagaaatagtcttatatttctcagccctcctgggacatccagattagaggaaaagctcttgaaattcaaaattacaatgagatgtttaaaagaaagtgtcgggcacccaaatgcctgcctacttgccttcctcacatggcaatagaatctgaacagtgtactcattatttgggggactatccagagagctcttgtacaagtaacacagactagttagctgccacgcccactgccactccccctgttcttcttctcctgccccatctccaaagccacttggcgaagcttcacccaaacaccttccctatagcagaataccagtgtctctatcaccaggcactccaaaattcccagtcctctgtgtgccagcttgctgctgggttccatgtagaagtgaggaagagtggacagctccccatctcttagtcaggcttcgtcatttttacctgaagcttaggtactgagtctcccatggaaatccaagagccttaaccagagaactcaaacccaaacttagggaccaaatggagaacattgcgtccattctccccctccctcctcctgtcccttgtgcacaatcaccaactcttatctcctccctctgttacttagcatggcttcccaaacagatcagtagataccaactgtagtggatgctgtgaggcttcatccaggcctctcttcagggacagctcattcaatcctagcttctgggaatggtttgtactgaaggcttacagctgtcccctgaccagaattatccttggccccagggaactggctgtccaaagattacacttcctctgaaagggcaatccattaccattgactggctgatttagggatatgaaggtcaagcctccttgcctctgaagggccaccacagctccagagctccttgttgagtcagctgaggcctccattgcaattgtattgcaagtcaactcttctttctgcctgatccttccttgctcacttcctcataggtttatctctttagaggattttctaataaaccttctacatgcaactacctggtttagtctttttctagagaacctaatctaagaccccacaaatacttttatttggagaggatggggacttgggagaggccccagataggctaggtttgagcccagttacacaataaatagcagctatttatgcatgaggtatgtagatttcatggggacactgggaatttctagatgtctgtagaactcagcctccaaattcactcatgaaacttgagccactttgtgactcaaacttgagccactatgtggcagtttcccactgttgataaactcagtgactaaatcacttatatctaccatctacacaaaactattcatcagaatgtgtttggggcccttgatctgggccctttttgggttataatgatgggattcttgtacagtgtgatagcttggttgtgtttttaatgcttcattctctctaaggcagtatgattttccagtgcactagagtgggttgagtatatttttgcaccaataattggtgttgggggccatatgacttgctttagccaatggaatgctagtagctatgatgcaagtggaggttttgcatatgcttacatggttaggcttgtcctctggtctcccgatgttgctgtgattagagcatgctccaggtacttactactctttcatcctgggcttcacgaaacagatgagcctgagccaaaccaaactgactgcagtctaaagcagagacactgaatgggattggatgatacttgttactgctggacacagagctgtaactcaacaatttgggttagcatttttgatagtttcacacataaaatattgtgaatttttcatttccattttgatgtattatactcttttatcttgttaaatcagagatgttatgcatacagaccataaaagtgcacctttaagaaattttgttctttatgtgtaaacctaggtcttctctacacacaatcctgttttcttctctaagtataaattgcattatttttcttgataaattgtattctaacatataatctcatccctctttcctcactatatggataatgcaaaagcttcctgttagtaaatcacaaataatgtttaatatcagagtcacagaaaccacagaccctttgatgtctcaaatctgatgtatttcaagcatccccctctacacatgcatatacacaaatgagatctgtaaacactgcacatacacacccacccatgcatttgtaagtcaaagcagcaatcgactgagggtaaaacactttctagagcattattttgtaccttgttttgtgtgaaaaagcaaaacagttttcacattgaagctctgttaatttaaaaaaaaattataaaattaggactgaaatgctcacacctatagatcttcttcatcagggtagcatttgctacttcccaggatataaattatactctcagtggattaagtggcctgaaaaccgatttaggaatttcacaatttttgctcagggcttaaatgcttcttgagagccactaccggtgagatggaatgagcaaccttagtgctactttccagggcagaaattccactctgcttttcagagcgaaggtcatgttcatggccctttctggagcacatagcctcaatcaatgccatgctgacgaaaatgtgtatcacaatctccgtgacttaagaataaagtcaggtgggccagtttagtggttttcagtctttagggatttttaaatgtcctatcactcagacacatccggtgttctgggcaaagcatgagtccataagcactcaagtgagttgagctcacctcctcagtggggatcttaatgctaatgcttgcatgtaagtgccctgatttccagtatcctccagtgtcaattggggataatggtaattgaccacacagaggtttagtaaagagctccagcgtgggtctggcagataagcacacccagaggttgtggacagttggtagtgccacattaccacccctttcctcaactggacaatacccactgtgtgagttgggatgggaagcatatccctacctcctcttgcaagaggttgagagggaaaataatccctctcccatgcccaggtgggcagagcaaggggctcatgacatagacctaaccaatcagttatttcttcctgaacttgtagcctggaggtaagtggcagggtagtgtggccactgggccccatgatagtagcactgcacaggcacagagaaagtgtcaggtatcccggagagacacttttgttatgtagcctcccttgattcctgtgcattttccaagcctgaattttgagaaaatgctaatattcttccaatatattgcaatatacccctctgctttttaagttagatttagatttctgttgcttgcaaccaagaatcctagcagatacccagacaaatgtttcatttgataaactttaaagcatttcactgatgggaggtattgctttttttattaagatatgtcatgatattaggaacaaattatatatatatttatgaagcatcaaaataagacttaaaaagtatcagttacattttactatctagtggtagagaatatttgtgctgtccacagttatgatataaatatccctagttcttttttcatccttaatcaactcttgtactcactccatttttgctaagcaaccccctctcacctccatacacacagcactactatgactagcaaaactgcactgtaggttctttcaagctttgtcttactttttttgtacttactcgccatttgttcttagcttcttttaagtgttttctttgctgtggttgtccttcagatgttggagttgctcagagttctgttctcaatgttcctgctctccctgggcatcttctcagctgccatggttactgccaacatggttgtgctgtaagcttcaagaaggaaaggacttcttacttcatattcaccactgcatgtctctagagattgacacattggccggcacatagtagacatttaaaaaaatctctgttgaatcagttttatcttatattggatgctatgaaatatttgtcttcagcacggactgcttctgggttccttaccagtaatatccatagcatgcttttatttggataccccataggcctcaaactaaacatgttaaaaactaactcgtgatgctcactgaggcataaataaatggtctgtccctctgtgtccctggtaccatgaatggtgcagccatctggtgtctggaggcagacatctgagaatctccctctttctgtgattctttaccctcccaccattcaccacatcctcttgattccatcccctctctccagctctacttcctctccctgccaccaggcatgcaccaccactgctcttttggatcagttcaccagcctgccacctactaggcctcccttcataatggctcccttcccatacactgctgctgtccctctcccacacccctcccctaagccccactagctcctacaatcctttaggacttatcccgatcagtcacctggaactgcttgctggtaccctctttcctggtttgtgcttctctgtgcttaacattcaccattcctgtatggtctgactgttgacttccatctaccagccaatgccaatctctggacatgcctctgtggatgctgcagtctttctagcctctgcacagtacaggatggaagtgccaagcagtcacatctgccaggatcaaccctcagcacatgtccagtgtgcttccttagttttactaggaaatctctgagacatgttccacccaggctcgcaaaggtccccagcagaactgaacctcagtggcccacaatgggaagctgtgctacgggctttcttcccttgccaatctcacttcacactcccctactggtgtttcctgggaacatcagcaaaataaactccatacactcatatgcttgcccactgggctcaatcctgccagaacactttgggcgatagtatagaacacctctcagagttatcccaactggggaccagggaggttgatgtatttgcccaccaacacttcatttgtcattggtaagggcttcttccaaggacattaactttctggtatttccacttagccctgcacaggaggtcttgctccttcagccagaagaaaagccctcaggcagagatttacaggtgttcccggcaggcaggcttcagcaaacaaggtggaggtcgagggtgaggcatcaataatatctgttccacaagtttaaattttataaaagactttgttattctgctgcaacgctgagattttccctatttgtttctgggcttggagcttatgaaatagaatgcgagagtgtttcttcccccatgttcaacgctgaaagcatctggtccttgacagtctggttaatctggtgtgttaccatccagatatactctgggattcttacatagtcaaaattacaactgtccttctgcatactgatactgttttcctttggcttaccttggattcccaggaattcatgtatgggcagcatgctgtgcctgtattctggtcaaatggcttttgagagtagtgcatggtatcttggctatcactgcagagccacccacctatgagagtttccagaaaaaagagcttccctagaacatagggtattatgtcactgaaagcccagacttattacaaattgccatctctgttccatttactctctgcattctttattttgcacaagtagaaacattcgttttgaaaccacacatttcattgttctgctgtgtttcctttttgtgtatgttcttaaggtgtgcaactttataatttgatatacatatacattgtgaagtaatcactacagtcaagtttatgatcatatccgcacctcacatagttaccggtttgtgtgtgtatggtaagaacacttaggatctatccccttagcaaatttcaagtatacactattgttacctgtagttaccatgctacccaccagagccccagaatttactgatctggcataactgaaacttgtacttcttgagcaacatctctccatttccctgttcccccagcccctgaaaactaccattcttctctcggcttctgtgagttcgactattttagattccacatataagtgatattatgtagtgtttgtcttatttcatttaccataatgtccaaaaacacatggagattcttcagaaatttgaaaatagatttttgagtattgttaccataaaaaattataagtgtttaaagtgatggctataaaactaacccaattcgatcattatattatgtatacatgcactaaaacatcacattgtgccccataaatgtctacaattattatggagcaattataaatttaaaaaataaaaaatagaactatcatataacccagagattccacttctaggtatttacccaaaggaattaaaatcaggatctcagagagatacctgcactcccatgttccttgcagtattattcacaatagccaagacatggaaacaaccttaattcccacagatggatgaagagatcaagaagatgaggtacacagacacacggtttattactcagtctgaaaataaatagctttatttatttatttatttatgtatttggagacagggtctcactctgttgcccaggctggagtgcagtatcatgatcacaacttactgtaaccttaaccccccaggctcaagcaattctcccatctaagcctcccaagtatctggaaacacatgcatgccccactatgctgggccactttaaaaatgtttttgtagagatggggtcttaccatgttgcccagactggtctcaaactcctgtgttcaagcaaccctcccacctcagcctcccagagtgctgggattacaggcgcgagccaccatgcctggccatggctgtgtttcttaaatggaaattatgtatttagaatataaaaatgtggtacatatacatcgtggaatactgtgcagccataaaaagtatgaagtcacgtcctttgcagcaacatggatggagctggaggccataattctaagtgaattaacataggaacagaaaactaaacactgcgtgttttcacttagaagttggagctaaatattgagcacatatggacataaacatgggaagaatagacactgtggactactagaatggggaggaaaggagggggtatggattgaaaaactacctattgggtactttgctcactgccagggcacaatatacccacatagcaagcctgcataggtaccaccatatctaaaataaaagttgaaatttaaaaagaaagaataataaaagtatgtatatgttttaaagaaagtggcactgtaagctggtattctttgtaggtttttgtcaacttaagggtcagtgtataaagcagctgaattcatcatcttcccatccccactcatcctcttccagagtttccatccctgtgaagggcaccaggtccactgattgctgaagccaggtacttgaatgtcagtttctgcccttctgtcctcccatgtgcccaccctacatccaatcagttatcaagtgatatgtcttccattttctaaacatctctccagttttcctctctccagtgtcccatgtgagatcacaccaagacctgtggcagtcttaggactggactctctgcctccaatttgacccatcagcaatgcactctctccttttgttatttgagtgattttttgaaaataaacatctaacatctacttccctgcaaaaatgttttgatggctccgcattgctcttagaatcaagtctaaactctgaattcacttctctactttttcatccttagccccaactctctatcctctcctcaattttttcacaaacaaaacacacttttagcttcttgaatatgtctcatggcccctcacttgtaagtccttactcacgctcttctctctgcctggaacattattgcttagtcttgattgcttgtgtttctcaagagccaagttcaagccctgacctgctgtcagtttctgattaaaaatgttgattttggctttgctttttatattaacagtgataaactctgtaattccttacggcttacagaatgatatttgcttctcccatggggattcaaagtaatttttaatgcaacatatttgacaaggaaaaaagggcagattcaatactctactatcactaccaatgaaaaaaggtggtagaacagatactaatcagctatattaaattggccataaacttcactcctactgagatatttctcagtggtcacagataagatggagacttagttaacacggatttttctagctgtgccatatttttttaaagctattaacatttttggctttgaacttttctttttctctttaggttgccaggaattggcagaccatttttgtctaattataacagtacttggaccttatgataaattcacagaaaatcactattttggaaatggatgcttaaaaatgcagcaacaaaaatgcatgcaattgaaattaatcacaaatatttctgagtaaatgttatgcttaaagccctgtattaagcctgtgaaaaacacagataagctcataatttaaatcaaagggtatagggtgaccaactatcccagtttgcctgggactgagtgggggaaggagtcctgagaaattgaattttcagtgagaaaaaacagaaggtcccaagaaaactggtacgagttgatcaccctagctacatatcaaaataatagcatgaattgttttatgaaaagtgccacacattagttttaacaaaaaataattacatgcttgggtcaggtggggaaagaagagatatcaagacactcacaagccaggaaaatggctatgatcaaagacaatgtgctttgaaacctttgagtatcaaagataagtatgagtcatgagaccagagaatttagaagaggccaaatttgaacaccttccaaattccaagcctgggggccagaccttattctctaaggacttgggtgctaattttggagaatttggggcaagttggaccaaaaattattataaaagcaatttttatggaggagtagtctaagttcttttttatttttaatatactttaagttctggggtacatgtgcagaacgtgcagttttgttacataggtatacacgttccatggtggtttgctgcacccatcaacccgtcacctacattaggtatttctcctaatgttatccctcccctactcccccaacccactgacaggtcttggtgtgtgatgttcccctccctatgtccatgtgttctcattgttcaactcccacttatgagtgacaacatgcgatgtttggttttctgttcttgtggtagtttgctgagagtgatggtttccactttatccacgtccctgcaaaggacatgaactcatcgtttttttatgactgcatagtattccatggtgtatatgtgccacattttctttatccagtctattattgatggacatttgggttggttccaagtctttgctattgtgaatagtgccacaataagcatatatgtgcatgtgtctttatagtagaatggtttataatcctttgggtacataccctgtaatgggattgctcggtgaaatggtgtttctagttctagatccttgaggaatcgtcacaccgtcttccacaatggttgaactaatttacattcccaccaacagtgtaaaagtgtccctatttctccacatcctttccagcatctgttgtttcctggcttttcaatgatcgccattctaactggtgtgagatggtatctcattgtgtttttgatttgcatttctctaatgaccagcgatgatgagcattttttcatatgtctgttggctgcataaatgtcttcttttgagaagagtctgttcatatcctttgcccactttttgatggttttttttccccttgtaaaattgtttaagttctttgtagatcctggatattagccctttgtcagatggatagactgcaaaaattttctcccattctgtaggttgcctgttgattctgatgatattttcttttgctgtgcagaagctcttcagtttaattagatcccatttgtcaattttggcttttgttgccattgcttttggtgttttagacatgaagtctttgctcatgcctatgtcctgaatggtattgcccaggttttcttctaggatttttatggtcctagatcttacgtttaagtatttgatccatcttgagttggtttttgtataaggtgtaaggaaggggtccagtttcagttttctgcatatggctagccagttttcccaataccatttattaaacagggaatcttttctttttgatccttcttttttttttttttttctcttgagacagagtctcaccctgtcacccaggctggagtgcaatggcacaatcttggctcactgccacctctgcctcctgggttcaagcgattctcctgtctcagcctcccgagttgctgggattataggcgtacgccaccatacccggctaattttttgtacctttggtagagatggggttttaccatgttggccaggctggtctcaaactcctgacctcgtgatctgcccgccttggcctcccaaagtgttgggattacaggtgtgagccactgcgcccgactgatcattcatttttaagagaatgaagaaatctccagaaagttgtgtttactaagaagactgcatcatctcaggctttgttttttattttgtaaacaagagcaagtgttcagaaccttcttaaacaactagcaacatgacaagcaatattgaaaactacaggtgtgccttattttatataaaactgctttgtgaaatacagatctttatgtatgaagcaattagaacagcatccccaacctttttggtaccgggaattggtttcgtggaagacagttttttcataggtggtgggtggtggggtggtttcaggatgaaactgttccacctcaaatcatcaggcattagattctcataaggagtatgcaccttaaatcccttgaatgtgcagttcacaagagtccatggtcctacgagaatctaatgccactgatctgatagaaggcagagttcaggtggtaatgttcactcacgcaacgctcacctcctgctgtgaggcctggttcctaacaggccacataccagtactggtctgtgatgggggagctgatgacccctgaattagaaggttatttattgcatgagaaaggcatttttcttttctaaattaaatagcattttaaaatagtgttaaatatatttaaaatagcatttattatataatgtaagcattgatttacttagctgtgacttctctgctgaactgagacctgtagggtcaatagtggagtgatgaaaaattggaggaattgtattccaggtaagggaaatacatacaaaggccttgaggcaaagggagcatggaaaattttagaaagtaaaggaagctctgggtgactagagcatagagagtagggtggggctgagagaaataaagctgaagggggaatgggcctgggatatcatgaagggcatgtcaaattaattaaggacttccaacttcctcactgtttacagggggctttgaagggttttaagcagggaaccgtatgtcaaggccagggccaacttcatcagcatgtgatgaatgcccattgtttagagaggcccaatgtttgatttaatgctgtttccaccattttggaattttaaattttttgaccaagtggctctgcatttttattttgtgctggaccctgccagttacctagctgatcctggccaaggctctaggtcattgtgtgtagtgaattaatacctactgagaggaccatgtttttctgctcactgctttttttcctttaaatagactttattttttagagcagttttcagttcacagcaaaaattgagatgaaagtgcagagttcccatacatcccctgtccacccactgcaacagcttctcccattatcaagaggtttgcaccaaagtgatacctttgttacaactggtaaacctacactgacatatctttatcacccaaagtctatagttaacgttagggttcactcttggtgttgtacattctgtgaatttggaaaaatgtataacacgtgtccaccattatagtatcatacagaatagtttcattaccctaaaaatcctctatactccacctactcatcctccctaaagtctggtaaccaatgatcttttactgtcactatggtttggtcttttccagaatgttgtataactggaatcatatggcatgtagtctacttggataggcttcttttcaccgctttttcccctgctagtatcagataattgtgcaggccactctacgagagccaaaggtcgtatttctccttctcctggaataatcacaagaacaggaggttctgcaggagcaattgactttagaggattaggggacaaataaacactgaagttttattcttcaggatttttgtatttctagaatagttcaaagtatgtacagagttgacagatcttttcaactgactggtcattcgttgcaaattccaaagaaataaactgtttaggaaacaactaactgatgagttacattcaataccctttctttgattccagacactaaagttattttgcatgcccaaattttgtactcagagacattacttctggggtctgtctagaagtaaaggcacaaatatgctgtaatagaatgctgccaggtagtgagggtcatcttctggccagaaatttcaccagaggctcttcaaaccttgcttttcccaaatgcagcccctaccaccaacaggttcctctgagctaacaaacaactccttgtcttctgtgacattttggattttaattctcatttcttcgaagaaaagggcaagcacatcttctcttttgggcttttctacaaattgtatatactgtctcagaagtagtgtccaacctttattattatgtacatgtggattttatcactagtatatactaaatatattactagatataaccactaataactataatactatataatgatataataccatatttttgtatatattatataccagcaatatacttttttcctattttgtcttctcctgcctatataataaaaacatgcttgttgaagatgctgccagagcttcatctgtattctcatgcctccttgtaccatttattgtgcacatcagttcctgggtactttcactcccaatagccaagtacttgtatctctttcttgaaggatcaaccttaggctgtggcacacaaagaaccacaacaagtttctgtgaatttactattccaggcaggggtggaggtaggggtgtcagccaatggctgattggtgttgtgtgttgtatgtttgtatgggtggtattataaatactccagcttcctgagcagatgactttgagtgggacccacactgtgtcatcaacttccccttcccccatcttcctcctctgcaggatggagccatagttaaccctctcaggctctttgtctgatgtcacatgtttgcttgccattcttacctacttagtctccctttctcatgctcctattttttcctgggactacttcttacaaatcactttcacacagttcttcatctcaggactacttttggggaacctactgtaagaatttgttgaggtagaaaagttgcagatcattgtgaagtgtaaaaaaagaacaggaaatgaatcatactatttccctacccccaagaaacctgttgtcagtctttttctatgaatttttagaagctttattgaggtatactttgcatatcatttaatttattctttcaagtatacatttcaatgatatatgtagtaaatttactaatcagtcattttcatcatcccaagaagacccatcatgtccatttaaatgacattaatcttcattttcctccaccctagcccctggcaaccgccaatatactttctgcctctatggatttgcccattatggtcaatttgtataaatggtatcataaaatatgtgatcttttgtatgtgccttaatttagcacccgtgttgtagtatgtatcagttcttcatttctttttatggctagcatttcattgtatggattgagcactttttatccattcattccttgatgtacatttgggttgtttctactttttggaatattaataattattgattaataatagaggctttaaattaataattatataattaaataattatttaattaaataattaaaattaataaaagttttaaaacatattttaaatttaaggctgttgttaaaaagtaatcctgtattctattgtttgtctgtaattctattgtcagtatctgtatgtgggataacaatatacatttgactgctacgctggaatttatttatttatatatttattttatttatttttatttttttttgagacgagtcttgctctgtcacccaggctggagtgcagtggtgcgatctcggctcactgcaacctctgccttccaggttcaagtgattctcctgcctcagcctccggagtagctgggactacaggcgcccgccaccacgcccggctaatttttgtatttttagtagagacggggtttcaccatcttggctaggattacaggcgtgagccactgagcctggccccctgaatcttttaaatcaaatgattcaacttaacttatcttttcttttcttttctttctttctttctttctttctttctttctttctttctttctttccttcttttcttttcttttcttttcttttcttttcttttcttttcttttcttttcttttcttttcttttcttttcttttcttttcttttcttttcgagatggagtctcactctgtcacccaggctggagtgcattggtgctcactgcaacctccacctgctgggttcaagcgattctcatgcctcagtcttccaagtggctgggactacaggcgtgcaccaccacgcctggctaatttttgtgtttttagtagaaatggggtttcaccatgttggccaggctggtcttgactactaacctcaagtgactcagccacctcggccttccaaagtgctgggattacaggcgtgagctactgcactcagctgattccattttctttaagttatttgtattcattcattttttttttgtttaataattcaacaatttttaaaagtattatgccaggcattgtgtttgatactggaaatacatggttatatttttgaaaccaaatttcaaggcatgatttgacaactgcatatgtattattggagatgataaaacagagctttggaaatcaagattggtgagaaataatttagataaaaaagggagatacaaagaattataatatagtaattaacctctgggacactctacctttgtagagttatgatctaaatctttctcaaatctgagtagatttttaaaaatctccatatacacgccattgctgtgtatttttaagatatcagattccgattcaggaccataagaaatctcagaacacagagagccagtataagttgtgttttcccttattctccctctcttcaccctgcccttctcataatcacttctgtctcaagttctctgtgtcttcatctatagggctggtacttaaaggcatgcctcattagtcttaactgtttctttcccatcaaaggctgtataattaccttgtaaattccaatgggagcatgagtgagtttgtctcatcgctgagcttcagggttctcataagctagcgataaagtaacagttcacacagatgaagggggactggggaagtgtgggtagaagtttttgcaatgaggtaaattttcttctgcaaggctcgtaatgagacatcaccacatgagtgggctggtctggattttgtcactctcctgtatcagcctttcccctccaaaccagcctatcaggctccctattagataattttgtttggactcagcatttcagcagatagtaactaaacaccttttttccttcactcagaaaagtaccctgtttttatagaaaacaagaagagcttgccgaaatccttctcagaggcaagctctccaagtaagtatattttctcaggctttttatagtttaatctacttacaaacttccataagcatagtatgtgtctttccatgcagtcttctgcttgatatccatgtatgagaaactgcaaaaaaaaggttatatttgatttataaaagttcttcattatttaaaagtgtactagaacaagccagtataaattccagtgcaggctggtgcggtggctcgtgcctgtaatcctagcactttgggaggccgaggcgggaggattacttgaggtcaggagttagagaccagcctggccaagatggtgaaaccccgtctccactaaaaatacaaaaattagccgggcgtggtggcatgcgcctgtagtaccagctactcaggaagctgaggcaggagaaccacttgaacccagaaggcagaggttgcagtgagccaagactgcactactgcactccagcccgggtgacagagcaagactcgtctcaaaaaaaaaaaaaaaattccaatgcagcagtcaaatgtatattgttatcccacatacagatactgacaatagaattacagacaaacaatagaatacaggattactttttaacaacaccgtttttgaagatataatccacatagcacaaaattcacccttttaaagcatgcaattcaggggatttgagtatattcacgaggttgtccaactatcatcattatctaattttagaatattttcatcatctcaaaaggaaatcctgtgtcctttagcagccacccctcattccgttctcctcctcagccctaagaaaccaaaaatctactttttgtctctatggattgatctgttctggacattttatagaagtgcagtcatacaatatgtggtcttttgtgactgacttctttcatttaaaatggtgttttcaagattcattcacgttgtagcatgtatcagtacttaatttccttttgttgctgaataatttattgtatggatagatcacattttgtttattcatttttcaggtgatggatagttgggttgtttctaccttttggatagtgtgaataatgctgctatgaacatttatgtataagtttttgggtaggcagatgttttcagttatcttgggtatatacctaggaatggaattgctgtgtcatgcagtaatattatgtttctaagctttggaggaattggcaaaccattttgcaaagctgccacaccctcctaaactgacagcaatcatggagggtgattatctacatttgtagaccagaaagtggtggtccagagagcttaaaaaagttgcctaagtcaataagataaacctgtattacttttcaaaatgttgcatcagccctgaaatgaagccctctcagattcctttaagaatgtctaatgacagagatggaagccaggagattgggacctgagtaatggatgtgtctgcctcaaattctgaacatctcaagggcagttccataaatggcaaacacatctgtaaaaagcatatttctctttttaacagcagaaaattttaattcttattaaaataaacacatatcactgtgttcatggagaacgcagaggggttaaatatatagaaaagatcatgccactgaaaccatcatactctaagaatttattctgtcataagattaactcttctccctttgctttctttatgtgaaggtgaagaatcctatggcccatagatttttacagtgttctccatcttgcagcacattaaggagttaattcctttcaggaaatccatttctgctgaaaggctcacttttccagcccctgaacagcatatgtgacctgcagtggttattcttagcaaacttcttcccagggatgacccaatgggagcagcacagctcaatcttttcgtgaagagagaaaacatctcagattcttttcctgttttaaattattgggaaccaatggctcagaactataccagttacccttataactaactgcattaccatcttccatccttctataccagtctcgctagtcttccttgctggctgtagttcttggaactctttaaccaatcttgacttagggtcttctttcagattgctctctatgcctgtgatgatctcccaaattcttatctagaaagaatcttttccttccttggcatgcaatgtattcctcatatgtattaccaaacacattgctttaaaaattatatagatacctcaaaataataacagccacctatgacaaacacacagccaacttcatactaaatgggcaaaagttgaaagcattcctcttgaaaaccagcacaagacaaggacgccctctctcaccactcctattcaacatagtattgcaagtcctggccagagcaatcaggcaagagaaagaaataaaggggatccaaacagagagagaggaagtccaactatccctgtttgtagacagcatgatcctatatctagaaaaccccatagtcccagcctcaaagctccttaatatgataaacaatgtcagcaaagtctcaagatacaaaatcaacgtataaaaatcactagcattcctatacaccaacaaccgtcaagtcaagagccaaatcagtaacgaactcccattcacaattgccacaaaaagattaaaattacctagaaatacaactaactaaggaggtgaaagatctctgcaaggagaactataaaccagtgatccaagaaatcagagatgatacaaacaaatgtaaaaacattctatgctcatggatatgaagaatcaatatcgtgaaaatggccatattacccaagcaatttatagagtcagtgctattcctatcaaactaccaatggcattcttcacagaccagaaaaaaactgttttaacattcatatggagctgaaaaaaagcctgaatagccaagaaaatcctaagcaaaaagaacaaaactggaggcatcacattacccaacttcaaactatactatggggctacagtaaccaaaacagcatggtactggtacaaaaacagacacacagaccaatgggacagaatagagagccaagaaataagactgcacacctacaatcatctgatctttgacaaacctgacaaaaacaagcaatggggaaaggactccctattcaataaatggtgctaggataactggctagccatatgcagagattgaaactgtacctcttcctatcaccatatacaaaaatcaactcaagatgaatgaaagacccaaatgtaaaacttaaaactataaaagtcctggaagacaacctaggcaataccattctggaaataggaatgggcaaatatttcatgacaaagacaccaaaagcaatcacaacaaaagcaaaaattgacaaactaatgagcttctgcacagcaaaagaaactatcaacagagtaaacagacaacctacagaatgagtgacatggtttggatctgtgaccctgcccaaatctcatgttgaattttaatccccaatgttggaggtggtgcctggtgggaggtgattggatcatgggggcggtttctcatggtttaccacgacctcccttggagctgtcatcataatagtgagttctcacacaatctggttgtataaaagtgtgtagtaccttattcccacttcctgttgctctggacatataggctctgacaatataggcagaaggcttcacccttcgccttctgccatgattataggttccctgaggcctcctcagctatgcttcctgtacagcctgtggaaatgtgagccaactaagcctgttttctttataaactacccagtctcaggtatttctttatagaaatgtgagaatggactaatacaatgggagaaaatatttgcaaactatgcatttgacaaaggtctaatatccaacatctataaggaacttaaatttccaagaaaaaacaaaacaccattaaaaagtgggcaaaggacatgaacagaaacctttcaaaagaacacatacatgtggccaacaagcatatgaagaaaaagctcaacatcactgatctttagagaaatgcaaatcaaaaccacaattagatactatctcacaccagtcagaatggctattactaaaaagtcaaaaaataacaagcactgtcgaggttgtggagaaaaagaaacacttatacactgctggtgagaatgtacattagttcaactactgcagaaaacatggcacttcctcaaagacataaaaacagaactaccatttgatgtagcaatcccagtactggctatatacccaaaggaatacagattgttttattataaagacacacacacacatatgttcattgcagcactattcacaatagcaaagatgtggagtcaacctaaatgaccataaatgatagactggataaagaaaatgtggtacatatacactatggaatactatgtggccataaaagagagggagattatgtcctttgcaggaacgtggatggagctggaggccattatccttagcaaactaatgcaagagcagaaaaccaaatactgtatgttctcagttacaagtggaagctaaatgatgagaacacatggacacatagaggggaacaacaggcactgaggcctttctgagggtggagggtggagggtggggcttgtacaacaagcctccatgacactgatttccctatataatgaacttgcacatgtaaccttaacttaaaagttaaagaataaaatatttgttgagtttcatgttacacatctgtagttattatagtcataacactttagagctgcacagactcaaatgatcagcactgccagacgttctgacagcaaaattatctgaatagataagagacttaggtgggcttttgctcagtaaatgaggttgtttatattctttgaaacagtacggcaattcataatactccaacacacgactgcctgtgggcagaccctcctgttcaaggtactgtgtggggtatcacagaatgctgttcaggaagatatcactggggccttctactctcaaaggggttgataaacacttgagagcatgaggatgaatacccaagggattaggtatgctttgggctctgaagctggccacatcagtaaaatatcacatacttggcaaattagatctgagtaatcaaacagaataattcagcatctctcccccatagacttttagtggctgacattagttttcatttgatgataattactgatcacagtaatcctcacaactaacagtttttcacttctgtaactttcttatatagatctggcacatttcttagtagtttacagatttacttttcgtttgtttcttggttgtgtttgcttatctgggcgaaatatatttttcctatatgttctcaatttggttatttatgacttataggaaatcgattaacttgtaagtttgtcttgtatctagtgacattattgctttcatattagttccagtaaactttaaattgacaagttggatttgtagacagaaagtcatttatttgtttataataacactttggcatagtccttttccgtatttaaggctttaaagaaatcttttcttatatgttgctgaagacttctggtacaatgtcaattttaggcatctttgccttgctcctgagtttaatgagaccactttttaacttaagcaagataaatcagtttctttccatcttgacttattggtagttatatttttctttcaagctggaaagcctgtgaaattttgtaaaatatatcttagcattacttgagatgatcatgtttttttttcctccatctttaatataaatacatagagaattctgttaatagttttcctaaagttgaacctccttgaattcctgggataaagcctggttgatcatgatttattgttgtggagttttctatttgcttagctttgtaataattctccattaaaaaacacttattggctaagtgaaccaaaatatctaatgaaccatgaagttgtttgaaattatagcaaggaatataaatagactagttggctatgctgttccctttttaaaaataatttcattccatgctgacatgagcaataggatttgatcgtaacagagagatgacttcttggctgtgtaggccatatgtttcctgataaaatatctagtgtctaatatcgaatagcccttgtggcttattttgtgtgtttaaacaatctggtccagttctgctaagtgacaacaagcatcacctactgtcaaaactcttttctgagcctgcagaaattactacaactgtgggatgtacttgatttcaatgtgctgtattaatgtttgcccagtaatttctagttacagaggctatagcttgttcttccaccaaccatcctggagagcagttagtaaggtgtagcagttgagagtgtgaactatctggtttcacttcacagctctgccattaactggctgtgaaaaccttaaattcctcagttttattattttaaaaatgggactatttaaggtaactttgagctattgtgaatatttagtgactaaatataaagcacttaaaatgtatttggtgcatagtgttacatatgtgctagctatgatttattttttgtttcaatgtaattttttcctttttttaaatttaaaacttttatagctctattgaggtataattcacaaataaatattgcatatgtgtatatattgtatacaatgtgatgttttgacacatgtatacactctgaaatgattattacaatcaaactaattatcatgtctattacctcacagttatatttaatattaatatttaagattattctcttagcaattttcaagtatacaatacattattaactacaagctatgactttgaataatcaagttagaatgatcaatttgccaggagtttttgttacagatgtcagagtcctatgatcacacatgaaagatttgctttttttccttatatgtgacccatggaaacatatcccttgtagaatttgactagtcctttactcattcaaggaatttctgaaaataggcagatttgtttgactaatgtttttccaataaaaaagggctggctgtttttctcacaatattttacattttgaaaaattcaaagaaatgaaattgaagctgattatcagaatctgtcggggaaatcattaaacattggccagccctagtaaatagcaatggaagggtaatttacacctctcattgctctataggaggttcttctgttgcccctgtgttgaccggttcacagttagcaaaagtatcttgtagggggactccaaagacagagagattgtgtgcagcttctgctctcagactccctgggtcaaatctgagctttgccactggtcatcagcaagttgaccttgggtgtgtttctagtgctccagtttcctcatttgtaaaaatgtgataataataataattacctctcagggctgtggggagaattacaagagaaaacccctgtgtatgaccaacataggaccctgcacatacgaagtgctcaataagtaatgtgtcatttagtacaaagcatttgttatttggaagtttttttttgttgttctaaggtgtaagtcatcatatctccggctaggcagtatgccatacatgaaagtttgggagagtggggttcatttattttaaaaacagttcagtgtttttagtatagtcacagatatgtgcacccatcaccacaatcaattttagaacattttgatgaccccccaaaggaacctcatacccaataactctcatttcccccttcccccgtccatctagctggctgtaagcaaccactcatctactttctgtctctatagatttgcctattccggacatttcacacaaattaaattgtactatgtttagtcttttgtgactggcttctttcatgtagcttaatttttcaaggtttatccatgttgtaacaagtaccggtacttcatttctttgcatggcagaataatcttccagggtatggatagaccacactttgtttatccatttattcattgatggacatttgagttgtttctacctttcggctatagggaataatgctgcagtgaacattcatgtacacatttttgtatggatgtatgtttttatttttcttaagtatgtatctaaaagtggaattgttaggttatattccatttgaggaactgtcagactgttttccaaagctgctgcaccattttacatccccaccagcagtgtatgtttgaaggttccaatttctccacactttcaccaatacttcttattatgtttttgtttatagccatcctagtaggtatgaagtgatatttcattgtgattttaatttgcatgtccctgacaactagtgatgtagaccatctttttgtgtgtttactggccatttgtacatcttctttgggaaaatatctattcaaatctgttgcccatttttaattgggttgtattttcaattattaagttgtaacactggtaatttttattgagctattaatcgctgttcacacttgaccttgcacacaaatccctggggactttgttaaaaagcagtctctgcttcacttaggtcccttggggaacctaagagtgtacattttccagtagttgcagatggcgtagtccatggaccctacttgaagtaagaaagacactttttaaaatgcttcatgattggctttttatgtattactcagaaaagccatttgaagagagaaacacaaaacctacattttatttattctttcctatattcacttccacaaatggaagtattagagaaatgtaaaatataatatattctcactgttttaaagagagctaacattatattagtgtctgaaaataaagatatagttagaataatttaactttttttctcgaatacttgtattataatttaaagcatttagaagcagtatttgccaagtgactagatttactttcagtttttaaaatagttttggctacagatgtagctgtaagtttggactttctagtacttatttattatctttttcctttaaaaaacagtttgagacacagtctccttctaatgaaagattattcatcatcctctttggtcatgcttcgttgggaggcacttgcattgatgtaggacaggaagaaaggggagggaccctggctgaaccagccagatttgcagaattagtggccaacacgtgtctcatagatttatgtgcctacagtcttggcagcatcccaatataaaggtatattatttccagggacttaattcccctcacagtgtgaaagagcaatgaaaagcacaagtttggaaaagaaactgcaaatgaaaaaatcaatgtaatgaaatcaattgtgaacactagagtttgttcaaattagttttttgtttgtttgtttgtttagttttggtagctatcatcctcatagatacctcacctaccctataggacgtatgatttcactttcaaggggattttctggcctttaatgagtcatggcagcagttaacactagttgcagtggctggtggtataatttggaggcgcattctgttcttttgtgacattaaaatggaaaatatgagcccagaaaatgatttctctagggatgcacatacatggttacagctcattatggacctgtcaacatcttctcctctgcccttccttgggggagattttgtctcctgacgcagttttgaatgagagtttaacaagtgctgagtctcgtaccttttacagtaaaatatttgcccagatgaagtcatctccttcggaatttgaaatttccctctaaaaatatggctaaacccacaagctataaagaatcataataattcatttagagataactttttggcagctggaaccactagaaattttctggagtatagatttggtaagttaggcaggctaaagggctctgcccccagataagtgacccttagggaattttccatatctgaaggtaagaaggactatgggaaattggtttattgatagagttagttaatcaagatgttatttctggcaacttttaataattaacatttattgtacacacattgataaagttagaaaatatctactctgaaataatgggactataatttttaaaatttaacttaaataataaagttatcatttgtaacattatactacactaatactatagtatcaccatgcagataacactatgaggctgatttgttatattctctttacttcttagctcagaaggcaagtagagatgtttcataatctgtcgttaaaattgttttcttttcctcattgggcccatgatcgtccaaacgtttctctaaagaaagtccccttgaataaaagtggctttttaaaattattattattatacttttagttctagggtacatgtacacaatgtacaggtttgttacatatgtatgcatgtgccatgttggtttgctgcacccattaattcgtcatgtacgttaggtatttctcctaatgctatccctcccccatccccccatccccccaccccacgacaggccccggtgtgtgatgttccccaccctgtgtctaagtattctccttgttcaattctcatctatgagtgaaaacatgcgttgtttggtttactgtccttgcgacagtttgctcagaattagggtttccagcttcatccatgtccctacaaaggacatgaactcgtccttttttatagctgcctagtattccatggtgtatatgtgccacattttcttaatccagtctatcattgatggacatttgggttggttccaagtctttcctattgtgaatagtgctgcaataaacatacgtgtgcaaatgtctttatagtagcatgattcataatcctttgggtatatacccagtaatgggatcactgggttaaatagtatttctagttttagatccttgaggaatcaccacactgtcttccacaatggttgaactggtttacagtcccttcaacagtgtaaaagcgttcctatttctccacatcctctccagcacctattgtttcctgactttttaatgatagccattctaactggtatgagatggtatctcattgtggttttgatttgcatttatctgatgaccagtgatgatgagcatttttcatgtgtctattggctgcataaatgtcttcttttgaaaagtgtctgttcatatcctttgcccaaaaagtggtttttttttaaatcatgaaagcaaaagagatcctccctgtgcagagtggaagtgataacccttcattggtgagataatatcccattatttagatgggggaatcttcacattgttaacacactgaacttagagtatagagggtgggggatgcccattcctggctgcaggggccctgggacctcatctcttctgggtgcagcactgctgcctttacatcttttccactctagacctccattttaagccactgcttaaagagtataaaaatatcttctgtttcctttcttcccctttccttccttttctccttttcttccttcttttttttccttcaaaatttaagtagtacactcatgcatgctggtgagtatgctaggtatgaggatagaagtggtccctcaagacgatgactatgatgtggcccctgagacagtcataggctggggaccagaaaggaggcaatataggtatcggccgaaagatgatgactttcattttgactgtgttgagttttaagaactgggagcatgtgtccagctacttgtacagtgcctaacacatagtagcctgagacactgaatggaagccaccatcagtgctcttctttggtcatgtgaccttgggtaattccccctccccaaccaacaccaccattctgggcctctagttgctcttctgaaaaaagatatcattggattagatgaccctagaagtttcttcctttacaagaagctgttggtaccctctatgtatttcctagacacacacctgatggcaagtacctggtaaaaacacctgcaactctctttctagtagtttctttctggtcatgggaacatactctgccatgacagggcaagtttcagaagtgacagagagttaatgatcctaggagcagccctcaactggtgatggatgaagagtaggtgggtaattctaggttaactctttcagggtaactctgaagcatatccactctgtctcgcagagtctccctgcagggctgagtcccagtttccttcgatgataactgtattgtgaactcatgttttattgacttctttctctttcctatctcattgcctctcactcccctaccaactgtttcctggtgttacctcctgtggtcagcagaataataccctgagagatgttcacatgctaatcctgggacttgtgaatctgttctcttagatggccaaagagactttgcagatgcagattaaattaaggatcttgagatggggagattggcctgggttatttgggtgtgcccattgtaatcacaagggctctcataggtgaaggagggaggcaagggagtcagattcagagaaggaggtgtgatgacagcaacagagttagagagaaattggaagatgatacactgctggctttgaagaaggaggaaggtgccacaagcccagaattgcaagtggcttctagaagctggacaatgacaaaaaaagggggatggggggctcctcctctagagtctccagaaggaatgcaactctgcctcttggtttgagcccagtgagatccattttggacttctgacctccagaactgaaagaaaatatgtatctgttgatttaaaccactaaatttgtagtaatttgttacagcagtgacacaaaattaatacccctcctaaataaaccatttgttcaggaattgttgcttcagcatctgcttctgggagaacccaaattaagacacttcctaatctgatattgtatgcttatttttaccttagttaaaatatcaacatttttcagttgttcaataacaattagttattgtgcccttttatatgcttgatgtttctgtaaggcaagtcacaaagatgcaattaactcagcccttccctgcatagagcttacattctaacagtggaaatagaaaatgccacaaaaattgtagcatgtgtcttgtactattgagcacttttttcttcactagtcagataactgtaagtatttataaggcatctaatgtgaaccttgagcaaagcatcaagtatataaatatatgccatacacaatggtgtataaaataatatagtcactgccaacaaaaaaacacattctcaaatctaatttttaataaagtgacagtatcaccctaaaagaggccaatcttattttgtcagtagaagaaaaggaagaagaacaaggagttctcactgtaaacaatgtagggatcccattttagggaaactgaaacactgatttcaccttctagattcccataaaaagcatggaaagtttattttgttcccaaggaaattcactgttgtttagcttctgaaccatcagcacattaaaaaaacgataatttactgcagcattttagctgtgaaatatacggaaagaaagttgaagtcagattcacaagatatgagttcaaatcctggatctgtcacttcataaaatcatgagctctcaggcaataatttaactgttctgaactgcagctgttaaataacaagtcatgggtggaggtcagcacatgctaatgtcccaagctctttctctgttttatatggttgggcatgtagtagagtaagctttttcaacgctttaggctgaaattctggaatccttgttgctttcatttctgctttcaaagttgccaaattctctcccatctctcccccaccctctttccttttaatcccttgtcagacacaggcaagagtagccaacatatgctaacattttaattctaaaggtgctggctttgaaggcatgtggtcgcccttccaggttatcacaggtaaaagatgtagcaagtttttttgctgccacatgatatgagtcacctgtctttctaacctctggtatctagttcctctttgtctgttacctaaggactaagccagttctaaattcattattaggtcttggttatggcagcacctcactttaaggtgctcaaatatctcaagtagaatagtcctgttgctgcatcaagaagctaattgctggaaaaaacaaactgaacatttttgcgacttaacacaaatttagttttcgtttgcattggaattaggcatttggagggcaggctaccatgtggggattcaaggactcaggcttcttctgtcttgtggcatcctcatgttcaatctgtgtactccatggaatggcctagaaaatggcagatcccatgagcctgacctggaagtgacacacatcactcctgcctttgaccagaactcttatcattccattgaccattatttgatcacatggctccatcctacctacaagggaggtgaggaagtgtgaactctggcttagcacaatcccttagtcatcagtgagccatctctgtcttcttgtgcttacttcaaaatgttgctatgcaggtgaaaactgcaaaattgatctgagagttacttttagagtaaaacatatggtacagatgagagggattgattttttcaaagaaacctcattaccctgagactttgctgaagttgcttatcagcttaaggagattttgggctgagacaatggggttttctagatgtacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccggttttcaaagggcatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggatttggtttgccagtattttattgaggatttttgcatcaatgttcatcaaggatatttgtctaaaattctcttttttggttgtgtctctgcctggctttggtatcaggatgctgctggcctcataaaatgagttagggaggattccctctttttgtattgattggaatagtttcagaaggaatggtaccagttcctccttgtacctctggtagaattcggctgtgaatccatctggtcctggactctttttggttggtaagctgttgattattgccacaatttcagatcctgttattggtctattcagagattcaacttcttcctggtttagtcttgggagggtgtatgtgtcgaggaagaaacagagagccaaatcatgagtgaactcccattcacaattgcttcaaagagaataaaatacctaggaattcaacttacaagggacgtgaaggacctcttcaaggagaaccacaaaccactgctctatgaaataaaagaggatacgaagaaatggaagaacattccatgctcatgggtaggaagaatcaatatcgtgaaaatggccatactgcccaaggtaatttatagattcaatgccatccccatcaagctaccaatgcctttcttcacagaattggaaaaaactactttaaagttcatatggaaccaaaaaagagcccacatcgccaagtcaatcctaagccaaaagaacaaagctggaggcatcacgctacctgacttcaaactatactacaagtctacagtaaccaaaacagcatggtactggtaccaaaacagagatatagatcaatggaacagaacagagccctcagaaataacgccgcatatctacaactatctgatctttgacaaacctgacaaaaacaagcaacggggaaaggattccctatttaataaatggtgctgggaaaactggctagccatatgtagaaggctgaaactggatcccttccttacaccttatacaaaaatgaattcaagatggatgaaagacttaaacgttagacctaaaaccataaaaaccctagaagaaaacctaggtagtaccattcaggacataggtatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatggtagaacattttcgcaacctactcatctgacaaagggctaatattcagaatctacaatgaactcaaacaaatttacaagaaaaaaacaaccccatcaaaaagtgggcaaaggacatgaacagacacttctcaaaagaagacatttatgcagccaacagacacatgaaaaaatgcgtatcatcactggccatcagagaaatgcaaatcaaaaccacaatgagataccatctcacaccagttacaatggcaatcattaaaaagtcaggaaacaacaggtgctggagaggatatggagaaataggaacacttttacactgttggtgggactgtaaactagttcaaccattgtggaagtcagtgtggcgattcctcagggatctagaactagaaataccatttgacccagccttcccattactgggtatatacccaaatgactataaatcatgctgttataaagacacatgcacacgtatgtttattgcggcactgttcacaatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcattaaactatcgcaagaacaaaaaaccaaacaccttgtgttctcactcataggtggaaattgaacaatgagaacacatggacacaggaaggggaacatcacactctgatgactgttgtggggtgggaggaggggggagggatagcattaggagatatacctaatgctaaatgacgagttaatgggtacggcacaccagcgtggcacatgtatacatatgtaactaacctgcacattgtgcacatgtaccctaaaacttaaagtataataataataaaataaaaaataaaaaaaagaaacctcattacccattatgatttgattatcctgatagtacaaatagtttagcatctaataggtcaatcagtttaatggacttgagccctattcaacaggtgttaacattgctttttgggaaaatgcctgtttccttgctggctgttgacagcaggtctatctcagctttgagaggctgtgagcatttcttgtctcatggtccctcagtcttgaaagccagcaatggtatgtcagatccttgttatgcttccaatccctttgacttcttcctttataattttttatttttgagacagggtctctgtctcccaggctggagtacagtgatgcaatcacggctcactgcagcctcaacctcaaaggctcaagtgatccgctcacctaagcttccagagtagctgggaccacaggcatgcagcactatactcagctaattattattattattattattattattatttaatatacaaggtctccctaagttgcccaggctgatcttgaactctggggtcaaactgtcctgtgttggcctcccaaaatgctgaggttacaagtttacacctgaaaagccaccatgcccagcctttgacttcttccttttaaaggactaatgtgattagagcaggcccacccagattatctccccatgtaagggtaagtgatttgggaccttagttacattttcaaaatcccttcgtagcagtacctagattagtatttaatttagtaaccatgggatgggaatcttgggaggctatccttagaattctacctactatagttaagtgaattgcctgaattcacatgagtagagagtagtgagtgaagcaaggatttaaaccccagcctatctggcatcagagtctgtgccttttctacctatcaggtgacccctctatgaaaatcagtggtggacattaaccccaaaagaattttctagaaggaaagcccaaccctaattcttaacctagaggaatgtcttagttcatttgtgctgccattacaaaataccacagactgagtaatttatagagaacagaattttatttctcactgttctagaggctgggaagtccaagatcaagaccctagcagtgtcattttctggtgagggctgctgtctacataaaaatgatgctgtctgcatcctccagagaggaaggatgctgtgtcctcacatggcagaagggacagaagggcaaaagggggcctaagctggttacctctggcccttttacaaggcacaaatacacttattagggctgagccctcatgatttaaccatttctccaaaaggcccctacctcccaataccaccacaatagggattaactttcatcataaattttggaggggacaaaaatattcaaaccttagcaagccatataatttaaataattattacatttaaaattgtagatttagtgtttaaaaattatgcaccaaagtaatactgaatctttctgaaatgccaccaccaaagagatagtatgattgtgggctatgtaaacagatctggatcaagtctaagagccaccacttacttgccctgattccccatgcctcagtttctgtaccataagtgggggataataatagtggtatcttctggttgtgctgagagattgaaattataacacttaccatagttcctaggacactgtaagcactcaataatttctaaccacccccactactatcattatcatcatcatcacattattattattattgttatctccaaccttcagcctagatggttgatacctattaaacatattatcaaatatttatactttcatatcaataacatataaaataaattatgttcattcttcagatgagcagaagaggtatcatgccatgatctcatttttaacatgcatttgcttctgaaatctcagctgtagattagtaaatgtaatacttagtaattttttgatctgatgttttctctgcccttcctgtaatttagagtttgtacacttggttctaattctgtcagtgacttaaatagatataaatttaatgtcatagctcatgagaattaatgtcactttcaaagtcatcctctcaacctgcccttctcctttttcctcttgatccaagacccattattctaaggtttctaacacatttcttttcacttatactccagacttgagattgctgtaaacatgaaatttatttttagatctttttgctctgcattctactcagagcctttctctttttgcattttcacaacattcctaggcttctgctcagccaacattttaaatatgacaaaaataaatgccatggagggaagactctgtggcagcaacagaaatgcctgttgagtcctctgtggaatgaagcctgagaccccttgggtggtttaagcagaaatatttgagcgaagaagtgtgaaggacagaggtgtcagaaggaattttcaagagtgtttataaacagtatatgctacagagggtgcagggctactgagacctcaattaggatggggggtgtggttaggagaggccactatggtgcagacatccacccatcccaatttctgtagaagtcagcgatggaaatgcgcagtggtccaataatgttcccattggtggtagagtcagagctttggttttttatcaccttacatggattttacacattattaagacataagctagaggagagaaatttcttattaacaaaacctgaaatcctactagcactgataccttctcccagcacctgcactagccacccatgacatcctctacagattagtgtgcctcctttgctttccatgttaaccttttagcatccataccattccccttatttaaaatagggcttctcaactgagacaccattgacatttggggccagacaattctttgtggtgggggctgtcctgtgcattgtgggatatttagtggcatctctgacttctacccactagatgctagaaacccctccccaagttgctacaaccaaaaatgtctccagacactgccacatgacccctagaagtcacgattgtctgcacttaagaacgactagtgtagaaccccctctttcttctgctctactagtccttccttgttttcctgtataactctgctcaaagctcacctgtacaaaacaattcattaattaatcccacctagctctgagctttttcatcactaagtaccttctgtcctgctgggcctagacatagattttaccaattatgtttttgccatagcctccatttgtaataaatcagtttttgttactccttctgtatgtaaggaaagagtaagtttatgacttcattttaaaaatatctccaaagttcctgctagcatattctgcataaaatggactcagtaacactttgatttagtgagcagaactacttttttttttttttttttgagatagtatctcactttgtcgcccaggctggagtgcagtggcgcaatctcagctcactgcaacctctacccttagcgttcaagagattctcgtgtcttggcctcccgagtagctgggattacaggtgcccgccatcatagccagctaatttttgtatttttagtagagacagggttttgccatgttggccaggctggtttcgaactcctgacctcaagtgatctgcccaccgctgggattataggcgtgagccactgcgtttggccagaactacagttttctattactaccagttgcattgcttgacttttatttatttagcaattttaccattgctgaattgcttcaggattgaagagaatgaatctttagaatctctattgaaataaggaattaaataattgtgatttcttttattctgctgagaacttccaatatactcatttggtgatgaatacattttttaagtgaatattcccaacatacttgggaccactgtagctttcagctatatggcatgtacctgggtatgctgacgccacactattttttgttggagattcagcagttattttgtgtgcagttgacagactttttttttccaggtcctccctgggatctaattttgtaatgctctcagtgttttctcatgtccccttagcatttactctatgcatggaaggctgcgtgtttggaacacctaaaactctgccacctgagggcatttcttctaacagtgggaattgcctgggtgttaatggccatgaaagcaattctcccagcatggtgactcatgccacctataattccagtgttttgggaggctgaggcaggataattgcttgggcccaggagctcgagaccagcgtgggcaacatggctagatcctgtatctacaataaaaacaacaacaataataataatctggatgtggtggtacatgcctgtagccccagctactcaggaggctgagaatggagggtcgcctcagtccaggaattcgaggctgcagtgagtcatgattgcagcactgcactccagactccagcctgggcgacagagcaagaccctgtcaaagaaagaaaagaaaagaaaacaagcagctggttggatggggatttggcaaaaaactgccccagcttcctagtccccctgtgaggacaactctgaggcaaatatatatatatattttttttttttttgagatggagtctccctctgtcacccaggctggagtgcagtggcgccatctcggctcactgcaagctccacctcccaggttcatgccattctcctgcctcagcctcccgagtagctgcgactacaggcgcctgacaccacgcccagctaatattttttgtatttttagtagagacggggtttctgaggcatattctgtactgtctctcagtattacctagtaggattgatcaaattgctcacagaagtaacttgtgtgataacacacctcggttggtttctttcccttctctgtctcaccttccaaataaactacttacactcaaatccttgtttcagactccacttgtaggagaacccaaaccaagaatccatgttataaatatgatgatttaacatgtttagagaaatcttgaactaattcacaaaggcttgttcatgaaatgctgttgatcggtgttgtcaccaaatgttctaaggtctacattctgggtgggccagactgcatcagggactgctgtgcactgatgtgtttgtctgtgatgatgtgggcattgttatttttactgggtttgttgtgagtaaagcttttggaaattatgttttcccacaagttccgcaaatgttttcacattttagaaattgtttgagcatgctgtaagccataactttgaaagtcaagcagtttggctggtgatattatttttaaagaaacaaaagtcttgttttgttttcaattttggcttttgttatgctttgcaatccttttttgctctcatggccttaacttactttgtcttgtacatggttttgcataatactcatggagatatttcatatacatttttgtgtggatatgattgcaataaattttttactggtaatacttcacattctaaagctcttttacatatatttcatttaatgctcacaaaccccctaaacaataggattataatcacagtttaatgatagagaaaaccaagttccagaagagtttaagtgagtttctgttcagcacttttattttgtcatgaattaacataaacattttattcatgtgatcagcaattctacaaagacaacaaagagtgagaatgtaatctccaagggaagcagagtgtgtattagcatagctgtagggcaggggaacttggggatgaatggatacagacctcagcaattgtcctaagtctggtcttctttcaggtttgttaattcaccacattctcatgtaatggaaagagtaaacattctctatatgctagcattattttacaaaatgaacaccagtgaaccagacatgaaagcagcattttcccagtgctttctcaccttccaggaaacctccttcactgttgctgtcagcctctggtggattatcagcaccatgaacactatagtccatattttctgcatcaccaaccaggacaccatgagtaccatgtgttggtttacacacaatctctatcgtacttgcactaaattcgtatctggggtgaagaggaagtgcatcactatctcaaatgtcaacactgaattttgaattttagtggatgctgtttctcccaggagctagaatattgcgtttgatagccagctctgaataggtccctccttgacaattgccatcccttatgttggactcagtctgatttcttgaacctttgcttgttatctgctgttggtacctgaactgcttctatggaggccagttaaccccctttggcccttccaccgacagtgcacctgagttatgactaagccattctgcgctggcaaggattcagttgggaaaacataaaacctttagatatttcaagaagaaagatttattacaggagtgagaggctttctaaagaattgaaaaggacttcaactagcattcaagaaattaggaagataataacagcaggcaggcaccattgatggtctcagatacctactgtacctggaagcatctagcaacacctcccatgggccactggcccaaggctgttcatctgcctgccatcaccatattggactttggcttctcttaggccttgtgaatatatctcatttgtgtgagctcaccctgaactgtatcgcaaggtgtctggaaaatgtaattaccaaacttctagctgctgggatccagagaagaacataaaggaatgaatatagttctgagtagcctactggtagttcaggccatattgtgtttctaggattttctgaaactgatctgtgagcctggggtgcccaaagaagaggatgttgttcctccaaaactgaaggtgctgagaaaaacatttctgatctggggcagggcaatagaatcagggagaaatagcaactggagatgtgatgaccctcaaaattaagattcagtgatagttgttgatgtgaaataggaaaagactagtacctatgcttcacacagagctaccaggaaaattgggcaactccctaaccgtatccttactatacatagtagagtagtactctgagatttccctactttctggtaaaatatgttgtgcactttaatcagctggctgagtgtcttctctactcctgtatgccaaggtcagagtctttggataagttttctccttcagagacaaaccttggaaaaagtctccaggaggcaatgagatttgtccaggaggttatccttgcataggaggtgctccatccagccagtcctgtagggcatgagacctggccaggagtagtagaacaacttttgggattgtttttagtggcatattctacttgtcatgtgattcataacatttgcttccagaagcctgtgcttttggcctagatacaagactgaaaggctgaggcatccatgaaattgacctaatgctgtataaaaatgttactacatgttacaagtcataaagtctggtttattcctcgtagaatgctagcaatcagttttcttttcatcatgatgtgaaatagtctttttatattcataattaggttttgttaagaaattttactgtgttcagatgaattaatattaaatatcaaataatgatatattttttccttcaagaatatattataaaaccagaactctattaaaaaaaaaagttctgttggataagtcaaataaaaagtactatacctaagcacttatgggcccttaatttaagcaaactgaggtactaactttgagtttccttaataccttattaatacttttaatctttttttaaggaaatttgtatggaagttgtaatcaatagtgttctgaaggttttaaaaaattctagttggaaaaatacttcacagagactatacctaatactgaaattttgtttcttttataatgattaacatgcaaagagaaaggcataataagctccagttaattaattggaagttgaattatttaacctgtatatattggaaatcttcctagttgcactgaacactgatttatctattcttgctatctatcattttattgtttttcattggaataaaagcactttttagaccttatgtgaatttttttgttgacaatgataagctaacatgtcaacaaaatgttttataaatgagtagttttagaggctgcctctctttgtgacctttaacacacaatgctttagatctctagactaaaaaaagtgacaagtcaaaactaagaatactcggagacatgttactgaaaataaggcctgcaagaaattattttaagttaaccaacagtaacttatcaaagagtattatgtttcacattgcaggcgaaactaagaataccagcatttgttatggtgaagtttaacttcaaagtgaagtttaacttcactttgattttaagtataaacataagtgtgaatttctgccagttccttctagacttaggttatgatgtgaaattaggaacttgattgtagctgcaatcaagttcttaattgttatgaatgatgaatgtttgcaaagtttccaatctttgcagagatgtgctattctggcttacaggagtatctttctaattagtaggtggatatgtacttatatgcatgtgcacgcatatgagagagaaatacttttctcagttaatgtgcttctgattatatacatcttgtgagatttcatacaattgaaaattagctagaaagaacaataatactgagttttcttcataacacatttccataatgcctgttccattacttttgttatttacatatttgaacttattattattaaattggattatcttatgatttttttaataagtggatattccaactcttggctcacaaaattacagttggtaaataatttcttcaaggaattttaatattgataaattacttatttcaaatgaattcacttaatatcatttttattttcttatgaattttctaataaaaacatatttttcatttcttcctctcttttttcaactcaatgtcttttttaaaaatgacagtaatgtgtggttataattatgcattttttccaggtgctcaatggcccttatgtctcttttaaaaaaacttttatttattgtgggttttctccccaaagcagaagttagtccaatacacatggcatagaaatttcacaattaggcaattaaactagaagtataacagctgacatgtgttcaaagtaataaagttccaaaattagaaggtgaatcaaattaacataaaggcattattaactttttctaggaggcgtgagtttgcaaaagtcttgggtaatttgatttgcttattctcaaaatagccactgaaccttgagtgacattgcgtttcaaaggtgggagccagagggaaggtcactgttagtgttggagtggcaaagaggaggtttaactttcaaatcatctagggtaatgcctgctactctattttgagacttttagctagatggcaagaagtttttttttttttgatgggaatcagaaagttaaataattcctgaatttggaacttcaggtggtttttaaaccttctccttgttttatagtttcctctgttgtttataccttcctaacattcaaatgataaagttattttcatttttaaaagaaacaaatccaaataataatcccattatgtgggattgttgactctaagcattgtgttttcttaatataccaattacatgctaatgggctttttaaaaatctatacaggaacattttaagattgaatgaatgagcatgccatttccattacaagctgctagactgcagtttcacagactactgatgtggatctgagggcagttcctcaaattaatatggtagatccacagttttgaaaggcaattttcattttatataacttctggcatgttcttaaaaagaattacacacacaccttttaagtggttcccccagtgtggctgctattcattttgttgtcatccttggtattcaggtctggcctagtcccttcataatgtattacccctgtcgcttttgctttcttgcccttcctatgagctcctgctctcttttctggtgcttaggtggggcagcacttttcttgttgcatatggatagagtcagccctgcctctggcccctcccaaaggacatgctgtatcacctgccccagcagcttctgtggtaggcccacagtgcttccattttgtgattgttgccactggcctccgtctgaatttgtttcactgccctagccatgtgtggacatccagatgttgcatccttggtgttcatgtggaacaaccaatgcttcctgataccaaggaagccagggctttctgcagcttcccttctttgacatgaaaaacagaggtggatagggaaacttgaaatcactagtccatttttgtccagagctggcagaaaatttgggttggccagatataactttatttcctttggggtcatagccaaacttgattttctttaatacatcaattttcaaaacatgttattttatttttatatacttattaatgttgaatagttcatgtatacatacagataaaaaattcaaatggtcttaaacaatatgtgcttttattaaaggtctcattctcatctctagtcctgagtctaccattttacttacccagagacaagtgatagcaatgtcttgcatacatttccattcttcctgcgttattgtatgcatttataagcatgcacgtttctgaatctatatgtataccacttttgtacaaattatactgcataatttgtatacaatttcttatacttaacataccttggagatagttttatatctctgggtgtacatatgcttcctttgttttagcttttgtttttaagggttttatagtgttccattatatggagattaattataaaatagtgatcccttaatttgtttaacctgtcctctactgatggctatttctgttgcttaggatcctttactttggatcaagggctggcaaacatcttctgtaagggataaatagtgaatattttagactttgcaggccttgtggtctctgttgaaactgcttcactctgtattacaataacagccataaactatacgtagctatgttccaattaaactttgtttataaaaacaggctgcagtccaggtgtggcccctgccctagatgttcagttttgagagactgtcatgcaaaaagtgtttgtgactggcctgcagaaagtgcttaacagatagctgttatttgattgatgggtaatttgtctggaaatttgtcattagaataaggagaatgctaaacagtaaaagatttgaaaaatacatttgtatcaaaaaagaggtatggaaaatagaaaatgcatgactttaggagcatttgactttctggtgtttaaaaaattgtttaagatgacgctttgacttcttttcaaagtgtagtaagcaggaataagaaaattggaggaaggattatctacctctttgtagcactaccaacctttgaaattttgcttcctgctccagtctgactagtaaactcagattcacccacaaaactgggtatggtaacatagctcatggttattaaagccgtttggttttgcatgatgagtgtattttgttgaaaatgtgtgtcaaccttatgatgtccacatacaaatgtcctacataggcttttccctccttctggggttctagagaacacatgaaagtacttctcctttcattaaacactaaacttgatgcttttaaattctttgacgttctgtattagagatgagtaaactaaggcctgcaggccaaattcaacctgctgcttatttttggaaataaggttttattggaacacagtcatatgcatttgtttacacattacctgtggcttccttcatgttacaacagacaacttgggtaactgaaatagagaatatagaactcatgataatgaacatttactgaccctttatggaaaaaaatcttttcaacccgtctttttgattgcactatttttccctcaactttgagaatcgggtgctctcttctctgaagttgtagggaatctattattatttttttagcatggagaacttgcaatcagcatgtttcttagcttttaaagaacaggcatggttgttcggttgatttatcttttcaatatagtgaattcctactttattattattattattattattattattattattttgagaccgagtctcactctgtcgcccaggctggagtgcagtggcgcgatctcggctcactgcaagctccgcctcctgggttcacaccattctcctgcctcagcctcccgagtagctgggattacaggcacccaccaccatgcctggctactttttttgtatttttagtagagatggggtttcaccgtgttagccgggatggtcttgatctcctgacctcgtgatccaccctcctcggcctcccaaagtgctgggattacaggcgtgagccaccgcgcccggccctcctactttatttgttgaacagacagttattaaactgcctcttaaatagttattaaacctgttatgttcaagcctgggaatacaaaggcaaattatattgatttcctgtttgggaaaaaacttgggggccaatgattgacatagataaataaatcagtgattataagggtaacagagatatgaaggaactgttatgggaggaggaaccctccatattatcccggaggacaacaaaggcttgctggtgcagaaaggtgacattttgaaggataacaaggaattggacaaacaaggaagaacacattccaggcaggcagaaggtacactaagcatgtacaaagatgctgagatcttaaacagctttaaacagcttgaggtagtggaagaagcagtgacagtaaaaaaatgggcctcatcatgaaagaccaagtgcatcgatgatgtaagaggtgaaagtggcattgcttctcccttccataccaccacccagccaccagggggccatgacctagagattgctggaacatgaaggactctgatgttctggaggaggtgttgccatctctgatccctttaaaggaaggactaataaagatctgtcgctatagctgaaaaatagctgtggacagggcagacaagtggacaagcagaagcggaacaaaagttcccgataaattcccaaagcagttaactgtagtagagggaatttacgtgacttaactgtagaattctccataaggggagctgcttcatgcaactgcgtaaaatttgtccttttttttttttttttttttttttttttttttttgagatggaatcttgctcttgtcgcccaggctggagtgccttggcatgatctcggctcactgcgaactccgcctcccggattcaagagattctcctgcctcagcctctcaagtatctgagattacaagcgtccaccactactcccagctaatttttgtatttttagtagagacagggtttcaccatgttggccaggctggtctcgaactcctgacctcgtgatccgcccacctcggcctcccaaagtgctgggattacaggcatgagccaccacacctggcaaaatttctcctttttaaactgtacctacagctctttatcttagtgcaactaaagttgataaagtcttcatgatcctttgcagcctagttcaagttaaaaccaagagagaagaaaacaaaagcaaattaagcccattcctttgccaagaagaagtgttacttgatttttatttgcatcctcaatgttccttggaaaataacatgatgtttggcgatgttcaaatgcctgttgacaatcctccgacatcattttctgtttccattgcctcactcagcacaagggctctcataagctttccagtcaacgatgaagcccagatgttatggataagccacagacttttgggggaaactaagcaaacaccaataataaataatgccttgaggacatactacagctcctctctaagtatcgtgatggtcaggcttcatcatttcccaagcagattgcttggattttaattttggcagcaaataacatggagcgtgtgggtttgtaaatggtagctctgtcccaataattccagatgatggggccattccagctttctttaacttagagatttgagcatgcattgtggtaggtctactcaccgtatctgtctagaatgattcagagaggccactcctgggctgagttacttctcatacatatatataattggaggccacattagcctgcagtataactttggaattaagatttgctcaaaaccaaggctgagtttgattaataggttgtaagttagaaacttcctttcttgtgttctgatcccaaattcctactttatattgtggcacctataaaattgtcctagctaaggatgacttgatggtacctaacgtgagactggtttatggatgaagttctttgtgcttacagggttttttcctgataattaacactgggatgaatcgcaagacccatctttgcaaaaggcagtttcttttcttatttttagaggattgttcctgaaatgattttgttcatgttttggctcctgtaatatctctattcatttttttcatggaattttttctttgggtctttttcttcataattttttttttttgcctttcagaaaacacaacacaaaacaaaaaaaaagaaacaaatggttaaaattcaagggattgttgtagctctgagggtaaaacgtgcagcctgttggtgtcatttgttactcatacaaactcttagtattttatttctgttgcagcattggggttgctatctttctcatcatgagtaatctagcattcatgctgcattctattcatagctgtcatactgtctctgacagggtgttttcaaaactttgatctgcttccagaaaagacttttacatgggtgataggatttatggaggaaattttcaactgaataccaggtattaccttcttggaaagagcaaagcatcaaacgtgaatatctcctttttcttcttcctctcctcttcttcctcttcattttaattttatcgaagctcagtttttagtaactttatgtttcctttttattactgtatctttgtactcttcaatagcagtgtccaaggggtagaaatttgattgttgtggtaggggaagaagcaggaaaaactacatatttcaacaaaggtttgtctgactctgagcaagttattggggtacagacatggataagacatagtctctgtccttggaaatttcagaacctagtagggagacagttacataaacagaaaatataacataggaaggaatgaacaggatattctagaaataccaaaggctctgaaagtagggtgatttctacttttaaagaggtaatttaggttctgaaattaaattcctgaaaataagggccaccctagaaccttaccataacaaaattagctacagttagttatgctaatagtaacctctttcctgtctcgaggaactccttttctttattccacaaagagcctcaccttcatggaagatccaaaacaagaaactgtaagtctggttttgactgttggtcttttaaagaaactctgtaatcggcaaagaatgggtccattgcaggaagttgtccaactggatgttaactagtcagatagcagccttgctggggtatagcacaagttggccaattcgcactggcacatagcctggcctcttgggtcttccttgtaactcaaatcactttgcaagccctggtagtttcacgaaagtcagatgtacccttaactcttaccccatacactcatctatcctggaaagaaaaagttgttggatcttggcccactactcaggaaagtgtattgaccacaggttgtatagttaagtaacagcattttgaggaggatgataatgatagtgatgatggtgatgatgatgataacaacattgatggtgctgctgttgctggtgtgcttaatgataaggatatgtgattataatagggtaggaactatatcttatccttttatacctagtatttggcgcagagtagggatttcagaaagtttgtttgttgtggatggagtgagcagttagagtttcccacttaaaacctgacacagagcatgccatcccacttactcaacaccctccagtgaacttccgtttcatcagcatcaccctgtgttgacctatgtattctggctctcctctgatgttactctggtctcatctcttatcactccccagagactggcttctttgtttttcttcaaacacatgcacgttcccatgtggaggtctctgcgtacgctcttccctctgcctggaatgctttcccccaaatatcactgtggctcatttttgttgttgttgtttttgagatggagtcttgctctgttgcccaggctggagtgcagtggcatgatcttggctcactgcaacctccacctcccaggttcaagagattctcccacctcagcctccccagtagctgggggcccaccaccactcctggctaatttttttgtatttttagtagaaacggggtttcaccatattggccggctggtctcaaactcctgaattcaagtgatctgcccaccttggcctctcaaagtgctgggattacaggtgtgagccacgacgccctgtcccaatgtggctcactttttagctttctcagttctctgcttaaatgtccgcttctcagagaggcctcccctgaccactgtgcacccctctctccctcccatgtccctttatccagctttatttttctttgcaatatttacgtattaagcattatttgtgtatttgtggcctatctctgctcactccatctcgactgaatctaagctacatgaggactacctcctttgttttcatcataggcatttccctagaacctagaacagtgcatggcatataggcatacctctgtaaatattgttgaattaatttgaaatgagttaatgaattgcttataccatcagaagacacatttcatgaactggcatgtatttcaggtatctttctaggtttgtctttcttatcaccctcttggttgtgtgagccccttcagaacagagatcctatcagatgtgttttgttgtcccaaaaggagcccagcacaaccccattcacacagtagttgttcagtaaatgcttattcattggtagattgtctcaaaggttcccacttaggagtattgcttttcttttttgctctgcttcaccacatttttcagtcactctgttttccttcctgcgttttgacactttatcaaactgtactttttcactgtagacatctatggggggagagattatacaagagtatttttatttccactctcaaatacatgtggtggattcaggtttaattttgtattattcataccactgcaccaaagaccaactaccaagaaaactgtaaaaaccagagaatatattttctattcttgatgaaataaaggttctgtatgagaaaccaaatttctaacttcaaaagatttaataggttgattcttttttaaaattgacacataatatttgttcatatttaggaggtacatgtcatattttgttacatgcatagagtgagcaatgatttagtcagggtatttagggtatccatcacctcgagcatttatgatctctatgtgttgggaatatttcaaatcttttcttctagcagttttgaaatatacaatacattgtggttaactatggtcaccgtactctgctatcgaaccttagaacttattctctctatctaactgtatgtttgcacacatgaaccaacctctcttcatctcacctccacccacacttcctaggctctggttactattattctactctctgcctccataaaatacactttctaagctcccacatgtgagtgagaacatgtggtatttctctttccgtgcgtggcatatttcacttaacactatgacctccagttatatccatgttactgcaaatgatgggatttcattctttttttatggtggaatggtattccattgtgtatattatacagcacattttctttatccattcattgaacaggatgattcttaaaagcaacttccagctgattacatttaggcaaatacatttaaacatttgctgtggtttttagcatgttagtagcttttgaatatagtacattctgcctactcaatgcccttgaaatgtctttctgaaatagttaaattcatgttggtattcacactggactctgtatcactgcctcccttacccaaaggagtttgactagttacttgctagttgaaaccagcttggtacaagctgacacatttttcaagaaatagttgtgtaatacatgttgatattctttgttcttcctttccttattcatccatttggctcctttcttctttccctgactctattccttcccccttgactttttggaagccattatcgctttagtaaacttaatggtgaattgcttcaagagtaaaaatgctctgcttttcaaattagaaaaggactatttcctgtattcttggggatctcattctctcatagctcttatttaaaacgttctggccaggtgcaagcactcatgcctgtaatcccagcaatttgggaggccgaggcaggcagattgcttgagtccagaagttcgagaaaagcctgggcaacatggtgagacctcctgtctaaaaaaaaatacaaaaattagctgggcatggtggcgcacgcctgtagttccagctgctcaggaggctgaggtcagaggatcgcttgagcccaggaggttgaggctacagtgagacatgattgcagcactgcattccagcctgggtgatagagtgacaccctgtctcaaaaaaaaaaaaaaaatgttctaagcaacgattttgtttatttgttcaagattggattttctacacatttaagcctgatttatcacaaataaagcactttctcacaaaatatattctcagctaattattattttcattagtagcactgtcctaactttataacacataaagttcccctggtcttgtttttaacgtcttgacatatgtatacatttttgaatgactaaatcaagctaattaacatatgcattacctcacatacttatcttgttttgtggtaagaacacttaatatctactctcttagctattttcaagtgtacaatacactgttattaactgtggtcaccatgttgtaccatagagctcttgaacttattcctcctaactgaaattttgtatcctttgaccaacatcttccaatcctccctctccatctccagcccctatcaaccaccattctactctctgcttctatgagtttgccttttttagatttcacatataaattgatatcatatggcatttgtcgttctgtgcctggtttgtttcactaaacataatgaattccaggttcatctgtgttgttgcaaatggtaggatttctttcttttttaaggctgaacagtatgccattgtgtgtgtgtgtgtgtgtgtgtctatatatatatatatatatatatatatatatatatatatatatatggcacattttctttatcagttcatccactgatggaactttaggttgattccatatcttggctctcgtgaatactaccacagtgaacatgggagtgcagatatttgacatgctgatttcatttcctttggatatatactcagtagtgggattgctggattatatggtagttctatttctaatttattgaggaacttccatactgttttccatattggctgttcaaagttacattctcaccaatagtgtaccaggcttcctttgtctccacatcctctccagcacttcttatgtttcatatttttgataaccattctaacaggtgtgaggtgatgtctcattgtagttttgatttgcatttctctgatgactagttatattgagtatgtttttcatatattgaaaaaaatattgaccatttgatgttttcttttgagaaatgccaattcaggtattttgcccatgttttaaatgggttgtttattttcttactattgagttgttttagttccttataccttttctaggtttttgtttcatctatgctgtcttctcgtacagctcattgtatttgtttgctaaggctgctgtaatgaagcagcacaaactgagtggcttaaacaaatgtattgatccacagttctggaggttagaagtcttagatcaaggtgtcagcaaggttggttccttctgaaggctgtgggggagaatctattctaagtctctctcctagttttaatggtttgctggcaatctttggcatcatttagcttgtagatgcatcaccctaatctctaccttcatcttcacatggcattctttctatgtgtgtatctctctgtctgtccaaacttccctatttcacaaggacaccagacatattggattaggacccactctaatgacatcattttaacttgattacttctgtttattccctatctccacataaggtcacatttcaaagtagtgggggtaaggactccaacatatcttttttttggagacacaattcatcccataacactcatcttctgaaatgtcaaactctggagttagtaaaaccaacaaaagtgttcattgcagcattattaacatgggttaataatgggttctctggtttatcaaatgtttaactttgactctttagatatagtaaaactttaactgagtagggtgagaggttctaacagatggaattttctaatttgctggcaattagcctgtagatgactatgcgagatgtcagctctggttccttcagtagaatatacataatagaaattttgatgattaacaatccttctatttagtattcatcctaacctcagactcttcatttcatttcatgagcctgcctacccattatggcaaagtgaagacactgtgatgttgtccatgacatttatgttgttcccaagtcacccttgtgttgtccatgacttttatctcactcctttcttccttgttctaaccactcctccagttcccgaatcttgcttctctcccctacttttgtacatttgtatttgttctgtagatttttttactcaatgccccctaaagaatttatcttagatatgctctactggctgttcctgattcaaatcaaactgatgaatgggccatcctaactagtccttttgacatcagtcaccacaccaatgagtccactcaccagcacacaaactgggcccccttagtttatccacaaagtggagaatttgacaagataatatactgtcctctcatgatatgtattgtgagatgccctcttaagagactttccaagtggctagtctctacctcatctgattacattaacatgcagttattccaatgatcttcctaatgtgtaattctgaaaagcaacttgcattcaaaatccatcaaggcccctccctccattgcccattcaatgaatgcattcttcagactgacatcttaccttcacatacctacctactagagctccaaacaagtagttctcagccttggttgacattgaattacctcaggagatttagaaactaaagatgcctgagccacacccaagataatctaatttaattggtctggagtgtggtctatgcatcaggatttttaaaagttccaatattcagtcagggttgagaactacttgtttagagcaacatgtctccaatcttaatgtgtgcagtaattgtcttattcaaatacacattcttattcagcaggtctggggccagccaaggttcctgtattttttataaccagtgatttttttggtccacactttgcataacagggtgataaacggagctctgtcaggtccgggaccacatttttctcatctttctgtctctaaagtatagtgtagaagctcttagcaaatgtttgaaatcaaattaaattacagcctttccccaactttccaacctttttctctgcatattgaagtccatataagcataggcttatctctttttgaagcctatccctagccacaaccagaaggccaatgttttttactcattcattcaaccaacattttctaagtgccctttatggcctgttaccaagcattctgtagataataaaatgtaatttccacctcaaatttgcatgccctaacaggggattatcctcttggtgtgtgcttcacagattaccagtgctacacaaccaggtgttttgttttaatatgctttaccttcgtaaaatacaaagttcaacacttgggtgtctctgcaatgtcaagttgctataaacgtttctaaacagtgctctcaaattctctccttgtaaaatggcagtaagtaattttcagatcatgttggttcatggactacactttgagtactgctttttcagggcctttccagacaaagtggagtctgtagaccagcagcatcagcatccttgaaagcttctgagaaatgcagaagcttggatctcatcacaggcctactgaatcagaatctgcatttctaggtgatttgtgtgcacattacagactgagaagcacagctccagggcagtggctctaaaccttggctgcatattagattcacccctggggcttctaaaaattctgctttccttcttttgagaattgtctattcagatcctatttgtttttgttgttgttgagttgagctctttttatatcgtggatgttagtccttcattggatgaatagtttgcaagtattttatcccattctacaggttgtctcttcactctgttgattgtttcccttgctgtgaagaggctttttagtttattatagttcccttagcctgtttttgtttctgttgcctctgtttttgatgtcttagccatacaatttttatggaattacttaaggctaatagaattagctgaaagtagtttccaaatgtgcatctctaccccttgctttgcaaccttctgaaaaccagacaatactctgatgtaatttgggaaagaagatatattagtttaggcctaacgtcttaatgtcctgaagaacttccctgtgttttcttctagtagttttatggttttggatcttatgtttaactattcaatgcattttgagtttatttttgtatatggtgataaataggggtctagttttattcttctacatatatagtacatatacacaataaaatgcttttcagccggctgggcacagtggctcatgcccgtaattccagcactttgggaggctgaggcaggtggatcacctgaggtcaggagtttgagaccagcctggtcaacatggtgaaaccccgtctccactaaaaatacaaaaattagctgggtgtggtggtgcatgcctgtaatcccagctactcgggaggctgaggcaggagaatcacttgaacccgggaggcagaggttgcagtgagctgagatcacgtcgctgcactacagcctagagtgagactctatctcaataaaaaaaaaaaagaaatacttttcagccataagaaagtgaaattctgtctttcttggcaatacggatgagcctggctgacattatgttaagcaagataagtcagacacaacaagataaatactggatgttctcactcagatgtggcagctaaaaaaattttgagccaaaggaagtaaagagtagaattgtgggtattagaggtagagaaggtcagaagggaggggaggatggggagagactggttaatgaatacaaacttacatctagataggaggaattagttctggtgttctagcactgtagggtgaatatggttgactataacttattgtatatgtcaaaaaactaggagagaggattttgaatgttcacaacacaaacgataaatgtttgaggcaggagatatgctaattaccttgatttgatcattacacattgtatatattataaaaatactctgtatcccataaatatgtagaattgttacatgtcaactaaacacaaaaggaaaaataattctgctgcacaagctatgtcccaatgaattaaactaaaaatctctgggggtggtccccagtcatcagtatttttttttttacagctctccaggtgactctagcatgcagcccagagtgggaaccagcactaagtcagcccagtgtccatagagtcccagaaagtggccagccattgctctaaccttcaaatcagctcaggttctcagatactcatttattactccattcccttcacttaggaaactcaggaccacagctaaggtattccttagggggtatttaaagaggactgcttagatcagtggttcctcaccttttgttccacagcagttcctgaaattggatgggtgcatctttaaagtgcagttgcagggcctgtgccttttttattgaggtggagcaattattgtgaccctgttctgctcagtaagacataaagaaaatatgctgggtggctttctccctgagagaggagcacagaaatagaaatattattagaaacagaattagaaatagatagaggtccacttcatgactgctcaactggactttttagggtctcaatttctacttgtgtaagctcagattgctcagtgggccaattagtgaatcccagagaagggactagagaacagacctcgtttggaaatactctattatcgtatttcaaatgtgggccatggactagcaacatcagcaccatctaggagataattagaaatgcagaatctcaggccccaaccagatctgtgaaatcaacaatgttcccaagtgatcgctatgcacattcaaatttaagaagtggtggtctctaagaggcagaatatattttttctcaaactacttttcagttcccctgttttccttctgctgtcatggaagatgagcttgccacaaagggaagctatgaagaatctagcacattcttcccttggaaattcaaacacccatttccacactgcagtggaagtgttgtgacatgttctattggaaaaccactacctacatgccatcatatggagccataaactatttttaggttttctggacaggccaaagattctgctgcccaaatgattccaaagaacgtgaggctgatgtgtctcagattttcttgtaattcttgcatttctaaaaatatcttgggtgtttgatgttgagttcagccctgttttactaacaagcgaagcctttgtatttactgtctcatttggtaggttattttctccctttttatttccagtgacatgtcatgtttcctgatactgatttatcagagaagtagaacaagaaattgattcaacatgcataatattttattgaatgaccatctccatgtaaaatttttcttggagtttgaagtggggaagaatgttggatatagacctggaaaagagaaggtatggtggaagttcaagtttcctcatttttgttagaggagtttgaaagctgccagcaagtgtttaacaaataagaaggcagccacctgagatagtctattgagataggaagagtgattgtagaagacaaacagcaacccatggtccttcaaagaaaaaaaatggcatgggcaggaattacttaagtctaatagaattagctgaaagtagtttccaaatgtacatctttaccccttgctttgcaaccttctgaaaaccagagaacactctgatggaatttgggaaagaagatatgtgagtttaggcttaatactttcctagtctttattattatattttacaggaatttcataatatatattttaaagattcttactaccatgattaaattctgcccagtatgatgatcaaaaagggcttactgaatggagaaagacatttgtgtaacacctagcagtcatttattgcaaagccaataagcgccaggcattagggatataggtataaataatgtcccagcataaaaggcaaatatatatttatttgccaaatatatatatatatatgttttactttatacatatttttcaggagttcacagaaaacaatgaaataacccttaaatcatagttcatttcttaattttcccagtaggagaaggctcatttttcatgtttttctttattattttgaaggcaggacttcaaaaaggaataaaaacagaaggtcaattgcagggcaaatcacagcggctccgttcttgcatatccagatgggcatcaccctcgtttaccttcctaaattgggaagctttacatcctttcacaaaaacatgatccataattattttgttgcagttcacttttttaaactggtagaaagcatgctgttaatgtgatagtaagtacttactctgtgaataataaaattattaacatttcaagcctgcattttggggagttaccttgagcccacattgtgccactcttaaacacatcagtgcatgcagtctttggggcagctccctgaactaactctcttgttgtcattttagagatgttgagattaaggtttagggtatagttttctccaaatctcagctataaataaaggatagagtgaggatgtctgcctgacttctatgcttaagcttctaaatgttgccttgcatgctgtctgttttgtgatctgagagtcatagtttatctgctattttgaagcacaaattattttttttaagaaagcctgatagctttatctgagaggattagctcctactatgcaaaaccttgaagggaataaattatgggaataaactagacagctacctgaatgtttgtattttagatttcaaggttattgaaagtactagagatatacctcagtctaatgtttgcaaataagaagcacaatatctccttgaagtcaagatttttgaaaggcgttattacttggtaaattaaacattagcttgccaaatagattttttcttattctggagaattacataatagaatcatgggtattttgtacttgccaagaatcacttcttgtaccatgtagaacactcctgactccctgcccctcatcattgtatagctgaaaaaatcagagaaggaaaggcacatgccccaggtcacacaacttgctggtgtctgaaatgagtgaaacctgagaggttgtctagtccacactgcaatggatctccagctgaacgttaaacataattatgaactatctacatattttttgtaggaagtttcagagtgatgagatcatttcttcaaaggttttgtttgtttgtttgagataatgttttaatttctgacaaatagcgttggccctattagaagacttgcgttatgtaagtctagcataaaatatttatcatatccttcatttgctaaaatgtttgatcttcttaccactgcatcaaaacaggctgggttctgaaaggctgatggagagtcaatttattcgcaagaaagaaatcacacgattcaagtgacccaagatgtcagtgtgaaattaaattccaccagagaactgatgatactgagattgacccttgcttgaaacaaataagatgaaccatgaagtgaacctcattccaaacatggcatcaacaaacataaatgaagacctaaaaagtgacttgttttgggtgccagatttttcaacctcaaaactgaagtggttgtgaagccaatttcaaaatgacaggcataacccaacctttagggtttattggaaacttgattatgttcttaaggcctctcagatttttggcatggtttaaacatttgcctctctgtcctacatatgataaatctgtggcttttggctaaagtctggcctgtggaactttacccatgtgtgaatctcaagctttcaaacatgttgcattcttctaaataaacattgggccactaggcatctgctgttaatgtagatcctgtagtcatgcattgttttttatcatttcattcattatttctcttcatcttttactgagcattatccattacatgggcaacatacctttcacatgttctgtgtttcgctttccgtgtgtcatgattatcccaaatgcctaaaaacaattgaaccagcctagatataagaaagggggccatagggagccttaagagtgaagataccttctaaataatcaaaagttgaattacacttgatatggctttagcattaagtcaatttccttgtacacttgttcttacaaaattgggtaatcaatctataacaagtatctgttcttaatgccttgctgtgttactcagagaatcttgactttaacagaatattttaaaaattcagcaaattaacaaaataagcactagaatgtaaaactctttctgtccctctttctacacacacatacatacacatttgcagttgtttacaaggtgtctgggctatgcacatcgcatgctgtttaggagtataggctttagagtcagacagtctcgggtccaaactcagctttgtctagtggcaatgtcacttgttgccactggcaggttcccatcctcatgaaagcaaccaagaggggaggataatacttaccttttggagtttttatggtctcagtgagctaatttcagcaaaatacctttgcattgtctaaactggggtctctcaacttcagcactattgacattaggaactggataattctttgtggtggtggtggtggctgttgcatgcattgaagatgtttagcagcatccatggcctccaaccactagatgccagtagcatgctcctcccctctgaattgtgacaactaaaaatgtcccatgacattgccgaatgtcccctgttgggcaaaattgcccctggttgagaactattgttctaaaattatacaaaataacctctttttgctaaagcaaaataattgttagacattctaagactcagaagagaaggaaacttgaaatgaatcaagccactaaggacatttgaactgagaggttacatagaacagaagctctaaggggaccccaagcatccccatctaaatttccttctctcctaaagttccattggtatctgcaataaatcaacattttttgtaaaatccacttgctccatttctcaaatcattgcttcatctctcatttgtgaagctattgtgtttgattactcccaaatacaattttttttcctacccaaaggagacccttcccactctgcatcctaaagtgtctgggtgtcgactcatggtcagtaaggtggttgctatgtagattaatgtgcgctagctgatattttggtttgctctcctggcctattttgtcaagcttggagggttttctaactttgcaacttggactcacagactcctagcctcaaagaaatattttcacaccagccttaagttcacatccaagatgtgacagattgtgtgttcttggggtggaagtgagagggaaggggaataaataaacccatttttaggaagtatagtcagcacttacgcccttccatcatgcctttctgaaggcattgcctcaaacccagacttgaagttgagcatactgcttaaattaggggattggggcaggggcatgggcatgatctacccataaaccatagatggtttcttccacccccgcattctccctcttctgactctattgaccactccctctccccaccaattctctctttttattttcttggcaccagaaaatcttttttttttctttttatcgaggtggtgtctcactttgtcacccaggctggagtgcagtggcgcgatctcggctcactgccaacctctgccacccgagttcaagcaattctcctgcctcagcctccggagtagctgggattacaggcacccaccaccacacctggctaattgttttgaattttttgtagagatggggtttcaccatgttggtcaggctgttttcaaacccctgacctcaggtgatctgcccacctcagctggcctcccaaagtgctgggattacaggtgtgagccactgcacccagctggaaatcttaagatttaattgtcttccagtgaatgagctgagagaaataggatttatttaaccagagttgtcttctcctcttgggagtgagaaaaaaaaaaaaaaaaagtagggctttgcctaaccattatttacagctgtagaaaaccaaatgcacagtctaaatctaagtaaggaaaaacacaaacacaaccttagaagatagaaatcattcacaaaaagctctgcatttgtatttcagtatgtgatgttatatgctttcagtccagttcaactgacattttgaaaccaaacgcttatacagtgtttgcagtgattttaaaaatattaatcaatgttatcctcatatcaatcctatgtagttgttattattactattatccccatttcacagataaggaaattgaggcatagataagtaacttgcctaaggtatgcagctagtagtggtggctctaggatttcacatttattgagcaatcagtaaatgtgctcagtcttgggcaacaaagacaagtaagaagccaagcagttttgtggggaagacctctgaatggttaatcctgtgatggagtggtgagtgctatgttaactgctggattaattaagcctttttaatttctatatttctgatcatttgatatccagagccttgctgatcctgaagggactgcccctcccctgggagagctagctaattcctagggatggtaaacaactcacttggaattatacctttcctatgtggaccaaccaatccagagcccataccccaaccacctcatttattgggctctcacagggctctcaaacccttgccctaatcaccccaggccaggtaccagacactagagatggaccctacaccccagagtccacttaaattattcaagctagccaatcctaagcctgctagccctgcctcacccattcctttccacacaaaccacaataaaggctcttgcccatgttttctccttgcttcctctttcccctgaccagccctggtgcttccccatgtggccctatgtggtgtggcatgcctctcctcttgggaactgtgtgtaacaagctgttttcccaaaggcaattgtctactgatctgttagccccactatacctgaataataacaaaacttacatttagaaacatttgcgtgcctgtggagccccatgcaggcactcaggagacaagtacagctggacgctgttttcaagctgctcacagctgtgctgtactgggccacaaaatgcaattcttctgccatggttggtgcacagcagctgtttggctccccactggcctggtctgtgtaagtgtaacagatgacttccatgccgttcttaaattacagcccagagaaatcagttggtttaaatagtctcacttatggactacttccaacgccctatgattgctttgtcccttctttatttgaaggttcaccatgttcttctttacagaagtacactatgttcttctatagaattttctgcatattctctcaagccttcttggtgccaataagccatcttcaacaatgaaagccactggtggctgctgggtaggagttggtcacctttggagatcccaaagagggatctaagactctctcaagctggggggacatcaaaatgaccagctatttggccaaggaaagacagttatctgtcctatgggtaattttgcttgtggaactctgctctctaccccaaaggtgaccatttgccatgattattgaaaagaggattccagatctgggcgaacaaatgaaatttgaggtttcttatagcatgggaccccctcctcctcctattagctgctctgtaaagctgaagtattgctcctcatggtaacttttcttatttaaaccttttcaatattgcacttgttgaggtttttttttttttttcttttcctttttttcttttttgacagagtcttgctctgtcacccaggctagagtgcagtggcgtgatctcggctcactgcaacctccaccttctgagttcaagtgattctcctgcctcagcctcctgagtagctgggattacaggtgcctgccaccatgcctggctaatttttgtatttttagtacagacggggtttcaccatcttggccaggctggtcttgaactcctgacctcatgatccgcctacctcggcctccctaagtgctgagattacaggcatgagccaccgtacccagcctgaggtttgttttgttttgttttgttttgtttcactttttgtccctggataaccaatgagattaggggcttattaatctcctctggctagttatctccattaagcttattgattttcattctaaataggttcaaaagagctgtttatagacttaactaaaggcttaatggctggcgatttggaggtctgtatcctttgccagagtgaggataaagtcacattcctttttctattcccaacccctcctaaaacagtgggaggccgtagttaggcactccactaacatttattgaatgtgggtattttctgatgttggatcgcttaggctagttcagaagtgggagctgtggtctgggtctctgtgaaacatctcctgagaggatgagaaaaagctgtttactctcgagtgtctgagtttatgcccatgtggatggttagcgggtctgtcattcagcagggtaggcaactctgcagaatgccatggaaattacctttcttgaaatccatggaacaattttaagttgaaatcacagtaatgaaacaaagctgttatggggatggtgtcaagaaagttcagtcatattccaaagtcctctcaatttgcatttgaagggtggtgcattaattgtctcaatggctcatttctcagacagttgaatgataaattgttagaactatagcagtggttctcaaccaagaaagatattgcattgtctggagacatttttgattgtcataacttggggaatgttactatagtaacacctagtgggtagaggccagggatgctgttgaacattttaaaaggcacacagtgggccaggcacagtggctcatgcctgtaatcccatcactttgggaggccgaggcgggtggattgcttgaggccaggagttccagaccagcctggccaatatggagaaacaccatctctactaaaaatacaaaaaaattagccacgcgtggtggcacacacctgtagtcccacctacttgggaggctgagacgtgagaatcccttgaacccaggaggcagaggttgcagtgaattgagatcacgccactgcagctgcactccagcctgggtgacagaacgataccctgtctcaaaaaaaaaaaaaaaaaccacacacacacacacacacagtggtccccacaataaaaagttttctggccccaaatgtcaatagtgccaaggttgagaaatcttgatctttattaatctaacatctggattagtttcaattaatctatgctgaaaaaataagtgttcagaatctaagaaatggagaaaatgattaattaaaaatgaagtaccttaatatttttaaaattagaagcatttagacattcagtatttggtttttattgtacacattataggagttaattctttattaaattgagaaaaaaattataaaaatattgagttcttcctgaaatctgcataaagaaaagagccattctgggtcttctctgtgagtaattgaatttttggggtacagcttgtgttagttactcttctcctaaagatacattttatagacaggtgctcagccataaagggccaggaaaatcaaagaaaatataatttaaggtcttaaagtccctttttattatcagatttcactgagtgtgggcacatgaaacatgagtccatgatcttctgatagtttcagatgtctcagattagaagatggaaatgactgattgtttttctcaaatgatctctaagatcaatgagccagtccaatgtacatattcaatatttaaaaagatcaaaagttgctgttatcatgatatagttgatttttgtttctcttgtttgtacactttgggccatagagaagctataagagacaactctgtatcttttagaaatgagcatatatttacaaggagaaaagcctttttatgtcacaaaggatactagtatatttatcaatttctaggcctttaaagtgatgtctttagtcctgcagttttcaaagtatggtctgaggaactattgggtttttttttttattcccaggagttccttgaggtcaaaattattttaataataatatgaagatattgtttgtgttttttaattctcattctctcaagagtgtgccataagagttttccagagaccacatggtgtgcaatgaatatcatgctgatagctaatagaatgtgttcttgtgttttaaaactttctcagttttaattcctaattcaataaatagcaatagataaaactcacataaacacaagcttttggaacttccaataatttatgagtgtaacggggtcctgagaccagaaagttatgagaactactgctttagtgattgacagagaaaatgaatcaagttgaacaaaagttcagaacttgggatatttcaaataccatggctaataacataagccagcatcatcttttattgctttgtagatattagagacacgaaaaacccttggattctgtgccagagcttaaaagaactagaagcaattgtttctgagttcttgtttcaaatccagtgtctgatttggagttgtgtaatctctgtgccgttgacattttgggcagggtaattctttgctgagaggagctgtcctgtgcattgtagaatgttcacaacaaccttggtctctgcccacttgataccagtaggaacctcagttgcaacaactaaaaatgtctcaagacattgccacatgttccctggctggcaagtcacccagttgagaaccactgtctcttaaggcaaagtatctgttgtcgcgacaggacgtttctgattccctctcattgtttagaatttattcacatagccattcctaattgtaaataggctgggttatctaatatttattctagatgggtatatgccagctaaaattggatgttgtattactgtgacagaagaagagaacaagtattgagggacagctcccagttttcatcatgtgtggaaagagaatctatgcttgaaatatttgtgatggtgatagcacattctatcaagtctaggaaaacaagtcactggattttactgaagtatttaggtgtaaaaaattgaaggcccttccgtgaaaaagttctaattggtaatttcattttatgcaaacccctattatgttattatttgagagagttcaagcgtactttttatccttggtaaatattacacagtaaaaaattcaaatatcagagacaatacaaaaataattgtacaggctctttgctttctttagttacgtttttgtccagaaatatgtttttgtgcatattttcataccacaagttaaattatttttcaactttcattaaggttttatcgtctctcttgatggtgattgttcacaaagaaacaaaatatttatctattaaacagagtgtgatttgcatgaggttctcccagaagtagcacctgagtcaaggattcacattcaaggagtttatttggagaataaaagtagaggagcggaggtgtgagacagagaagggaggaatccaataacaggtgtactgttgagcacatttccactttaggagatgggctgcaatcccattagggaaccctataagccagtatagaatacaactcagagttatcccacccaacggacaaggacactgaggtatttatcctccaaatctcagctgctgttggctcagggcaacatccaggggcattaggtccctggcacttctggctttcctttttttccctagtcaagagaaagcttataggcagagagctgcttatgtgtgaagctggatgtcatgggatgtcctgaagcagcgagtgctgagaggacatgatggggtacctacagcatctattccaccctctacactggttggttggcttggctcactcaccagcctctggcccaccagccttgctctatgttatgttgtgggcttactaaggtcagataggcaaaggaaaatgagctgaagctggacctcaaaaggatgctgacaaaaatccttgcatgatgaataaatggtgaatgaacttcatcaatgtgatggtcaggaaaacataaacattaacaaaaatatgaagctagttttcaggagccatagcaatatagttttaaattccaacccaaaggatatctgcagagcaacaatgggaaatggaattttttgctgttgtttgctttgaacatatcacagattcctcttctctaggatgttaatcagggccatcttggatcgtacttactgtcagatgtaagccaggccactgttaatgagagactggaatgcagccccagaatcggtgtctgcttcaacacagatgggcatggggatgagagatgccgggtggttatggaatatggggaaaaaatatggtgacttaaaggagggcagaggcccttaaaacttccttttatagtacatcaaagctgttgatcattgaggagaaaaagcttaaggtgggctactgggacctgccgctttcagcaagaaggctcattattttgaggataagtaaaacaagtagcctcatgtaaggatgaagcgctcttcagtagatgttggttgagtccatatggcttgcagaacatcacattaaagtttgctgactcattccatgcaagatttaagcaattttcccaaggagacaatatggctgtctccatataaatgggaataattctagaaggtaaacattagtcagcacagagaatgatttgatgaagagatagagacttctatgggtaatgggggcagacataacacagatacatgggaagcagggtggctaaatgcaagtgtgttttaagccaacaaaggtagcagtggccatggtggaggaactggagagaggggccacttgttgataatttattcctaccagctcttattgcaataaaaagaaactatgtaataccgtatgtggttaaaaatttgaaactaataagataaaggaggatgatggtgaaatggggggaagaaaataagatggtatcagtatataaaaatgcacgctatgagatactgtctccgcactgttcaatatagtagcccttaaccccatggagctgttgggcacttgtaaggtgctgagtccacattgagatgtgctgttagggttaggtatgcacactggatttcaaagactaatatgaaaaaatgtaaactatatcattgataatttttatgtagattacatgttaaaattatgataccttggctacactgggttaaatagaatatagtttaaaatcagtttcacctgtttcttttcacttttttaatgtggctactagaaagttataaattacatagtggctctcatttgtggttcacattgtatttctgttggacagggctgttcgctaccatggcctgtaccagtggttctcaaagggggatgattttgcccccgagaagacagttggtaatgtctgaaaacatttttggttgccactgctggaggggagggatgcttctagaagccctctagtgggtagaggccagggatgtggtcaaacattctatgatgcacaggaaagcctccgccatcaagtattatccaaatgtcaatattgccaaggctgagaaactccactttacaccatagatatagggtactgggagcccaatatggaggtatagtattaacctaagtgtgagggtgtaagcatcttctctagagtgtagacagtgggacccataataacacccttcactgctcaactgcatgtcaacaggcagtacagcaagcacctgatattgatgttatttaattcccatgagagcactattgcggtaggcagcatctccattttgaatctaagtcagctgattccagcttatgggctttatcgcccacagagataagaactgtaactacttcaagtctcttgagtccatttatttctttccattgtaagggcctactatcctagataaggccacctaactagtctctagtcttgaccacttcagtcctccagttctttctccatgtcacagtgatctttccaaaaatccaaaacctttcaatatttctataattactctcaggatgcagcccacattctttatcatagtctagaaactattacttggtttcaacacatttttgtcaaggatacacaatgtattttggacaaaatatggtaagaatcacaaaatgactgcaagatgatgcatgttaatggctgtcactactagagatgcatcttgaagacaggattggtgacctttctctctgtaaacaaagacttttagggcagtattttgcttatgtgggacctgtgaacatttgggtaaaacatgtttatgcaatttaaatgattatcaaaccaacaataagtttattgaaatgagaagattttaatttgggaatttgataggaagatacatgttgtttgttatactataaatctacaaatgatcaattctttggagggagaggttctgatttgtatctttttctgtctccagcaataacgagtataaagtaggttttgatagttccaccttaattaaattacaaactttgtgatgatcctgaaatgtgtattttgaataagggatcttaagtgccacctagtggcaatgaggggatatattacacattacattacaaaatgtattagttttgaaattataaaggatcttaagtgccacctagtgggagtaaaggattatattacacaacatactacaaaatagagccgttttgaaaatgtaaatggtcttaagtgccacctagtggaaatgaggggatatattacacttattttaaaatatgttactgaaaagttgtccccttctcggtggtagccccagtatgacttaaacgctgtgaatacaaaaatggtatctccttaaaattatgcattctcatcttctttattcagtttacctgtctgtcacactgccctctggacatctaattttttaaaaaagaaattttttgtatgagttgaaacagatgaatcctgaaatctgagtgaaattttgaaactgcaagtttgtttctctcttatgtaagagtccaatgaggatatttggtggacagccttccttgtagtgacttggggatccatgctcctcccatcttgtagttcagccagactttagggcagagatcagcaaactgtttctgttaatggccagatgggaaatattttaggctttgtggactttctggtctgtgtcaaaactactcagctttgcctttgtagtgtgaaagcagctgtatacaatatgtaaatgaatgagtgtggctgtattccaataaaagtttatctttaatgctgagattggaatttgataggtttttcatgaaatagtcttctttttaatttttcttcaaccataaaaatgtaaaaaacatgattagctcacaggcagtgcaaaaccagtttgttaacacttgccctagggctttggaatccttacttccagccagaggctggagaaaggatcttgcatgggaagtttttttctaggccagcctgtaatcagtcaagcaccatcccattggccagaacacagtcacatgatcacagacagggtggagagggaataggttttggtgaacacatagcagtgtacccacagtctctaacacagtccaccctgttactttaaaaataaaattttgttattcattcatttattctttatcagttgatgccatttcttagccatgttcccttggtatttatcattacacgcacatgttcgtgaacatatccactttaagaccttgtctttaaactcggtacgtatgtataaagtgattatgatgaacataagaaatggcatcagttaataatgaatgaatggaattgtatttttaaagaaataccatgaactgtattagagattgtggctacagtgttgtgtgttcaacaaatctttctctaacctccacccacatggttgaaaacaaaggagacttcgaaccccagctcagtgtagcaccaatgcctcaatagcatccttggagcagagctcctcaaatgagaatgtgcatgtaattgtctggtaaatattaccagcacaatggggcctgagcttcagaatttttaatactggttatgctgatgttgctggactgtggaacacactttgagttgtaagaataagtgtactgagctaataagagaaaccacgtttcttcatctctgtaatcaccgatagttttgactgtaatagctgggaccccaggcagctgtctggattttggagaaaatgaggatataaagggaatgtgaactgaagctcaaagcttgggatagctatggattataataaattttaaagcaacaacttgcaaacaaatgggtattatgtatctgatgcagttcaggttttaaaaataaatcttacagccaaaaaaaaaaagaaccccctgtcattaatctaggttgacaaacatgaaagaaaagtttaggaaagaaaggaaacagagagatggggaagaggggtaaggtgagtgggtgggtggaggaatgtcttagattgactagagaaatgggttttgcttcatgggattttttcatatttccaggagagggcagccagtccccactctaaaaacaatgtaaacttttacatttgcatctaccattttcagaaagtattgtgatatacagtgattttttaaaaaacttacttctgtccattctattaaccataattggaagctcaatatatacgaagggcattaaactaagagtcaaacatctgaatttggaaggtcctttttcctagatcttagcaattctgtacctgcaggcaagttgatgaacatcctagattttttatatgtaaattagatgcagtaagactagatccgcctcctggaaggatggcagataattaatgaatattgtttgtgaaagccctgtatgaatatattaattcattcatctatccattcacttgttcagtcacacatttaagccttaacgtgttgcagtgctggatgtcgaaatacaaaatgaccgtcacacagattctgccttcaaacaacctattgctaactgaagaaaaatagtatgattatgctataattgaactgcaaagtgacagtctaataaggcttggtaggagcaccctctactgacaaccctgacctgctgtccttttctcccagtacttggcacttcactcattccattccagttacataggcctcccccagctgttcctcagactcaacaagttctctatgttttggggaatttgaatttcgttttcttgcctgaagtgtttttcccttagttatccacatggctcatgctcaaggatttttaaaaaaagatctctgctcccttgtacaattcttacagaggccactcagagtacattatctaaaatagcacctcagttactctctatttcaccctctctcagtctgcaaattaagatgtcattccctaaggcatccattgtatgcaatgaattaacttctctcgtatgtatcgagaatggtaatagctgtgcatcatccttgggaaaattgagaatatagtctgtcaaagtactttctgtgttctgtggtttagatgaagatagcaagttgagtccgtgttttactttgctttataacagttttcacttaccaaacacaatattatgaatatatttaatttgtttttctctcctttctcaccattagaacacaaactctaaaaaggtaggaaccatggtttgttcaatgttgtatctgtagcacctacaccaccatgtgccatctccagcttggcatattgtagggtaggcaatacacttttgttggatggatgagtgtgaatgacgaatgaatggatgaatgaatgttgagaatgcactcaagaggtaactcttgatctgggtcttgtaagatcagcagaattttccttggtagatggggatgggaaaggtattcagacacagtatggtttaatgccacagtcttgtaaacttgagagagccatatccaggtaaggcagtggctttctgaagtggcaaatccatacctattgtagttttcctgatttttgtccttctttggagagtattatacactgcatatacattgtattattcacaatatatttttgacagaaataagttgtatttcctgagcagacacctccacttgttgatggcctgtgtactaaggaaaatacagattttaacattagcctaaataccacataattagaaatttaatctactggggaaaatatcattaaattttcatactgcatatattactttgacttatcagagttattcttctcttattaataaaagaacaaggtgtcagtttactcactgattaaaataatcatattattccatttcaagagcctatgttttcaatagtgaaatgcatgtttaatgatctttagatccatgctactcaaagtatggtccccggaccagtgccaattcttagatagtccttgcaggtctgtaaggatatatgcaaatcaagcaagagtaaacatttagaaacttttatagaaatttggcaccataattttatatctattgaacctaatttttaaaactgggcttgtgtttcatgtgcttccctccacccctttttagtaatttattttatttttattacattttacaaaagtatgattctgcaatggattggaaacaaacaagcaaaccttgtctttcaatacaggtcatttgagaaacactgctctagagcatgattcgtgcactgcctttagtcccacaaagcctaaactatagggaacactgagaatttagcttggagtcgaactgaccttaaaccaggtgacagtgcctgttaatagtgctgatagctggcatttatcaagcacttactatgttccagacattacactaaagactcgagagatttcccttgcagcaagggcctgagaaaagtaaaagtagatgggggagagggagattgtgtgtgtgacatcagaagcacacacagatgtttcttgctctatccaacttctttcagggatagaaagtctagaatgacaaccactccactgacagttacactgatttgacatccattttcttttatttctgggttggttttagtaatgttttggtaatataagccattaagcttacacatgggtacaggaaaggctgagtttcgggttgtttgtttatgcatgcatggatgccttggagacctggtggagaacccaaaagcttaatagcggcctttgcttaaggaaacctggcctacttcacccaggggcaaagctattagtgtccagaatctgggccctgttgcataaagatcttgttgtaactggttcaattctaggagggctggggaaatatgttttttagaagccttgaaatttacaacctcattgtccattgtggtcttttcaaagcattcaaagaatctgcattgataacagtctgtggattaaaaggacaagcaacctttgctatagtttcctgcatttggaaaccctgtggaccctgctaggcaacccttttggtaaaaggtaggcagcgaaatgcaagaatcggtagaatctacacagcatctgggctaaatcagaagtatgccagaataaaaggggaatatataacatatgcccttggtaagctggacttcactagcagggcttcatctccctctgtgctgaaaggttagcaaatattttatctaaacgtgccacagaaaagcaccataggtattgtctattggtagaataaatagttcaatcaatagctcagtgtagtttaagttgaatttaataagactttggaagcagatggactaaaagaaacacagacacacacagaatttggggcccttgttctgtagcgattgctcataaaagaatgtgaatctttagactacgtttcctaaaaggaatccagccatacttatcgaaaattttaatggaatttataaaaactgaactgaaacttgtatccacaagtccttaagccttttgaccacctctgtgattaggcatattcagctaatgtaactaattgccagatttagcaaatcactcagttacatttgaatttcagaaaaacaaatatttttacagtatattccatgtggtatttataagtagatcccatgcaatgctttgaaaagaccataatgcaaaataaggttgaaaattccagggtttctaaaatcatgttttccccaacccatctagaaccatgcaatatttgggacatatttatgctaaaaatattcatttattatctgaaagtcaaatttaactgagtgacctgtattctgtctggcaaccctaatctagtgtcattgataaaaagatgtgggaacagataaaaaagatgcagcagacaattggttaattcttttttcttttcttttctttttattttttgagatggaatctcgctctgtcgcccaggctggagtgcagtggcacaatcttggctcactgcaacctccacctcccgggttcaagcaattctcctgcctcagccttccaagtagctggtactataggcgtgtgccaccacacccggctaatttttgtatttttaatagagacaaggtttcgccatgttgcccaggctggtctccaactcctgaccttgtgatccacccatctcagcctcccaaagtgctgggattacaagtgtgagccactgtgcctggcaacaattggttaattcgtatttgaaatctttatacatatatctcacttgaactttacaacactcatagaagaaggatatattaaaaagcttgttttacagatatggaaactcaggcttgaagaagttaagtcatttgtctaggttcaaacagctacttgagtcagagaggtaagattcaagatcaaatttaactctggagcctagacacttaaacatatcagtgtaatcttaagtgacatttaataatactttggaagcagatggactaaaagacacacacacacacacacacacacacacacacacacacacacacacactcctcatattagcaaagcatcattaggactaattctcctttagtgttttccaaccattatatcaatggtttctaaacttttaaattatggacacctctcctccattttaacctctcatagttagaattactaagcatggtaattttagttgtctgatataatataatgacagaaattagcaaattaatttgtcaatcaaaatgaattcatatataattttcacaacacaagtagcatctaacagcatatgaaagacagtaaaacataccttcagataaattatttattctagaaatgatgttgagtgtgcaaatagattggaggattcccttatataatttgaggctctcccactaccacctcaaagcagtcatgtcccacaagttgggaatctataaattagagaaattaaatcttagagatagacccaagatgaatgaaatttctttccctgaatgtagaaatgaacccaaaggaaaacaactactgaagctggggagaaatgcaaggtgaggggaggggagggtcagtgatttaattctcagccacagcaggtgcttctggtgtcctgcctgcttcagcctgaaggctttatactacaaacattggcaacttttgacttgatggctttctctgccacctctccctactcatgtacagctgacagtaggacagcagggaagtctggaagtggttacacctagaaagcaacacttaacacaaccagcttccttgccctttgagtgggatgactcagagtgaagctttacccaatctcccagaggcccccagaaggactaagtcccaggtgcccacagtagtcaccagctcattaatgcatttgaattggtcaccttcccttcctcgtctcactttcatcctttcccagtgcttcctgggatcttctcccaattaaactgcttgcatgcaaattcttatctcactctctgcttctgggagaactcaatgttaagaaatggactaaggaattttatatttttgaaccctgccataggtatcaataccagaaaagattagctctctgttacttttctgatcctcagtgccttgagaattagtccagccttttgaggataagcaggttggtgagcctggttaatatcagttcttcatggaggggcccatgtggttactaacaacatgggtaaatagagcctgacgtaaattaattatgcttacgtagattttttcctctgtaaattttggtcattataaataaagaattgataggtttttgtacacagtacatggtgaataactgctgtccttcagtgctccactcctagcatctttatttgggcattttctttggactgaactataaaatataaattagattaatttattggatgagaaagttgtgcaatgataaagcagaacaatgtattcactcagtcttatgccaggcagtatggggtagtaaaagcagaatttaaatgggagttgggagcctaatttctgcatggtgtgtaacacctctgagtcttattttccttatgaatcaaatgaactctaataatccattcaccaacaagtgtctatgatcttttccaccaataaaagtcccagtgtcaattgcagagttgaaaaggattgtagattatgggcagacttcaacatctcaagatttcctgctcaaccacccctggaaagagatcatgcatgcagtattgtgaatacctctgaagatgagtaagatgagtatatggtaagataggctcttcaggggacacttgacaatgtctggagacatttttggttgccaacaaccggagtcagggaagatgctagtggcattagtagatagggatgcctctaaacatcttacaatgcaggggtccccaatcctctggtcatggaccagtaccggtacatggcctgttaggaatcaggctgtacagcaggaaatgagtgatggacatatgagtgaaacttcatctgcatttacagcagctccccatcacttgtattaccgcttgagctctgcctcccatcaaatcagcagcggcattagattctcttaggagcatgaaccctattgtgaactgtgcatgcaggggagctaggtggcacatgccttatgagactctaatacctgatgatctgtcactgtctcccatcatccccagatgggaccatctacaagctcagggctcctactgattctacattacggtgagttgtataattattttattatatattacaatggaataatagaaataaggtgcacattaaatgtaatgcgcttgaatcatccagaaaccatcctcctcccctccggtccttggaaaaattgtcttctatgaaaccgctccctggtgccaagaaggttggggactgctgctatagtgcacagaacggtcccccaaagaccaagaattatccagtcccaaatgtcattggtgctaaggttagaataagacaacaaatagaccaaagcatccaatggctgaaagcaatagaaatttaatttttgcatccataacaatctagggtagttcaagctagaccagggtggggttgtgggagtgggcaggtagacccagctctgctctgtgagaggatatcaactgatggcatgattgtcactttcagtatattgtttccacagctataccaggctccctccatttcagccagctgaaatagggaaatggtatggaggaacatgtataggaggtttatctgggtaaaatccggcaataacacacacgtcttcctctcatgttccattgactagaaatcagtcaatgcaaggcaggctaggaaatacagtgtggactaatccattactcagaaagaggaggaaagaatattctgcctactagttagcaatctctgccctaatgtgcaactacatcacttcttttattataataataagagagataatagcttcaggttttgagtacttgtattttatgaatttgtatatattttgcgcatgttaactcaattttcccagtaccctaataagctacattctgttattagctccattttacattttaggaaaccaaggcatgaatggttaaataatttctctaaaatacacaataagtgtcagagcctgcttataaacccagactgtatgatgctaaaacctgagttctacccattataccgccattcctgttttctccttgagtaccgtggttgtttctactattgaacccaaatctgcctttccacaccctccccctccacttgctggttctacttttgttattggggagaaacaggacaatcttacttagcgttttcaatatagacaactagaggcataggtggaaatcaaggtaatggccatgggggctggaaagaaacaggcagatgtaagagatgcagactccataggagaattcaatggcctcgaatttttttctaaggtaactggaattctctaactgttaaagaaaattgattctcacattgattttgtatcctgagactttgctgaagttgcttatcagcttaaggagattttgggctgagacgatgggatattctagatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcactatgatattggctgtgggtttgtcataaatagctcttattattttgagatatgtcccatcaatacctaatttattgagagtttttagcatgaagggctgttgaattttgtcaaaggccttttctgcatctattgaaataatgatgtggtttttgtctttggttctgtttatatgctggattatatttattgatttgtgtatgttgaaccagccttgcatcccagggatgaagcccacttgatcatggtggagaagcttcttgatgtgctgctggattctgtttgccagtattttattgaggatttttgcatcgatgttcatcagggatattggtctaaaattctgttttttgttgtgtctctgcccggctttggtttcaggatgatgctggcctcataaaatgagttagggaggattccctgtttttctattgattggaatagtttcagaaggaatggtaccagctcctccttgtacctctggtagaattcggctgtgaatccatcttgtcctggactttttttggttggtaagctattaattattgcctcaatttcagagcctgttattggtctattcagagattcaacttctcatggattagtcttaggagggtgtatgtgcccaggaatttatccatttcttccagattttctagtttatttgcatagaggtgtttatagtattctctgatggtagtttgtatttctgtgggatcggtggtgatatcccctttatcattttttattgcgtctatttgattcttctctcttttcttctttattagtcttgctagcggtctatcgattttgttgatcttttcaaaaaaccagctcctggattcgttgattttttgaagggttttttgtgtctctatctccttcagttctgctctgatcttagttatttcttgccttctgctagcttttgaatgtgtttgctcttgcttctctagttcttttaattgtgacgttagggtgtcaattttagatctttcctgctttctcttgtgggcatttagtgctataaatttccctctacacactgctttaaatgtgtcccagagattccgctatgttgtgtctttgttctcgttggtttcaaagaacatctttatttctgccttcatttcgttatgtacccagtagtcattaaggagcagattgttcagtttccatgtagttgggcggttttgagtgagtttcttaatcctgagttctagtttgattgcaccttcagctgataagcaacttcagcaaagtctcaggatacaaaatcgacgtgcaaaaatcacaagcattcttatacaccaataacagagaaacagagagccaaatcatgagtgaactcccattcagaattgcttcaaagagaataaaatacctaggaatccaacttacaagggacgtgaaggacctcttcaaggagaaccacaaaccactgctcaatgaaataaaagaggatacaaagaaatggaagaacattccatgctcatgggtaggaagaatcaatatcatgaaaatggccatactgcccaaggtaatttatagatacagtgccatccccatcaagctaccaatgcctttcttcacagaattggaaaaaactactttaaagttcatatggaaccaaaaaagagcccacatcgctaagtcaatcctaagccaaaagaacaaagctggaggcatcacgctacctgacttcaaactacactataaggctacagtaaccaaaacagcatggtactgataccaaaacagagatacagaccaatggaacagaacagagccctcagaaataataccacacatctacaactatctgatctttgactaacctgacaaaaacaggaaatggggaaaggattcactattcaacaaatggtgctgggaaaactggctagccatttgtagaaagctgaaactgggtcccttccttacaccttataaaaaatcaattcaagatggatgaaagacttaaatgttagacctaaaaccataaaaaccctagaagaaaacctaggtaataccattcaggacataggcatgggcaaggacttcatgtctaaaacaccaaaagcaatggcaacagaagccaaaattgacaaatgggatctaattaaactaaagaacttctgcccagcaaaagaaaatactatcagagtgaacaggcaacctacagaatgggagaaaatttttgcaatctactcatctgacaaagggctaatatccagaatctacaaagaactcaaacaaatttacaagaaaaaaacaaccccatcaacaagtgggtgaaggatatgaacagacacttctcaaaagaagacatttatgcagtcaacagacacatgacaaaatgctcatcatcactggccatcagagaaatgcaaatcaaaactgcaatgagataccatctcacaccagttagaatggcgatcattcaaaagtcaggaaacaacaggtgctggagaggatgtggagaaataggaacacttttacaccgttgttgggactgtaaactagttcaaccactgtggaagtcagtgtggcgattcctcagggatctagaagtagaaataccatttaacccagccattgcattactgggtatatacccagaggattataaatcatgctgctataaagacacatgcatacgtatgtttattgtggcgctattctcaataggaaagacttggaaccaacccaaatgtccaacaatgatagactggattaagaaaatgtggcacatatacaccatggaatactatgcagtcataaaaactgatgagttcatgtcctttgtagggacatggatgaagctggaaaccatcattctcagcaaactatcgcaaggacaaaaaaccaaacactgcgtgttctcactcataggtcgaaattgaacaatgagaacacttggacacaggaaggggaacatcacacactggggcctgttgtggggtgggggaagggggagggatagcattaggagatatacctaatgttaaatgacaagttactgggtgcagcacaccaacatggcacatgtatacatatgtaacaaacctgcacattgtgcacatgtaccctagaacttaaagtaatatatatatatatatatatatatatatatatatatatatatatataaaatcaattctctaactgttaaagaacattggccctttgtcagatgagaaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtgtaaggtgtaaggaaggggtccagtttcagctttctacatatggctagccagttttcccagcaccatttattaaatagggaatcctttccccattgcttgtttttctcaggtttgtcaaagatcagatagttgtaggtaagcagtgttatttctgagggctctgttctgttccattgatctatatctctgttttggtaccagtaccatgctgttttggttactgtagccttgtagtatagtttgaagttaggtagtgtgatgcctccagctttgttcttttggcttaggattgacttggccagaatctacaatgaactcaatcaaatttacaagaaaaaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccactatgagatatcatctcacaccagttagaatggcagtcattaaaaagtcaggaaacaacaggtgctggggaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaatgatagactggattaagaaaatgtggcacatatacaccatggtatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaggggaatatcacactctggggactgtggtggggtcgggggaggggggagggatagcattaggagatatacctaatgctagatgaaaagttagtgggtgcagcgcaccagcatggcacatgtatacatatgtaactaacctgcacaatgtgcacatgtaccctaaaacttaaagtataatttaaaaaaaaaaaaaagtgcactgttgcaagggaggccttgaggaagagatttttttgaggggagaaagcaaagaaacatcccttagttggaaggcactgttactctgatggagtagacatgtgcctttccaatacttaaattctgaccaagaaagacagtaggtcaaaaaaaaaaaaaaaaaagaaaaaaaaaagaaaattgggccaggcacagtggctcatgcctgtaattccagtactttgggaggccaaggcaggaaaatcgcttgaagccaggagtttgagaccagcctgggcaacatagaagaccccatctctacgaaaaacaattgaaaataatagccaagtgtggtggtatgcatctgtagtcacagctactcgagaggctgaggcgggaagatcatgtgatcccaggagttcaaggctgcagtgagctataatcataccactgcactccagcctgggtgatagaccaagaccctgtcaaggaaaagaaaagaaagaaaagaaaattgaagacaggaggacaaactgattttggttgtggatgagtgcgtgggtaaggaagatactgataatttcaggttttaaaatgttaggttaaggtatttggggctgggatgttgcatgattattttatttttaattttttaaagtttttatttttattttaaattccggggtacatgtgcggatgtgcaggtttgttacataggtaaacgtgtgccatggtggtttgctgtacctatcaacccatcatctaggtattaagcccaggatgcgttagttatttatcctgatgctctccctcccccaaccccaccacctgacaggccccagtgtgtgttgttcccctccctgtgtccacgtgttctcattgttcagctcctacttataagtgagaacatacagtgtttggttttctgttgctgtgttagtttgctgtggatagtgacttccagctccagttccatccatgtgcctgcaaaggacatgatccatttatcacaaacctacagccaatatcatactgcttgatgattttaaaccaaacacataggattaaagttcaggagagagatgagggctaaagataaccattttaacattctcttaatagacatgacagttgaacctatggaagtggaaaggattcatgatagagaacagtgtgcacgagaagataagattaaaagcagaaattagtaatgccagttgttttattggctctgattcctcacctaccctcgcatccacacccttgtagaatttgaagttccatgcacaaaaaggggagagtacgtaatacgctgccccctgatgtttagatctttgacttgctttggccaatagataaggcagtagtgacagtgtgccagttcctagcctaagcttaagatattttgcatgtgtctgtttgttgtcttgagcctctgccaagaaggtcatgcctgggctaaccaacttgtcttgggtaaaggatgaatgacatgtgaagcagagcccagcctacattagccagcctcagtctacctagacactcatgagctacatcaatgcctcttgtcatattgttatgggcctctgagatttcattatttttgtgattgttattattgttatgcagcatggattttgagttctggagagaggctcgcggatagatatagaagattattttccaagaaacagtagcggaagctgtgaaagtgaataggggccttgaaggagaatacaacctgagaatgcctacatttacagttttggaggaagtgtggagatgacagagaaggaggctggagtctagaaggagaagacagggttagcacagcctttagatttggaaaaatatttgcataatcatatctttaccatttactagcaatgtgaccttgagcaaaatatgttttaaaaacatacaaaatatgtttcaaaagaaatatcaataaaactgaaacattaaactcccaagtcctcagttttttcatctgcaaaatggaggaatgaggacctatgttgagtattgctacaacgagtaagtaaacttatcacggtatgtgttaaatctaatagaatgcacagtaaatgttagctattctctaagaaactcaatagttatgatagctaaaatgttgcatacatacttggtgagatattgaaaatatatttttagaagaaaaaggatgcatctcaaaagagaagaacaaaatgaaaccaaaggctggggagagggaggaattgggagttgtttaatgggaatagagtttcagtttaggaagatgaaaaagttctggagatagacgatgatgatggttgcacaacaatgtggaagtacttaacgctactgaactgtacacttaaaaatggttaaaatggcaaattttatattatgtatatgttaccacaataaaagaaataaaagagaaaacatttgaatgaaaggaaacttacaaaatgtaattttaaaaaatacttagtaactaacttttcgactgacaagtattagatcagagatataataagtgctcaatcgctgtttttgtaaataaaaacatggtagcagagagagttcccccagaaacaaggttaggagtagccacagtagattgacaggagaccttgatggcctatctctactcatagccaattaactttaataggaaaattgttgattttcatttgggatatcacgtttgggggtgaaacacccctggggggtggtctggcaatgcagaggttcatgggggcttttgactccattttagtaatttagtcttcactttttgttttagaaataccaataacatttcataaatcatgtgaggttttgagataaagctcaactaaattttagggaatgttttgtgcaaattgtttactgtttctgaaaaggacatttctttcattactaatttgtatgaatcattttgtaataaacaagatgagtttgtgcccacgacaatgacacatctagttcttttaataaaaaatatgttttagaagaaaaataaataaaaatgaaacattaaggaggcagatgtccaaaaacatattttaaatggtataaatttccatggcctataggtttttagccaagcgcagaaatttggccaagattattgagggaaagctttggttgttaaaaaagggggaggtatagttatgtgctccagtaagtatataatgtatagctgctactcaaactgataattttgatgaaaccaaaataatgttccctaacatgacactgtgattgacacagagcctagggaatgattgcttcaggacgcaacttttccttcttgataaatgtattaggaaaatgtttaggaatgatttcacaaacttatgtgtaccttagtgacttatatacttttactttccaagaaagttcttccttctgcatgaaacacatatcctgcttttaaggaaattatactagaactgggaaaagtcaacagagagcaatgtaagacaatctatcttggatggcatggctaccaccattctacttcaggtccatgacagacattactaattgatcacaacatactgttgctgagcctgtgtacaccctcgctttttcaacgttgtgctccaagcagccattgtcagttatggtttttctgtgagatggaacccatttttcatcccgtattagaccatatggctatgagaatttacagataggagaaaccagtgagggtggaattcaaagcctcatgggaatggatagtaggatcaagcacacagaagtaaaatgtgtggatgagtgtgtgtgtgtgtgtgtgtgtgtgtgtgtgtgtgcaatgcatagacaaaggtgaagagggcaatattagggagattcagttgatttgttgtacagtaattatcaagaactttggaaagtaaaagtgggtcaaatcaagaagatactgaaaatcacatagaggactttaagtttccaattattcaaatagagaattgtttgataactagacgagtgaagcctgtgcataccaaatagatgagaaatgggatatagtaggcataagaggccattgggtctcaaatggaggcaatttgtcttctcaggggacatttggcaacatctgaagagattttggttgtcacagctggcagggtgttgggaacggtggggtggtgcggttctgctgatgccacggccagggatactgctgaacatcctatgttcaggataggatatcccgagaggatattcccccacgacaatgaattatccaggccaaaatatgagtagtggtaaattgagcaattctgctataggctaattgctgtaatctgtaaccccaaatctcagtgatttaatacaacaaaatccatcttgctcatgaaaagacaaaagcaagtattttaggtgaggtagaaattctgggagttctccttcaagaagtcactcaggaattcaggcactttccgttatgtaaaaccactttttttttttttttttttttttttttgagacagggtttcacttcgtcacccaggctagagtacaatggcaaaatcttagctcactgcaacctccacttcctgggctcaagcaattctcctgcctcagcctcctgagtagctgggactacaggcatgtgtcaccacccctggctattttttgtatttttagtagagatggggttttgccatgttgcccaggctggtcttgaactcctgagctcaagtgattcgcccttcttggcctcccaaaatgctgggattatgggtgtaagccatgatgcctggcctaagccactgtctttaatatgtagctaccaaggtaggcatggaaagtgaaggagagtgtgttcatagagaagtcgtccttgctcttacctgccttggaccagaagtgacctatcaatacactcacattcctttggaaagaatttgtcgcatggttccacctagatgcaaggtgcctaggaaatgtggtttatctctgtgcccaaagataaaaagaactgggtctcatacgtttcagtctctcccatactgggagagactggacaaataactcagctagaaaactattacggattcagtgccaagttgtaagcacctgggcaagtgatggcataaggacagagggcttagcaagagactccatttaacaggtaaaacagtgcaagtgtccaaagtaagtcaacaatggcaagtcttggatgttacgccttccaactaactataatctctgtaaacgtggtcttgagtcttgctgctctttgaagtctcaacttgcttgggcacaggtttatgacccacagtccatgcaagaaagtatggatatatagaaataaagtaggaaagaacaaaatcttgtgggtttttttgttggtggtggtttgtttttgctggggggtcctggaggagggaatgattacttaagatttcgaacatgatgagttttcagtaatggtagaatattctaagagctgggccctaaaccattagataagagggcagtattgcagatgtagttttggaggcaatcatcagttgagtggatttcactactatatccctggagtccagttcagagcctgacatggaatatatggttaataacattttgttaaatgcatagatcaacaggtatttgactaacataaataagggaaatgatacttttccctttcattaaaatgaaaataaacctgatgcttatatatctttgtttcagttagctattgatgtgtaacaaaccatcccaaacctcagaggcttcaaacaatagacattgattatttgccatgtatttatgaatcagccagatgatctgtctggtcttggctgggctttcttatgcatgtgcagtcagctgtaggtcatggagaaggctctgctgatcttggctacctctttcatatgtttggaagtcagcaggtctagggtggtcatgcctgagaaaactgggttcttttccatatggtttctaatcttccatcagattctcctgggtttttcttatggtgtggcaaggatctatgagagaaagtggaaacactcaagatctcttaagatctaggctcaaaactgaagtaccatctcttatgccaccagatgttaactaaagcaacacacaaggcctgctcagattcataggtggagaaatagacccaactcttgatgagagtaggtgcaaagtcacatttcaaaggttgtatatatggagaaactgttaataggctccatcagtaagataaactcaccacagtctgggaggaggttgctacatagtgtggaaagagagaacactaagcttgatttattcacttctgagcatcctgatctccatggtaattaatgagatttctaaaataatttccaggttatgtttttattactcttgatcagtgaagaattaatttgaaaggcctaaggtttaccctgcactttaaaagtaaatagctatcacacaaaactaatctccttataggttaaatcctgtcacaacttgccccaaatgtatcctatccattttcatgtcatggtgcataaagaaaacgcgtggtggctcacacctgtaatcccagcactttgggaggccaaggcggacagatcacaaggtcaggagatcaagaccatcctggctaacacggtgaaaccctgtctctactaaaaatacaaaaaattagccaggtgtggtggcaggcacctgtagtcccagctactcaggaggctgaggcaggagaatggtgtgaacccgggaggcagagcttgcagtgagctgagatcatgccactggactccagcctgggtgacagagcgagactctgtctcaaaaaaaaaatcataattttgtggcacgctagagtaaaaggacaaggctgcttgtgattatggggctctgacttccccaggtctgtttcacctggctggttcaagggatgagttgattaccacctccacacacctgtaacccaccagcagagtgagccaggtaggatgttctgcaatggaccaaaatatcaatgggtccagggaatcctatgacttagttgcaggatcaggcatagaggccaggtctctagaccttcagtcccatgccttctttatggaacgatgttgtcttcagagatatgtctttaatcagcacatgtttctcagttatctgctgttagccttgaaatgtgcaagacacctgaggggaatgtatacactgtacaaggcatggccactgtcctcccaggggttaggaaagaaactctcgtacacccattttgatttcctctctgggtgcagtatcaatcggtataaagtctaatgcaaggtaaggaggcaagtgccatttcttctggagtagcaagcattgcaaaaatgtctccttcctctattttaatcactgtatttggatgcaaaataatccagcatagcacaggaaatataatcaatttactcaagaatccctggcaatatgatacaatagcaggcttgtataacccattcaggaaccatagatcctctgattcttctacgtttgtgtcattttaattatgctcatttcctgtaatgcaattactaataattatttgccgctctattgtaggggaaaatcacttacatattgctgcatagtaaaccacttcaaaacttggtggctttaaggagaatcaaaaagctctttttggaaagagctaggtagtaaatattttcaggtttgcaggtcatatgttctctgtcccaactactcaactctgcttgtagggctaaagcagccataagcaatacataaataagaatggctgtgttttaataaaactttatgtatagatgctgtgatttgaatttcataaaattttttaggtgccacaaaatcttcttctgatgtgttttctacccttaaaaaatgtcagatccttgaatggtttgctgatagaagctggatttggctcgaaggccttaattttccatctcctggcttaaaacggccatcactatcactccgtagtcttcagattggttgggagtgcacaatgcaagcttgggcttttttactctgattcaggttctagatccatgtgaccttggattcttaccaaaatgggaataacttttatccttgtgtattcattctgggacccaggatgggtggcagcagcttttttcatagctgtgacacggaaaagagtacaagctcaatcatccaagtgcatctgtggcctcaagctggctaccatgtcattggccattccatactatcgcatggccaaatccaaaatcagcaggcaggaaaatatcctctttagtgatagaaactacatagggtatgaattcagggagccatgaagaattggggccactggtgccgcctatcacactcaccttcccttttctttattgaaaaatataatgatctccttatttttcctccaactttcttctagacagaaaagaagggcatatataatctattttagattatttctggaggggataacttcctatgagtacttctcttagtcatctgcaggaaaatgctgtttataattttgccctgatccgatatctgtcatgcaggaaagtacacattacatatctttggacattccacagcttaatctgatacaccaaaggtcaactgaatgttttccttgagagaattttgaaacaccaactgctatctctgaattttctttgtttggcatctaaaggtatccctgttaccctagaggtcctctcattctgaacacagggaggtgagaggagttattcctggaagtggggcctatgaaaccactggaccttttcctgacaattgctatacccacgtcactgagcgaggactgtttaacctagcttttcttgcctttagccacattccttccactcaccatttgttgatgcaacttttaacacaggacaaagtgtcttatgtttttctaaccatctttgctttctggattttcttttctgataaccttctggattttagacttacgatttcaaattcctgaatggaacatttctcaaaacaaaaaccactttttaaaaatatgtaccctgaatttaaaaagtaatagtgaacagaatgtagcaaaatatcagggaggactgagaatgtgaaggtccacctgataggctaggagggtcacttagcttggcagagcctcagtgtttgcatatgaaaagaaaagtcactcccaacttggaaataatttgattctgaggttccacaaaatgcatatattcagaattctgtgtagaatttgaggtacaacttaaagaagacatctctgtcttctatatataggctgtatattgggccccaaacattatttttcagctccctagctatcccccttcttttctacttccaccccttcctggtcctaggtacagaaatctcaaattttattttgtttagctgaataatattagttgtggagatgctcttaaatatatgatgaatggcaaataaagaatttgggggagtttccccagtatgatgaactctgttaactgtcattgtagggatgagatattttgatcaaaagatcttctcatgggattatgatcaacactgtaagtagatcgatcacttgtttgcagaggtttagaatcaatagcataacttagtacccaaactcagatgggtataatttgaagttttccttaatgattccaatatcaaggttatcactatgttggtgagggatggtaaataaagaaacctaaatgataaaatgccaaatggccaaatggtgactaacttaccatatagatcgcatgtgtgatgcgtgatatgtgtgtgtgtgtgtgtgtgtgtgtgtgtagtatgagttggctcaggcatgaggcacattttggaatttcatcagcatttgaagtagtgaagagacgaggaagctgagattcgaaaggggtggggctgaggaagtgatggttgaagggatatctttgactccagagactatgccaagcacaggaggcatacagtggaagactggagaggtgagcatattgcagaaggactccagtccttgggtgggtccaaaggcagctggagtcagtccttgggagcaatgaaattgtcaggctaggaataccccagccaagttgactggtatgcagcttagaaggaaatggaaagacggacttagtggcatggagttaggagttggggttacagtcggggtcagggcaagcctgcatctctgaaactacagctatttcttttctccctagggttgccaggtaaaatacaggctgctcaggtgaatttgaatttcagataaataatgaataatattgccagtatgaatctgtcccaaatatagcatgggacatacttatgttaaaaattagccaggtgatgtggctcactcctgtaatcccagctacttgggaggctgaggtgggaggatcacttgagcccaggagttcaaggttgcagtgagctatgatcgcaccattgtatcatagcaacagagcaagactccgactcttaaaaaaatactcattttttatgtaaaattcaaatttagctggatgtcctgtaccttatttactaaatctggcaaccatacctacccacatccatgctaggtaaacaccctgtacttttctttccttgtacctttccattatttgggtgatttcttcatttaataattgtctccctcttgagaaaccaagttccacgagggtgttttgactttcagcatactttgtgcaaaaacataggtgaggctcaagaaatatgtgttgaatgagtgcatactactttattagcagtgggactataagtaccactagaagtctctctgaggctgctggccaaagttctactctataataagggctttaggattttgtcagtagaggcaactgcaaggagctgggggcaaagtgggggattgacagtcccataacttcatcattattctcatatttaaatacacatgtctgcctgggggcacaattgcctctgtggaaatccacagccctagatggaaaatcagatggcttgccctgtcattaattggcacaatggctttaggaaggttcctcaacctttagaagcctcagtttctttctacaaaataggagtgaatctcctgactcatgggcactcacaaggattgagaactcatgaggtgaaagtgtgtattggaaataattatgctgtttttttaagaagatacaaatgtacactttatgccgcagaaacagtagaggcccctgagataaatttccctgtcacctgagcaaatatcccttgttttaaagacacggagactgagatgtggaatctttcttattcaagcacaccctcagtcactgttcaaaagctgtgctgccatgtccatcccaagtgtcactggaaggtcacatcctggagagtgtagggaaaggagtccccctgcaaagagccaataaccgcccttatttctgaagggtcacagagtcacaaacctctagatatttcttaggaattcctctccccttcagaatgaggctttaatgactcaactttctctactgaataatcagtaggggttcaagagtatattaatagatcaggctcaattaaacaaacatttctggagtcctacaaggctctgtgcttagggaaaacagtggagaaaataaagatgattaagacactatgtactatgaaaaaatgctcaccatcactggtcattagagaaatgcaaatcaaaaccgcaatgagataccacctcatgccagttagaatggcaatcattaaaaagtcaggaaataacatgctggagaggatgtggagaaatagggacactttcacactgtcggtgggactgtaaactagttcaaccattgtggaagacagtgtggcgattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactagataaagaaatgtggcacatatacactatggaatattatgcagccatataaaaggatgagttcatgtcctttgcagggacataggtgaagctggaatccatcattctgagcaaactatcgcaagaacagaaaaccaaacaccacatgttgtcactcataagtgggagttgaacaatgagaacacatggacaaagggaggggaacatcacataccggggcctgtcgtggggtggggggctaggggacggataacattaggagaaatacctaatgtaggtgataggttgatgggtgcggcaaaccaccatggtacgtgtatacctatgtaacaaaactgcacgttctgcacatgtaccctagaacttaaagtatatataaaaaaggagactatgtactgtcttaggaagaaaaagcccccactcagataatgctaatgtaagagcaagacaaaggctgaagagaagaagcaaacgcttctgactgagagttggggagaatcgtgggagacttcagggaggagggtcttgtaggttgcatagaattgatgtaatccccgttcaagctcttctgtgttctttttttaacttttattttaggttcaggggtacatgtgcaggtttgctatataggtaaactcttgttatagcggtttgttgtacagactattccatcacccaggtaataagcatagtacctgctagttatttttttctgctcctataccctccatcctcaagtaggccccaatgtctgttctcttctttgtctccatgagttctcatcatttggctctcacttataagtgagaacatgtggtatttggttttctgttactgcattagtttgctaagaataatggcctccagcttcatccatgtcccggcaaaggacatgacctcattctttttgtgtctgcatagtattccatggtgtatatgtaccacactttctttatccaatatgtcattgatgggcatttaggttgattccatgtctttgttattgtgactagtgctgcagtgaacattcacgtgcatgggtctttatggtagaattatttatattcctctgggtatatacacagtaataggatttctgggttgaacgttggttctgtttttagctcttggaggaattgccacactgctgtccacaatggttgaactaatttacactcctgccaatagtgtataagcattcctttttctccacaacctcaccagcatcttggtattttttgtctttttaatagtagccattctgactgatgtgcgatggtatctcattgtggttttgatttgcgtttctctacttatcagtgatattgaagttcttctgtgttataacactcaataatagtatgaaacctcaagttcacgaatctgtgccatttacatgtttgactaacccaagcataaaacaaggggaacacaacctgcctaggctgccacagagagccaaacgggagctcataggtgaaagcgtaatgcactatactggtgggaggttggtcttatttactggcttgtcatctgcctagtttggactctgttgcgccttccttcattatgttggtctttacggggaaaatttcagggaagctcccaagtttgctcaagaaaagccacccagactttacagtcattttttactttgaaaaaaacaaatccaatcatcttccagatgttttcatttaccaggtctaaggaggagaagtacaaaaaggaagacatgctaacttttgggtttactcttcccattaaaacttctccaatgtgacattgaaatatctttctagcattgttggtggctgttaaccatttttgttcattttctccccatgtgtttacctccaggaaaggcatgaaaccaccattgtccattccctgactttaactgtgtgtctcttcagtctcagtcttctggctcagtaagccagtgggtgtgtatgtgttttcctcattcagctaaagacctgcttatttgcacttaatgtgagtaaagatatagttggggttttaatcaataattttcattgcatcttctttaatagctttttggtgaacaagtttagatatgagggtttaaaagggttctacaatatttatttatatagttaagagacggattcttaacgggggtaattttatccaccagagggcatttggcaagatctggagacatttctgactgttacaactggggagtggtgttggtgacactgctggcacctggggggaagaggtcagggatattgctaaacatgttacaatgtgcagcacagcctgacaacaacaaattatctagtctaaaatgtcaatagtacagaggtggaaaaaccctaatttaagatatgtactctacctgctttccaaggaagcttaacaaattaaacataataacaaaaagtaattacaaataaaagtagaactgaaacagaatagaaggagcagaagcaaggatgtcactggagtcctgaaatgacttaatcattagggttgaatatttgattgagttctgtatttcccaacaaatgagaaaaaaagaaacagttcttgggtagcccccccccaaaaaaaattgatacataactccatcagccaagaccacttttttttcctgccattgattttaaagagaaatatatcttgtagggcattatatgtgggacattgtataagaaaatagataatttttcaaccacggttttgcaaaagacacagatgtgtgtgtgcatgtgtttgtgtgtgtgtatgtgtgtctctttgtgtgtgtgtgtgtgtgtgcaaatggatatttctggtctaaattctctactaaaacggtagcagacagtataacattaggttttgtgagatgaaattcatttctttgagttgcagaactaatacattctgggtattgtctttgcttgtgatcaaatgaataaagagtcgtgtctctgaagatccgagagagagaaagaacgtttccatcgaactttgggaatctctccctggattatcaaatgactgcaacgagtctttggcaagggctaaagagtaatcaattcatggtagcattttccagtgatcatccaaagtgtttgaaatcatttgatagtgtttattcctagtctgctgtggatcagtctatttgttaggctttggggacaaaaagattattaaaatgtagtccctgttttcaagtagcaggagtctaaccctggcaagaacatatataaataatcatgaattaatacacacagtcgaggaatgtgcagtgtgccatgggaacccaatggaagaagcgaagtttcactgaggaaacaggagatttgaactgtgtgggttattgaagaagtcttcacaagtcttatttgtaaatacagctgatccttgaacaatgaggggttaggggttcctaccctctctgcaatataaaatctgcatatggctgggcacggtggctcacacctgtaatctcagcactttgggaggctgaggtgggtagattgcttgaggtcaggcgttcaacaccagcctggccaatatggtgaaaccccgtctctactaaaaatgcaaaaattagccagacgtggtggcgcacgtctgtaatcccagctacttgggaggctgaggcaagagaatcgcttgcaatctggaggtgaaggttgcagtgagtcaagactgcgtcactgcactccagcctgggtgacagagcaagactccatctgaaaagaaaagaaaagaaaaaaaagaaaatctgcatataacttctgactccccaaaaacttaactactaatagcctactgttgaccagaggccttgcagataacataaacagttgattaacatgtattttgtatgttatatgaattataccctgtattcttccaataaagtaagctagagaaaagaaaatgctattaagaaaatcataagaataaaatatatttagtattcattaagtagaagcagatcatcataaaggttatcatcctcatgtcttcttgttgagtgggctgaggaaaaggaggtcgaggaggggttggtcttgctgtctcagaggtggcaaaggcaggagaaaatcagcatataaattgacttgcatatttcaaatgcatgttgttagagtcaactgtattttataaatgtatgaaatgggtgcagaaaagtatacaaatcataatacacacctcactttgttttcacaaagtggactcacccatgtgactatcatcagatcaagaaataaagcatcatgagaaatagaactccagaaacttctcaggcctccttttccaggcattatctgcccctgtctgccaaaggtaatcattatcccaacttgtaactccatagattaattttgcattttatacaaatgtaatcacatgttatatattactttgtgtctggctttaacatttttgtgacgttcagattgtcacatgtagttgtaattaatgtacttttcattgccatgtagtattccattgtatgaatatacaacagtttattccattgatgaacatatgagttatttccaggttttggctattgcaactcatgcattgttgtacatgtttttaaataaacacacttgtgtattgcatgtgtctatacctggaaatgaaattgctgaggcttcatttgtatataaacacacacacatgtgcacacacacacacagttgatctttcaacaacacaagtttgaactgtgtgggtccacttgtatgtagattttcttctgcctctgccaccctcgagacagcaaaacccaaccctcctcttcctgctccttctctacctactcaacataaagatgatgaggatgaagacctttatgactatccactcctacttaatgaatagtaaatatattttctcttccttatgattttcttaataatattacttttttctagcctactttattgtaagaatacggtatataatacatgacatacaaactaagtgttaatcgactgtttatgctgttgataaggcttctggtcaatagcaggccattaaaagtaaagtttttggggagtcaaaaagttatacacagatttttgactgcatgggagtttggcgcccctactcctctcatgttgttcaaatgtcagttgtaatttagttttagttttccaacctgcttgtacaaatttattctaaccaacaatgtattagagcaggaactggcaaactatggctagaagacctgttttgttttgtaagatcacagctcactgtagcctcaaactcctgggttcaagtgatcctcctacctcagcctcccaagtggctaggactaccggtgtgcaccatcacacccaggtaattctgtaactttttgcagagttgggatcttgctatgagagaagggtggtctcaatttcctggtgtgaagcaatcctcccttctcagcttcccaaagtgctgggattacaggggtgagtcactgtgccagcttgtaagtaaagttttattggaacataatctcagtttctttttaatgtattgtctatgtcagttttcctgtggcaagggcagagttgagtagttgtgaaagcaactgtatggcccacaaagccaaacatatttactatctggccctttacagaactaatttgccaacctctatattagagttatgagggtttcaaaaccttgccaacaaccacgctgttgactgtttcatgtcagctcttctagtgtgtgttctggtgggtgtttcatgaatcatgttatggcattaatgtccatgatcctattgaaatcttcatatacattataaatagagcttacaagagagagttgtcattatggttaaatgctgagctccacttgagattctataaccttcccccccaaaagacttgatttattttatatgatttttctaaagtgtatactagtaatttcattttgaaaaaaaggtttctctttgcttcttctttttttttttttttttttttgacagagtctggctctgtttcccggggtacagtgcagtggtgccatctcggctcggctaactaaaacattcacctcctaggttcaagcaattctcctgccttagcctcctgagtagctgggatttcaggcatgcatcaccatgcttgggtaatttttgtatttttagcagagacggggtttcaccatgttggccaggctggtcttgaactcctgacctcaagtgatccacccacctcggcctcacaaagtgctgggattacagcgtgagtcaccgcacctggccttctctttgcttccgaaacttaagttgtgggatttagtgaaaaattattaaaatgtactttggaaaagggtattttattctcagtggagtacagcttagtaggcaagtcaataaggagagggaacccccatggatgaagcaggtagatgaccaagtgacttgggaagtaccttccaaagaaaggaagggtccataaatatttattgatagaatgaaaagaagaaacagtggttcaggtggctcaatgccctttcaagtactttcattttataaaatcacagaaaagtttctacatgtgactaaacaattttctcccttcttcagatatcctcctaaagactctgttagaaaatagtattactcttccagtaagaaaattatgcaaataaaaaaacccacgagacctaggtatctgaatcagtctttgagaagaaagctgatgtgcacactcattaaactgcagaatatggctcagtaagtctttctgtctcaagattgtttccagctgaagtcacacttggcaaatctgaatgcctcagaatgtaaagatggcccttgtccaggggcagacctccatgccgctgcttcctcttcccatttgcatccagcagtgcctgggagaggcaaggatcagagtcccttcaggcagtaaggatgaaatagatgaaaaatgagaacattaacactgggaaccagaagtcagggaacctagagcccaagatagcaaaaagatgtgagaaaacagtcgttatataaacacctaaaagttggagaaacctttgctctttggagaggaattactgcaagaagactattgagaggatctttaagtcctggaggccccagaggggaatggagagggagaatgaggagacaccattttgtttaagaaagcaaaggagtggagaaatacaggactactattttgaagataaacaaattaatagaaaaaaagtcctacagtgtgtttagaaggggaaaaaaaactgcttgcctgaagttgagaaaacatttccataaatgtaaacttcacaaatatcttcacatcaagcacatgactgactaaagatgaatgactcccaattccgcaataaacattagggttcatctacacacacaagtcagcttgactcaatgtattagaaggagaaaaggtcaagtcaatgaaacaaccagtccttagagtgccaagtacctgatttgcctgcatgttttcgttttcacttgttttggcattcttagacatagccagaaaatattacaacagaaacatctcattccaggatgttattttagttagtgggacagggaaggggagaagtgctttcctagatataacttagttgataggtaccctggttcttaaaatctgtattggaagttaccagagaccctgaccaaatgcagcatagtatgttcatgccaaaatgcctcctcataaatatgtacaattatatgtcaaataagcaaaagaaaaaatgaaataaattgcttccagatattgctcttttaccaaatggtttcaaaacatggacaggattattgaggtcacctcttctacctgtgtataattgttttatttcaacaacaacaaaaaagtatttgagaattgggacattattttatttttttttaaattccctttgcccacagatgcttcgatatactcaaactttggtttactttttactatttactctgtgaggtaaatgttaccccactttgattaaaataagaccaaagttcaggaggctgaaatgagtagcctaagatcttatggtagggagggcacagacaggttttcctactctgacacccccactggactgagcacatagtgggccctttatcaatgtcttttgaaggagtgactgactgaatgcacagatggtgagagtggaatgaggtggagctgagtttgtgatatagatactcctccttctttagtcatctggcaacaggcacagataaatttttggagttaacgaaagtgaaagaaaatgagagtatgtatgaagttctcatccattgcatgtaaacatgaaagcctataaattgtaccacctctatggagagcaatatagtggtgtctattaaggtggaagattccaggctcttgaatcatcagcttcacttctaaatacatactctagggaaattctcatatacgtgcatgagactgttcattgcaacattatttgttatgggaaaaaatcagaaagaacatacccttatgagaatagataaattaattatgggataatatttcagtaaaaataagtgaaatgggccaatatgtgtcaacatggataaatctcaaattttggcaaaatataatttatatattgaaattcaatcaaattcaagcttacagcaacaataatgatatgctgacttatattctagtatcctattctgattgcaagataaagaggtggcagccaattgtgcacaactttggggattatacccgcatggaagaatgtcgtgtatgtgagcatcattgtttggtgtgttaaagtgaaaaaaggaaggttgagaaccattactctagagttttgttgttcaagtagtgatcaattaggaagaaaaattttcatgaactctgtcttagctcaggctgctataacaaaataccacggactgggtggcttaaacaatgggaatttatttctcatagttctggagactggaaaatccaaaatcaaggtgctgacagattcagttcctggtgaggcctctttacctggattgcaaatggaccctttcttattgtgtcctcacatggcagagagagagagagagagagagagagagagaaggagggagggggaagggggtgggaggagggaggcacactctggtctttctcttctcataagagtactaatcccatcatggggtcccaccttcaagacctcatctggacctaattatcttccaaagaccttgccttcacattccattacattgggggttagggcttcaacatatgaattttagggggatacattcagtccataacagattcccagtgttgacttactctaattttactgaaatagggctatagttatttatgtaagactatgaataaacttcttatgttcagaaatcttatctatataatccaactaagttatttgtatcacacaaacatggctggatgtattgcattagaaatttatgtttctgatgatcttacttaaaatacaggcttcgtagcatacagtaaattcactttgatggccctcagggaaccacaaaaagttaagtcctcctcctccacagcagttgaagccaaagcagaagaaagaagatctggtgatcactaaaccaataaaagatgtatccatagcagagaaaataaacagaatttcaaatatgggccccaaaagaaagtcaccaaaatagtcaccacaacttgtagggctgatgtgtgatacagcttcccactaagcagctctttggtgctacaaaataaggggcaggaggatttatgtattttatggataatgattctctgggatattcctctattgcattgaaaccacctactactaaatctattaatcaaaacaaatactttatatgtaacaatcagtaagtttcacagtagtaatattaatttaatttgacagatgatttggctttgttaaaatccagtgatggatgtatggttaaaaaaaatgaagacttgggtccaactccatgctttgatttcaataacacaaatgtagaaaatgtctgtctgtataagaatgctttaaaatgttacaaataagcacaataattctttttttttctagttcaaaataatctgaatacatttaactgaaatgaatcactctcaaatgtcaactgtaatgaggaacacttgataattttgtgaatgtccctcatttatttgaatataaagataacacacagctttttttagaatcttatagtagcagatatataagataataaattttgtaataagcagtagctcattcttgtgctaataaaatattacaagcacaaaaagataggatatacacaagaaatcttcctgtgtatcagctaggctacttttggctgcactaacagagtacatgattgaaagttgcttaaatagtaagaacattttttatctcacataagcatggcattagatattactgtgtaacaaattatcactaacttagtggcttaagacaatacatatttattatctcacagtttctgtgggtcaggagttcagacacagtttagctgatttctttgcttcagaagttatatgaggctgcagttaaggtggcagcctgagctggggtcttatctgaaggctcaactggtgaaggaaggccctatttaccagcttaccctagttgtttgcagaatctccttaaaggccatttgactaagggcctcaccttctcattggcagttggctggaggccaccctcctccactccttgcctcatgggtctctccaatatggcagcttactttatgaatgcatgcaagccaagaaggcaacagcagaatcaactgtcaagacaaaagttacaattctggcaatgacgtcccatcacctttgccatattctatttgttagaaggtgctatggagtctatttgttacagcacctttgccatatttgggtagaccagctcacgctcaaagggaagagattgggtaggggcataaataccaggaagggaaagaggagaatccttaggaccaccttagagtcagcatgccacagacataaacctggagcatggttccaggattacctcagggactcagtgactacatttacccagatacagttcatctctcttccctggctcagagatgtctctctccatgtagataggctacagccttaccaggtgctgtgtgaaagagcatactcaggtgaagaaaagagggaatttcaatttttgttattttggaaaaaaacctttcccaaaagtctcctgggagaagtcccgtcaagtctcatttatcaggattgggttgtgtgtccatatccacattgcaaaggagtctagggaagtaagggcaaggatatggcatttttgccctcagtaggaggtaagtctctgccagagagaaaaggaaaggggtgggtgggggcagaggctgggaatgttccaccaactactaaaagacagacttctttaagggctaccttgtgttaacatgataactgaattttctgcctctattctccttacttgagatgttcattcatatagtgcgctatgatgtcattgggtctttacttggctcaaacattattgtacagacaaatgcaaatataggtcctgagactgcctgaggttctctattactgatatgattatttttgttccaatatttcctaaatatgttaagctagttataaaattcttattcttaaatctcttatctgtaaatgtttttctttttgtacttcttcaaacaaaagtgactggctccttaacttccaaccatctagagtcatttatttagatatgcaaaggtaatcatgaaaataaaaatagatggtagaatgagcctttgatctaccctggcttttctgcaaaactccccagataagtacacaaagggtgagttgtttacaaaaatctctctgtaatcagagcaggacctgtgaccttcagcaccttagactatgagggttccagacttcctttcaggttcctcaaagcctggtgaccacctctcagaggtgaacttacttccagtcaacctagctgaccactaggagtatgtgtgaaatgactctgaaagcatctgctcttgcagaacttcttttcaggaaccaaatctctactcttttatcctataatttgctgttgttgatttggattcaagtgaataaacttacatttatccttttcaaatacagtcttatttattaggtccatttgccatgaccttctgaatcttgcttctgtaatctctcttaattaatgtaaggctccatgttgtgttgaccacaagtttttatagcatgtccaggcatgtttaccaactgagccaatgctcagttacgtcccaaaggatctgaccattttgtgtggattttaaaagaaaacatattagaaggaatacactgatttttatttgttcatttaatgcagtggttctcaacctgggttggaggggaggatttgtccttcagaggacatctggctatgctggagatgtgtttgttgtcacagtggaggagggaggcatgttacttgtgtctagtgggtagataccagggacactgataaatattatctaatgcacaggatgccaccatccctgtaacagaaatggtcccaaacatccatactgctgtgttgaggagcccagttttcatttcagaaatggagctgggcatggtggcatgtgactgtagtgccagctacttgggaggctgaggtgggaagatcacttgagcccaggaatttgaggctgcagtgagctatgatcctgctattatactccagcctgggtgacagagcaagacccatctcaaaaaaaaaaaaaaaaaggcattctgttttgtatgggaaatcttacataacctttttctgtcagtttgataggaatttttacgaaatattttgatgcttgaatgtagagcccaggtcttactatatttacgtgcgtctttgttctatttctctgttgagcaactctttttgctcttacatctggactccacagctgaatcctctgcttacttgtctggggcccagataccctcaggaatccgaccctattgtccataccccaaaccactggcagttggtaacacaaacacagtcacaccaatgaatagtaaggtaaggaagtgtcaatggacacctaccaccactcctgctggcttctcaatgctattttggccaccatgaattgtgccatctcattgtcctattgctctgcgtcactctccacgcatttaaagtgctggtcaggagcattcagctggctaagcctagttcccatgatgcagtctgagcttttgggatgggctctggaccagagaattcatgtgcatcactctttgaatctattcaataattactgcccctcattgccatgtttgttgattctccagaaataaccacttgtaacagtttgttgagtgtttttgcaaacattttcagtgcatatacagacacatacatagtatgatatactttttatattataatgtgcatataagttaggattgcttaagctgctataaaaggcctccgtgattcagtggcttaaaaaaaatgagatttgttttttctctgcatcgtggcccaacatgtatagtccaggttgataggaagctgtgctccaggcagtcagctggggacccaagatgacactggctttgccatcttcaacatagtccctcaggtcactctggtggtcaccattttgtctagtggtaaggagtgaaactgagtatgaagaagacgtgcaccttgacttaagagacaaggctgggaaaaagcttacttacatggctatccctaactgttaatggggccgagaattgaagtgtagctgggaggccatatgccaagctacaattctattgtatacaagaaatgaagaacaaattttggtggatagcgacctaatcatctagttcattctttctctctcctctttctctcttaacataaataggactatagtatacaagcacatttcattaccttcaacattgtccatgttagtatatataaatattcctttttccacaactatattaactatattattcgtgactcttatgagaatcgtgtataactttcccctatcaggtttatcaagttggtcttttgagtacctctgtttgtttagctgttcattaaatgctcagcacgtataggacttggtcagtagatagcagtgctctttgaatggctcactagggttttctttttaagccattcttttctagtatagaaatttgcattctgatatagaatgtttggtttctaattatttaaaaccatatattgcctaggttttcttctagggtttttatggttttaggtctaacgtttaagtctttaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcgaaaactgggtgaaggacatgaacagacacttctcaaaagaagacattaatgcagccaaaaaacacatgaaaaaatgcttaccatcactggccatcagagaaatgcaaatcaaaaccacaatgagataccatcttacacctgttagaatggcaatcattaaaaaatcaggaaacaacaggtgctggagaggatgtggagaaataggaacacttttacactgttggtgggactgtaaactagttcaacccttgtggaagtcagtgtggcgattcctcagggatctagaactagaaataccatttgaaccagccatcccattactgggtatacacccaaaggactataaatcatgctgctataaagacacatgcacacatatgtttattgcagctctattcacaatagcaaagacttggaaccaacccaaatgtccaacaatgatagactggattaagaaaatgtggcacatctacaccatggaatactatgcagccacaaaaaatgttgagttcatgtcctttgtagggacatggatgaaattggaaatcatcattctcagtaaactatcgcaagaagaaaaaaccagacaccgcatattctcactcctaggtgggaattgaacaatgagaacacatggaaacaggaaggggaacatcacactctggggactgttgtggggtggggggagtggggagggatagcattaggagatatacctaatgctaaatgacgggttaatgggtgcagcacgccagcatggcacatgtatgcatatgtaacctgcacattgtgtgcatgtaccctaaaacttaaagtataataataataaaataaaataaaccatatattaaagaatttttgatttgttctgtttattattgcactgttaaataacaagggtcattaaaatgatacactgcaaattgcattctgttttccaagtctagagacaaatttgaattcccccaaagcctgttctggcttgcttttacactgttgacattcctcagaagaggcaagaataggcaaataattatgtgatgcccatttcaattccaacctcttgactgcttcattctcacccttcaccattcacatttggcattacaattccaacattaaatattctttttgaaaaatggttaagtttttatctgatgtttcaatgttgatatactatgattgggtcttattgtccaaagtgaagtcaaattcgtgtttaagtaaaataattctagcatggtttcctcctacctcccacccattatttgaaaagtgacaagaaaatgtataaagctggtaataattgaggcatttctaggcttgggatttccaaaaactgtgaatagccataaactggcaaatagaaggagacctggaaacgaattgcagtttgaaatcacagcaccatctgggacaccattttcctaatagtattagttttctattgctgcataacaaattaccacaaacttagaggcttaccatacacctttattatctcacagtttccataggtcaggagtccaagcacagcttaactgggtcgtctgctcaggggtcccacaaggctgcaatcaatgtgtcagctgagctgcatttctctctggggcttcagttcaacttccaactcatgtgattgttagcagaattcatttctttgtggttgtaagatcaaggtccctattttcttgctgactgttggctgggggctacgctcagcttttggagtccaccctcattccttgcctcctgtcccttttccagacctctcaacatggcaactcacttcctcaaagtcagcaagggagagtctcttagcccagcttgctaagatggagtcttatataatggaatataattatgggaatggaatcgtatcacttttgctgtattcggttggtacaaagtaagtcacaggttctgcccacactcaaggggaagggattgtataagggtgtgattcactggaggggggtcatcttaggatatgtctgccacccgtatttctggtttaactcactaccttgtttccatttcaccttcagtgcccttctgatgcctgtctggtgcctggtttcgaattcctacctgtctggtcctcacattctcatggttctcacatgcttcctgattaccttttaccttacatttccaacaccttcacagaatgcatcctgctacctgtctctatggccttcttttctctatggtcaagtcaccaatcccttggctctgctagccctctccttttagtgttcaagcacagcatgggtaaatgaaactgatgctgttatgttgaatacctcctcctcctggcttttctactcatttcagtggtgtgatcattcttcaagtcaccctaagtcaaaaccatacagttattcatatcttggacttccctaaaccaggggttggcaaattatgacctgtgagccaaatttgatccacatgcctgttattgtaaataaagttttattggtgcaaagccatacctatttgtttaagtatggtttatgcctgctcttgcactacagtggcagagttgagttgttgctacagaaactggcctaaaagctgaaaatatttcatatctggctttttgcagaaagcatttgccaacctgtgctctaagctgaagaagacagattgtttcttttgcatttaaaattccaatagcgttctttccttaccttcttttccttctgctattgttcaccttggttagtgcttttgttgtcatacacctgaattgactcagccatctcctaattgggcctcagcagctattcagagcttctcttctctgaagcccttggttcattgctgttgtttgagcatctgaagatcttccttgtctagttctaaattctttctctttatttttctatgctttttacagaaactcatcttccctgggtgggctgagagcaaacactggctcaaatactttacccagttttgcatgtatgattcattaggaacttctcataaactatctggatttaacagttatgtcttactctacataagacctagatcctctatagattattataaaatcattgcacacaagaattatgtcttacacgttacatctgataaaatgcttaacgttgagttgagctggacagagaggtatagaaggtgtagaccagcggtccccaacctttttggcaccaggaacctgttttgtggaagacaattttcctacagaccagggttgtgggggggatggtttcaggatggaagtgttgttccacctcagatcatcaggcactagttagattcttataaggagtatgcaacctagatcacttgcatacacagttaacaatagggttcacactcctttgagaatatcatgcagccgctgatctgacaggaggtggagctcaggtggtaatgctcgctggtctgctgcttacctcctgctgtgtggcccggttcctaaccataccagtaccaggccatggactggtactggtctgcagcccaggagttgggtacccttggtatagactgttgataggtctttgtgacaagctgctttactatttaaaaatgaaatagagctttgtttcattttatatcgtttttaatggtggtgattaaagatactttaaataaatttaaacttacaaaaaggtcgaagtaatggtataaggaactttttctctaaatcatttgagagtaagtttccaacctgatgccctatccctcctaataatttattgtgtaattcctacaaaaaataaccaaaatactaccatcaaaatcagtaaatgagcatggttcctgatagccatttagtccctatgctctaacaagtttaactaattgtctaagtaatctcctttgtatcaaaaagatctagtccaggatcataagttgtacttggttgtcatatctctttactctctttatatttggaacagttcttcagtattttttgacttgcatgactttggcattttttgaagagtattggagagctgctttgtagaatgtaaaattgtatttgtctgatgattccttataattaacttcaagttatatgtttttgatatgaatatcacatttgaagaggtataaatatcccattcgtcatcaaactttcactcactagttttagtggtgtttcttggctaaattaattattactgtgttagttgacatttgataattttctatttccatcactcctataattattatttggcattccattacagggaaaacaattcatctcttcctatttgttcatttatatcaccatggactcatggattcctattctattcagtgggttagaatcctttactttcatttattttgatgctcaaagggtcccacatttagcagtgggataaggttgcctgataagatatagaacacccagctaaatttgcatctcagataaacaattaataattgttttagtaaaatatgtctaaaatcttgcatatacatgcttaatattgcatggacatacttaaattattagttgtttaactgaaattcaagtttaactgggcatcttctatttttatttgctgaatctgaagccctgaagtgggagccccttcaagatgcttactgtgttctttcaatatgtccccatcattctttgaatacttccttgatttctggcccaacaaaatgctgtagcctcacctcgtacctttcttgctccagctctcaagccacttccccaaagaaacctggctctgtttagtgtaaaatggtatttagaaaccaagatctgtacacagagtatactcattactgttgaatgtcacaactcttagaccttctcagtggagagatccagggcaatctatgtatttatctatttacacatatgcatatatgtacatacatctacatatgtatttacttctgtatctatctctatgtattgaaaaatcatgacttcacaccaatgcttctaattccaatctagtaccacatgaacatttctcattttccttttctacttctctaacagtgagaaatgtggtcctcccaccctccatataaccataattgatcaattacccccatatgtacccaatctcccattgccaccaccagcctccacatccctacacggatgctttgctcacctttcttgggctctgacaccccaccctgtgcttcctctcactgcctcaggctccaaaatcccataccaagccactgccagtaccacttctgccaacgtggcacatgggcaccttattcacctgattcaggcttcaacatcccatgccaggccagcatcatcattcccctgtgtggatgccctcttcatgccacttgggcttgatccccagcaacagaccaccctgagtgaatgccctcctcatgatacttgatacactgtgctgagtcaccactcctgccccacctgatgcagatacctgtcctgcaaggcctgatgtcatgggtcttggattgaattgttcaggaaaggaaggagggaaaggaggaaggcatttctcaccatgtaacattataactgatttattattttttataattgatttatgttttcattctgttttcccctcaacctggctcattcactggcagattaccttattacaagaacaatgcttgctttatcataagcactcagagattatccatcgaatgaaaaagtgagtgacttaatgaacaaatgaatatgtagagagctaaagtttctacatatgcagaaaataaattttaattctcctaaaaaattattttctcttggctcttgaacttacttaacatctgatttaggattcacccatggtaacccaatgattgtttggggttttctacctcacctagcatgacatctgggcaagtttattttcaggtcactataacccagagttttcttgcaagagtatggtcaaaacatcatttttccttattaggaggtggcttgtgtgtgttgagctcacatttcttttctcacaggcttctcttgctctcatcccctgtgcagacttaatcatatgcctaccggtgatttctatatactgagatcaaaatcagcttctgtttcttatgctatcaaataaaatatctgctctgtaaaactgcttctacatataaaagaaagaatcggggaccagctcttcaattggtatgaatgagttggagagaaaaggcagtaaggcacccacccataggcccccaggggtcaggaagcaatgttcgatgttttccttctctcaccagctagctaaattcttgtggaaaaaatcccttcctcacgaacctgcaaattgaagagatgtagcaactgggctcactgatcctacccaccccaatcctgccccaagtcatcacagggaaaatgagcagtgcatgtgtgaatgggtatggcatataaaattatattttcatttagcatttattagagctgattcaaaaaatcacatgaaactattataaattgctgaacagtttcaaagtttattttgcttatgtgtgtggaagagagacaaaagtagatgagaactttaaaaataatgtttattgcatgactaaaaacttgggagctgagaagggagaccaacattatgtaagctcagaatatttttggaagttaaatggcatttcctacaattttacttccaatgcattcagctgatcacctctctgaaaacaccttgtgccttgcataccttttttggaagcttacttctccctccctcttctcttctaatactctttccgtgataaatcctcattcatcctggaagactaggcattaaaaacattttctgtatgaaacttgcagtggctttcaagtgagttcattagaacagtggtcatgcattagaactacgtatttacactttgtctccactattggctgtgaacttccagacaggggaatgttacatctcattttgttttcttttacttaatgttaaggatctcatatatacataattgggtaattacactggctagctcatgacacctgagtgatatgttttttttttgttgttgttgtttgtttgttttccattctcagtgaatgtcttcagtggcattgagcacaagagtggctaagaatggggctaaggacttaggcacacctggtctgaatccctgctcacccacttaactgtgtgacttggggcaatttatgtaactttttgagcttctgttttctcaaatgtaaagttagaaaaataaagcccctatttaatagtttttcttttttatttctgagtgttaaatgtaatattgcaaactaaatgctaaacatgatttatatgacaagaagcagccagtaaattttagctttttaattttttaatggagtggggctcaacagatacttaatgaatgatacagccattaagctttttagaatcccaattatgtatccaatttgttttatttattttctttttctcttttcttttcttcctcttctttcttttccttttcttcttctcctttctcctctttttcctctttttccttctcttcttcctcctcctcctctgcctccttcttccttttttctcttcctccttctcctctgctctcatttttcttcctcttcatcttcctccttgtcctcctcttcctctttcttctttttcttcctcttcattatcatcttccttctctttttcttcttcctcctccttcgattctccttcctcttcttcctcctcctcctcctacttaatcttctctaaaattctcctctctctctcctttctttcccctttcccctcccctgccctcctctcttttttggacatctctgagcacagctgctgcacataccagggcaaagctgcatcagatgccaaagtcttttcaagggaagccagttttcaagctcgggcacactgacttttaggatacaacccaaatactattaaataacaaaacattaagcttctttgcagataagcctggaataccttattctctaggtttttaaatttaagagaagtggaaccaggcactttacaatttgaaatgttatttcaaattattctcatagcagccctgcataataggaattattattcccactttacagataagagagttgaagacggtgtcactataagaattaacattagtataagagcagtctctcagctctgtttccctccctgctggctttaacttcttccactaaatatgtctttctccctatagtcataaaagataatcacaatccaacagagacatccatccctacagctcatgatcccaaaggaagtgagaccatttctattacaacatccaatttattaaccagtttcatgggagggctatgattgcctttcatctcaggatattttcattggtaagcagaagagtaatcagcagtggcttaagtgaaaagaaaagaaaaaaaaaaaacatttgattatctcacagagctagaagtttggaggtaaggggctcttgggttgagtcagtgactcagtgatagcaggagctgagcagtgtcttgtaaccctcttgagttcatgctcatgattgcagctccaagcatcacttcttcacctcagcatcataaggaggaagaaaggatagaaaagaggtcattcctctgacaacactcttattttgggggatagaagatctctactctaaaacccccagtggacttctctttatatcccattggccagaagtggggcacgtgtccactccaagaccaattattggcaagaagcgacggagttaacatgagtggtttacaacaatcatggctcggcatctgaggctaagtgaagggacagcttttcctgaaaccaaaggttcctgcctcttgaacacattgcaagttctgtgtgcatggcaggagagggtgtgtgtacagatggttgttggtaaggcagtggtcaatatctgctgcagcccattttgggtcatatgtctatccctcatatctgctgagggcagcacgaagagttctgccttcgactgtgttcctctggtgcagtctctgagagtaggattaacaggaaaaggattggtcaggaaatattcttgggaaaaaatggtagaggaagtgggatgaagaagagagggaggctccacagagttcaaggtctcataaaattcaccccccagaggataacttaagtgcaactccacagagaagtactggggacagtgtagaccccactcagtgctgtgttccccatcgggattaccccaccaacactgtggggaggggatataaatttctgggcactcctggttcttcacatgtgcaggcaaaagagattctggaagtctgtgggtagttctctaaccaggagacacaaggctggccgtttggagtaagagcctgttagagccactaagcataacactggggacttggaggggatatgagctgagccccaaggacatctgccacagggtccatgacagtccagaccagcatcaagtctgcaccccagagccacggtgtgggtgggcattgcttgatggttgccaagtgaaccaggacagtatgagcacaaggaaggtggccccctatggaaagaaaaatgctgagaggtcaacatctcaggacaccaactcatcagccctctgcacattccccaaactcattagggtgcctccaggagaggtcttacgtgagaacgggaattttggctgcccaggtactgtgtggaatctgctggattctctttatctgcagctgctgggggtacgccagctgtcagtgatgacttctagtgccattcctcttttccccatttaggcttttcttactttttagctgagagtagagtttctcctccccaagtactattgatatttgaggctgaattattcctcactgtgggggactatcctgcgcactgtagaatatttagtagcatctctggcccctctccacttgaagccaattccaccagcattcccccaccaaagttgtgacagatatcccctagaccttgttaaaaccactcctggtggagaaccaccggcttagaacactgggctcctgcaactgtagcttccaggtttcacctgctaaattgggggaaatgccctctaagctgtggaactctatgaacttcatgggagtttgccagatttagtgtgactcttattcttagtgagttaatttgtcatttgtgtcttgtttcctctgtgctaggggaataaagaatactggacctgtattcagaatttcctctcccttctcacatttacctgccattagtgagctgaggctttctttccttagaattagggttgccagattaagcaaataaaaatacaggacatccagttaaattggaatctcagaaaacaaacaatgttttagtaaaatatatcctttgcaatatttggaatatagttatactacaaaagtatgtgttctttatccaaaaccaggtttaactgggtgtcttgtagtttatttggccactgtacttggcacacattctttctctaaggactccactaggaaatgcctgcattactgtattctggtgcactcatcgtatccttcaatcatggagtccccactctgcctgttggttagcttgtactccactcaccgtggcaccacaacttgggctgtttctatcacagcactttcagcattgctgctactttccatagtgccctgtcccttcttttagcttttgtgtctttctgcaaattgattatatggagttggattaaggcctgcagtcattatatgtgggtgtgcgtgcatgtgaaaaaaaattactcttagcttccctaagagaagctcatgggaatcgaatcattgagtaatacagccacggaggatcctggggaaggaattctccagcattccacagtagcccctattctgaaagcctctagttagtatcaccatgaaaatattagagggagaggaaaaaaaatcctctgtaaatagtagcactccaggggagatcctagtaatttgcatttttaagaccagatgcagttaacctttcatatattgtacatattttaggatgatttttttctaaaagatttattaatactatcattgcctaaaagatcagctgatttgtgagttatttgaataaaacaaactaaaaaataagggaaataaatgttgcttgtcatcttccttacattcattgtggcagaaagggcagcaatgagctcttgctagataagagaactacagcagaggtacaggatgcagcatcatgggaaccagaattcatctgagagactcaataactctgatgattgtttatttagtaacccaggggaaatttggcttgagttacagtgtgtgtattgctgagttctttctgtgtgtcttggttatttcaactaaaaaagactggggggaggaaaagcagctaacatgctaaaactgtaatgattacttaacattacattttggaaaaatggctttactgaaatgtaattcacttatacaattcacgcatttgaactgcataattaaatggcttttagtatatttacagaggtgtacaaccataaccacaatcaattagaacatttttatcacaccacaaagaaactccatatccattagccagccatcactccccatttctcccactccatacctactcatcctcagcccctggcaaccactaatctacttgctgtctctgtggacttgcctattctgcatatttcatataaatggaattatacagtatgtgattttttttggtttctggcttttttcatttagcataatgtttttaaggttcatccatgtcgtatcatatatctatactttattctttttgttgccgaataacataccattgtgtatatcacattttacattcatcagttgaaagtcatttgtgttttcagttttgggctattatgaatactgctgctatgaagattcacacacaagtttttgtgtggataggcaaaacgggcagggaaacaaactagagaaagaataaactgcagaaatccaagtgagaacaattaagagctcaactgtcgtacatttccctttcctttccttcccttcattattaccctgacttaatccttgcccagccttcctttcattttcacagtatcctgctcccaccctaagcatgtgtatttcaaggtaaggctttttgtggagccaaattgaagggggatcacctggccagatttgcaaatgtaaaggcagactggtacatagattctccctccacggtatacccccgacccccagtgaatttaagaaccaaatttaatatatagattagctcttgattaagagcagtggggccaaggttcacttttagtctcaaggtccaggagagatgagcttctgtagcatcagctgggactggctacataattggcagaacccagtacaaaatgaaaacacgaggctccttttgaaaaaattattagaatttcaagatggcgagagatgagccttaaaccaagtgcagagcccttctgagcatggggctgtgtgcacaggtcatgaacccatgaagccagccctgaaaagagttctaagtttgaaaatatctagattccatctgccatagagtaccagcctgtaatcagaatgtcacatttgcagatacttcctaagcagctgaatgtatacaatgacctgttgatcagagggatgctaccctccagaaatgaatgtgttactaggtgtctccaacattaaatctctttggagctgtgttctgatgagctgaaccgggatgttgcccttgctggttgtacagtcataccacttcacatttcatgatagcaacaataaaacaccatgaaagatgtgttgcttcttgtgcggcaggcactgtttgtctcatggcctgtgagaaaccttccaagacacagcccttcaaactcaggaccctgtaagtcagattaactgtgaccacagactacatgagttgttatgagtaactctgggagaaagccgcctttcgttaaagtggagactgagtggattcaaatgcattttaaaacatctgtcatggccagattgccatttcaatagccccattgcctgcctggagcttttgcatgcatgagtatttctgctaggaaacagaaaatgtttggattcccaatttagaatcccttctatgagttcaaagagtttgggcttacactgctcagcagtctcctggttttgtttctttgtgccctcatgaaactagagctctgtgtcactttgctctaggaagaattttgttgttggtgaagaatattcttgatagttagcatctttgaaatctctatgaaaatgagaaattaagcacaaatgaacacaagctctgctgaactctcaaccccccaatctttctggcttcaaattttatttttatgggttttttttcatgctttgcaaggcacaatttagtaaaacacagcaatattaaagtgtacgtcttgaagaaatttgagaaatgcacatggccattacccagattaagatataaaacatctccatcaccccaggaagtttccttatgcctcttccagttagttcccctgctcagaggcaactgccatcctaatttctatccacatagattagtgctgcctgtttttgaaatccatataaatggaataatactgtatgagttaatgtgtctttcactgtacgcaatgcttttgagactataagttgttgtggacatcattagtttgttcctttattgccaggtagttttccattgtatgaacacaccacaatttgtttatctactctcctgttgatagatatttggggagtttccagcctttggctattacaaataaagcttctgtgaacattcttttacaagcctttttgtggacatacatactcatttctcttgggtataaagctaggagtggaattgctggttcatagggaagctgtttatttaactttaactgccaaagaagttttccatcaatgtacaggagttctaattatttatatctttgccaacacttggtcttgcagtctttataattttagtcatactgaagggtatgcatttatatctctttttaaaaaaaatcacttttattgaagtatgattagcatacaataaaatatgccatcttaagtgtgtaggttgactaagtttggcaggtatatatatccatgtaaccaccacatcaagatatcaaatatttccatcaccataaaagaaactcttcatgccccttcccagtcagtgcctggtagcaggcaaccactgatctattttctgaccctacagattagttttgtttgtctagaatttcttagcattggaatcatattgtatgtgtattttttggtctagcttctttatctcaacatatttttgagattcatgcatgtccttgtgtatttcagtaatttctttttattgttgactcatattccactgtacagacatatcacaatatgtttacttgttcatctgtggatgaatatttgagttgttttctgttttgtgctattatgaaaacagctgcaataagcatttgtgtacaattcttttggggacatatgttttcctttctcttgagtaaatacctagaagtaaaatggccgggatatatggtaagcgtatgtttaactttataagaaattaccatacagttctctaaagggttgtcacattttatgcttccatcagcaaggcatgagagttccaattgttccatattcttaccaacatttgtcattcatacagtaatcatacagtatagttttaaattctagcaagtttagtggtatctcttgttttaattcacattttcttgatgaatagtgctgataaatatcatatcttatgtgcctatcagccatttattatcttattttgttaagtttccaaatcttttaccagcttgaaaaattgtttttttttttttatcatatttgaagttctcataactgaaaaattgtcaatttttgagttgtaagatctctctgtatactctggaaacaagtcacttgtctgatataagtattgtggatatttttttcctagtctatgtcttgccttttcattttttaatgatatctttcaaagagcatgaattttaaattttgatggagtccaatttttaatattttcatctgttcttgttgggtttttcttgtatcttaagaaatctttgtataccacaagattgcagaggttttcttctatattatcttgaaaacattttatagttttaataattacatttaggtctatgattcattttgaattcatttttatatatggtgtgaagtagagggacagtttaattttttaagaaaacattgttataccatcattttttgaaactctctcctttccccattaaattacttttgacacctttgttgaaatcagttgactatattatgagtctgtttgtggattctctattctgtcccattgttctatatgtctttcttcatgcaattatcatcctgtctttcactgtacacaatgtcttgatttttgtagctttatagtaaatcttgaaaccagacactgtaagtcctataatttggttattcctattcaaaatgtattggctaatctgggttcttggtatttcaatacaattttataatgtctgcaagaactgatgatgggattttgattgagattacactgaaattatggtttgatttatttgtcttttttctttcctcagtaatatttttaaattttcagtttttaggttgttgtgtatatctggctaaatttattcctgagtggtttgtgtgctttgattaaattatacgttgtattgtttttctggtttcatctttcaatccttcattgattacaaatagaaattcagttggttttggatattaaccttgcatcctgaggccatgctcaatctacttatagctctagtggctttttaaagtagatttctggattttcttcctacataattaatacatgattgtcttttctgggaaaaaaaaaagcttagtatttctcctttgttttcaatgtgtatgtcctttatatcttttgattgccttgtaacactgtctcagatatcttattcaatctctctgtggctttaatatgcatctccttgctgagcaccttttcatatttattgacagtttgagtattttgagaatttctcgatcacgtcttttttcccattcctattgttttgtttatttgcattatttgtaggaattttaaaaatctaaatacaagtccttcattagacatgtgtttttaaaaatttctcctagtctgtggtgctttttttttttttacttcagcaatgatgtcttttcatgagcaagagttgtttttgtttttaatttgatgaagtgtatcaaattttatattctaggaaatgttttcctacctcaaagtcgaaaagatattctcctgtgtttttgtctggaagcttttaagtttttagatcaatgattattttcttgaaagctctgtgtgtgtgtgtttgtgtgtgtgtgtgtgtgtgtgtgtgtgtgtgtgtgtagtttctttaatattacactcaaatgctttttaccatttttatgggtaactttggcaaagatgaaaattgtataatatataatgctggtaattggattgggaaagaaacactcaagatatgctgctggaggtgcaaatgcatacaacttttttggcatgggtaggaaaaaattcagtaataagaatcaaaagctgtaggaaccaaaagccttaaagatgttaattcctgaaactctataggttcatatcaagacatttatcctgtagaaataaccctgggtgtgtgctaaaatttagcttcaaggatgtgttatcacagtattttttaaaaatagggcacaagaagaatggaaacagtctataatagtggattgattaaatgatcatatagcgctattatggaatactgttaaaccactgaagataatactgcagaatattgaatgcctgtctttgtctgttttgtgttgtgataaaggaatatgtgatgctatgtaatttacaaagaaaagagatttatttagattatggttcttcaggctataaaagtactatggtactggcatctgcttggcttgtggtatgggcttctgtgctgtgtcaaaacatggcagaaaaggtcaaaagggaagtgggcacatgcaaagagggaccaaacccaggagtatcctggatttataacaactcatttttgggaaaaataattcattcccttgagaactaattccatttcacaagagctagaactcactactgcaaaaatggcaccaagtccttcatgagggatctgcccctatgactcaaacatttcccactaagccccacctcccaacaccaccacactgaggatcagagatcaacatgagatttagtgagggcaaacaaactgtatccaaaccatagccatgccatagaatgccacactttaaaatgaaaggcaaattattattgccatttgttcactgctttataattttaatttgtccctttgattgcatatttttattcttctgtatgactaagaaaaagggcttcttgtcccctgccaaagagttgaaagcatgccagagaagtgccaccatccaaaacatttctcttgctgtctagcattccatcttctgagttacaatgccttggtccacttataatttggtgagatttatacatccatttaaattttcattagctggatatggaggtggatgtaaacaagaagcattgattagatctagaaaaggtggtatgtggacccaaagaagcaccaatagataacgctgtagacagacttggggatgaaactgttgtgtactccctggaattttgctgactcagctgtggtgtggtgtgagggtgacacctttagaagactgtccaggtctctttggagtagtgtgtgcttgtcaagtttacagcttgtgggaaagggtaatcagaacatgcaaaggctcaatcaacctttactgaggctccctcaggcatggtactcaggcttcagggcccagagggtacatattgaatttcactttgcaaagaacccagcattagagcctggaccccaggagcttgggtctagtggagcagttgagcagccaaaaggagtgttgagaaggcagctttaacagggcatatgtgttcaatatcaactgaattcagaaggtcaagctgctggagttcttcatctgattaaccttcatcattcaaatattctgtgctatagcttttcaacaggaaattcacatgtacttaaaatgtactttttttggcccaaactgtctaaatgtgcattgtgttagtttcctagggctgccaaaacaaatgactacaaactgggtgttttaaaacaagagaaatgtattctctctgtcagttctggaggccagaagtccaaaatcaaagtgtcagcagtgccatgatccctgtgaaggtgctaggggagattccttccttgcctcttcctagtttccagtggctcctggcaatccttgatgttccttaacatgcagttacatgactccagtctctgcctccattgtcacatggacttctttcctgtgtgtgcttgtgtctgtatgtgtcccctcctttttctgtaaggacacccttacaaatttagggccctcccgaatccaatgtgaccatcttaactaattacatctgcgaagatcccatttctaaataaggtcacatacacaggtaacatggggttaggacttgaccatatctttttgggagacacaattcaacccgtgatttcaatcactgtttaaatatcccttttggggttactatgttgtactgtacattcctctttcttgcatttttgacccctgtatgtaccatgtcttttgttcataagatgactctgagaaaccccctaggctcttctctggaattcatgatgaagataattcttgggtttctataatcatagaaacagaatgttcagctttagctcccgagagacttcaagtgctggcaatgtttggagggaaaccggatgtgagaaaatggtagggaggctaagggaagatgaggtttctggccatggagctgactagggcagcggtcaggggtgacctattagaagatgagggtacagagtggggccaagaattagagattgagcccaaacaggaatgcagcacatctggcctagttggaggcaggggtggatctccagcagaatatagacaatgggacccatcttggcagacacctaaaggagaaggggaacttgttgtccatgtccagtctattagcaaggcctcttacctccacatcaccatgtgacagatctgttcagtgactcccatttccttcactaaaaccctatttctgctcccacagtctttctcctagactaccaatttccccttctattcaggctacctcaaattgttctccaaagagcaactgaatcatcttttcaagcataaaccctaagttgctgtatgatctggcccctgctcacgcattctgtgtcatcacacctcagtcactctgttttctttatgttcctttaacacaccaagctccttaccacctcaggaacttttcacccgctgttcccactgcctagaactctctgccctcatatgtcaatgcctgattcttggccttctccccttgaaacaaccttctgtgaccctccagtctaaagtggtgcctctccatctctgtccatcatccaattttattttcttcatattgcttaccactatgtgaaattattgaattcatttatgtcagtggttcttaacatggagggattttgtctccccagggcaaatttggcgatctggagatttttttgttcttacaactggggtggagggtgctaccggcatctagtgggtggagaccagggatgctgctaacatcctacaatgcacagaaccaccctcacaacagggaatcattcttcccccagtgtcagtagtgccaaggtggagaaacctatttatttgttgcttttgtattctcaaatctgtgcttaacccttttgaatgtatatcccaagaaagcaggaaagcaaactggtatgtgtcttgttcgttgctctgtctctcccccagaacaatgccctggtcagagttggtgatcaaaaaataattgatggattaatgaatgcgttaatgactgaatgaatggtctcaagccctggatctgtcctttcctagctttttgagcctggggacatgtttttaagtgaattaagccattgctgacctggttcagcctcagtttgaggtaggccctgtatccctgggtctcaggatcagactattacattgtccttcccccaaggatgattccctgcatcccccaggggtacagagatttttcattatctttttcagattacagaaagaattttaaaaatgtattactttagacaagtctgatatttttatgaaattaattatttccatccagcaataggatatgattcatttacttcagtcttctttagtatcatttagcaaaattttataatttattcacatacacaaacacatgcacatatcgttaatgcacatttctgaataaagggattttcatttttcctattgttgtggtccaaaagtagactgttgagttttaaacatattttttgctatatttaaacaattctaattaaatcctttaatggttatgaaaataatagtaatatatttccaagtttacaatttccatttttaattttctttgatcaagtgattttttaagaagaatactgttgtttcttttttatttttaactttcaagtgtgaaaggcttttgttactgttgttgtttctggttattttacaattgtctctttataattactacattctttttaaattgatgatgagctggtctttatattttagaataattttagatttacagaaaagttgcaaagattgtacagataattcctgtataccctgtacccagtttccatttcttctaatgttatcattttactttactgttctctcatcctgttttttatccttgtggtgggccaaacctttcagagactcagctactaaaagatacattttatatttaatatgaatagagaaacctgtatatgcaaacaagaaggaaagttgtctaggaaggaggtagaagtaaagccacattgctgtttccaggtttgcaaggcccagttcaaaatgagaatgcagagccccttgttcaagaaatattaagaatttcaagatggcagcagcagagcatttaactcagcacagagccctttgtactgtgaagccctgagccactgcctggtttcatgcctgtgaagctacccctgctgttcctacagttgaaagtaatctttcaacttcttccatgatacaaatacctcagtaagttaagggaaagtgtcctgcacgaccaagctaaatctactcatatttgagtttttctagaacactcaaagtcacaagctttgcagcttgcctgccttctaaatctaagttcaaaaggctttgagttgaggacaatagtattagctaccctgaaatggcagtgaagctaattctaaaataacatccacattagctcacacaggctgatattttctttgctgaagatcaggcaaatggagtgtttgttttgagtgccttccaataatacttacaagtagccaagaatgcttgggctcttggaaactgtacctatgcccagaggctcttggtgaatatatttttttaaccaggtttactcatttaacttgtccaaatggggcactttcacaagggaacccatcagccagtcatttctgatgaaataccaaaaggacctgtgaggaaatgaaatacgagaggtcttggtaaactgacattttgaaagtatctgggaaatacattgctggaaattggtttagcttcatcatttatttatcaatgttcaacaacattgtatcttgaaatttgagggtacaatgtccacttacagtatttggttaactgtgctagccagatagcaacatacctacaacttacaacatacacaccatatgtactacataattccagttaggcccatcttcccttctgcatcccttctgcactgatgttctattcatcatggtgaaaaaaaggtatcctggatctgaggctgcttcctcctgtttatgcaacatgggcactggctctactgtggaaccgaatcccattagatagaacagatgtacccacctctctctcctgcctcttttgactcacaagtgtgcccccctagtttctgggaattaactcccactgagagcaaatggacaggtgacctatgagaatgacattgggataggcttttcttctgctattattcccttccttgtatgtaggcattgtgtgcaattagcgtgaaaatctaatactttacatcctcccacccttggaccttggaccttagttcctgggttgcaaagaggtcccaggttggaccttagttcctggggtgcaaagaggtaattgtcacttatagttttgggctgtattttagtggattagagttgttagaagtctgcaagagatttcaagtaaaagactcctcaggagactatgtcagcattctatgggcatatatgcatgcacatatctatgtaggtatgcacacatttgagtatagtatggtacttgtgtttttaaaaaatcaaatttgtttaaaacagtacagaatacgtcagttcaaagagcaaaatagaaaagtaactaattaagtttctagaattagaaatagaattgccttaaagattgctttgaatcatttatttttaataacatcatcacatttgttttctaagaaaggcctgatttatgtgcagattatcttcctagaattctgacatagtttcttaaaaagcattatcatattctaaaagacttaatttttgttgtgtcttagccagttcaggctgctctagcaaatgccatagactgggtggtttgaacagtaaacatttatttctcacagttctggaggctgggaagtccaagatcagggtgctggcagattctgtgtctactaaggaccttcttcctgatttgcagatgcctgccttcactcatatcatcatgatcatctctctcatgtttcttctacattagtgtctttataagacatgaattccattcatgaaggctccaccctcatacctaattacttctcaaaggttccaccctcaaatactgtcacattaggtattaggccttcaatatatccacttcaaagggatacaaacattcattgcatagtaccttgacataactacatttttgtggctttccctttttgtcatttagaaattgccacttagcatcaattctgtgtttcggactttgttggaagaaattttctcaaactggaaagcaaaaaacagattagaaaatgttttctagaagtcatttcagatattttaagtacttctgctactaaacagataccacttgattaatatttttgccaacaatgtccatctcagataaatgttctttacattttaaaaatattacttttcattaactattgagtagattcaaaataaaatttgtggttaagaaaagaaggacgtgatggctagaacactagaaggtaccaggatttaaggaacagaggtggaagagaaaaagccgatgaaagagagaaggcagaaggctttagaaagattactgtgaaatgaaggggcaggggctgagctgcattcagcataatttcttcaaatgtatcatccaggttactgattcagctatgcttaatctacctttgaaactgttcgttgagtttcatttttgtttcatttcttattatattgaaatgtatacacacaaaagtatacaaattataaatgtacagcttcatgaatttgcaccaagtaataacagtcatataactagcaccctgatcaagaaatagaacatcattggaatcctacaaacctcccttgtgcccaatcatgatctccaacccaccatctccaaaggttgctaatattctgacctctaccaccatcagttagctttggccatttatttatttatttatttatttatttatttatttatttatttattcattcattcatttaagacagagtcttgttctgttgcccaggctggagtgcagtggcacaatcttagctcactgcaacctctgcctctcgggctcaagtgattctcctgcctcagcctcctgagtagctggaactacaggtgcatgctaccaagcctggcgaatttttgtatttttagtagagatggggttttgccatgttggccaggctggtctcaaattcctgggctcaagcgattcacccatcttggcttcccaaattgcttggattacaggcatgagccactgtgtctcaccagctttggccatttttgtactttatataaatggatatctacagtgtacccttttgtgtctgattctttgcttatcgttatatttgtgagtttcagcctcagtgttgcattcatctgtagtccattgctccttgttgctttgtggcatttcattctatgtatataccataatatatccattctactgtgatttgtgttaagagttgttttcacttgcaaagtttaaggtaggaaattttcctgcctttggttgagagagggctgttctcccttaccataaagatacatcctttttagagacccagagtgtttttttttgtttgtttgttttgagacagggtcttgctctgttgcccaggctggagtgcagtgagccatgattgtggtgagtgctaccacatccagctaatttttaaatatttcgtggaaatggggtctcatcatgttgcccaggctggtctcgaactcctgggatcaagcaatcctcccgcctaggcctcccaaagtgttggggttagaggcatgagccaccatgcctggctgagtcccagctttatgggaaggactgtcccattcaacttgttaccatgggcaagcctagaattcgcattttgtccactgaatcctgtgaggtcaggaaaacagaatttagattcaccacattcaacaaatgacttcaaggcaagcactggctgtagggctgcaatgttcttcctgattattttgagacataagtgttctttacttttttgtccactcatgcatattttaaatagggctttaaaatacattatccaacatccctagttgttttctgtggaaggctggtgtgggtattcattctgccttactgtaagaaacatatatagacatgtactttaaaaatgccccttgtgtttgggtgtggtggctcatgcctgtaatatcagaactgggggaggttgtggcaggaggattgcttgaggccagggattcaagatcagtgtgggcaacatagagagacctcgtctctacaagaaacaaaaaattagcctggtgtggtggtatgtgcccatagtcccagctactcaggaggctgaggtgggaggacagcttgagtccaggagtttggggttacaatgagctataattgtgccactgcactccagcctgggtgacagaacaagactttgtgtctatagagagaaacaaaaaggcccctggatttgtgaaaccaatgtatctattataaaatttaaaacaagtgaggtgtggtaatagtttttttttttttcatattctttctcaacctatataaggataccaaagaggttataattttttaccgaagttgtcctcttctggttttgtttgtggagagtaaatagtttatttcaaaggcttagacttgtgtcattttaatatttccctcacaaatcattttgagtgattcatgcacaaaatatttttaggagctactttttacattgttttgaggtaagcctttatgggtttccaaagatggtagtacaggagtcaggagtgaaaggaaatgtgtactctacaaagagaaatatgatcattgacattcaagaggcccagaaaaagtgctctgcaagttcaaaggagaagtttacttccttttgagtggatcaggaaagtctctgtgtaggaaaagacatctgaactgggcctcggaagatgggcagggttaactgttctcatggaggaggaggaagaggaagaggaggaggagaaggaagaggaggaggaggaagaggaggaggaggaggagacatactcgtctgcatgagttcaggtaggaaaatatagttgagtttgtctggaagaatgcattcatagatttagaactgtgctatccaacgtggtagccactgactaccatgtggcttttgagcacctgacatatggctcatgtgactgatgaattcattttaatttaatataatttgcaatgaagtgaaatttaaacttttaaaaaagtgatgctgtgttcagtttttggaaaagttttaagtacgtttggaacaacttgggtatgtgaatctattcttgcaatcatatattttatgaagtctaagtccagatcaagtatttctaatgaaaatccactgtccaaattgagatgtgctgtaacaatgtaaaatatcttattaataattatttatttacatcaattccatgttgaaatacgatttgggatatttgggttaaatgaaatatatagttaaaaagtcagtttcaactacttatttttacattttttatctgactaccagaacattttaaactacatatatggcttgtatcacatttctattggacagtgctactctacagagaaggttgaagcataaaatgagagtgtcttgggaactttagcaagttacttatcttctctgagcctaagtttccttatctcctgtggtttttgcttcatacaagtattgagagggcaaaattagagttgcacgcaaagcccatgttaacacagtaacaacgggctcaataattgggtatcattattcttttatttaaagggataaaaaggtagacaagtaagttctgtagaaaagggaagggacagtgagagtatctgatttataaagtatgtaatggcatgggcagttataaggatcatagacccgaagatcagtgagtaatgagtgatgcgtggcgacctggcaaacaagattaagaaagctgaaagataacagatgaaccgtgagggatgaaggtggtgcagtcagaagattgttctaggcttggaagccggttctgactttgccgtggatagatggggaagccagctcacttactatgtctctttgtagcatctgaagaatgacatggccagaccaggtggccacccagattactttagggccaggtatttaacttggtagaagaaatggaagacaaatttttcataaatgttggtgttgctccttacatgaagctcattatagttaaggaaacagaagcattttatctaaaggtaggtctaaggaacttgtgatgacgtattgaagaaaatgagcagtgaaaacaaagaggaataaagtcttgaaagaagagattggcacattctttagctttgcagttgaacttgcttggcaattactggagataaggaaaagaagaagggtttggccaaggtttgttaatctttataaacaggcaggaacatcctgtgccttttcccctgtaattacagtttatgaatatttgtttgagtgttaggatacttttttctttgccttttgatacatccttgtgtgtactccttgtttatctgtgacttagtttcagttttcatgtctatgtgcttcagaaagtcagaaaaattaatcatatgagcttaaaatgccgatcaagaaaagctcagcaagatacattgtattgaatgcagtgatttcttttaaaataaaatattaaataatttctgcttacctggaggtaagggaatagctttgtaaatattccttttttggagaaagttccactgtggtttatattcagccacaaagagggcatgcttcttatattatatctcaaggtggaattcattttgcatgtaaacaatgtgtagatgaggatgaggtttagccgcatctatccaaaaactcaaagtaaccatagctgaaaaagataggaagttattattttctgatttagatgagactggaatagtgacttcacatttacctgggacccaggtttcttcaagctccctcctccatcttcctagcacatgtctttcttctgaagggcatttcatggtttaagatggctgttgctttggcagccaactacgaagcagttgacttataattgaaggccatgttgtatttaaagaatgtatgacttcgaacactaaatgcggttcatagtttagcttagtgaggtgctgtctgtgggaagcacgcaaagacagacaccgactgaacaggcagttgtgatgactttaatggaatcacattttcaaagttatgtgcactcccagggggacacactcatgagtgcaatgtagcatgtaatcaaatgtttgaattacaggctgggttcagtggctcacacctgtaatcccagcactttgagaggccaaggcaaagggatttcttgagtccaggagttcatgacaccagcctgggtaagataatgagaccccatctctacaaaaaatcaaaaagttagccaggtatggtggttagtgcctgtagtcccagctacttggaaggctgaggcaggaggatcacttgagcccagaagtttgaggctacagtgagccatgatcgtgccactgcactccagcctgggtgacagagtgagaccctgtatcaacaaacaaacaaatgaaagaacaacaacaacaacagaaaaccacaatagttgaattatgttttttcataggcattctcccatttttccctccatcctccctctccacacgccccacccacaccttttccagaacacccatagttgaattcaaggtagatatatttgcacgttacgtaacttcactgtatagtgaggtctccctactcctccaacaccaccttccactctgctcaggtgatctttggatcctgcagttctgtactggatgcagaaagagagaaatccaccaatgctaatgggagacacctaaaaggaatcataaagtaaaaagatggatacccagatttctggctgggacagactgcatttctcagccatggggcagactgcaagaggagagatacaagaatacactcaagtactttcaagggtctcgccactaccttttaaaagccatttcagtcagccatgcagttagtggaaacgcctgtgacagtctagcaaagtgctggcagaggtccagtttttgctcacactttttagctttgatggtgtcaccataggtatttgagtttaaaagttggaagcaaatgcatcatagaatccttaccacacaacattataaatttgaatcccatgcaggtaaagcctttatattggatttgagggatgaaatggctgctttctaagatttggagaatcagaatgttatcccaaatctcattataaaaatcaaattaatcgatttggagtgaattgtcaaacacagcacgatggtaatgttttctttcttgattgagtcattaaactacaaaatcgctgctatgtttctattctgttattccttaaccacagctgaaataaatttggaaagtgttttcagacagttgggatggaggaaacacaaggacgccattactacactgtacaaacaatgcaaaggtcgctttcccacatcatcccaaggcttgctgttaatctgggacaaacacagttagatattttttgatggagagggcattgtcgtgggtggagaagagatgaggcagttcccttcgacccagctgtgactcagctcaggtcacaacttgtggccttaaatctcaaagagaattagatgtgtgtgatttcacaagttggactttcttttattgaacctatttctaaagcacaagaaggaaatgtgcagcctaccgtgcattaaaaggccagtagacactcttactatctgtatcccctggttccttttgtgtctcataaataaaatatctctacaaaaatatggaaaatatcctcgctctaaattaggaaagcagccttgctttaatttccttctctgcaagttggcagctgggtaaaagaaaatattttgacttccagagatgctattgtccctccttcagcctccctcctagccctgggcttcaggcagtctgcagggtgttctttctggccagtctctggtcagatctgatatgcttcttcttgagagaggcccctgtttctcagccagcagaggctgcagtggggaagagttgctgcctgcaggaagtctaaagtccagtcacatctttcagctccatccttagcctacaagataggaatgtggtttccttgataatgttctgctgaactgtcttgtacacaagataatgtttgcttcatcatccctgaaatatgtttccaaagcttcgttgtgatggtcaagaagcagtccgtaccttggagagaggcccggggaatgaaattcagagagacaagtatgtcaaccccaccacctcattcatgtattcattcagtaaacaaagtgtctgaggttctactgagtgtccagcaagtgtgttaggcacttgggggatagaagtgacaaacacagatagctcccccctttgtgtggctacgagtctaagaggtgacccagacagcactttctgtctctctcactctcttgcttttgctcactctgtgtgatcttgcccctccctatctctccaatgatttcttctataactcttgtccttagtcaccacacaactgtcacactgagcttcttactctttcgtgaacatgtcagtaattccttccccacagcctgtatactggctcttctctgtatatgaaaagatttccacagggtgggctccttctttgtttgtctcttcccaaccagcttgagttacgtgagatcacttgactggttttgcagcatggactgtgaatggaagtagcatgtattactttctggccaagaaagtaaatgaccctccagctctgtctaagcaatctgttaagatggtggcatctcagtttggaggaccctcgctcagctggagtccattagtaactacaagaagtagagcccccgaaaacccacagcatcactgaaaaatatgtttccattgcattaagccagtgaggctccatggttaatttgttaccccagcataaccttacctgactaataaataagctcatttgagtggagtagacaccattattattctcactttacaaatgaggaaacaggcacacagaagtaataatctacctgtagtcacacagctagtaaacagtagaactgggatttgaacccaggtagtctagctcctaggactgtggtaaactgcacaaacaatgcaggaggaggcacttaaatataattaggtccaaccaagggaagtacggtggaaaattccagcctgaggaagctattctggagtggtacacacagcaggatctcaataaatgttaaatgaatgactggatctttttaaggagcagtatattcaattgttttggctgcataagagagtaccacctagtggcttaaaatagcacacatacattatcccacagtttctgtgggtcaggaggccaggaacacctaactggatcctgcactcaggatcatacagggtcatacaagggtcctatgaccctaagtgaacgtatcagccagggctgctgtctcatcttcagctcaggatcctcttccaagctcatgttgatggcaaaatctagcttcttaccattgcagaaataagatacccttttcttgccagctgtcagccaggggttgcactgtgctcctagagtccccttgaagttccttgccatgtgaccatctcacaggccctctcacaatctggcaacttacttctcaaaggccagcaggagcatctctctcctgtaggctactatggagtcttacacactgtaatataatcataggagcaacatcccatcacctttgccacagaaggtaacctaatcaaggggcagactgttccatcatattcccaggtcctgcctacactcacatgggaaggggttataccaggtgtatataccaggggatgggaatcttgcaggccatcttttaattctgcctatcaaaagcagtgaacaaggatcaactataacactttttttttaacactaattcattggctactcactattaaatgcacaacctagggctgaagtctgtgaatggtcacatattaaatagaccatgtaagtcacacctcaaggaaaagtaagggagttaagacaaaatacagaactcacacttggcccatgaattagaaacttgagtaattaaagacagatgttctgtagggtaattggggtgaatgaaactggtgatttcagtatatgcaagctaatctttccagaaccccttttcaaagttcattttattgagcaatagtttaataaactgcatccatttcaagtgtacaaatggatgaattttgataattgttgtgaaacgaccaccacaaaacaatagctaaacatttccatcaccccaaaaatatatctgatgccccttgatagtccagatatttctctacaaccccaactcccaccaggtagcctttccagccccctttaactgtccttttaattaaataaaggcagtatggtacagtggtttggcactcaatacttgagtcagaatgtgttgtttggatcttcctttccctactttcttgctgtgtgaccttaagcaatttactaatttctgcctgcttcagttttatctaaaaaataagatagtgcttctctgaaagatagtcatatctcgaagaattcctatgagaatcgatgtagttgatagatgagaagcctaagtagttcttggcacatcatgagcactaaataaatgtttaccgtgttttttattgttattgtcaatattgttcagttcaattaaaaagccactataaagatggctagtagaagttaatgttcattaaaatatatttatgtcttttcctggagcactcttcccccagatataagtactccaactccctcctcttctttgaatattttctctaatctcaaactctgattgaagcctaccctgaccacattatctaatactgcaagcttcctcaccccaccccatcccacctcctctttcctgatgtttccctaccctgctatagtttttacttctccttagaatttatcaccattaacatcctaaataatttacttatatattatatttactttttattactatctctccttattagaatgtaagctccatgaggacagaaatctctgcctgttttgtttgctgatgtaccccaggctcttagaacaatgcctagcacatgatcagcgctcaggaaatacatgctaaataaaagaaattggaacctgtggcctaagctttatttatattatcacatataactcttaaaacaaaaccatgagatgtagatattatcactaccttttgataaatgaagaaaataaatcttggagagatgtagcttgtcacaatatacacagtttagttggtgctactccaagacatactctttttggctgtagtataccatatggaggagcttggaggaaccctagggtggatgtgacgagtcagacattgttgcccagctctagtaacccacaagcaatttgtgtgtttacatgcactggattttggatccactggcttatgccaagccaattccttattcctgccctgctgcttttgaaagtactggagtggcaagaggccgaggcatatttttgaaggatgagctcattccctggcccgcagccttactaaagtcttcagtaaatctattgaatctatggcaggaggttcagctgcatcaaatttaggattatcttgctttaatacagctaagactgcagaataatgaagatttggaccatcatataactctgaatcagggaccatcttaatacaggaaagatctttaaagtatgactcccttccatttttttaggctgtgtctacacatcacaaagtaaagatgtcagttatggacactaactgatgtgggtttatttctttgctctatctgtcttggtatggattttccagaactagaccctgggaccaggaattgagttcaggtagtttatttgggaggtaactgcaggaacacagtgagaaagtaaggaagacaaggaaaggaggaaagctaatagaagctatgttaatgagttggttactgctgtgggaaagtggggctaaatgcagctgagggcctgtgtagaacacaattcagaaatgtcccagtgaggggtgatgatgcaggggtattatgccatcatctgtaaccttttctgggcccttacctcccctgcacttccagcctgaccagtgcaggtgacctagtagacttccattgccggagatcgccctggagcagtttgaatttaggggagctgtctgcagctgacctctattgaaaggcagttctccatgtgtcgctggcatttctaacatcttgtgaacagaggcactcacacttttggaatatcttttcaaaaatatttgtttagtgaacagtctcaagagggatagaggtcatgtctccctctagagagaagggcaggtttgttttctgtccctaaggaagagaatgtcttccttagggacaaaggttaggcaaacttaccatccatcacaaaagatttcggttctctaagctcagagatgatgtcctgtaatgcagtccattatgtgagcaggtgtcacctgactcccataagtcaccttgtagggactggggcttggagggactggagcaaatggtgatgctctggctattactattgttgtgaataatatattgtccttgatcttggactcaggtgtctcatgtcttctaacagcatccatgaaactggcagaatgactcattcgcttgaaagtagagtaaaatttcagacctatcacagtttttggggacctccatggtggatctaggggatatgcacagggttccagctgtgactaccaaatgctatgcttcgctctattgatagcagtattaacaggatagtacaaaatctctgttatgtcctgcatgtttgattgagcctcagacctaagcattgtgttcctctaagtagaccagccctcttttaaggataaaaataatattaggggcaaaacctatgagtgtgtagaagtatattgcctattgaatactcactatatatttcattttttcaaggcaagacacgttttctattttgtaatatttggaatagaatagattcactgattagtgaacattgtaattattcttttctgaattaattatgttgaacacattagaaaattgctaggattgtcttttgtaatggaggtttcatgttgtttccattttcaaggagttctctcacgtactgtggtatgcagagaagggttgtcttctgctgggcccaaggaggcatcagtgggcttgccccacctccaccccttgccactggttaagttgggtaattgaagttctttattctatgaggccaggtctgtcatatatcacaatttcaccaatatgatctggatctgtagctaaattctgtcccatttcaaagttttctttgttctttcacccttgtcacattcttttaatgacattgggcagggcaggtctctctacctgttttttgttttcctcgaagaaaatcttggacacttggaccctttccttagcaacttcaaaggaaaataattagtttggattttgattgaaattgtaaaaaatctgtaaaaaatggggaagaattaacatcattattgatattttgtcttcatattcatgaacatgttatttctctcattttacttcaggcttctttagtggcttacgatagttaaaatgtgtaattttctacataaaatattgcatattttgattttgtatggtatattatatattattttgcaattataaatggcacagtttttaatattacagtttacaactgctggctgaaagtttatagaaatgcactttgcttttgtatattgaaattattgcagccaccttactgaactcttgttaattctaataatttatctgtggattctcttgagttatctatgcaggaagttatatcatctgcagattataacaacaggttagaaattttaaaacactttcacatacattatgccatctgattttcccagagcaagtattatcatctccattatagaagtgagaaaatagatcaaaagattttaagtgacctgccataggtaccaggtaccaagttattgaggtagaagaatctagtctcatgtcatcttatttcaatccaacactgtgcctcctaaaatcactcaccttgaaaaggagatgaaaactacaattggagagaagccacggatagtgggggtagatggaaaagaggaaaataatttcacttaccatgtgaacatcaaaatatcatgaattggctaagtcttgatttattggccatagggacttacagactcctttttattttttcccgtttgcaaggtttaatattattggtatgtctataaaagtaaatatttcagttttgtcccaatgctactgaagtaatgaagtccttggctgcaattacacaactgtggcaagatccagctactgcagttgtaatggtggcctcataagtggtaggaactagtatcagtaactattctgcctctcataatgctttgtagaatgacaaagatgtcaccaaagagtctatgtttatgtcatcagaaccattattgcaaaaagaaggtcaccatttcttcttttgtcttcactctgcaaaatctgcaaaagtactttagagtttggattcagtaagagtatatcccatttcttcctgtggttattttcaaaagaggcctggaaagcaaatagaggaatttccatttagtaaatataggaatttcttccactgccttggagaatatgttttctctccaatgtcaagtagatatattggaatctacccattggataataaggaaatagagtctaggaaaactcaagagcaattaagtgttggtttccatgtttataataaagatctggcatctccccaagttgtgcttgaaaaaaatatgttttgttataaagccaaacagctcctattcccaggtagttcaatattggttcatagtctgcagtgattccaattatgaaaccaaactggattgaggtgtatatactgaataacaaatattttacaccatacatgtcctatgacatgagatccgtctcatcccaaatgctatctaaaatgcccagtgcacaccaagaacctcttaaattcccttgttgaaccatttgtttcatatggaagtgggaattacggattttcaagcaggacttctggttgtcactcacatgaggcagagctagactggctgtccaatcagtaaatgaaatgatataaacctaatcacctccaagacctgaaaaccacactccttgattcttgccaatacaactccatatggaaacttactatacaaaatactccaatgaattcaagtgccagattgttggaaaccttccttaagaaaaaagaaatctcttttattcaggtaattattttctttaacaaagacaccctcagttttatttaaggggcttaaaattaggtgtcctttctctttttctttactctgaatgcttcaaggaaagtattttagagcttatattttagagtgtgattttatagaaaaggagcttcatcgtggaaggttccatgcaaacccactaatgtttgaaatgatcctttaagaaacagcttttggctgggtgccctggctcccgcctgtaatcccagcactttgggaggccgaggcgggcgtgtcatgaggtcaggagatcgagaccatcccggctaacacggtgaaaccctgtctctactaaaaatacaaaaaaaaaaaaaaaaaaaaaaattagccgtgcgtggtggcaggagcctatagtcccagctactcgggaagctaaggcaagagaatggcatgaacccgggaggtggagcttgcagtgagccgagatcgtgccactgcactccagcctgggcaacagagcgagactccatctcaaaaaagaaacagctttttttggtttctgggacagcatgagacaaagccaaggaaagaagatgagaaaacagctgaagtgcaaaaccacaagagatttctcaggaagatacattattaatgcatcttaaaatgttatcattaccaagactgagagttgacatgtatgtttgcaggctactttgcttactcttcttttggaaatactaaacaaaacaaaagcaagtggattgataggcttttttacgaaccttgctgagcaacaatataccttcagagggctggggatgtatcatgtaactcatgtgtggcttagttttagaagagtcaagagaatactattggtacaaccagaagtaattttaaaacaagtcatttacttgaacttcttggaaacaactaaatatttaatacccagaaatattgcttacaatgtcttctttcctctcccatcaccatccttaaacactataaccagatttgtacctctttcaagtgctcaaaaatctcaagtacaagttttgcaagggtccccgttggaggccagggcaggtacatgctgaagctggacaagccagaagatctttaacattctggagaagggagtatttaggaacattcctaagaattatatatatatatgctatatatatactatatatatatattatgtatatatatagtatatatatgctatatatactatatatatattatgtatatatattatgtatatatatagcatatatatatattatgtatatatatagagagagagagagccaattccacataaaactgcagaaaataaatgtaataaatcccaaatcaaattttagcttgaccacttctaagttctgagttgacaaagtgtagctaattatttctgggttttccaaatctacactagtgtttccttattttgaataggggcttttaataaatgcctttaataaatgcttttaataaatgcccatgtaaggatgcctctaagtcagtcttgcagcatatattagtgaggagtagatttggaaaacttgactttccacaactctgcaagactgagaaaaattgtagaattcatttagcttctgtttggcttccctttgctatttatcttaataactaagtgagctttctgcccttggacaaagcccaggggaccagtcacacagagagattcttgtgtgcaaatgcctgcttctatgaaaaaatctctgtagagtaaaattcattagctgtcatggtatgtgagcagaatattgaagttttgaaggttgaaaaattcaattatttgcttgttgagaagcatgcaattcttcagaggtatcattctgaatggaagtttttgtaaaaagaacagtaagcatagcatcggtcagaagagccagatttctcacttttgtatgatcttaggaaatgcaaccactcaatgtgtttccggatattcctctgattaggttctgtggatgaaactgttacatggactgtaaaacattgtagaaatataaaacatggcctggtgcggtggctcatgcctgtaatcctagaactttgggaggctgaggtgggcggatcacctgaggtcaggagtttgagaccagcctggccaacatggtgaaaccccgtctctactaaaaatacaaaaagtagctgggcatgatggtgcatgcctgtaatctcagctactcaggaggctgaggcaggagaatcacttgaacctgggaggcggagcttgcagtaagccgagatcgtgccactgcactccatactgggcgacagggtgagactcagtctcaaaaaaataaattaaaaaaattattattctcatttatcatgtacctagtccataatagacatctaatagatattccttgaatgatttaatgaatgaatgaacaatgtggttactctgaacccattgatggaatatttaggatttcagattgcatccatactaatattatatctcctgccagaagtctggggtcaggggttgatacgtaattgtggtttttcttgttttcctaatttttgcatgagtttcttttgttatctgttgattttcatcttaagtgtcaaacataaagagtcatttcaattcaacagacatttattaaacccttattaaatgccagggaagacatcatctctaccttcaaggagtttccagtctagcagtaatttcaaacatgtaaaggagtggtattacagtggggcagattgttaccaaggtgctatgcatcatggagaaagggcattgtcttactctggggagcaggggagtgacacctgtgcggggtgcagaaggtactgtagacagagtgagcagcaaaagcaaagctgaaagtatagatgagtgggggttgtgagtctccagaatgttgttcttcagaactgttacttgtattgctagattcgctttcatataaaccctctttcaacttgaggaaccacgtttgaatatttatcatcagttgtaactaaggttttacttcttgaactgtaatgcttgagtggactgattgttctgtgaaagcaattagcaaatcaagtcagatggcaccagaaagctgcactgtgaactcaaggggtacagaaaatatactccggctttgttgctatggtaacaagtggttctcctgcgttttagttccattataggccatggtgataacagtttctctttgggtaattatgaaaaataaaggagagagaaagaaaagccacatcttggtgtttgcccctgcgtctaacagctgcattttattcctgcaactgttaagggtattggaatgaattcttgtaaggggcagctattgtgataactcttccctgaggatccatgtgacattggctttatgaacacttccaatgtgtgcaggttacagggaggctaagcatccctgggcaagctatgctgcacagccagatccacgaatgggaatgctggggtctctcacctgcactcatattaacagccctcttggtaattctccagcaagatgccatcctttggaccagtggtttgcaacggaggtcagcggtggggaaatgggggaggattttgccacccaggggacatttgataatgcctggagacattttgattgtcacaacaatggagggaggtgtgcaaatgacatttagtggacagaggcccagggtactgctaaatgttcttcaatgcacaagacagctagcaccacatggagttatctgcccacaccggttcatagtgctgaagattagaaaccctgctttggaccatgattttcatcttttggaatggctggcattcaggaagtactagcagaaccagtgtatgaatctgatgctgtaaaacggatttcttcggggtgagttttctgtgacttcttagaggatgtcggagatgttcagccttggaagaacgtgcattacaaagggcaggctcaccagagccctgcagtgaagggctcatctcacactagcatgactcagaagcccagcaggctcaggtgctcagttccagaaaaacatttctcttctcctcatattgtattacttgtttagaatttcacgtaggtagctgagcacgttgaaatgacacgtttgttgtatttagtttgaacaccatatgttgacggggctgcaagcccaacaagctgtttttttataggatttcagctatcaccctttcatcaacctgggatcaaacatacaatagatagcaaaagaacacacacacacacacacacacacacacacacacacacacttattatttgttctacaaaggggatttcaagcataaatcacttatcacgctctatgcaaatatcaacgacctgtcagcttacttcttatttttctgggaagctctcccttaaaggagcaagaacaaactgccttgttgttggtatctaggggctgttctggtgacaactgtgagtgtccatggtcgtggaatgtgcccactcatcagccatttctgtcagggtgaatatctcacctgtcacagggaaaggatatcatacctgtgtgtcttagagtgttccccagcagcattgtggagcttcacagcctgacatttttcttcctagccaagatgtttctgacatgtcagtccacgtatgtttactcccagttttgcctaaggcgcctatgatcactgatgccagtcagctacaaatcatccaggaatccttccaaatccctggaccttgatgcatccatctactaaggctttgttagcacatctccagcagtgtgccagcccctgtgctgaaggatgcagatctaaaaatcaggaagttgtggctcatgctttcaggggaacttggtaagggaaagaaggcacatgtagaaaataaatgatgacttttaatccaagagaaggcatgtacaggggcagcgtagcccaaagaggtaggggtgcattggcctgtgggtgtagaggaggctccactagtggaggtgtgactttagagctcgagcctagaagcctagtgagaatgtgcccaggcgggagagaaaagctgggatgcattcctgggagcacaaaccaatgtgaggtcttccagggactcccaaacaacacacaatggctgcctggatgtcagatttctgttgctaatcagatgtaattgaactggcacttgagaaagacagttttggcagtggagagtaagctatatggattggggcttgcgaaggtggggatggcaggccaaagccagggagaccaatgaataaaccattggtggtgaggacacaaaggaaataaaacgtatagattcaagagagaattctgacatggggcccactagccttggtggcttgttgggttaggggccaaaggtggtgtctcagctggcagtgacaaaggaaggctagtgaagaatacgcttctcatagctttcacaacatcttgttcccagctgccccagagaagtatagaaaccaagtcaacaaaacttactcccagcctcccgcaccaaactgtattgctgcatataaaaccctggaggcatcactggcccctggcttagaaaattggatgaaggtgagacatttcaatgaaacatactttatggtaggagagaagtgtggataatgtttggtatttcacatgataaatttgagatgcctgtggaatgtacatgcaggggtgtccagggagctttttggtaggagctcagagaaagagctaagatgaacgcactcatttgggaggaattaaagactaggccagtggttcccagccctgagtgcatcatctatggggcctttcagaatcccaatgtccaggcccacccccagaccaattatatcacaactatacagcagcatattttaagggatggaggaatagttcccagaaatcgtgctggttctctgtgagagaagaggtaactttaagtggtgccagttcatgcaggggcttgagaaaagaagtggagtgagtacaggctaaaagctgcaagtcctggaagaggaaggaatgcaatggactgatggccaaccagtgctctgaaccccatctgggataagaattgtggatctgtgtctagtctgcatatttgtgcactcattttgccccagtgtacttaccatccaacttgaggaaggagggtatggtggtatggtctgagacaacggaagggcaagaagggtttctgcagctgactttggaatccaggctggataaggaaggcacaaaagtcaagagggactgatgatccagaagaaaatcaagtaaggaggaaggattggaggctgtgctcaaagactggaatatttgaggttaagatttccaagtggtacaattatagtggatgcatgacagagagtggctgaatatgctttgaggcgaaagctgttccaattgaggtggaaagcataagtgtggagaagtatttgtttagtcttcttgtactcctttgttctagaagtctgccttggttattcccaacttccttaacataaaggctgtccaatggtgactgcaagtgttttaacacagctgtcttctatagaacgggttattattatatctgttattttaaaacacccacccttgcatcaataaatatacatgtcaaccaaattctttatattaattgacaattatttatgaaaattgcaatgccttaagtgaaaaatttgtggagccagcatcccttagaaacacctttcttgctagaaccatgtgttcttgctttgtgactgtttgcatgttttattgctaagtctgtagataacattctttcttgaagattattaattatgtatacaagtacccctgtgtaaaagtattcacttggaagagacccaggaatctaaggcaggggccagcaaactgttcctgtaaaaagccgagagtaaatattttcagctttgcagactagacaatctctgccacaactactcaactctgcttttgtaaccttaaagcaaacatacaatacatgaatgagttgtggctgtgttccaataaaactttatttacaaaaataggcagtgggctggatttggtctgagagctgtagtttgttgacccctgatctaagataataaaggactctagtggattatttttgtgggaaggtttccaagttcatattttaattgatttgacttttcagttttggcttcaataaaaccatttaaatcatagtttgttatggtgctatagaaatgaagtaacttgtaaatgatgacacatggaaggttctaactacagatgggtttgtggaaaactaataggtcacgatattctgatgtagacagtcatcaggcttgtcatcttaacttactcccttgaagactcaagtacctcctccctcatcttggagaaagtgcgtgtctgacgctacagtgtcatttccttcaaccatgtaatccataggcacaagtgaaatggtgtaattcaatgttgactagaccaatgacggtattctaaactatttccttatggaaattcagtgtcttctgggaaaactaacattagattgcaaatctgttcctagcatttagagactcctcattaataagcactttttttaatagtaaaatatggcctggccaaaaaaaatctctgacaagatgtgagactcaatgtcgttcttatgatttagaagataggctgaagtgagatatacttccctacaaataaaatagatattcctcaaaatgtcaatcgaagttatgtggtttcattgtctctgtaaagtatttacatatttgcaactaaggcctattaaatatttattattaaggttgccaccctctgaggtggtttgatgtttcagtcagggcccagaggtttttttaattttttttcatcagtcattctttggaattaaatgtgtgcacgttggtaggacagaaaaggaacggaatgtcagctttctgccaacaactcttctggctacaagagaatttctcatttttttttcttttcagtgtgagtcacatggagaatttatctgaggagggcatcaaaagaaggagtgaaaagcaattaaggagaaaaaacacagttccttacatccatgttggtccatattggaaaatgaatactgagtatcatggctggttatcaatttcttttctttctaaagcccaattactgaatttttcacttggaacatgcccagataagatggaacttattcaggctccattcttaaaaaaagataccagaagtcatgatctgcctttctcactctggacatggaaattctcatcacagtggtcagttgaggtgatttcaaggaataatacctgaagggatcctttaattcaggttgtagaacaaaagcccaaacaaatcattaacaataattaacctctcagatgtaataaattacttttcaataagttagtttattgagaaatgtaatttgaacatatataataacaacagtctgacactaacttctgtaccctctgcttgaagcaactggggaactctgactgtggtgtgatgggaagttaactttactcaacctgtgagactgggtctttcttctgaaccaaccacagggcataaggttcatgctgatgtgctttggaatgtgcatggcccatcctatctatttctctagcttctgctggctttaattcagagtttctcaacctcagcactgttgatatttgggccacatgtgacaggccatcctgtgcactgtaggatgtttaacagcatccttggcatctacccactagatgccagtagtgcccaacccctgaccctcgtcacgacaaccaaaatgtccccacacattgcccaatgtcctctgggaggcagaatcaccctggttgaaaccactgccctaataagatgttgcaaagttccagatttgatatcattgaactgatattctaaaaagcattggctacatctgcatgctgctgccctaggcttctcttgacatatttgatctcaactttgcattgagtcttggagggaaggggcaatgtgtgtaggatgtccacacatctaggtttgcctaggataatccagtttttgtctgtcatctggatgtaattattaagtagcaccaccttgaaaagtgacacagtaagagtgaaaattatctggcccccatgtggtcttggaaaatggggaagagttttaagagttcttacaatgtcagaaaacttttaccttgcagaggtttttgatgccttcctgtcctattttaagagcctgggaattcaactatttcatgcccatatggaccacatattcaagtcttcagccttaactcttaacagcttcagtttttgtccaagtaggcaaagtgagctcagacaacaaggaaaagaacagtgcttttaaaagaatgttcttctcaataaaaataaattctaaagttctaagtagggagttactgctgagtttataatggctttcatatttgcttttacaatcacagtattgctgggctcaggcttcctgcttggaaaagtgctttgcaatgcttcagacagaagagaatgattttagaacaggctgggctatgaaacaagagagttgaagaagcccgaagtggtttgaaagcagtcattcctttggtgttaaagataggggaaaaaagattgttcccccttattaaatcctgtcacatgtagacaagagtgcttgttaaagcctcgagtggacatttgcattgtgtggttctctggtgtgtacctttgctaaaataagtatgcaaaagtctccaggtagtaatatgcccttgaccctgtaatcagaatcggtctctcacctggaaatgtgaagacaagatgtttggctagtaatgaaggtaagataatcatgtgggaccacaccattcaaaaggttgtctcatgctcacaagatgaatgctatatttccagccatcatgcccatgtatcagacagaaagaataaggaagaggggagctcaaaagggcatccttgctgagacagcttcccaaaattactgaagccctcaacctaacacttgctctccaatatcgatagttttttcagccaggtatttttaccacctccttcagtattatcttaccaatgaatgacaggagaatggatattgggtagacaattagcaagctctggtatatagcccaacttttgctaatgtttaaaagtcaaaaccacacaaatcttctaaaccagtggtcaacattcgctgcctgtggactaaattcagcccgctgactgttttggtaaataaagttttattgggacacaaccacaccccttcatttacatatggtctgtggctgcttttgtgctgtcaaacagaatagttgtgacacagactgtatatatgacctccgaagtctaaaatgtggtctctctggccctttatagggaaatgttgccaacctctgttctaaacagataactcaatgaaaaaaatgggcagaagacatgaacagacactttacaaagaggatatccaaagaccaataagcacatgaacaggtgttccaactcattagtcaccaggaaatatttttttttttttggttttcttttttgttttgttttgtttgagacggagtctcgctctgtcacccaggctggagtgcggtggcacaatctcagctcactgcaagttctgcctcccaggttcatgccattctcctgcctcagcctcccgagtagctgagactgcaggtgcctgccaccatgaccggctaattttttgtatttttagtagagatgaggtttcaccatgttagccaggatggtctcgatctcctgacctcgtgatccacccacttcggcctcccaaagtactgggattacaggcgtgagccaccgcacctggtaggaaatgttaatttaaaccacagtgggatggcactgctttcccatcagaatggctataatcaagaaataaagagagagctgacaatatcaagcattgcattaatatgggacaactggaactcttgtacattgctggtggcactgtgggttggtataaagactttgagaagctgttgggcagtgtctactaaagtagaacatatgtccccctctgtgatggagccattccactctcaggtatacgcccaacagaaatgcctacgtatattcaccaaaagggatggaccagaatgttcacgttggcactatttattaataatccaaagttggtaacaaccaaaatgtctatcaacaatagaaaagggaaaactgtgttttattcatatgatggaatacttttagcgatgaagaggagtctcgctacctgctacaacatataatattgacaagagaaaccagacaaaaaagactgattctgtggccttaaagttcagaaacaggcaaacagatcaatggtgtttgaagtcagaatatggttccttttaggggtagagatcaggagaggactcttcatgatttgggtggtcgttatacagggggttcactttggcaaaatgcagagttgtacacttatgagttcagaatttttctgcttatatattgtatttcaataaagagtttcaaaaacagaaaaaagaatgcacatctctttaatgatagaaatgtatcagcattgctctcagccagttttctattgaaaatgatgcctatgacatgtccctcatgaaacaaccacataattagccctggccctttggattctagtcttattcacaaatggaataaattttctgttttcagatttttgcatttgactacgtctaccctgacagtgtgactgactaggtggtctcagctccacacaccccatggcaaaaataaaaaggttgtgtctaaactgcagtggattaacccactgagcagactgcgtgctcctgggctttcttgccaaaggagagagcaaaggatgcaaagaagctgaatgtggaatttatggaccctaagaaggcaatttggaaggattttttcccccgtttctgtttagtcttaacttcgtgaaattgtaaagaagtgctggagactgggggagctgtttgtatgcaaagtgttgtctgcctcagttgtgctcctgaattttgactggctgcccagtcttatgtgggaagctgaataaaatgtgtatacttctaaaaaaaatcaattttagattttacaaaaggagtcaaatattattactcccaaaggaagaattgaggcagttttttttttttttaagaagagggtcagaagaaacagccaggtcttttttaaaaatcacccatattttttggctgacatattcagttaaatttgtcccctctcattgatgccggtggggagttataaaggaaagaaaaatattaaatgctaaaaatgaatagaagggatgtaataatccaagaattagggcaattgatgacaattttttaaagacactgctgtaaatgaaatttaaataactgtaaagctagatattcaatccaatagttatatacataagatgtactagttattgtttcataattatccagaatctttcatttaaaaatatcattttatgtttcttagactgtatatgtgtatatgttacgtatatgtgtgtatatatatttcaaatacatatgtgtagaaattcatgagatttttttttaagttaccatcctccaaaggaaaaaaaaaaaacctggcaagtgatgagaaggaattggagctgtgtacaagaatcttagaagatttaggtgatctcaatgcagcctcccaggtctcgtgtagcacctaaaaggatcattttttaaaaagaaatccaaatattagtttaggagaaaacacagaaaatctcatgactctcgattttgtgaaaattaaaatctgacagtagaaagcaaagtggcatggcccctgtgcttgggttaccgctgcttcccaaggggctccttagggaaataacttccctgttccttctcttttttacttggcagtcccaggaggacagttgagttgggggactaggggcattggaacaagtgtgtccttgccaggctcctgtggttggctgctagttgggcttctcactttgtgaaccaaaacgtttggagagtcttgtcttaggaaaagcaaattattctgccccgtgatgtcccttcagtgtggaaacatcaaggagatagatctcactgataacagagttgatcaggggagagtatgcaaagacaagacccaattatcaaagcacagcctttttaaagggttttgagtagattgcacttgttttggtgagaaaccaaattagagagttctgcctcctaaactctacatagactaatgtgttcttgggaagcacccctgctctgggagtcgcatttacctcttggtcatactgaattccttcgtaggagggcctttgatatatttattctgtaaccaaaaatggcagccctgagattggagagcatccctttgatttcctgtggactgtccttttctggagatatggtttgttctttcctaagggtcggaattatgattctgaaaagttttgcttttgaaatactacatcacagtgtcctaatgagaatggtgagccatctgcagcattcagcacttgggcatggcaatcaaatctgggcccgatgaatgattatgttatataaatcaccaggttcctccaggcagcagtcattgccattgtaattgattcctgatgagactgtttcttgatttgctggtgctgtaaccactgatgctgattgttctcatctcctgaaattgtatttagtaacagcattcaacaaatattactcaagtggttattgtatatgggaccaggctctggggttaaaaaatgagtatggcagccctgtctttgaggagacaagtgtttcaggaggaaacagacaagatgagcatcctaacagaggtacgaacaggaagctagcaaagctcctattggagggtggtgaggtgaatcggggaatgtccctccagaaaatccagagaggctaatgggagttacacaggcaaaggagaaatggaagggaggtgacagaggaagtagagcattataggtggagggaaatttctccttgaaaacaaaggaatcacattcaatgtgtgacctagaatttcagtgggcatctcctctggcaagaaattgagtagaaggatggctgcattttggaatgttcaaagtgtggagaggatgctatgtgtactgtagtaagtgcaaaacaatgggttggatttttaaaaattttatgtacacacatatttatctatatagtatgacgtgacatagaagttacagcctgttgaaaagtttatgccataaaaataacaattcgagttcacttcctgtgagtggcctagggtttttaagacaaggaagaataataggatgtcaagggccaaatatagacatggatgttttagaatcctttgcttttctgatctcagagcatgtggcatttggtgtaattgaatccaggacagatgggtgcaagccccattcaactttggagggaaaccaattaacaagcatgtgtccaaatgtaggattaaacttgcaaggcaagcgagtggcttccaataacacttaggaaacactaattagtgagagggaaatactttgtcaaatggtttgagaatagtaaatacaaatgcaacaagggaacattgtttttagttacaatttatattgttctagaagaaatggggctgcaggtgctttctacagacaaaatgaatcccaaatacatttacctaaggcttctagaaataatacaaatgtgtctttaaaagctcagatacataaagcagtagcatccaatttggaagtcctcttgatctaagcagtctggtttctctttggtaagttgcctgtttccagactataaatgaaacaaaataatcactatgttaatagagatgaatatatggaagataatttttttttcttttgggcttataaaactccaggagggaaaagatgaaagccaaaagtagaaaaagattcaaaggaaacaaattgcaattttagttttctaaatcaggggtgggtgaacattttctgcaaaaggccagatattttaggtttagtgaacatgcagttggtctctggcaactgctcacctctgctggtgtagtgagaaagcagtcatagacaagtaagtaaacgaatgggtgtgactatgttccaagaagactttatttatggatgttgaaatttgtatttcatgtaattttcatttcataaaatgttattcctttaattttttccaaccacttaaaaatgtaaaaacaattttactcaccctgtgctagatctgagacaattatctccccacaggtttgttctgttagaaagtccttggttgaaaagcaacatgctttccttttaaagttttcataaatttattaaataatgatgttttcccccactggtgttttcctaggtttttctagaatgctctgtgctctcgtaacactttctaacatctgttgtcatcatgcatttattaagcactcaccatgaactgaaatgctgaggacagacgtcagaggaaaagaaaatattagcaatagaaagtggtacagaagctcctctatttatggaatttcaactcgtgcactttcagagatacaaacaaaaccatactctggagcaaagccctctggctctctcttcaccaccaaaatatgcgtcaagaggttctgggacctcttttattttctgccctttttaaaaagaatttctcatttttcagtctatggaatatttgctgtctttctgctaggtgttgaggaattttgccaggaaccccatcttatgtgataacctcagaggacttgaaagaagaaagtgctagtaagaagtagtagaagtaaaggcaagatagaaacaatttctttttaattgaaataggtcagaaaaactgttgtaagccctttggcaggaagaatgattttgaggacaaagatcccatcatacaacctgagagaagctctgtacttgtgtaataatagcaaacattgatacagagcttctatgtgcctggctgtgttttaagtgattacacgatcacatgagtgtgcatgtacactaatttaatcaccaccaaaaaagtgttaatcaactaatgagctcacgaaatgattgatgaaacagtgaaatttgaacgtggctccggaattagcatcgtaggcctatttgtgttaatttaagagaaggaaacaaatctggtaagtgtacccggtcatggatggttccatgggtttgcagcttttggcatctgcccaaccttaaagtaagaggcagaacagcaatgctattttggagtaatattacggatgctaaagctgttgaggaattccctgtggtgcttgtgggcagattacccatttcagaagattttcggtgtatgaaatgaaacagatcgaatgtaggcaaagatgtcagtcaaagcatttatcagtaaggaggagtacgaaaagaccgactcatacctcacccaggtggaaatctggaggttgcaagcttctaccctgttcaagacctctggacgtaggaacaaggtcatacatagcctttagagcttaacatgtattcaaccaaaaagcacagtggactctgtctgtgctctgcccggaatatctcagatcttttaccagttctgtgtgcctgtcccattcaccagcttctgtgtagttttgcttctaatgaccaacatctgtgagcactctgtggggttctggagcagttgccctatattcacaaagagcaggaagtgcctgggagtttacatcaccctgggggcggggcgtcccacagcccatgactgactgatgtgtgtgaaaatattaaagtccaaattctttggcgaaggcgggacaaagtttagatgtaattaataccccagagcttccctcaggaccagactgagactgggactttgctagaaatcacacccttacttggctttattcccttccctaccctgttatgctcaccccttaccagtttctcctgggaacaggttcttaataaatcaattgcacatcagtctttatcttagtatctgcttctgaggaactctacctaaagcaacaagcacatatattattaagacagagaaatatcgtaaggctttaccttaagtcagcaatgaaatattgaatgaaagaatggactgaatgaattgatagaagccagctttgcactactcatgttgcagttagggaaacagaaaaaggataaaatattgaaacagtgactgttacattttagagtttgaagggcgtatagtgagactgcccacatagtgcagcctctctggctgatggtaatctaggttcagcttacatatggccagggaagaagatactaccacctcctgggactgttgccttccatctagatttgttataaagtcagtccttccttcctctttccctttctccctccctccctttcttccttccttatttccttccttctactttatggaggtaaaattcacatgccatacaagtcattcatttaaagtgaacaattccttggtctttaacatattcaaagttgggtaaccactattaacataaatttcagaacattttcatcaccctgtaaagaaacactgtaccctttagctatccccccctcaactcctcaacccccaagctctgcagtcctaggcaacccgacatctactctgtggatttgcttattcttgacattttgtataaatgaaataatataatatgtggtcttttgtgactgacttctttcaattagcttacaattttcgaggttcatctacgttttatcagtatttcattccttttaatggccaagtaatctttcattgtatggatagatcatattttgtttattcattcatcagttgatggaaatttggtttgtttgtaccttttggccattatgaataattctaccataaacatatgtatacaagtttttgtggacatatgttttcatttctcttggctatatacctaggagtagaattgctaagtcagatacagaaagttctttcttatattcagacaaaatctgagtctccttaacttccacacttggtacttatccagctttctgaagaaatatggacaagactttcttatgtatgacatcccctcaaattattcatcatctttatgtcctccttcaactttcaaagactgaatatcttctgttctttcaatcattccactgcaaaaatgggacttacagaaatgcaaactgatagctttgaggttgtcatattatctgttataatgtacaaaacagctttcttttgttccaaatctcagactttcccatcaacaacagggaacaagtggctaagtttattttgctaagataagagaaaacaaattattttctgggtaagaaggcttttcgatagactctgcatgggttttccctttggaaaatcaagaggactaatgatttgtgtagtttatgtatacatttgtcatttcttgacatgttaatgtgagaaaaaattttgtgcttctgaaaaataaaattggatggaaatcaattatcttaagagctttaaaagaaatcacgtgtagcattctttttattcttagtcatgaagacaatggggagaaaacttgacaaaaccacaggaaaatgtagcaagttacttagcaggctctgggttgtgctgaactgggccaaatgttatggtcatttcttcttctgtagctatgaatggatctaatccttgcttgttagtcatacacttaggactattttccaccttcttttaacattaaatccagagctcaggatggcttctgactttgtctcatgctatctgcatgacgttggacaaatcacccggcctttatgagtttcagtttctgcatcatactaccactacatcagtggctttcaaactgtgttgcacgggataacaaccaaagaatctcactaaaaatgtcaatggtgtggtgctgcaaggaattgtgcaagtaggctctggggaggtcctcaaaatctatttttaaaaacccacccaagtgatgctgatgcccatggtcctgaagaccataccttcaaaaacactgactagccatttccttctggtccctcttcctcttgttctgtattccactgaaagggagaagaaatcttattatctttccaggtaatatcttttcatctgtgctgtgtgcaaggacatgaaggaagacaactaaagttgaaataatgaaaaaagtcccagtctgatgcttagattctgatttattagaattattttgaccataacaattttaaccataaagtagggtttcttaaccttggtactattgacatttgggaccagatcattctttgccttgtgtgtgggaggctgtcctgtgcattgtaggaagttgagcagcatatctggcctctacctagtagataccagtagcatctccccctccctccaagttacagcaaccagatatgcctccagatattgtcaaatgcaccctaaggggcaaatctgcccctggctgagaaccaccttcataaggcatggtccccaaagaaaataatcaagaaattaggcttggagcagttttcttcggttggttcttactgcacagcaaggcaaagaaggccctgctaaactgttggttcttgacctttatgtaccaagcattcctgggggatctggaactccctggctcatcctctctatttgctggattaatgggatacagacagtttaagtgacttggcaggagaaggacattctgttttattctcctcattttattacactcctgacaacgaattcttaacatttgccttatatgttctgctccctatcattatcacaagatagattagttggcggggggaggggagggaaaccaatatatgcaaaattgctttgaaacctgcaggcaccagagtaatgccaggtgtcatcattcatcctactcctgagcctctgaagccaggggtttcttgaggttataaaagtggtttttttaggggggtgactagtcaagcactccaaagaactccagagtggtcagttttgatcacacagatggccaatttttacccagtctgttagccttttaacaacacacagtgttgcgtggagacccacttgtgtatgggtcttcaacgatgggtggagacccagggctcagctctactcttctgctctggagaactttctctttgttttcttgggtggtgcaagacctacttcactgaaagaaaatgtgttgttggtgtgagaggtactgctaagtggaaattattaaaggatgaattccttatgtctgtgaaagatttctccgccttggcactctagacatttgggaccagaactttctttgttgtgaaggccgtcctgtgcagtgcaggatgtttagcagcatctctggtctccacccactggatgcaagtgacacccttcccctgcagttgtggcagccaaagatagcttcagatattgccaagtttctcctcagtggcaaaatttcccctgttgagaatcactggcctaggaggtgtggatgggacaccagcaatctaatgaatgggcctgatttgtcaaaaagaatctccaccttgaaacatactggaatgacctgcaaagagattggggtcaactaccatttacatctcaactccaccatttattaggtatgcaaaacaggttaattaacctcataaataaaattaagatagtcatactttccttcccagttgttctgaggatccagatgtttgcaaagcatctagttgagcctgtgatgtaggtgcttaatgaatagtggaattgttaccatttcaaacaataattctagcacctgcggtgttggcgttgtcatgggaattctgcaggctttagacaactgaaacactgtgcaactgtgcagaagaaaggagattatgatcagaggaatgaaggcaatagactaacattagattatggatataaatgaaaaatcatttcttaattcccaaatggttatttggaaagtcgtagctggagaaattgcggcctctcctttttgcctaatgacccttgaatagaacatatatattagaaatgtctctttttaggcactttttaaggataccctccctggctctgtggcatggagtagaaattcttcagtgaaaatatcaaaacggcaaaaaacaagataaaccaataataccaaatagaacctactgtaatggtcatttatttcctcacccttcctcacttgttttctttccctgaattctcggattatcatattctcgactccaattgatgcataactttatgatattctttgtactagggtttgaggccaaagacaatggtactatgctgtgccaggatgttctcctctctcttctccatctctcctatgtgactgcagctccagctgcaggaattcctccttcactggtcttcagcccagctgtcttcaggctgggggttgtctccttaaacttacctggaaaaaggaatgagaaccttcattcttccttagatttcttctatctccatatccctggaagggttaagagggtgggaagaaattatggctatagagtaaaatgataattcctgaaatggcatatatgtttacagttatcaggctgagattttacccccactttgctgaaattctgcctaatgagatgtcctccctcaaaagcacattcagtgtatccattgctcctgtctgtgcgtgtgggtgaagtcggccttatcactgccaatgccagggccttagcagggctggtaggtccttcacttacaggagacacatgatttcagccaaggagggccttaagctgctactccagctctcctttctgatcctggagtttgatttccttaatttcatctttgtagccccatgaaaaagacttaaaaaagagacaactctaaactgtgttcagtcttcatataaactgtgttcagtctgtttatacaatagtgtaaataaagattctaattaatacagtttggaaaactgttaggcattgtctagtaaagttgaagatatgcatgcctatgacccagcaattatattcctgggtttggaccctataaaaatgcatgcacatatgcacaaggagatatgtataatgatgttcaagcagtgtggttttcagtggtccaagattgaaaaggacataaatgtccatcaacagttacaaagataaatagtaataaacacatataatggagtactagacagcaattggaatgaacaaacaacagctacatacagcaaacatggatgaacctcagaaacggaatgttgagcaaaagaagtcagctataataaaaacatacttatgaatctgtttacataaagttaggaaacaggcaacactaagctctaatatttatggatgcctgacttcctaaaaggcagtggatttcaaccaggggtgattatgcctttccccactccctgggggacatctgcaatatctagagtcatctttggttgccacaattggcgtagggggaataatactggcatgtagtgggtagaggctggggatgatgcaaaacattctgcaatgtccagcctctaccataaagaatgattggttcccaaatgtcaagagtgctggggttgagaaaccctgctgtaaaagggaagtgaagaagtgaagtcatgacagtgtctaccactgggatggaggagggaaatacagccaagggacatgggggtctagggtactagcaatattttaatttttgacctcagtgaaggttagacaggtgaatgttttgtaacaattcattaagctgcacattatatgctattgatttttccatttcaaaatgttaaaaatactccaggggctagattaacaggacaataggatggcatagtgtgggcactgggtttgggggaggggattccccatcttagagggtctcatagtaactctgttaacaatggtggggctgggccttcaagaagggcctgtcctgccatctgaagtgatttttagtactcagatgggccctcagctcttcctacactctgaagttgaatttgcttccacagatttgggtaaagtttttctgaaaaaagtaatcacccttgcattggcattaactgtggaaaattttaactcagcctataggcaggcagaataaatgcaaacaagtattttaatttaaatgctctggcagaaagggcagcattcagttctggaaatgctgtaatgtttagggacaggaagacatggaaattccacagttagcagggcacgttttctcttaaaggtgatgctagtagagtaactcatacagattatttttaagtcctctctggggtgaatgataaacatcagataaatttattattttttaaaaaagaaaaacaaacaaaaaagaacattagcctagcaggctcttaaccaacaaattggatgaacttcagcctcctctgaagtgaggttttatgtgcttcttgctgcctttttatctctctccattaccccaaaggatcaaatgtgcattttaaaaccacatgccatgtcaatatacagtttagttgacctagaacaatacctgtgcatagtatgcacttaaaaatatttataaagtgtggaatgatagacaatggacactcagaagggcagtggggtggatgatggtgaattacttaatgggcacaatgtacattcttctggtgatggataccctaaaagccctgacttcatcaccacacaatctatccatgtaatgaaattacactgttaccccatacatttatacaaattaaaatttaaaatttaaaataatatttgttgaataatgaccaagtgaacaaataacatgggaaggatacttggaagtagagatatgcaaataagaaattttgattagagtggtgttttaaatataccctgaaatatatttaaatgaaataatgaataatgtgtgaaattcaaattgtttaagattgaacagacttcttagagttctgcatgatcttctagatcctttctggagctttgagccttacacaattggactaagaattgaaggaggtggatgattcattccaaggtgatttaagagtcttgcagcatgaactgatcatttctttaggtgctttgcccaatctcacaaactcttcaaacacagagaaaaaacaatcctattgcacttgaacattttactccaacttagctatgacactttagcaataaataatgctagaaggcagaagtcattcctaaaatgtaagtacacagtgtggggctgatggagtatttttggcttacaagaatgtcatttagtgacttactacatttttgaaagaaagaatacaaaccaaatccaggatgacccagttttaagaggtgacttactcaggggtaatgatcaaaaggctatggttaaggttttaagacccagggatccaccttgtgttgtttaaatatattcataattaaatagtatttgtagggaaagggatttttagcttcaggggcttaaaggcaagcgtgatggaagaaaaagtcctaaggctggagtgttcacctttatgaatagaccacagtgaagtgaaagtccctaaactggggcttgtctaggccattgaattacatctgtacacacgtgcccccatcaggctgccctggctgcaattctctgaaagatgccagatggtgaagctcaagctggttctctgtcttattctgaggatctttgatgactttgctctaaaggttgcttttagcagcagaacagagtgagagtaaagagggaactttagtgtgtcatttttcgagctctgcctggacatgtcacagagcaaggaaggcctccaaggtcaatgggcatgctcatttctcctacaaagcagaagaaaggagacttgggtagatcaggctgtgggagaatgaaagacttgggcaaatagttcaattgactttctcataagacaggcaacactgtttggaagttcctgggtttggcaagggattgattttaaatttatttttatttttattttttatttttgcagtataaaatacatgtagtgaagggtgtaaattacactagtctgaactgtactgcacagtgaatgtttacatatgggtgtactctagtagctgccatacagatcaagatatagatcatttccagcaccctagaaggttcccttgtaccaccttcctagtcaataccaccttcccactttggtaaccactgttatgacacctattaccatggattccatttgcctattgcacttaaacatttgaatttcagttgcagaataaataagtgaaatcttacagtatgtacacttgtgtctgatttctttctcccaacataatgtttgtgagattaatccatttgttctgtgcatcagtagcattttcctttttattgctgaatagtattccatcatgtgcacagactacagttggtttgtcatgcatcagttggtgtacatttggatcgcttttatttggggcaattatgcctcaacacagtatgagcattctggtatatgatgagattattgtactctgtatatctaggggtggaatttgctggattggaaggtaggcctatgattgactttagcagatataaccatccagttttccaggtggataaactgtcatgggactatctaatggtagattcctcaggccacttgcacccctggcttcacattcccactgctaattataattatgctgtgattgttttaaaatattacatgccagtggatggttcattcaactaaattgtaagggctgaaattccggggccacatccaactttcctcccctctcctcccctctcctcttacacagagcaagtggagagtcattcagccggttcagtacagtgggaccctgacaaactggcacaagctacccccaagcacatcttccactttgtagccacccctctggggcttgcattgattgattcatgagtctggagtctctactctggccccaggcctggccttcctctgggctcaacttgtgggaggctggacgtaaattacagaaggacaaggctgtggagggaactcgctgatcttctccaaggtgttttaaagtgcaggtttccatgaggggatttcagagcagaggccagttttaagggttattgtgaacctacagaatgtgccctgcaagcccccctggaactcgggtcaccctaagtgaccagcatcctgggcagccttgtccccgcagcagttctcctgggtagcatgacttggttcctctcagtcctgccctccccaagggtccccacaatttgagactctcacagaagaaggctttctagaaagggaaactctgccctcccaggagaaggctctgaatctccttccactgtcaggcccacacctccttcaaagttagtgaaagtctctctttcttggaaacccaagttcgccttctcgctggcattaaaggctttggcagtccccgcctcagcagccggggtcccacgggtccggggagggtggggtggcaggaggcaggcgtgccggccagcctgacacctgtcgtgggcgcgttcggcctccgcagcccccaacagctgtcagcggcggcggccgccggagggacccgccaggagcggaaggaattaaacgcccgcccatcgcatcagactcggccgctccctcctcctcctcctcctcctcctcctcctcctcctcctcctcctcctcttccccctcccccttcgcgccgctgccttctccaggtccccaccggctccgcagcggcagcgggacgctgtgccaggggcgctttgcacagcactcggcacgcacggagcagggctcgcgcccaggggctgccccaggatggcagtgaagtgcggggaactcagagagacaccgtgaccccaggctgagcccaaggcgcgccactcctcccggaggcgacatggggcacccggtgtaccgcggcgagaagccccagctgcactacgcggtgagtgtcctgacgcgtgcagaggacacagggggcgccactgggccgctccgggtggggactgcgaggggcgatggtagtcggggctccccacaggtccacggctgagggggtggcgggtggccgggtacgtcaccccgaagtgccacctgctcactaactcagtggcgcttcccgaaatcttttagaaggtacaggggagccccaaccctgaattcagtgtttctttgccccaacgctgtggtcactgcatctgggacggggctggactccgccaccacctcgctgacaaaggctgacaaatggggttcctggggttaggcctaggtcgctcattcagccttcagtcagatatgttgaaaggacgagaataagactggacaggaggcagggccgcttcatgatctcagtgtgcggcgagtggatttgctgaagaaatgctgccgggagcgttggggtgcagccgtttcactccttagaaagggagtgcatttccctcctactttgtggcgggacagaatgttgcacattatcattaatgttgcacgctaatacaagagaataccaggggctcttctgtcgtaccttccccctcccttatggtggcttctgttctccctgttgatacaaagatttactggggacctactgtgtgccagggactgcgctaggtgctgcaggtactgcaggaaacacaacagagagaaagctcatgggatttgccttctttgaagaaggagtcaagattttaaggttaacgaccgaccaaatccagatactagatgagtatattctttgagagagagaaaagaaaggaaagaaggaaaaaaggaaagttgtttctgaggaatgactactacttctgaagatttcaaatgccccctccaggaagggggcagggagaaggtttaccttattccagtcttcagacattgattttccacgtgtgagatgtgtcgttttgagatgagacactgcagttgttctgtcatctgctaatttactgagttttccttgaattgatttgcactgttgagactggacgttctgactgccaactttaaaaattggagagaagcaggcagagagttgacaagaatcattaatatttataatcaggcaaagacagttaactgtctggaattcgtgtcttccaaaatccagtccccaacataaaaaaaaaaaaaattgtttttttgaagaaaggagtagaggtggacaggggtggtggactcaggcatcccggagctgctccagttggttcctggtgtcacctcggggctcctggattaattgcagggccattgggcaaattgcacacctcgtacacttcgctttcctccactggaaaaatgaagacctgaattaggaaattgttaagataccttcccaggcaaacgttccaggaacctgtaacagctctttctctggtttttctatagttacttgtcttgaaacaccaaatgagatacttgtaagttactaatgctcgttcatctgtcttggagacaccggtggctcagtgatttgccttttaaagtagtttaaagggtaaccacttttcaacagaggttgctttacactgaaggaagtagagtctgtgctcattgtgcccattcaacatctccaccccaccacctttttgaactgtgtgctggtaccctttgattcatgatctgaggtctttgccatttgcaagagtgcgggtgggggaggaaaggtgagaacgggctccttaattttaaaaaaatctattcattcaatgaatggttattgcctcaattatgtaaatatattacaaaaatattttaaaattgtcatttaattaggctgtctgattcttctaaaatcataaactgaagagtcaagccgatgctaatgtcccctcttggggctctgaagactgctgatgaaatagccctttattctagtacagattatcatgtatgtatattctggtttaagactataaaaaggaagattccagagggaatttgttgggattccaggttggaataagtcacccgggctctctgaagtttcctatgcatactttaggatgagaaagcagcagctctgaatcagtcacgtgtccagagaatgttctttattaagtgcgacccattgtttttcatattagtataacccttggtggtataatatctattctaacgctgcacttttgtttacttccctcatttgggttttgataattccagagcttgttttgccgtttagcacaaatattccacttactttgctcaacagggttttgtcccactgtgcattttcctgtgatcttgggttttttttgggtctgtcttccttgacatgaatgaccctccatgtgtccttaatacctcctgcctcctctgaaatataattcggggataagtatgtaatgctcttccttcagtgctttttcgtttgtccaaggtgagactgcatataagaggtcagtggctcacatttgattcattcaataaacatttgttgaatgcctgttgtgttccaggtatttggtcaattttccaaagagacagttagatagtgaaaatgttaggagttgctatggacatctcactcatctttttaaatggtcataatggtcacagagagcaaaatgcaattaactagacaagaacatcctccatttacataaacagacattttcaaagtataatacaactgtcttcttgctttatcatcacacacagaaaataatgtgtgttagcagctaatgttctcctcaaaaaatttcctcctacagttttcccacgttcagattatggtgactccgtccttccagctgggtgttgtccttgatgccttttggtgactgaatcagatttacattttgaaatgatcccagtatggagtgaggatgaggaggagctagagtgcatcctggtatttgggcctgggagagattcgagaagatgactgatgctagggtggcagctgggtaggaggttgagagcagttggcatattggagagatgcttagaacatagaacctgtcagacttagtttggatgggataaagaggtgatagagtatgaaggatgaggatgacatgaatgaatcaatgattttctggcagcatttctagagaagctcttgaagtttatataataagcaaatagtcataatgatatttccctccttgttactgtcttatacagattgcaaaatatttgaacacagtctaggtcaatttcagtctgaaatccaattgctgccttatgcaggttttctgtttcctgattgaagaaatctaagctcagaacagtagaattcaaggcagcacatgtgtcgctgctgacagaactgagagctttatccaggtgccctgatcctgcagtgctcttctgagtcatttagacaatgaggatagtcgaacctaatcatccctctgcgatccactttgccacagtaataaaccaacaaccaaatgttggaccttcagtgacttaatgtgactatctgtattgtcaaattgcatggccaaatagcttttaaatttgactagtgtagacaaaaactaaaaatttaagtatccattaagttcaatgcaatatctttatgtctttctgaaagacactaaaaaaaatctggattaaaagcttggccttgtgacttactggggaccttaggaggctcaagctcttctctcctggtgccccaacctgtctttaccctcaagtggggcagagaaaagcaaatcagtgtccattatacagtcaccatcaggaatccctggactgacatcattcatttctctctcgctggcaggttgaaaacttgctgggagtagtactatgtgtgtcttgtccctgctgtcacctggacacctagcagagtgctggaagcacagtaggtgctcagtagaaatgtgttgaatgacttcatgaatctagtagttgagacctagtttttgaggtcctaagctgctcattctccttccttgtactggtctagtctgagctcctctgctgctgatgtcacttcctgtttggtgtggtcactgcaccatctgtgcttttgaccacagccttgtaatcagatgctgactctgcccttgctccagttaaccccttcctaaggaactcaccagaagtgccaagctgcttaccctgacagagaacctgttttcacatagaatggaaactatgaaagtttccacgtttgttctctatgaacattcaattttcaaagactttgaagtcattaagtttgcttaataattgagtggtattgaatacaggatactctctggtaattctgaagatgcccagaactgggcgccgttgcaggcctatgctgatatgaatcagttatcatccatcggtgctaacagtgtagacatcttaggaaactcagcagaacttatactgacctgtggcatggcccagaacttacttttataaaaccatttttatattactctggttgtcatttgtctcctcataaaagcaaaattttttcaacttacaaatatgtgagagattattgaatcctcttaattgacacctctactaattgtagataccttttctactcccacccccaacctggcatgcttacttttctgctgcatgcagaaattttcctggatgaggcctctttggtgtggaagccccatcatcttaggaagctacatctcccctccttcaaaccactcattaagtaccactactaattgataaaaaatcagattcctgttggatgttgcatagcagacatctctgccaatcatttgaaaacaattaccaccctttgcctagtcctttctggtgatgaacttttattatttacttttcctgttcccacattgtgataaccctggaccacacacacatgactctcaacttggttgtgaaattattgtccagtcatacaaagtcttcattgggttcttgattcctcacttccctgtcacctgtttcattctcagactttcccatctcagtgagtggttggctgtccctatggccagtgcaatctttttaaaaggtaatgaaatagtgacatttcagtgcttaagctctttggttggtttccattccacttagaataatagcttcatccatgaccttgaccttccaagtgctccttacatggtcttctctgcctcataccacaccccactccacaagcttatcattgcctggccacatctgtgccctttctgttcctcaaatgcgaccagttcttttctgccccaagcctttgtacttgctgtcccttctgcctggaatgtcctctgtgtgataggctttttttttttacatccttcaaattgcaggaaaaatgtcgcctttcctgactgctttctctgaagtgtttctgagcccactcagttaccctggatcatatcacactagccacttccctcattgttcacatcaccacttggtattatattatatattcattgtttgtctgtctcctctgactagtgtgtaagtttattcagggcaaggacccaatgatcctttcccactgtctttccactgccttagagcaggtcctggcacagggtaggcatacaataaatatttatgagaacatgaatctggctgcctgtgtatttttccctaggttacgctaggactttccaaacttaaccctttattagttgatgattgaggtcagagggagagacgagactaaaaattagctttccagtttcactgaattcttactaaacgagaatctctaaggaccagacttggaatcaatcctttgaaaaagctttgggggtggttccaatatcagctgggtttggcaaacactgattaatttacacggtgaaccacttactactcaagcagcccctacaaaatgtaggattcagcagcaaagtagattcagaaagtgcaatacaatacttcacctcagctgactctgaggtaatctagtacaagttttcagagcagtcctttgttttaccacccagtgttcatttcagccaaactctctaatgatacaaaaggtataggaatacttcctctatataatgtcatctggcaatatgtccctcggtatccatattctaggtaaaatcgaccagtggttctgaaccagaggaccctgggcaatgtctggaggcacttttggttatcataactggcaggggttgccacaggcatctattaagtagagacctgacatgttgctgaacatcctacaaagcacaacacaacccaacaaggagttgtccagcctcaaatgtcaatagtgctgagacagagaaaccctgacttaattgtatctcagtagatatcaaaatcttaaatgtttttgagaacaattttgtatggcactttctaaaatacattattcgtagtttcttgggttttcagagatagaggtgagaaaatgtgagtgagcttccctggctgtgagtcacagttatgaacagtgtgtttcatactgtgtggggattactctggagagggtgttggtggtccttccagaagcctcagcatcttgggctttttgtttcttcactcctcaatgccaaagcccttcctaatcttgggttaaaaaaatgtttactgtcttctctctcatgtcagacattagctaacttcttcctttatgaccgtctaacagccttgcctaatttgccacctctcttctgatttagccagaatacccgtttaacaaatgtgttaatcgtgggcctaaaattagaagttataatctccaaatgaggatgtgtggagtgctcagcagccttggtgtgtggatgtgggatctgcatctgtatgaaagtgagaaactagagtgcctgcttctgtccctactccttgaggataatgacacagaccggcctgctctggggaaaagggaagagttgctgaaagaaaagccaaaggaaagagggagggaaacagtggctcccagcgtttctctctcaatcacatcagggttcaaaatctcctgagcagcccagggtggcaggcgggtttgtggcctacctgttctcccattgaattgcagagcccgttcttaactcctggccatgtcactgcatgtccattagcatggtctgttttagattgtgagttacgagatgatggggagggtggggatagatttaacggtcttgggtgcttgccacattttggactgagaccactgtttacaaacacaattaattaatttaatatcttttaatgtactttctgttctcaggttttctcattctaaccttattttcaaaagaccaatttttctgatttattttattcttaaatataccctgaatacttaaaaacgtaaaggtagatccagtgatgcaacaaggactcccaccagtcattatgtggtactgctttcactatctttgtggtgactacttggatgtgaatatgggatacttttcaatacaagaaacatatacaaaatataagccaaattttttcattcaaatacagttactgttactgaagactcttccacttccaatttccttgaaagatgccatgactctttcaaatgaaaacctgtcaggcttgttctcctcttctcttcggatacttgtcattttcttagaacttttctaacataaaaaaaaatcttatagtaaaatttgagtgtttgggatgtcagctaaattagatttctgaaataacaattttagaagaatttggagttgtggctttagagaaaagttgccatggcaacagcaacagaagtagtttagatgaataaacttttaacatatttttgaatgacccctttctgcagttgactgaaatatctggtaaagaaatgtataagccagtccaagtgcaatacagaggctaaaagcatctcagcactttgtggagcacgtgggctccatatttgccaagcatctctgtgccaggtgggtgcctctccacatgggcacaaatccctggacattgctctaggttcctagcttggtgatgccatgttaattagacccacagatgaataatagattagcaagggtatggaacattgagtttgctagaatgatttgaaaatggtaacataacacatagtattatttctgtgggtatctatgcacatgactttcaacagttccattcatgttaagatgccatttcgatggtctgagcaaaatgcaaaacacggtcttaacttttatctcaaaagttaaggcatcctcccacattagctactgattcacagtcaagggctttgtgtcgatcaggatccaaacaggaaacagataaatcactcaaaaggcttaatttgaggaatgaactacgccaatgtgttgacaggtttaaaggaaccaacggtgagtggtgaagcacccagcaattagcaacactgagaagctgttaccagggagggaccagcgttaccagagcccactgacttgcagccttggctggaagggaccctggcaatgtgtccagagaagactccagcaagggcaaaatacagagaagcagggatagactggaacagtaaatactctgacttcttggtctccctgttctccatctccttctgggcccaagcccagccaatccagtgagaccagcacagagaagggcagaacattttatttcctatttttgttgagggctggcgggagggggggtcggtgttgacaaacataaaatatcattacaagcattttcagtcttgtttggggtttgcttacatttatgaaagaccttaaattcctaagtatatagaagtctcccaaattgcttcaaatgtctctttcttccacactgtagattattttgactaccacatttaaagtactcaggtgctatgccagctccatccatacgtggtgtgcttgcttttaaggatttttatatcacaaacctattaaagcatttagtagagagtgatatattctacgtatattttgtcattaatctaatattggaaagttcattactttaaagtgccctggtctaaatttattagtatttattaatataattcaaaatatgtaaatgtattaatatagactacaattagattttttttccctctaagcccattaggatagtctaatgtaatttccttgccaaacaaagaaaaaggaagatttggtttggctttttttctggttgatgggtaaagggttttaactcttaaaattgcacatcaacacaaatggtctaacctgtgcttgactgaaaggcaattttcatttatctctgctggtcaaggaatggttgcagctaagtattgcagttaaaccgccctgtaccccagtaaattttagcagagagaaaactctcatttcaacctggactgcagaaagtacctcttattcttaagttagttcctccttgagtcttctgtgcacccactttcataaatattcatcctgcttctttggagaccatattcacaacagaaccagaaaatccaaaaggacgcagaccagaaccagggactatattgtgtgtgactcaatgcttggccatttatagcatgtgcctgatgcttagtatgtacttgagtgtcaatgaaattaatcagtgatttaaagctctcagaaatatttagtctgacttagagtaataataatagccaatatttattgaatgctctctatgagtcctgcttattctacatatattatctcacttaatccttaaaataaccctgtgagataggtcctattatcctcatttaaaagatgaggaaaccaaagctctgaccttatgtctgtttcagggccacacagctagtacgtagtggggctgggactcaaatccttgtctcttaatttgattgccaagtctgcatgcttgaatcactgtgcagtgggtgattgttgacatgccattggcttaaggtgatacctttgaggtaatactttttaaagcctttcattttgtaataattgaagacttataagaacttgcaaaaatagtactgagaggtcccatgtaccccttatctagcttctctcaatggtagcatcttatttacacaatatcaaaaccatgaagctgacattgggacaatcctattaactagactacagattctcattttaccaggtttttacatgcattcttttatgtatgtatatatgcgtgcagttctgtgcaattttattacctgtacagactggcatatccactaccgcattcaaaatacacagctggtccatcaccgcaaaagcactccccccatgctacccctttgtattcacatccaccctactcctgccctcatcctgaatctgggctaccactgaactgtctccataagatgacacattttaaattcttcctcctgttcttgctgcacggtggaaacattcctgtctccattgattatttacacccaaagcatccataaacataacagaagaaagtatggtgaattgatagggagatcagagaggattttggtgtgtccttgttgtcagcaatgcatatatatgtatgtgtatatatatatatatatatatatatatatatatatatatatatatatgtacacacccatataaagaacatcctgtttgttatttttagttgagggtttgagggttgtggtaattttataattccaacacctgtgttttcactagcaaactgcttttgattgaaacacggcagagtttatctcctgcgtaaatgcggcacactccctctttgcatggctgttctaacggcacatccatttctggaccgacaaccgcgtgactgaacttgcagcagcctggaaaaggtacatgagagctggcactctgcccttgtcagggttttccaaaagtatttacgaacaaggataaacacgagtcctgcatggatttgaggtagccatgaccgagctgggctctgggcagcacaacagttacgtaaaccttggcattcatggcacacatgcatttttattcatccatttcaaagggagtggccgttcgtagacctctcttggggaaaggtttgaaccttatcatgatgaactggttcaaaaaatccttaatagctgtttttattcaggattgctgaagagtgaaaccttatcatcgggacacagttagaaagacttcctgcatttatttggtgctcactattttaaaaaaggtgtccaaactgctgatgctgtctgattctgcaaacataggcaaacttactagatacttcacatatttcagttttaccatatgattatgacttgatatttattagaaaggaagaacattttttaaatgtagtcatactgagcccaactcttgcttttaatgcaatttaattgcattaaaattagacaggtaatgtcaccattaccacgcagatactttgtatcacccattgcaaacatctgtaaaggatcaaaggctcatgtagtgagtctaagaggaaacttggtttgagaatgaggccttccatgatatttctgtgctgccgcaggtgggggagggcacatttttatttaaggcgtcattagaaaggaatgaaatatagaactcctagcatgcatacatatatgcacatagacacacaaaatcgtactttaccttatagctgtgttgtctaaaatgtagaagtgtgtttgtatcagttagctatcaccacactaatgctgtgtgacaagctactctgacattcagtggcataaaaaaaccatcacggatcctagtggatctgtgggtcggttagggttggcttagctagacagagctcagctgtttgaccagaggccaaagtgtcaaggctcttctgtcaattctgtcccatgtgtatctatcctggggcccaggctggcagcatctacccaaagaagttcagcaatgacaaaggcacaagatggcaagtgggatcaactgaagactcttgagacgtaggcaggaatttgacacactattgtctccacccacctgctactggccacagcaagtcacatgtaaaagcctaacttcagtgtgtggggaaatgcactccttccatgatggggctgtggtaaggatgtgaagcaacgagggatgaagagatgggggaattgattcactttacctcagtgtttaatcagtttatcctgagaatgccaatacttttaagaaggtacaaatctatcctgattttctttttctgtttcgtcagtgagttctttctgtcatggatgtcaatatctatgtcatcatgacccaattaaatgacaaaagcagggttttgaggttctctcactgatatcagttcccataaatccacagtgattggagaaagactgagtagacattaagggaatatagaaatagactgaatgatattaacatttaaacagaattgcgacactcgtccctgtttccttgtgtgtagcagctctggttcctcaaactatcaaaaagaaaccattcagaatcacctccctggatactttttaaaatttatttttaattgacaattaaaaattaaatatatttatgatgtacaatatgttttgaaatatgtatgcattgtggaatggctaaattgagataatcaacatatgcattacttcacatacttattttttgtggtgagaacacttaaaatctattgtcttagcagttttgaagtatataatacattgttattaactatagtcaccatgttgaacaaggaatatgaacttactcctcctgcctaactaaaattttgtatccttgaccaacatctccctggagattttttatctgcttctttttactagtatcacttttaaaagatttctgaatttagctactgtttcaaaacctagaagaaattaaggatgaggtgatttatgaatgaaagaaaaatatattaatcctttaggccaaacacaccagaggcaacgtttggcaattaaattattaatttgatcaattttgacatgtaaatggataagctacattaaaagcaatgcacttaaagtacacacacagaatcttgtctcattgaagtttgaacaccttcaccatatcttcctctattatatcaacttgattgaacagttgccaaggcctgtttttttttccagtttgctctgtacgtgatcatatctagtagactgtctgccatattacggtagctcagttcttaaatcaggggtcaacaaactatgacccacaggccaaatccagacaactgcctgcttttgtgtctcctatgagctaagaatcagttttacatttttagatggttgaaaaaaataccaaaagaagaatatcttatgccatgtgaacattttatgaaatacagattttagtgttcataaataaagttttattagaacacagccatgtgcatttattgacatattgtctttggctgctttcacactatgatagcagagttcagtggttggttgcaatgaactgcatggcttgcaaagcctaaaatgtttactctttggccatttacagaaaaagtttgcctatctctagtctaatgctatgtctcaaattaccacagacactgtagataggtctacgttacatcagtatgaaggcaaaagaaagggacacatattgttggtatggaggggagtggtgggtatatttcagataagggcaaaatgtcagtgaacattcattgattcaccagtatatgtgcagaactgggtatgtgtatagcgctaagggaaacatttttttaaaaggttagtctccaatttttactctaaggcttcctcttgaataagaagatgcatctgcaagtatagtgtctgaaaactatttgccttgtccaatctctacatcactggaaaatgctttaaaaattttaagttaaaaatagtatatgtttcatggtttattttgcaattattctaggcagaataattttcataaacattgccattcttaccagtgcgaaagggagacttaaactcagaaaagtgtcatttactcatgggtttaaaatgctagttcttcttgtggatgtatctgagatttttatgttactgtatccagaactccctcagaggcaagaacataaagggcctccaggagctgactctaaaaacaccagtctcctgttctttaaactccgtgtggcttgctgagcgctcagccacaagagctgggggtgagccatctctgggtcctgccaatgcagccagtgttgtgccaaaggaagtagccctgtcttacactttgtgatgtttcttttggctgactcttccacattcttgtgaccctttgaatgaagacgtcttaacagctttagctctacaccatggcctcccgctatcatttcctgcaggtcttgtcttagagctcagcagcttcctgagtaaatgtcaccttggtgtcttctaagagggtctcactgaggttcaaaaaaccatggcttccaccagattgaaagcataatgtccacgagtctttgtctcactggactgtgcaggaggatgaacctggaattctttttggttttgaagcaacgagtaggtcggggcacagaacagagaaccaggaaaatgtctctgagggtggaaatcaaatgaccccagaggaggaaattccagttgaaaatagaaaccgggtcagcacccttgtgagagccacagcatcctagacttggaaagtggcaacctgtggcctgtgaaggctgctatcagaagtccatggactggcctgaaaagagtgttgtgttttatggcaatccaaattgaaacaggatttatctagcttcacagatgtggtctgctggagagttatgtggaaatgactcaatgtcatatatttgtcacattgaccaagggttatttctttagtaggaaaagacaattcgggaacaatattttcttgagaactatgatatatgcatacatgatggtggtagcttccaaattaccatggtacgaattctctccattgatggttaaggggaaaagggttattttgttgcagctgtacaatatcccttcattaattcaatgaaaagatctcaattaatgattattccttaaaatgacagatctataattaacttggaaatgcccacaatataatcatgttgctatgaaaagtgatggtttttaaactagtctaacataattccggattatctttaaagagaatttaatgtctagaaaagtttctgtagctctaaaaagctgcagaataggatgtcattttgggaagtttcccttgcttaattcagcttatgatccaaatttgaaggagaccagtagtccaggagttttgtctgcaaataaaatgaacaatatgtgttctaaagtgttttggatttttgtttttggtgggaggctggttagtcatggagcagggtagaattagtagcttttggctttaatcaggaaaatatcacatggtgttaaagtgctgtctattaattggttattataaactttaaaatgtatattatggtggagaaacttctcatttgggggactgtttttcatagcatttgtggcaacttttatttattacttaaaaattttaaacatcacaaacactgaaattctggggtagagataggattttcttaaaggagagatatatttttgatatatctttttctatctgtgtgtgaaagtgtaatgccttccagaaatccataggaacagaaaatagattagtggtttcctggggctgtggttgggaaaggagagtgactgtcagtgagccccagggatgttattgaagtgacaaaaatgttctcaaattggattgtggtgatggttatccaacgcagtaagtttacaggtgaagtttatagaatgtaaattacatctcaatgaagttgttttagagtatgagttaataagagaatcaaaaagtacttatttacaaatgaaggattaaaatcaatattatacaatcaaacttgaaatacgttagtaatggtatatatatattttttcctttctaggccacctcttagaaagttcaaaatctaataaatgaggggaaacacctttttattttttgctagttgttcaggattcagtgatctgaccaagcacccatttgtagttaagacataaacatcccactgaactagacaccagacttctaagaaactcgactttctaaaatcaaaagcaaaaacatatctgagcagccaccaggactgtctatataatttgataaaaatgttgcaaaactgaattaatagttatggttacacaatttggtacatttactaaaatatcattgaattgtacacataaaatgcataaattttatgctgtatcaattataccaaaataaagttatcttcctataaatatatgttcatttgtttatatatttatgtttattatatatgcatatataaatctaacgtaaacatataaataaatgtttatatatttcatatatatttgtatattttatatatatatatatatatatatatatatatatatatataaataatgtctgccagtgacacaggcccaatatctatattccacataatgaagtcatagcaacagggccataatcttatcttattcatcttattttgggatattttggccttaaccatgtgacactgaaatttgcttgggactgttgaaagcattccccttgtttaaagaggttctactaaaaacaacttttcacccatttttttgtttgtttgtttctctctttttattttttctagcacagtggtaacaccctattcccactttaacttcttttccttccttcttttttgaaaattttctaacttgtatttataattctcttgctcatcaaggtcatccagacactatggttctgttcatgtggaattttagtctcatagcaatcagtaagactgtcttgcgagagccggaaatgtgttcattaacttgagaggccttcctgctaagtggtcaaacatggaaacacaaagttatgtagggacattttgctctgtaaactcaaggtatagcatcatttgtttaaaccctctctattgagatgtaattcacatgtgatacaattcacccatttaaagtgtacagttcagtgggttttagtacattcacggagttgtacaaccatcaccactagctaattttagaatatttttgtttccccaaaagaaactccatgccactggcagtcactctctttttatctcctccaccaatgctactctgagcccctgacaaccattaatttgctttttgtctctagatttgcctgttcttgagattttccataaatggaatcatacaatacgtggtcctttgtgactgtctcctttcactgagtgtgttgtcgaggttcacccatgttgcagcatgtattagtacttcattcctttttatcaccatataatatttcatcatatggaaacatgatactttgcttattcattcatcaagtgatggacatttgtggtgttttcagtttttctgcttttatgaataatgctgctatggacttctgtgtatatgttttgtatggatgtatgctttcacttctcgtgggtatataactaggagtagaattgcttggtcattataggaactctatgtttaactatttgaggagccgccagagtgttctccaaagtgattgcatcattttacattcccacaatggtgtttgagggttccagtttctccacatccttaccagtacttgttgttgttattattattagtagtaatgtttagagacagcatcttgctatgttgcccagactggtcttgaactcctgggtttgaggaatcctccaacctcaatcttttgagcatctgggagtatgggcatgtgccaccacatccagctttgtctatttgatagtagccatcctagccagtgtgaagtgttttattttagttataacttttatttgtataacaaacaagaggcacattagatggtgatcatttgcttcacaacagtattttttgtagtcctccttttaaaatcacaaaaccacatatgaatttaaaaccagatccttttctttaaaaatagtccactgcagtctgcccatattccagcagtatccattatcaaagtaaagtgtacacaaaaggctccctccacctctccttgcttgagaatctgtgtcccctgagtatggatgtcctgctccaccttcacagtgtcaccttggaggaagtggcagggggtcatccacttcaaccattttccagccctggcacttggcagcaagacttggagaggccagaggacatgtggccacaggcccctgcttgtgctcctgagtgaacacttgacatagatatccagtgaatcatggggtgcaagccagagacaaccccccaccccatttcttgcaggctgtggatctacgtgtcggtggccctagttattatatctgttatgctttaaaagtgaagactaggccaagacctacaggctgatgattattaggtggattaacatacggaaaacactatagaaaagaaggaatagtttgtgcaaagatgctgaggagcaaagtggcatagcaagttcaagcaaatgagtgaagaaagtagcagactgagtgaaggagtaaggggaacagtagcagaacagagctttggagagatgggtgcggtggtcaagaaaaatggcagggacttacaggccacagagtaaggatattggagtaaggggaagttatagaaacagttaagcagtgtgagggttggaggatgcgtgtgtgtgtgtgcgtgtgtgtgtgtgtgtgtatgtgtgtgtgtgtgtgatgatcaatttcctcaattagaaaaaagagatgtgatgaaattgtgttacagccttttggacactcagaataggaggtcttttattgccaggatacccatagcattgccaccctcagatatcttgtaaactctggtaggaagaactcatggatgactactttgtcgtcctactgcctttaaatctgcttctgtctgttcccggcacccactgaacggcaatttctacaactctcaatttgggcagcagcgtccatactgggaaaactcttccatcatgcttcctcatagacccctattgactgggtaactgctgcatcggtcacctcctctccctgggcctattatagctatggctaagggtgcttccgttgtacctggatagagttttatgcttataagctgcttgtggctattaaacagagcaagaggaaactgtgtacatggaaggaactttgttgcccttctctgttacagacaagcaaaccaccaatgagagcaacaactttttaagaaatcctggcagacttgtggcaagaataaccaatattgtagttcacccgtgaggcttatacaacgtttgccacactgtatgcattgagaatctggttgcgatttttgttataaactcttccattccgcttccccctccctgcctccttacacacgtttacttcagtgaactctgcttgacagactaaccaggctgaggtctcaatctgtgacctaggagccagtgataacacctttgactaatggacagaagacttatagttctatttttgttgttttgattttttttaagttatagtgttgaagtcatacgttgtctttagttattaatcttactgcttccttcagcattttgttgaatagcatttcatcatgctttggttaagtgatttatagttagctcacaaatcccaggcttaagattaaaaagctactcataaattccttagaacattcattgtgccagcagaaagaaaaaaatactggactataggatatcattcctgtatctgattcctacactattcctttgaatatcatcccacacctcctccccgttcaactccaaatggccaatgaacacatggaacatacatacagttagccaataagaacatgaaaacatgctcaaaatctttagcagtcagggatatggaaatcaaaaccacaaggaaataccactttacacccaccaggatagtaatgatgaaaaaaatacaaagaataagtgttggtgaggatgtagggaaattagaaccctcataaactactggtgggaatgtaaaatgctgcagccactttgaaaaacagcctgtcagttcctcaaaaagttaagcatagagttaccatatgactcagcaattccactcctagttatctacccaagagaaatgaaatgtgtgtacacaaaaaacttatacatgaatgcacatgcattattcataacaacaaaaaagtggaaaaaacccaagaatccatcctaactgattaacagataaacaaaatatggtcaaccatacaagagaatattattcaataggaaaaagaatgaagtactgacacacgctcccacatggatgaaccttgaaaacatggtgctaagtctctcttgagctggacacaagagatcacatattctcttgtgattccacttacatgaaatatccagaataggcaaatccatggagatggaatatagattggtggttccctagggctgggggtgggataaaatgcagagagactaataatgggtatggggtttctttttgaggtgataaaaatattctaaaattggttgtggtgatggttgcacaactctgtgaatatactgaaaaccatttaatcaaacacctgaaatgtgtgagttgtaaagtatgtgaattatatctcaataatgtagttataaaaaatgaaccaagaaagccaagcaatgctagacatgcatggtctattccactgtaaggtaatagtctgtctaggcacatttacttattaaaaaaaaaaaaactccccatttatctatttagatgtttctttgttatatatgtgcttaacaatcttctcagtttacttgcagtttgtaggtgacagtttattttatgtcatgggaaactgaaacagaatatgtcaggactgtttacgtgaacacggtctggcctttcgctggacactgggatacagtatatttcaataccccctacgcacacatcccacacacattaatcagggccaacatgctgggagtaaccacgatggccaaccacaggatactaggatgctttttatatggacatttgtgggtgaatgtaccataatctgtttaactggctgatagtcatggtggcagtggcatatgtgtgtgtgtttacattgtgtgtgagtgtgtgtgtggggtgtgtgtgtgtatagtttacagcaagctcaggcggaatgctgtaagccaaacagtaccatgaatctctaaaaaggaaaaaagatcattatctttaaaagtgcattcttacatgctgtcaagtatttgaggattgcttttcctagctgaggctcagtatagtcttctttagtctgttgccaggggatcagcaatgggcaaaatctccgcccccatcccagtacccactctgtgtcatacattttccttgatgacttatgcgagtactttataatctttacaattctcggctgggcatggtagctcatgcctgtaatcccagcactttgggagagaaaggaggatcatttaagcccaggagttagagaccagcctgggcaatatggcaagaccctgtctctaaaaataaaataaaatattagctgggcatggtggcacacttacagtcccagctactcaggaagctgaggcgggaggatcacttgagcgagggaggctgtggctgcagtgatgatcatgccactgcactccagcctgagcaacagagtgagatcctatctaaaaaaaaattccttacaactctctaataggtttctttatatcattttatagatgaggaaactggggcttgtagaggctaagtaacttttccaaagtcacaaaaataagtggtgaagttgggttgtaaactcaagtccactgattacaaagaccatatttagggtcccttaagttaagctgtcttacatcttcccgaggagaaataacatgcttttttgctactgacttaatcataattattaatgaaactgaagtagaaattgattatttgactagaaattgattacacaacaattcaatgtttagactaagaaccaaggatttccaattaatatgccagagcttgccattaaaattttttaaattgtcatttttttcttatggatatgtaataatcatacagtaaacccttgatttgtaggataccaacctgcaggaatgactagtaatttttttaaaaagaaagaaaaaagaaattctccttaaaagtagaattgggatccagatgtgtttttacccagcagtgtcttccgtcatggatttgtcttatagaaggaaaaagacattccaccccagtggtgataggtgcatgaaaagctcattttgagaactaaggatggagaaagcaaagaggagcagagtggtagagatcacagtggcaacagtactggggtcacctgggacctcaaggtgggcacccatggccatgtggtggtagaagtgagaatcaacagagggacagcagtttgcccttcctgttgacagtggaaaagagagcagcaatgaagaagtagagtcaggaactgctctaacgtttgctggaggggcagccagcagccccttatattaggcctaccaggacgctgggtgccatattgaaaagatataacagtcataatggattgtcagtgtggatgcctgcagacatttgcttcatgtggtaatatcatgacagattcaatcagctctttatttaatctgtattttcacctataattatgcttataagacaaactgttcaatggttttaaaagacatgaaaatgtctccattagagaaatagaagctcttacaataagatagttagaatgttaaccctgagctatccaggatgtgtgcttatctagaattactcgttcctacatgatccaggctcgctgaggatttagcatactgggccttaagagctatgatctgcttttttatttttaatatttttggagatattcttccttcctgaggttacccaaagcagtatcctttggccacattttctttgagctctagattagaaaaacatttataaccacccacaaacacaaaactttttaagatgaggttttggagggtaaaaaacttatgaactgaaaagaaaatttggttcctgttggcagacagtgatactttctttgagttctaattatatggaataatttgtaaatgaattaaacaaatgcaaaacaaagggattatttttatgttttaatgtaaatgttgcattaaaaagactgaggattgacttgaatagattggaagactacttcattattaatgattctcgtgcttgcctttggaatctcttgcttggctggattatgtagaatcggattttaaggctttgatgcaaggatgacctcgatcctgggctgcctgctactctcataggttcttaagccaaaagttgagatgatttgcaatggtagggggacaagacagattagcaatgggagatgcaaagagtggagaggctcatcagagagatgaggaagacggctttgcctctgacccaggtgtgaatcagttaagtggtggaaattaaagaggagatgccaaaaagcaagaagtatcagtaaggcatagactggtgaacttggatatctgtaacatatttgcattcataaatgcaacgttttctctcttgccttgtgcagacctggcctttctgcatctgtgtctttttgaaacattacaggatattcaacattagcacctaattatgagcccatttcaatgttagagcctgttttatctctgctttaacgtggtttaagtatgtctgcaaaggaagaaagtttagttacattgttaaccatcctttttcatgtctcaaagagtagaagatttgtttatctaacagattttgccaagaaggcagtgaatgaaatttcagttttgaagtatatttgaagttaacattttgagatagggagccaagctcagtcaagcaacactttcctatggaagcgccttcctttgagctcagcataaatcatgccttaaagtaactttcagcctgattagtgttgtccaatagaaatgaaatccaagccacatatgcaattttaaattttataatagccacatttagataagtttaaaaataaaaagaaacagtaatatattttatttaacctaatatatctgaaatattattttaatatgcaaacaatagaaaagttcctaacgagatatacacatttgtcatgccaagtctttgcactattatttatttcatacttacagcacattttaattctgactagccacatttccagtactcattggtcacttggggctagtggctgtcgtatttgacaccagggctttagagaactgaatgagcaaccaaaagatgactgatttgactcagtttcctactggggaagttttcacatcaactatctctaactctcccccatacctacacccagccctgagcaccccaagattgctgaacttttctcacactgaaatagtcaggatgtcttatcttcacaggtggggaggatacagagctgtgttttcacatttcgtagtaaaattcagctgctgttctctgcccgtattctactcagctttgaatttcaaccccttggctttcccatactgagcagccaacgcaaactattgttttcaatgacacctgttcctttcgaagaagatgaaggcagtaagcagatttgtgcttagtacaaggtgttcaagtgaaattacctatttattttggtgatcaccctcccaaattgctagggtgtatcttcatctggagttacataaataggatttgcccacctcctaaatagagtgtgtgataatggaggtaacctaggcatcctcctacgctctgccacaactgatgctcaattattccccagaacacctaatgctttatgtaacagagctctgagagaataggggagtggcaggcaaaaatgaaatagatatttcaaacatcactcctatgtgaaacatatagatttggcatttaggtggaaggctcttttttccttccacttacagagtttgttaaattgcaagcatgccttggtgttgccagagcaatgtcttgtagctgatactcacagagagctagtgacttgtagacttctctatacaagcatagttgtggataaagccattctagaagggaggtgacccctgtacaataaagcctgggttgttgcaatgtgagatcaagagagcagaacaatcttctattttgttaattaatctagtatataaagtcttgcttaaattaggcataggctcaaagtctgactcacagtcttttatgttttgaaaatgttcaaagaaggtggaaccaaaatgggtgaaaaaaacttgacacatatttgaattgttctcatttgttcatatttgtaattctttaaaacgagacagacaaacgtacagcatacttttgtggccaagaacttgggaatcagatcctaaatctcaatgcaatgttgtactttgggtttgtgtttggaatcaggcatggtttcaaatcccaactcttgtatctactaattggatgacttccagcaagttatttgtgagccttagtattatatcataattgagtcagcagacctatctttcagagatggagtcagaattaagcagaatgatgtacataaagttattggacagtgatgggacaaagtctgactaaataataacaccactgaattttaaaatttaacatgttatcagatctccttcaattatttatatgtatatatgtatgcaatgaaaacataatgcactagcctttttactgaattattcttattctaaaacaggaaatatatacaatcatatggttttatttaagctaacaaacatttgctgagttttggtaatgtcaaataacttactgttggatactgaagggtatatttttgttcaggtcgtaagtatcctaatatcctgtacatatgaatggccgttaggtcacagcttccctcctgtagctcttaacatgtaatgcctctagccctgtggctctcaactgggggcaattttgccctcccccacccctactcccccaccaagggacatttggcaatgtctggagacatttttgtgtatttgcttgccacatcttggggagggtgctattggcgtataagcaagtagaggtcagagatgctactaaatatcctacagggcacagaacagcccctacagcaaagaattatccagacccaaatgtctacagtgcctaggttaagaaacatggtcttgatattatgtatttttctagagtttattatgtctttcatcatttgtgactttggccatgctatgaggactgtctagataaaaattgtccagtcatgagctggttggacataaagctgtgactacttgaactcaaggtgatacttacctaatagcatcgtcggagggaatttgttcattgggcgggaggctggattagctgcttttggatgctcttccaatcccaggaatcccgtgcttttcctcttttgtcacacaaagctatatttcagcaagaatctctcccaaactttgtgttcaccatgaccagcttcttctcagatcctgccatcaaggccaagcagagtatttttggaatgtggatgaatgtgacaagaatgttattcttaaatagcaattctgctatgcaacaccatgatacagtctcctgaatggatctgattccaagtggaggcttgaactctaatatttaatagtaaactatagaaaccttatcaagataaacagcactaggagtttttaattctatttacatgactagaagttgacattcatgtccttcttgaaactcagacccccaaatattgggaaagtcaaatacaatacggcacagtcacagcatgagtatcatacagtgatagttcatgctaggttaatgtcaaacattaagagtataatgctgaaatatttctggatgaaagataggatatctaggatttctttcaatgtaattgagtgggacagaaatctaaaagttggtgttttaaagagaaattggtaagccacagctgtgaaaatggaggcttaggtggtttgcatattggctgccttgaactgtaaattccacctgaagcagaggtaaacgacagtgcttttagccagggggggacggggtgcgggggggcacgttcattgacaatattattgcaaggtatgttggttcttttttttttcatgactggaacaatgaccagcttcacttcgtcaccttctttctcttctatgaaatgccttccctccttaaacctaaatccaatgcatccctgaagacctagctcaattatcccctccccctggaagcctctaaggtcttccaaattttattaatacttctccactgaactcctgcagtgatgcatcttttgcatgttttaagaaattgaggtctagttcacataccataaaattcccctttttaaaagtgtacaatttagtagtttttagtatattcacagaattgtgcatttatcaccacatgttctagaacatcctgatcacctcataaagaattgctgcattcattagcagccaaccacccctccctttccctttaacacctctggcaactactaattactttctgtccccatagatttgccttttatggatatttcataaaaatagaatcatataatatatggccttttgtaactgtctcctttcacttagcataatgttttcaaggctcatctatgttgtacatgtatcaggatttcattttgtggctgaataatctttcgttgtatgggtacgccacattttgtttattcattcatcagctgatggacatttgggttatttccactttttagctattatgaataatgctgtgaacatttatgtgcaagtttttgtgtgtacatgtgtttttgtttctcttgaaatgaaatatagctaggagtggaattgctgggtcacatagtagctctatgtttaaacttttgaagagctgccagacagttttccaaagtggctgctccattttacattcccaccagtgatgtaacagtgatgattaaaagcaatggcaaaaactgcaattacttttgcaccaatcttaatacagggattcagatttctccatatcctctttgacattttaccctgcacaagtctgttgatgtcactatttgtcctcaggattgattatcccacatcccaaattagtctcacctcccaaattagactgtaagctacttaggacaatgatccatttatttggtctttatttaagccagtggtttttttttttttttttttttttgattgcttattgtgtggcaggaactggtaagtgctaaggctttaattaagaagctctattttgtgggggaggcacataaaatcacactggcctgttttggggtgatgggtgcagtaataacagcctattcaaggtatagcctttgcttcatatagtttccctcccacaatgtcatacttacaaacaccactcaagtctactatttaatacattctattagagaggaacagatctctgtgtgtgtcctctttttagtccaaatgtagaagctctgatttttctgttgggcttttgtgtttaaatgtgcttaaagaaatcaatgccagcaatatttctagcagtaactttggatgtaccatgtaagttattttgaaacagtgaatcatcacgaatgttaatctgttgacttgtatgtataaaagcttcttgagactctaggctaaggagagacaaagcatcaaaaatgtaattcctctggattcagaaataaattatccacatgccattttcacctgcagttaatctggttttatgtttgtctttctgcaactctcattcagtgttttggagaaattaggacatttagaattcctaaatgacatcaaggataaaaggaatcaaactgcaaactgtagaaaagaatgcattgttatactatatataaaggtataattatataattatgactataataattaaaacatattgtgcttaacaatagtatcaaattgttttcatctgagttcttaattacctaatataaatatgtctatgccagccatgccaaagcaggtacctaaaggaatttcttatatctaggaaaaaacgtattgatcacctcatgcatttaagggacaagaatggcactttcattccagcttataaatcatgtcaattttaacaatgacttaaaaattcttttgtgatttgtttaaactctgaaaagaggcttgtttgtgttaaggaaaaatcaaactgagaatgagttatgtgctcatattatatatagatgagtaaaactcttactccctctgcaaacattagaaaacaataagatactcccacggtttctttttttttttttttttttttatagcacttacgcagtccttactatttaacaggcactggtttagaatttttacaaatacttctttaatcttcataacaaccctaggaaacatatacaattattatccccattttacagataaggaacctgagagtttcagtaacttgtgtaaggtcaccaggtagtgtaagcccatgagatttggcaccttttccaaagtggagtaggcctgccccagagtaaagagtgcctgttctagtctttatctcaaagaaagcagtgatttaattagttactatcaatgtggggaatctgttggtctgacatcattctaggtttcagaggcaacttggctgcaggttttgtttttgttttcgtttttgttttcatttttgttttgagacagagtcttgctctgttgcccaggctggagtgcagtggtgtgaccttggctcactgcagcttcgacctccctgggctcagttgatcctcccacctcagcctcctgagtgcctagaactacatgtgtgtgccactacacctggctaattttttgtgtttgtattttttgtagagatggggtctcaccatgttgcctgggttggtctcatcctgggcgcaagtgatccgcccactttggcctcccaaagttctaggaaaacaggcgtgagtcaccatgttcagcttgcaggatattttcatacagcttaggagagcaatgaaattaaatgtgagagataaaatatacattgtcacctacctgtttgatggtatatataatggattatctataccatacattatacattatagataatatatattatattacatcttcatattatgtatagtcatgctgtctttgatatacatacacatatatatgcatatgttatacacacacataaatgcttagccccttgcaggctaccctttcccatgtgcttccatgtcttgggtaataattcttctcagactttcaggaagtacagtgctactaatattcttggaggttattattctttcttcttggtgaagaggatgttgaaagatcaataatttccatctatctccagatagtaaggatgccttgtaggagagagatctgaagaccctgacatgtccacagctttgcagcctgattctgacctttctgctttgggggcaacttccatcaaaaggagtttcttgtcgcagttcttacaggcaggggcatctcacaacagttgctagtaatgataccatctactcccaagaatgggaaacctatactcatctacttggcctcccaaagatggatcccatttagggtgtgtgtgcacatgtgtgtgtttgtgtgtgtatatgttttaaccaaaataattagtgttaccaaatctctaggcctccatgcctagaggatctctcattaagtaggatattctatgcgctcatactagaaagttataaaggcaaaaaagacactagattaaaactgataatgtccatataggttctgagatttttttaaaaaaaagtctgagcttatgttaaacagaggtaatgaggataatcagttgtataggcttccctaatgtaagtcagcgtctctcatcttggcattcattccagaactgtttttaaacaggcttgcatgtgcacagtatgttaccttgccttctaagtactgtcagaattggactggtacctagcaaaaatatcaaaattatgagtcctagaacagtgcttggatgtaataagcactccgtaaatacttttggaaaaaatatgttgatcaactacggttttattagataatttaaaaaagataactttaacccctgccctctctggaggagagagttgctacagtaagagggagcagtcatccccagacctctctttgatgcttctgggtgtaagaagggcaattgaaaagggatttaggaaacaccaggcatgctgggtgagtaatatggctgccacctaagagaccatcagggaagtgtcttctgtggtatcatgccctgagccagaatgccgttgactgcttgactctgaagaaattttaaagtgttcctgagggtgagagaggtcttttgaatcagggattctcaaggtagcctatggtgatttgaaatgtttacattttaatatcacatatactctcctttctattggaagcaactaaaactgatagtgaagacttatgcttttgctgtaaagagtaagagttgcctatctgtggtatgatagtactcctagagggtgattcataggttaaaccattggaacagaaaagagaaaatatttttacttggccatgctctcttttttaaaaacaaatattactatttttttaaaagccatatcactggcatagttttcagttgtttttacagtcggttgctctttaggcttacaatctttaaccttgaaattattcagagataattatttttggaaggaaagtgacaagggaaatagttatgtagtcaatttttgattatccaagatgattttgccattagaattagtatcttattttagcaaatagcaacagtcaccttctctctttgctaacccttggaacaaaatgttttataagggaacagaactgaattttatttctcctcctgtgccccgggcctgtcttatattttcactgccggtagtacctaatgttttccccatttcagcagtatgctggagccagcttgcgttggctggagaaccagttgtgtgcatctcttcctaactgcatgtcctgtgtcctcaccttggtaccctggaatccgccacaatgagtatttatattatggaaattaacaaatggcgcaaatcagagctttcctccagagaaccagttgttaaatgttttatcagcacactgctgccccattgagtccttcctttttgttttttgatgaatattttctaaaatgtattagatgttgctgtctttgcaaacagggtgtaatagaaaaatttactatttcctggtcccattattatacttcatattgctgggttagcttcttagtgtttcttcacttttcccttcagaagagggcttcttccttctgaaatcttccactcagttcttatgtgttgattttgattgcccttagtccatcaaatgagataaccaagtccataaatgtgcatgtagaataaaatgagagttagaggacttctgttacagaataaacctcttgaataaaatgcatggccttagtccagaatttttgtgacaactagtttgattgccaacaccagctttatgagtatcctacctgtgtggtcgcacagggcccatgctcagaaggacaacatgactaatgttctgctgtcatcattttaaaattattaatctgagcaagaggtcctgcattttcattttgatcagggctccataaattatgtagccaatcctgatagttgttcagatgccttttttgcttctgattttagaaagctgaatttcttagaagtctggtgtgtagatcagtgggctgtttctatattaaccacagatggatgcttggtcagatcactataaatactaaataagtagtaacaaaaaaatgatgtttattttcattcattatattgtgatttttctaaatgggtgtcctaggaaggaaaatgatacattataatgttactcacttattttgaatgtataagattaattttaatccttcacttgcaagtaatttctggttctcttattgagatatatttttaaaataactttattgaagtaattttacatcataaaatttactcagtttaagtgtgcaattcagtggtttcttaataaatttacagagttgtgcaacattcccacaatctgtttagaatatttccatcatcccaatgaaattgttcatccccatttgcagtcattccctgttcccacccccagccccaggtacccactaatctactttctattggaacagctttgccttctatggacatttcatatgaatggaaccatacaacatgacatgtggtcttttgtgattgacttctttcactcagtattatgtctttgaggctcattcatgttgcagcaggtcaatgcacaactttacgctaagatttataggatatgtgaggttggtgtaggacaaataatgcttatctacttatctgtgagtgcacatttatttttgctgaaattttcattgagaatggaaaggtagccccattgcattctacaggaagtccatttttggcttataacgcttatcattttggcaccttctggatcaactactcaccctaccttctgagaaactttaagctatttatgagggtgtaagtgaacttaatatttgagttcaattactaccaagcacactttctggaattactactaaattgcaaacatattgtagcagttctaaagacgcttttttgagttaatgttcatcaatatttaaaaaatatttttctcagtattaaaacaagttaaaaataccattgataagaattcaggctctgggctgagacagctctcagtggaaatcctagctctgcctctcaaagccatgtcctaaaataagctattaaatctctccaatacttgatttcctagattatgaaataatactacacactacctcagagaatcattgacagaattaaataagtcaggtaatgcattgaacacagtgcttagtacaacaaatgttactaaatgtaaacatttctacaatgatgagtgatgattctgttatgtacagatatgtactaccatttgctagtgtatcacaacagaatagaacacatcatataatatgatgcaagttatattaataacataatgtctatgcatatattttgttatatccatagaaaattttaacaaattaatagcacagtgtgtggcctttactacactcaacaaatgttagttatattattattatcattattacttacaatggctttcttcagggggaggaactataggagatttcttcttttcacagtatatttctgctgtttttggtttttgcttttgtttgttttctttaaaaaagtattacttttttaaataggaaaaattaaagactaaaaaacttaaattgctcttgaatagatttgtaatcattatcatatactctcttaaatcacttattattcaccttttataatctttggaataaataataattaaaacttccattttctttaaataagaaaataatactgctttataaatactcagtaatacaaactaactgactatttcctgaatttgatagtgtctttttcaggatatccttcttgtaattcagtaaatagaaagggcccccattaaaaatcacatggagaaagtagggtgtagggttgggacaaacacaccaacgtgacttgccttgtatctcttatttcccattttagatactggtgggttaaatttacttaatatcaagttcaaatgtatgtacagtcttaggacttggttgttgattcttaagagtgtgttgaaaaaataaagaagtcagctaggagaagttgaaagaacttagactttgaattcagatgcctgcctttgattcttccttctgtgattttgtgctctttggcatctcaaaaactcagttttcctaccttgagaatggggaaaatccccaccctatgagtttttcataggcatcaaatgagacaatcaatttgagattaagctataaatgtaaagcctcctccaaaatgctagccagtgtgattttttaataaggtcattatttttcttccttttaggatttctctctcccaagaccaatagtactaaccaatattcaggcttcattcatgtttcagcagggcatgggaatggttgtgggtttctttgagctcactggccatttattgttattgattaattaactcgtgataaacagctggtgaaaaacccaggataaggaaatgagagtgatggggtggggttgggaatggtacataggaggaggctggaatgatgaacaggaaacagccatgcagaactctgctgaaagagccttccagaaaaggaaacgcaaaagctaaggctggggcaagttacctgtattaatataagataacatcaaatgggctgtccttccagaggagtaactgagcttcctttggtctacaatggaatttcttcccattagaaaatttgacccttttttcttgcaaaagataagccaaagatatgtgaattgcatgacagtgatttaggatggaacaattccttatttgaggaatgcttctttttctattttacttctgtgcccacatagcacccagcttacaactaggagcttagtcatagacagttctcaatgctggctgcacattagaatcaaacaggaagcttttgacacctcactattccaagtgtgttccttagaacaccactgttgacattgcaaaatgcagaatctcaggcacaccccagacccactcaattagaatctgcattttacgaagatccctaggcaatctacatgaaagttaaagtttgagatgtgctgtacaatactgtgccaaagatcaagcttcactcctagagcttctgatttatttggtctgggaagaagcctgccttggcatcattttaaaaaagaaaaagaaagcttgtaatctccaactgatgagaacgtacagcaaaacttgaagaccactgacttgattgttctcactcacaggccctcaatcactgatgactatcaagcacgtggaaatgggattcatcaattatttaaattgcttgtttgagagtaccagttatgttttaaagttttctggcttttttttttcttttcttttctttttttaatcatactttaagttctagggtacatgtgcacaacgtgcaggtttgttacatatgtatacatgtgccatgtttctgtgctgaccccattaactagttatttacattaggtatatatcctaatgctatccctccctcctctgcccaccccacaacaggccccggtgtgtgatgttccccttcctgtgtccatgtgttctcattgttcaattcccacctatgagtgagaacatgtggtgtttggttttttgtccttgcaatagtttgctcacaatgatggtttccggcttcatccatgtccctacaaaggacatgaactcatcgtttttcatggctgcatagtatttcatggtgtatatgtgccacattttcttaatccagtctatcattgttggacatttgggttggttccaagtctttgctattgtgaatagtgccacaataaacatacgtgtgcatgtgtcttcatagcagcatgatttagaatcctttgggtatatacccagtaatgcgatgtctgggtcaaatggtatttctagttctagatccctgaggaatcaccacactgtcttccacaatggttgaactagtttacagtcccaccaacagtgtaaaagtgttcctatttctccacagcctctccagcacctgttgtttcctgacatttgaatgatcgccattgtaactggtgtgagatggtatctcactgtggttttgatttgcatttctctgatggccagtgatgatgagcattttgtcatgtgtgtattggctgcataaatgtcttcttttgagaagtgcctgttcatatcctttgcccactttttgatggggttgtttgtttttttcttgtaaatttgtttgagttcattgtagattctggatattagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctacctggaggcatcatgctacctgacttcaaactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaagtattccctatttaataaatggtgctgggaaaattggctagccatatgtagaaagctgaaactggtttccttccttataccttatacaaaaattaattcaagatggattaaagacttaaatgttagacctaaaaccataaaaaccctagaagaaaagctaggcaataccattcaggacataggcatgttttgtggcttttaatgaatactcttaataatttgtaaatctttctctagaatagacttctagttcccattagaactagactagtggttaacattactgttatcacagatcagagactgggatgcatgataagttttccttgtcttccttcagctctaaccacaccgactttctcatgtttgggggtgatattatttctcactgtatttgcattgcaattctgaaaaatatcttcctatcccacctctgttttgttttccatgaagtgagcaaatttaccaagtgatttggaagaaatttatataattgtatagcttgaaaagcctttttttcccctacaaatgtattatttaggacatgtaaaatttagcaaacacagatattttaagcataatttactaaatattgatgataacgcatgctcagaagtcttcatttagaggactctcaatttgtctgagtgtaaactcaattccaacaatcaaaataatttgatatctggtttttgctttagcaacttcacttggttggccaatgttttaattctccagtccttgatctctcattgtggtaaacccacaggataattttattagtgctttgattttctgtaagaggcttttttgtttttctttaattcagcatataattggtgcatgtttaaacttatttgtgtttcggttgaaaggcagttattagtagagagtatcaatagagagttattatagagagtattagttattatttgcagaaatgttaaccttactatctagagcaggatctttctgcctcagcacattgatattttggactggataattctttactttaagggatttgtcatgcgttgtagagtgtttagcagtgtccctggtcgatccccggtagattccaataacaagctgccaatcatgacaataaaaaatgtctgaaatattgccaaatgtcccctaagggtgcaaaactgcccccagttgagaatcactgatcagtagagatgaaaacagaaaaagaatctgtaggcattttgtgacctaaataagacattcttatctccgtgttgctagcttttattttgtggctgagtgaattgttttcagtgtgaagaccaatggtacactggatttctatttaaagatggtttcaaatatgtaaaataattgatagtttacaagccacccaaacatatttccccacttccttttctgagtttagttgagaaaattttatatgtagaaagctgaaactggatcctttccttacaccttatacaaaaatcaattcaagatgggttaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaagagaaaataccatcagagtgaacaggcaacctacaaaacgggagaaaatttttgcaatctactcatctgacaaagggctaatatccagaatctacaatgaacacaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttagaacggtgatcattaaaaagtcaggaaacaacaggtgctggagaggctgtggagaaataggaacacttttacactgttggtgggactgtaaactagttcaaccattgtggaagtcagtgtgttgattcctcagggatctagaacttgaaataccatttgacccagccattgcattactgggtatatacccaaaggattataaatcatgctgttataaagacacatgcacacgtatgtttattgcagcactattcacaatagcaaagacttggaaccaacccaaatgtccaacaatgatagactggattaagaaaatgtggcacatatacaccatgaaatactatgcagccataaaaaacaatgagttcatgtcctttgtagggacatggatgaagctggaaaccatcattctgagcaaactatcgcaaggacaaaaaaccaaacaccgcatgttctcactcataggtgggaattgaacaataagaacacatggacacaggaaggggaacatcacacaccggggcctgttgtggggtgggggaagcggggagggatagcattaggagatatacctaatgttaaatgactagttaatgggggcagcacaccaacatggcacatgtatacatatgtaacaaacttgcacgttgcgcacatgtactctaaaacttaaaggataataaaaaaatttcttcctttcttccttctgaattttaaagctccttaagtcaagtgaaaaatctagtcatttacctgcgaagttcaaataaggaaatgactttggctacaattattggagtgcttcaggtgcaagtggctgtttgggcctgataatttagagatatgggacctcacatttactctctctgcatgcaaagcagtgggtctcagccctagctgcaaattgagatcacctgggagctttagaaacttcatacccaatccccaagccccagagattccagctcagtggtcgagggtggtgcataggtattttgtagagctccccaggtaattctagagtgcagtcagggttgacacccactgatgtaggtagatagggctttgctgcctttctccttcattgatcactttcccacatttccctgtagcctgctttcttcctgtctgcaacatcctggtcaaactcttctgcctatcccttgttattatttttaaccaaatgattttttccaagtgtttttcctttgttcagacttggacttggcgtggaaactgctggatcagtctacttaatccatgaccttctttcagctgctgccttcctttcaactgctgcctttatttcaactgttaacctcagtccaccttaaaaaatatatatggtttttaagcgggtatttcttcctttgccagcaaatcattatacgcagttcctgtctatgtttaccaccatcacttgcctctatttctttttccttactgctatttatagtttaattttctttcttttctttgtgctcttttttattcatgtttccatccttagatgacatgctcacgttttgtgaattaggtgtgtttcaagatgctgggaaagtaagttttctgtgctttataacttcagacccgtgtatttggtttgtgtcttatttaaaaatgtatgttcttatggccctgtttgccccacctaagcgtttaaatgtgacacctcatgtctgttgggctcccaggttcctattatggccggtggatctgggccaggcaaaccatcctaggcctcaggcatctcgtcacgtctagattcacctctccccttcccacaagacaggctcacctgccttccagccctgtagctgctggcctctccctgaactccgtggtctctagcaacctttggacttctaagtaatattgcaaagatctttatccttggcttgcttgagagcatttctgctaagccctaccagcaactttcatcttgtttcctcagttagttcttctaaaataaatcataaattgccccattgctaaaacttacgtcacattctttcaattctagtatctgagtcattgcaaaaaggcatctcaggttcgttccagagatttggcaggggagcttcccacaactcagcaaagtgtttggcccctttgggccttttcactgagacttgaggctagatttgctgtgcctgctctgtcctttcccttctaatttctcaggaattgtctttgctgtcttcttgtgttctctgagatcacacttccacagctgttccagaaacatcacaccacttgtatttttttaaagccttagcttttgcttgtgggttcacttgtacaagaatattaacgttgactctcactttgtgtaatactagtatatcaagctagtcttttaaaaacaccttttttaagcctttaagcccaatttatatatctcatttttttatcatttttgcattaatgtttaaaaacaaaacaaaacacaacacctttcttttgatcccttaaataccagctagtgagactttcaaatctagcacttaattttttactgagcatctaaatattccttacaaaatttaaacttctagatttaactcatcagatttcctcaaacacttaaacagagattgcaaacttaaatcattaagtcccaagtattttagttaaaatcataagttcgatatgtcagattctccaaaacaattcaaacacctcaaagaacaaataaaacttgcatatcctaacatgttgattccagaagttatttttacactcaactcaattgtattaataccaaagtttgattaatttcttcatttgccccatgtattttatcaatattactactagtacctgattagtattaatactggtagcagcattatcattagtattcataatagtgttaatgctagagctatcatcattattagtaccagcaccagcactattagcatagaattagccttggtcttagaattatattagtattagtatacttctcagagttgcaaggttactgacccaaataaggaaaacagaaatgatagatacagttattggttgagaatgtgacttcaaatttataaattgggggttttcagtcagagattttggaccaagacaccaagaactagggtttgccattctgattcctcaatcccactgggcctttattgtgctatagtcatttatacagtagtaagaatttctaagcttcaaccttttcttgtagtctggtgaatcatggtcatttatacttaattttcttacagtgttttcttatgtaatttttattgaaaatttctgtgacaactttttattgcctgattggagagggtgaccaatcatccttgtttttccaggactggagggtttgctgggacatgggaacttttcagcgctaaaaccaggaaagtgtccaggatgactggttatcctagattctaggccagtggttctccacccccactagaatggtctggggaacttttcaaacataccaggccccaagccccacctccagagattctgatttaatttgtctggggatagtgcccagtcattgatattttttaaattttctcaagtgattttcctgtgtagccaaggttgagaaccatcattctgcattctctacccaatttgaaacaccctatgcaacattgtattgtctactttgacctcctggaacttagcaaaacttgaatttgacaagcatgtgtttgggttcatcaatgtgaagtatttccagtaaatattcctgggggaagtcatgcacatctttcttgagcagattatgttatttgttgtttttgagtatatgtgttctcatgacttttcacagagttttttgttgttgattaaactgtcatgctttcattagtgacaactgcattaagctggtccatttgtccagttagcaccacccttgaaagtattcaagcttcttggtaacaacaaagtgttccagactcatcctggtttttcctgccacaagacatggaatcaactacttttcaaggatccctgtgtctttcactttttagttgaaagttttagagaccaaaatcttggctacccgggggcacatcgtgttgttttacaagagcattcatagtaggtagatcttggatccatgatcttatctgaaattgaaattcttaattctctcacatggtttttgtgcatccccattgtccatcctgtagatacttttttatccttattctttttttctataaatcaatatggtgttctttgtgtttttttcaagcattaaaattctgtcactcttttatttactttcctttcaaatttcaactgagaatcaggaaaactgtgtgtatagacttcatttattttctagtttattctgagaggcaaggggaagcaccctgttgtcttttccaggcacaaactctatttccttttatagtttgataatttcttcgttctccagtactcatattttctgaagagtcatcactccttagcttatttcttcataagttatagccaactgagttttatacatgaagtggaaagtggattttcctctgaaatgagaggaagtaggtattttgttgccttttaaaaagaggtagaaatgtacgagcaggtcaccctctcagtcctcatatgggctgataatttgtacctgagactatagatttaggatatggggcagaaattgagtcagaacagtacagccaccaatggcagagaccacaggccaaggctcaaaaataaaacccacataaatgttattttagtgagttttgccctcatcctgggttgttttgtagggaaagtgatgggagagagaagggggcatatcttaagaaggcagtcccttttgcagtgttttctgacttaatcttagacctaactcttaattttagaattcactctgagaagatattaggcaaactcttactatcaaaggatttccctcatttgggatcctgagtttcgtcaagtcacttcagatcagcaataaaatccccttgagagtttccagatttttctccacaatgaaccatgaagcatgctgtttatttgtggaactcccactcctggttcttcagaactccttcatttgccgatctaaagatagcaaaaaaggctcttaaaaatacacgccttattgattttggaatgttctggtaaatgccaatctgattgatgtcatttatgtagggaaggctttggcttaagccccaaagtgattttagccaagaggaagtaacgtatctaataaataatgtggagtttgtgtattcatccaccaaataataattatcatcactaaaaatgtgactagagatgccacatccacttctccattgaggtaaatttctaacagacaaagccaagtgaaatttgatgtccgtataagctgctttgacctcgttgtttctgactttcattacagatgaattttcatttgtaattttgttgttgttttttggtttccttggtactttgatttgtttgggcaaaaactcagtgaatctgtagtgatttaggagacagtttaatcaacacaagtgcccatgtttcagactcagacatgcaggtgatatttattctgggtaattttgggggatctacaccttttgtttattctaagatgacgaagctgcattattattttatatgtaacatgcactcattgtaaaaaagttgcaacgatagacaaaattataaagagtggattgtaataagaaaaaattctgagtacatggcaggatccatatactatgtgtattcttgccttattttattgggacaacaatgaaaataggccaatagtttatcacatgaagagccagccttcacaaatacagctctgtggaattgtatctgagcataaaaacactctttatttaattattattaatataacaattaccaataacctttatatctatctatttacttatttatcttttcctgtggtggggggttcaaaggtttctgggagtgatcaggatgcccaaacttcctctaactttaaaattttaataagtaaatgaagaaagctccatgttttcctcctagagtttaattagctactaatataagttgcttagcccaggatctatcctatggtggtaggtgttcattatgtttagctaaaatttccatcaccattatcatctttgtcatcattactgccatcactaccacaaccaacaacattacaatcaccaccactgtcatcatcaccattgtcatcatcctttaatactaggcttgaggaagctaaagggagccaaatgtacatttatgtcttatgtaacattaatgttacttgtcttattcctaatgcctcatcttaaatgtaaagaaagtaagaagacccagagatagttaactttgtcgtctcttgactcccaggatcaaaaatagttgttgctgcagtgtttggaataaaaaagcttaaaagaccttgtatacaaaagtggttcgtactgccttctctcgtgaattcatgccagcagatatttttattctggtaggaagtaactaaaagctttgttcaaccctggtctgccagcctctgtaacgcacgtctgacaaatatgtgtgactctgtgagaaagtttggttctccccctggtggcaaaaggaaaaactaacactagtgctccttatgggagtgtattgatagggtacgagatatgtaaatacagctttacccttttcaccagtgttgcctgagatttttatctcagcccccttggttacttttgttctttggacaacaactggtttatatcttctatggtcgttgggatgaaagggatttgacaaactgacaaagcattttgcttcagaaaccacttgaaaaacacatctatgtttcaaataaagattatttcaggatcataaaaatatgctcggtgtattagccatggaactagattttaagcttcatgatcatagagatagatattgggtttattttattgttattgcctctgaactgagaaaagactctagaattctaaatataacgcacacacttgaactaagtagacggaaacttacccttctaggtaggtaactctgcttaccttccaaacagagtttggatgatattgcctcatagaaagattttttgatacaatactcaggaaccgctatggactgctgctttggggccaggccccatgccacttgattaaatacatcctcacttaacctgtccctacaacaactctgtgagggaggcatactcataccgaagctttagccatgtggacactgctcccctgaaccacatgcgtagtcaaatggttagggcagatttcagctcatgtctcttttattcagaacccatcctttaagccagtagttctcaatgggggtgatttgactcccagaggacacttggcaatgtctggaaacatttttggttgtcatacctggagaggtgctactagtcggtagaggccaaggatgctcctcaacatcctgtaatgcacagtgcagcccccacaacagagaattacttggtccagatgtcagtagtgccaaagctgagaaactgtactcctaaccagtgctactcaaaatgtattccacggaacagcagcatctgcaacacgtgggagcttgttagaaatgcagaatcacgagccctgtcccagacccagtgaaccagaaactccatggttggagctcaggaacgtgtgtttctacaagcccccaagttcttcttgcacactcaagggagagaagctctgctctaaaacaacagatcattctgtgtctattgagctagacacaatcgtatggtttcctcaccactttcagtgttccgttgtcgcatagaagtatctcctcaagcatctaaaaggggaaagtctggcgtacactaggaacaaatgtgactcatggggaaatcagtgcaattacaaatccaggaaccacacccagctgaaaatctaggaaggttctttttctcttattttctctacttaagaagggaagtctcggagacttagtctaggttcaaaagatgtcaacatatacacaggcttggtttggggtttgattatctaaaattaaaccttaaattgaattaggtaaaacccattttggagagccacagaattctaaattagaaattacattgagtttcgtatttactggcccaaataagtaatcttctctatttgtgcatttttctaatcacaaattgtcttctgagagccagtgaaataattatttttatatgggtctctcttcaataattgctcatcacttggtattttatgtgatttttgtggggcatacattataggcaaggatgtattgtaaaggataaaaatgtcagataaaacatctgtgtttaggtagtttgtacgtcactgtcctccatcccacctcatagattcctactgcttggctataactaagagtagaatttaaggctgacacaggaaaccaggcaatcaagttcattaagtaccttaatcaactctggccagaggatgatctcagagctcccctatctcaagaagaaatttcatgagaaagctttggggttacttccagattaaagattatgttctggacagttcaagccctaaacaacagacacatgaataagtggagccatttctatcatactttttcagggactgaagatataaatattgctatttgttattaaaggattttgtttgttaaacctgatgatacttatttttatgtgagttcatagtattccagctcttcaaaacctaatttgtttgtagatccctcattgtcatctttgaaaggttccagtagtttctggaatactttcttttcctatgccaaatacaacagtgaccaagaaatccatctgaaggatttggatagtgtggtagcatgtattgatggacccagtgttccactcatccctgtatacatgctctttaggtaacatgacagtgccctctaactctgactctggagtcagccttttgactggctttggccaatagggacatggagaagtgatagcatacctgttgtaatcctagacctcaagagacctttcttgttcacacttgtccacttgtgcttctgccatggccatgagaaggacatgtctgagccggattgctggagaggaatgagagacatgtggcgtagagctgcatagctaagcaactccacccaagcccagcctagagcacagccccctgcagatgcatgagctagtccattcaggatcaaccactctccagcttccgagtaggttattacacagcaatagctgactgatacacatgagtagagaagaaaagaattttccaagtaaagataatagtattgataaaaccgtgaagagaagggtctatcaacatgttggatcacgagaaagttggcttgagtgaagtagaacacgcttattgagaaataatcaaaaataaaactggatagagagtgctgactcaaattatagaggagtttaaaagccagccaaaagaatcatagtattgtgtgaaagtgccatagaaataatctggtgccaggtcttcaactaagacaaagtgattagtggccaaacaataatggtacccaagtcttaagtgtttgtaagtgatgcaataggaagagataatggaatgatggaacagggattttaggaaggtaaatacaaccatgagttagaaggaatggtttggctgtccctagacatattacctgtgagacttttgtagtattatggaactggagtcatgaagctctgaagcagaggatggtcttcgggaatggaaaggatagttatggaagaatttttgagaaagaaaaaatattccagttatctattgatgaaacccatgtttctctcctgatcacacttgatatttaatgagagagttcttattaaaagtaaccatgtccatgaaggatcttattgggatgaagaaagtgttctaaaactggtttatggtgatggtagcaccacttggtaaattttctaaatgtcattgaattgcatgcttgaaattgttgaattttatgatatgtgaaatatatatcaataaagctgttaaacaaagaaacaatgaaaatccccaccagttatgttccatagtccctggagggggctgttttcatttgaatacccaaactcatcctgtcaagtacaggtagcatcctcctcttctttctcagatgacactatacgcagcgaaccattggggtgcccacatgtgccacacagcctagagccaccactgtgtccatgccagtggtactccatgtagatgcagggaagagcccttcttccccatcctggcccagactgtcagtgagtaacaatgacgtgctgcttgtatccatcatgaaaacagtccctttcatcttggccagaaaccctcttttcctagatctgagatctatgtcctgtgtttgggcccacagatcagttccttggctccacttctcaactgtcccttccagttgccatccttcttactttttctgtcctggacctatctctctcactgtcgtaaaccctcagcctcatttgaatgttggcaacgaatgaatggtagcaaattctactactaaaatcccgctcacgaggggactaatcaaaggtgacattgaaataagtcttctggattttaagcacaatatggggcaaatgaggaaattgatataatctttttaaaaaatttaatagcattattgagctctgattcacataccatacaattaactgatttaaagtgtacaactcaacggcttttagtacattcctctagttgtgcatccattaccacaataaattttaaaatattttcatcactccaaaggaaactccatacccattagcagtcacaccctattttccccatcacccaccagcccttgcaaacactaatctgctttctgcctctatagatttgcctattctaggcatttcataggaatgaaatcatacaagatgtggtcctttgtgactggcttctttcatttagcatcacgtttctgtgttcttgattcaattaaattaacacaaaactttgggatccattttgtgccaagcactatgctgggcactggttggaaaaagagcttacctttctgggaaagcagaacaacaaggaaacaatgaatcccattccatttaacagagggattgatcatttggagtgtgcaagttgaagcatgaggtatgggactcacactggaagaattttgctctgcaggccatcaaagcaccagagtattgaaccaggcaaattactttaattgtgctcttgagtttattagatgtgaatgtcttgctggcaatcatggttttactatggaagcaaactgaggtcttggagagctcattctgtccttaattgtaacatttagtaccaagaccttggacatggtacctctctgggccccccttgtctcatcaggaggggtagaattgatggtctttgcttatattccacaggtcttagaatgatcagacctgacaatatatgggaaagggctttgtatgctgtaaaatgacaaccaagcatgattttaacaattgtgctgcacaaaataagcattttgctgtaataatttgtgatctcataagcattagtcttctattgatgcaataataaatgaccacaaacttagtgtcttaaaatactacaaaagtattatattctagttctgtagactagaattctgacacagatctcactaggctaaaatcaaggtgtcagcagggttcctttgggaggctccaggggcagatccctgccttttgagctcctattaatagaagctgccctcattcattggcttttgtgcccttcttccatcttgaaagtcaacagtgttgcatctccctgtgcctttgtgcttttcttccatttccctttgacagactccaactggaagagtctcacttttaaaggttcatgggattagattggttttacctggataatccaggataatttctccttctcaaggtctatacacttaatcatatctgcagtgttcctattaccatgtcagtcaaaatattcacaggttccagggatgggtgtgtggacatctttgggaggccatctttctgccaatagatgagtttctgttatttctctccttatcgcatctcactgtgtttgtatgtgcacatgatcatcttgttattttctctcttctgtatttacagtcttttttcattttctcttttcatgctgtatcactgtttatccttttttactatttctttcccttgctacacatttcttttttcccttattgttactatcctttactgcttcttagtattttctttgtatttcttattcatttggctatttatggatattttgaacttcctttatcttcctggctttttctaatttaattttcttatcaccttcctttgagccctcttggtctctatttttacacaacattgagtcaatctctttttctgtccttcttagcttcctcttctaacccttgctctcatgcagaattcttatcttcatttacacacattgtttaacttttgtagctccttcagccctgactgtgcagtttatatcttgacaaatgggaggcgggaaagcagacatagcagggagaagccattggtactgagaatcacaatccacatctacataaaaatgccccatgttctgcagccaaacttgaaccttttggagctcctgctaaaatctcttaaggaaatctcaaagacaacagttacatgattactgattacacatgcgtaaatatagaggtatgtttaataagaaagatcagaatagaatttggagtgatctaaattacctaggatagatgaagttctttttggtgtaaattttcttacaattacagcaacaacaacaacaagcccttcaaatataaatgtttcatgtcattgctttttcaacttatatttattttgtatgattctaataaagtaagcatttgatcagttgcagaactttcatgtatggacattgcagagaatgatgttgctgataatgaaatggcataatgtgtgtaaaactcaggttcttagtctttttaagccccagaacaaatctgttcagaataagatctaagttatacatttgctctccagaggaatgtatatgaagaaaattttgtatctgctttctggaggtttcattcataaattcattctataagtatttactaagcatatataaagtgaacaaaaacagagatactgttctaggcattaggaatacatcagtgaataaaatacaatactttcttttaaagagattatgctgtagaatagggagactgacaagccaataagtatataatatgccaggtggtaatacagaagataaggggatagaatgatggaggggagtcagtaggatggtagggaagctttctcaaaaggtgacaatcagaaatatgacataaaggagacctgatatttaaaggatgagtcaaccattgttaacggcttgctatcacttaggttcctgtgtgggaagtcaatttagatagtcagacaaagaaagccctttttgtctgttaatgtgaagaacaggttttagtttaacttcttacgcatagcagtgagtaactagaaattagcacattccagggacaacatactctttcagatttatttgattttccaatatggctaagcaaacatatgattattcattgaaatagtagctccagaggtggtattagattgcctacttctgaggaattaagagaagaaatggttgcagataaattttaaaaagctaacactttaaatgttatagcacctagatatacagcattgtccaatagaaaattttgtgatgctggaaatatgtaatatctgccctgtcccagtgaatagtcttcctcagaggttttctttatagcttccacatctctgttgtttgagatgtcccaaggaccacaaagatggaatctccaccctagagcccacctgagagggagtgactactcaaagcctctttacgagcaaaactgtggctcctaagtacctggccaagtcaaccacagtcctccaggatcttgttttgaattttaaagctgctctctcttgggcccactccatattactaccacggagagggtagctaggccatagtgcttctgtgaaggaggaagagccccttcaaactccagtcctttacctcaacaggcttagctatagggatgtctcctcaggcttgtgtttgtatcttcagataatttccatgggatattggtcttgattattttattttatgttatatagtcaaaaggctgataattgcttggtctcaataataagacattgcctcctcactgaaatattaatcagaatggtaggtggctgctatctctgtagagtaccaatcaacttaatctcatttggataaattttgaaaatgaaggaaagaaatgtggctacaaacaccatgttttattttttagcacctggaatcccactccaaaggagataaatttatttcactaaccttagcaaacaaatcaaatttacccactaactccacctatgcccaccctgcctaggagttcacacttgttcaatcattccattccattgcagcccaggtgaaaaaggctggttgaatttgagatgtgacctttgcttaaatttcatccccaaagtgtgcccctcagaatgtcacattcttttggtaaatagccctttcaaagtgaagacacaattatttcatgttatttatatgcttgaaatgcagaccttctgtttttcaaatccacaaaagcaatgatttaattttcagtagttaggaagtacttgggtcaaattttagccaccttgcttcaggataaatattactatcatttgcttttttctctctctcttttttttttaaacaatgtcttttttatgaacttgagagggctggtgatgattttgttttgttttgatttattttccccaaagtagagaaaacaagatctcctgttttacattttactttttattttacttaccaagcaggaatttgtcggtctgttgtctcacctactaacatctgtgtatcctggcattgaagattgggaatcacaagctctttaaaaggctgacacagatgggcagagatttagcatcctaattttaaaagtatatatatatatgtgtgtgtgtgtgtgtgtgtgtgtgtttgtgtgtgtgtgtgaaaaaaatagaaaatattcatatttaaaaatttagaattattagaatctttagtttcatggttagggatttgtatgaataatttttatttcaatatttacatatggcaagcattctataaacattccaaattttttgtacctgataagaaagaaaagaataaagcaatattaattgtggttggcttttgaatttccaaagtctttccttaacctttcagcatcagtagaattgtaaatcattgtcccaattaagttaacaataatttcgtttcttttcttttctttttttttttttttttttttttttgagatggagtctcgctctgtcacccaggctgcagtacagtggcgcgatcttggctcactgcaagctccgcctcctaggttcaggccattctcctgcctcagcttcccgagtagctgggactacaggcgcgtgccaccatgcctggctaattttctatatttttagtagaggcagggtttcaccgtgttagccaggatggtctccatctcctgacctcgtaatccaccctcctcggcctcccaaagtgctgggattacaggcgtgagccaccgtgccagtcaacaataatttcttaaccattctgtacaattcacatagcatgaggaatatgagatcaatatcccaaagtgaacatgatttttaaaaaatccattctttattaatattcacttggtatatatttaatcactgactcattagtcaagaagtatctgtagtgagaaaaatgtttagctttaaatactggtttcatgtgggaaaaagttaatatataaacatatagtcagtatatactttatttactaagaaaacacaattttgctgaattttccatctgattataatgacacatctagatattttaataataaagctacagcaaatacttgagggtctttgaaaggagaaagcaggttctatatttcaaaagtagcttggatataaactgcaaaattatttctgcagatgggcttgtttccccttttgttttatcaactttagatatttatgtcttaaaattaactaaagcaggacacagaaataaccctcttctccatttaaatatatattttttcatttgggttctagattctcaaatgattacacatatacattgttaaaagcttatgagatacattaaatctagattaaaatgataatatacttttacagagacatttcctgtagtacttacagcagagtcgtggatcaactcatctattcctaattattatgtagatattaggatatgagcatgagctcaagtactagtatttattttatgatatactggcagaaatcagagctgttgaatatgtttacttgttatctttttcattaagtttccaatatataaaactaggcattatctttctcataaataatatttgattaatttgttagtgattaaccatataccaaagggatatttgcatagaaatttttattccaaatctctccattgtagcttttaattacctctattaaggattatagtaatttaaaattattaaagatatctatgaattcttcaaactaaatcactgaaatgtcaatgcaagcttaatggttttgttgttgttgtttttggtaaagtagcatggtcttttagttaagaccagatagtaaatattttaggcttttctgaccataagatctcagtcacaactctgccatttgagtacaaaaacagtcatagacaatacacaaatgaatgtgcatggctggttccaataaaactttatttacaataacaggtgatgggctggatttggtccatggattatagtttgctgacccttgcttagaggataaatagctgtgtgcttgtagaaccaatctggtgagggaaacacttaagggaccatgttaattttaatgttgcacatatcctggttgctgttctctaggaaatagccatccctccagtcagataatgaaaatatgctggtgatttctcttctttctgcatggaaatcttcttaagggattttgagaattatccatcaagtgagacctatcagtgctcagtgcaaccctggtggaaaatataaattagttattcctactatttctataagtaggccctccagtcattgtgatagttgggccaatctttgttaagaacatgttgttgttgttgttgttgttgttgttgtttgtaagcatactttgaaaatgacctgccatgtaagtgtcaagaatagttaactcaagatggaatcatgattgacctgtagagtgtgatgggcctcaggaagcatgccctggtagttctgtgagttctcactagggagagacattttattatgttcttcatgccataggtactatggtctaagcaagtgtacaatgaataagtcaatgaattaatcaatggaaaattatagtctatagtgagctttgaattgtaggaggtaaacctatagcacattgtcacttcaaactcaacatccagttttacaatgactaagtagagattttctagtaagaaaattatccaagtttctgatatcacttttattctttcactggtgactctacccagagagaaagaacatgggtcctacattaggactgacatcagaggaaagagaaatgtttatagccagaagggaccttgaagatgaggaagagaataacaattttgatgactgcaacaatgatgttgacgctataggtttaaatagtaagttgttatttacaaaatgctgtttcagtcctatcactttccatgagttaaaacgaaggtttagattatgtgacttttgaaaggctaaaataaagtaagtgaaactggaatacttggaattctgctacctgatacccaattaggaaaaagagaaggcaaagtttaaaacaaggtctaggttgatgagttggtctattaaacttttctatttttctaatattcattctctttcttctggtaattctgggttttagaagagtatatacaattgaattgcttctgactgctgctattgacgcatgctaactaaaggaggcagcctcagcccagggaatttaatccagtcaagtgataattaagcatctatgaattggcattaattgccaacttttggcccttcctgtagatctgtccaaaccttgattgtaattcctgcatgtactgacaacttgatagtttagcatatcccagtgtccatttttaaggcactatccaaaatatatctctgctcattaccctttgatatttatctaaacaagtaacttctgatgttaagctttgagtaaaacgggggaaatggcagggaagaactgggcagagaaaacgggggaggaattcaaactacacttgataactgtgatgatgacaatttcagctaccaccagttttgaacatttacaatgagggaagatagtactgttttatatttattatttcatttaatcttcacatcattcctctgagataattgttattctttgtatctcatatataagaaaactgagttttagagggatcaatacattgtgtaaggtcacaaaggtatgagtgatgagggcaaggtttgacctcagctctgtggcttctaaagagtatcctgttgagcactaagcaatgttatgtcataatagctgggctctaagtcatggctaactaggaaaacttggagacccttgttactcaaagtgctgtcctcagcccaacagtatcaggagccccattccagacctgctgaataggatctacattttcacagaagcccccagtgatacattaaagcacactaaaatttgaaaagcatggccctaggcttttcctagacaacccctgcccagtagtctgaaagtccgtagagatactttatcatcaggaaggggagtaggcaaaaaaacaaacaaacaaacaaacaaacaaaaaacctaccacaatgtcctgtaaaaagaaagctttctccagcttctgaaatgcacatgtagaattttacagaggggctcaagggacccgggagaatagtgattagagggtcattcaaactgggatacttttgaaagggaaaagatcactaggaataattaccctggcacattaggcatgaactggaactgcactaagcaaactgggacatatgggcacctaagtcttacttggtgagaatctaccaaaatatcaggattttttagactgtaaaacatgaaaccagagagacaggaaatttaaagtctacaaatttaaaagggtgacaattagttattgattaaattattttattccacaaatatttatcaagctctttccttctttgtcaggtactttataagctacagagatatgagatggacaagacacaatagaacttaacaggactaggtaataccctttaagcttgacaacagcaatattaggaaacataaaattagagttaacttcatggaagtcataaattgcaagcatcctggttctatttctatcctgtatcttaagaagtgatatagtctaatattttaattcatggaagatgaatccaaatgtgataattaaggcaggttgggaagttagaattggaggaggaataagaatgctattttagatgatagccaaaaccatgccctccctaatatgtcacggggatcttctgacagatatggaaccctgggccaaatgggccataatgaaaattagaacacatgtaagctttggagtttatcatcttttgtgtgttttagaaaagagtatttatcctagggctttgttcaccctgagctgtatcttgtaaatgaaaagtacaatgtgtgcatcttccatgccgaaaaataaacagcaaccttacccttttgtaaacagtaatgcaatatgctcaagcaagatttacagatgcatccgtttagataaacaacaagaatccttattaacaattagtcctcatgcaagacccacggcaatctgtgctacataggaaaactattttacgatcaccatgctttctccagtgcctaggacagagtctaatgcacagtatagatcagtcaaaacttgtgggtttagtaaatgagtcagacggcatttcagggatgctgaaagaggagaacagtgtagtccttcctgctttaattctttttgcagagtgcagaattggttgaaggcagttcacgtagatagttccaggtcagtgcaggaaaccaggaaggagagggcaagaattgaccttgttgctttgccaactgactcttctattctggttttgtttccttcatctggagaagcagatgtgcctgcctgatagggcggaagcctggaagtcccacaatctggaggtaacatcctggtctctcaaacttcctgggtgattcattagccagccacaagcacaagatctgtcacttccagaaacttagccccatcaatgttcttatgatatgagcttaagatccagaacaaataacaataattgggaaattttaaatgaccatattatttatatataatactttgtgaggttaaaacaagctcacttaaaactttaaatatcctttgttatagctagttccacatgaaagtactgggtcaatttgtccttgtagtcaaagattcatcacaaatgaaattcaagtatgggcagcacaggccccatttcctcccatctcagaggcaaaggcatctgtcatcctgtccaaatcccatgcagttctgcttcatcagggtcactccagatagcatcatgttaactcttccccagcttcaacttctacactctcagtcatcttgtcatgtcaaaacccttccttgagcaaacctcttctgaaagccatctcttttttgcaactaaatctctcataagaatagtttacactcaaagctagttcacatgctcatctatctactcctgaactctctgctatctggcttctaccccatcattcctttgagtcttctgtcttcagggttataggcaactttgctgcgaattcaggagagtgagtccttattgcatgttacctctggaacctctgaatccagctgttttttcctgacaacgtcttttcttcccttttccataactctattatttctcctcctacctctgggagtaatatgtcttgctctcctttgaaggcatgttattcctcacctgctccttaaacatacttccatcttaggcctcttctcctctcactgtagacacatttctttcacccttttatcaattctgtggcttaggctactactttgttttatgttcttccatgttgcaaggaacagagacacacttggttatttcaggtaggagatatccattgtaaagttacacaggaaagaacttaaaaggggaaaaacatcttagcccttgtgaaaactgaacaccaccccatgcaagactcaaaggaaactcatccctgtgcaaagtatgactctagtaacattcgacatttaccaggctgtagacttgatgctaactagctttctctctttctccccacctccctcacttacccacgtcgctctagtctactctcaaatacctttcgttgacttttcttctctttccctcatggcttctgctccttcatgacatctgatgtctcttggtttctgctatctctctatctacccataatttcttgatagatacaatttattctataacttaaaacattgcaataatttttatatttgctttccttctgctttcaatgccttctggaactaggtggaatctgaatgtatgtatgtataaacgaatgaatgaaatattgaatcagatctactaactttgtctttgtatcctcactggctgcccatgatgtcatagttgccagttaatgagtactatataactgccattatgccacttacacatttcttcaaccttcacacattcttaagaagagatggttttatggactgaatgtttgcgtcccaccaaaattcctatgttgaagcctagccctacagccagtgtgatgctatttgcaggtagggcctttggggagtgattaggtttagctgaattcatgagagtggggctcccatgatgggattagtgcccttataagaagaggaagagaccagaccttgctctttccctgccatgtgagaacacagtgagaaggtggctgtctgcaagccaggaggagatccctcatcagaactgaactctgctggcaccatgatctcagatgtccagcctccagaactgtgaaaagcaaatgatattttgttttggcagccaaggctgactaaaaccagtggtattcctctcccattttttaatgtataaaaaactatggctctcacagatgaaattgctttccttagatcacaatgcaagtggtaaggccaggaattggaaccccaatacctgaattattttatggttttctgcattcattttataaaacaataagccaaaagataaatgaacaattattttttaatgaacgtgaatatgacgtatttaatgaattttatctttttgttctgcttttctattttggtctacatgacaataacacatcactataggcatatacgttacttaatattgctaaggcattaatcaagatatattttgataatagtgattaaaataagaattgattgatcttctatgtctctagaatttttagcttgtgaaaatacaaaccaagagggagaaatgactgtctttaaatttgtaaggcctactggataggtcgaatgaatttgaagacatttgtctgcaagtaacagaagactccccctccattggaaataaacagtaatgaaatttccatctaagatgacaagaagtccagcatggcctacgatctgggtaccatacagaatgtcaggatgttgggtccttctctctgcaggctctgtcctgctctgtgtattgttggctttgctctcaggctggtaccaagatggctgcatcagtttcagacatcacattgagatgtgacactgatcagagggagaagtacagtttatctctttttgtttctctttcatagcaggagactttcccggaagcttcatatttcataggcgggaattgggccacatgctgtgacaatgactactagttgtctccccttctccttgcatttcccccaccttcctttcactacctcctgtatagctaactgtcatcatgtgactaagtcccctgcagtaagggcttcctgttggctgaagttgtccagggctcctagcagcagtgccggacctgagacagcacagcaaaatggcagaaaagtaagctagttgagagcctcatccctgatgcatctatctactcctgaacagggtgccccctgttgcctaacacctgtcttcttttctccagtatataaaatataattccccagggaattatatttgcatcttatttaagaccactgttatttttatttcttgctcttttttgtagttatgcaaccaaacttaatctgatatgcatttcccttcttaaaacattcctggcaaatggaatagtgtaaccacaagggaccaaacataatgaggatctatctttggagccgggatgggtcatctacccttggtcacgtggcggaaggttgaatagccaaataacattagacctctctttggaagaaggagggaaggggaaatcactgttgggtaggcaactaactgaggctgctaataaagttaattaagttttccaaggtcacatggctaattattggtggaaaagtaatttctttttttttttttttaacatttttagtttcaaaggtacatgtgcaggtttgttatataggtaaattgcatgttgtggggctgtggtgtagagattatttcatcaaccatgtagtaaacatagtactcaataggtagtttttcgatcctcactctcctcccaccctccaccctcaagtaggccctggtgtctgttgttcccttctttgtatccatgtgtactaaatgtttaactcccacttacaagtgagaacatgcagtatatggttttctgttcctatgttcctccacttatgataatggcctctagttccatccgtgttgctgcaaagaatgtgatcttgttcctttttatggctgcatagtattccatggaatatatgtaccacattttctttatccagtctactgttgatgtgcatttaggttgattccatgtctttggaatattatggatagtgctgtgataaacatacatgtgcatgtgtctttatgatagaacaatttatattcctttgagtatatacccaataatgggattgttgggctgaatggtagttctgttttaaatgctttgagaaattgccaatctgctttttacagtggctgaattaatttacattcagaaaagtaatttcgacttaggttgtctaaaagcaagttcagtggacttctgtctataagataagcttagtcaatgatttgtcattgatattataacagaaattcatacacagctgggagatgacacctagctgttaaacatttattgcttcatcaattccctcttactaagatacaaatgtgagcagttacctctacattgctgagaatcatatgcatacaggtcaatgttatactcatatggaaagaagcagaccgcgcagaccacctcaaagttatatatttggccatgggcaataaggtgagaaaaatctgctttgctaatgttgttggcctgagctaaatattgaaatagcatccagttactcagcatgtgaaccaggcagtggggagtcacgcaaactgggactgttttgtgtggtggaacagaggtgatccaaatgtgtgtttgtgtgctttttagagtttgaggccaatttaaaaaatagtctgcactgcaccatgcacgtgggtttctttgtcaacaccatctgggtgctgactctagaagtttcacttcccttagcatactgtggctccattaggagatggggcacagcactttgatttcaaaggtggttggcctcattagctatttgtggaacttagtaaccagcagaaatgatgctgttggaaaaatcctctaccttaactttaattcatatggttttattttttttcttctgcttttgaggggctttcaaatgaagtatcagaaggaaacagtgctttttatatgcgcatgtgtgtagtttttttcttagtcaactgaaaagatagaaaaaacattctgtgtttgtggacagtattcatataaaattcaaaggcaaattttatctatgtgaccgataaacaaattactaatgcctgttaatcccagtgaattttacaaaatgatttgactggtgccgaaggaggcaggagaaagacagcaaatctgaactctataaaatccctcaaggagtaccttcttagaagacaagggaggaaatactttttttcaaatgggaagcaaatcacaatatagaattacagtgtttattattattattattattattatactttaagttttagggtacatatgcacaatgtgcaggttagttacatatgtatacatgtgccatgctggtgtgctgcacccattaactcgtcatttagcattaggtatatctcctaatgctaaccctccccccttccgccaccccacaacagtccccagagtgtgatgttccccttcctgtgtccatgtgttttcgttgttcagttcccatctatgagtgagaacttgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatccttgttggacatttgggttggttccaagactttgctattgtgaatagtgctgcaataaacatacgtgtgcatgtgtctttataacagcatgatttatagtcctttgggtatatacccagtaatgggatggctgggtcaaatggtgtttctagttctagatccctgaggaatcgccacactgacttccacaagggttgaactagtttgcagtcccaccaacagtgtaaaagtgttcctatttctccacatcctctccagcacctgttgtttcctgactttttaatgattgccattgtaactggtgtgagatggtatctcattgtggttttgatttgcatttctctgatggccagtgatgatgagcattttgtcgtgtgtcttttggctgcataaatgtcttcttttgagaagtgtctgttcatatccttcgcccactttttgatggggttggtcgtttttttcttgtaaatttgtttgtgttcattgtagattctggatattagccctttgtgagatgagtaggttgcaaaaattttctcctattttgtaggttgcctattcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatgcagtttcagctttctacatatggctagccagttttcccagcaccatttattaaatagggactcctttccccattgcttgtttttctcaggtttgtcaaagatcagatagttgtagatatgcggcgttatttctgagggctctgttctattccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacggtattgattcttcctacccatgagcatggaatgttcttccatttctttgtatcctcttttatttcattgagcagtggtttgtagttctccttgaagaggtcctccacgtcccttgtaagttggattcctaagtattttattctctttgaagcagttgtgaatgggagttcactcatgatttggctctctctctgttattggtgtataagaatgcttgtgatttttgtacattcattttgtatcctgagactttgctgaggttgcttatcagcttaaggagattttgggctgagacaatggggttttctagatatacaatcgtgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgagatacgtcccatcaatacctaatttattgagagtttttggcatgaggggttgttgaattttgtcaaaggccttttctgcatctattgagataatcatgtggtttttgtctttggttctgtttatatgctggattacatttattgatttgcatatattgaaccagccttgcatcccaggaatgaagcccacttgatcatggtggataagctttttgatgtgctgctagattcggtttgccagtattttattgaggatttttgcatcaatgttcatcagggatattggtctaaaattctctttgttggttgtgtctctgcccggctttggtatcaggatgatgctggcctcataaaatgagttagggaggattccctctttttgtattgattggaatagtttcagaaggaatggtactggttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgttgaggaatttatcgatttcttctagattttccagtttatttgcgtagatgtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcgaaaaaccagctcctggattcattaattttttgaagggttttttgtgtctctatttccttcagttctgctctgattttagttatttcttgccttctgctagcttttgaatgtgtttgctctggcttaataatgcttgtgcaaagatgattaggaattttgaatacattggaatatggtgataggaggtttggtactgatacacatttttagcaagccttttattataggctaaataagatttagaagttgtattgataatacatatgagcaagactgtttggttacctttaatcttcctttaagtgccacttacagaattaatttgtttattaaacataatgtcctcttattatctaacaaagtttcttatcctgaaaatctgaataattgtgtgttcctgaatataaaaatgtttacatggaaaaacttgtttgtttttggtgtcactaattcagattgatccgtttgtctcatataagatgggtttggcactaccagattttacagtgagcagaaaatgtttctgtacagattcataccatcagctctcagaggacttgacattcacacaaggaagaaattatttgtaatacctagtacctgaggtgtttgctttataaggagatgccataacagataatattataacaaagagttattaatgaatggggaatttacccatttttttacatacagaattcttctaaatcaagctgaatttatttttaaggagataagtgcttaggatttaactttctttaggactttgcattaaaatgtttctagacatgggtggaggacctttatgaagataaaatggaataaaatataccaaaccaatttttctattataaaaaggcaggaagtcactaaatcataaaagaatttacagaagaattgagaccactcatagctacctgaggaaaacaattaagatatagttaaggccgggcacggtggctcacgcctgtaatcccagcactttgggtggccaaggtggacggatcacctgaagttgggagttcgagactgtcctgaccaacatggagaaaccccacctctactaaaaaatacaaaaaattagctgggtgtggtggcgtatgcctgtaatcccagctactcgggaggctgaggcaggagaatcacttgaacccaggaggcagaggtagcggtgagctgagatcacgccatcgcattccagcctaggcaacaagagtaaaactctgtcaaaaaaaaaaaaagaaagaaagaaagaaagaaagaaagaaagaaagaaagaaagaaagaaagaaagatacagttaaaacgtagaactaccatatgacgcagaaactccactcttggttatctacctaagagaaatgaacatatatgtctacatggaaacatgtacatgaatgttcagagcagtgttatttataatagctaagaattgaaaacaatccaaatgttcatcaacaaataaacaaatgtgatatatcaatacagaagaatatatttagccacaaaagggatgattcctgcgacaacacatgcaaacctcgaaaatgttatgctaagtaaagaatccagacccaaaaggctacatattgtatgactggatatatatgaaatgtccagaacaggcaaatccacagaggcagaaagtagattcatggttgctaggggttgagggagagggatgtgaggagtaactgttaatgggtatggatttctttttaaggtgatgaaaatgctccaaagttgattgtggtaatggttgcatgactctgaatatactaaaacttactggattgtacactttaaagtggtaaattttatagtatgtgaattatatctcaattttaaagaaagatataattaagactcaagttcgagaaaaagcagacctgactagtagttctagcttttctatccacacaacagatatttattaagtaaatcgctatatccctagtgtactgctgttcatgacttgtaggatacccaagataatttctgggttttaaaagacttattagcatgggggtgatgtcatctctcacaaaggcagaatctttgcagctggccagagagaccccatatccaaaaagtaatgcagctttgggggaagaaaggagaaaaaagtactacatctgtttgaatacaatggatagagttaggagtctgattaactgacccaaacacataaaatttggagaacaataaagccatgagccaaatcataagagtgtaggatgtaagtttccctaaccccatccctcatctaacttaaaaagagaaaacattttccatcaactgagtgggaaaaaagccaggaatctccatgaatcaggaccccctggatttcttccatcctcattgctttggaagtgattaagtccaatgatgagccagtgtctataaagaattatgctttgtgtatgagcctgtcattttgaaattatattataaaaggtaaataaaggaaaatgacttcccaattcaatgcagtttggggtcggtccataagcacaataccattgtaattaaaatctaaaatgaaatactcagagacaacaggatcaaaagccgtggcatttcaaattgacctgaactatcacttactggcaggtaatatggctgtgatgaaattcctcagcaagaaaaggtttcaatggattaaggagaggtacaggctcgggtagtattatgtgtgtagccaacatagcaacaaggaggtaaagaggatatttgaaaatgcactccctccattaattatgctctacaataatattctaaccttgctttaacactgtagcatcattttcctcatttctgggtccaggcaatatggatattttgtgttaaatatgaaataaattctcaattttctttagtataatttaatacataaatggatgtaattcttctagaaagttttgttagatattaaggtacatatatcaaaacataatgtatgctatatattttatattatatcaaaatatgttaaatcactatagtgttgaagcacagtctaacaatattctttaatgtcccatcagacattaaaaagtatattttaaaaagacaaattttaaaaattaacagtgatcaagagatttaagaaaaaaacccacattgacatactactgtgatatttttctcaaaaaaacagcaaaaatgtttatatcaccttgatgtcaaagtacttcaacttaggttgaggtcatatatcctagtgaaagtagtcaaggaaatagtcatcttgccaaacaagtttctttttgtttttgttttgtttgtgtgtttgttattttgctttaagttctgggatacatgtgcagaatgtgcaggtttgttacataggtacacatgtgccatggtggtttgctgcatctaccaacctgtcatctaggttttaagccccacgtgcattaggtatttgtcctaatgctctccctccccttgtcccccacccccaacaggccccggtgtgtgatgttcccctccctgtgtccatgtgttctctttgttcaactcccacttatgagtgagaacatgtggtgtgtcaaactagtttctactgttgactaatcattcctcattctttagcctgaactccctggagcaaaagtagaaagttaataaagctgctgcctagtgcctaaggtgtcatgaggactgtgaaaaagaataaaacatcattccagcatggggagggaatggattagaccatagggcacttgggcagctatctttgactcagttgtcattagaataggactagcattgagtaaaattccaaagtttggtttgagcctttattaattaattagtatgaattcatttatcatgggaactatgctacctgctacactcttcagctacccaaagccagccgtaaactgctctttccccatttccagccatccccttctcctctaacgaagccctccctcttcctcatatcactcattgacactttacacaggagaactgaattacagttgtggcaccctaacggtcatatgtttggccactcacccaaaacaggattcctttttaccacattcagaatggataatcagatggttatctgcatgaacctttaagtattaagaatccccttacccttaagtcacttatccttgggtgaatgttttctttagatatagtctccttgaaggaggcccaggcctacttcctgaaattctcattctgtcatttgaaatctgctctcttgaaagataggccagatctactacttcaccattcaaatattttaggtcagcatttctattactgcacagcctttgcaacttcagtctcaacatcagtttctttcatggatttcaaaggtttgtcaaatgaccaagctttcaccatcttcccctctctagcctcactaccctcttcagaacttgctggatgcctcaatgtctttcaaaggcgtatcctccagaccagagtttagtgctccatgtgtgctctggctggggtggaatccattgcgtggtcacttttctcttttcttgagttggattccaaagtttttttcatgcagctcaagtttccattgcctggtgtaatgcttttgtcagacttggagttcatttgagcttatcggacaattgttggctcattagaaatcctacctcttccttttcacagaattaaactcaagttgcctctctctgtctaattaattgttacaatttaaatgcaaatttctaatttcttgaatttttaaagtatcatcctaaccttttaatctaattaaattattatatataaattacaattgtattttaaaaccccaattctctcttctattatattatgcattcttcctagcttagttgtctagtaaaaatttgataatcactgcccatgcttttatgtaagtttctgatgaagatgttaaacaagatgggaccaggtacctgtggtggtagatttgcctactttgttaattagtacctgatatgcatagttcttcagtccatctgtatgtacagctgtatttgctacattttactgtctgatccacaaagtttccggaaaaatttgtccagcatgctgctgaaatcagtaatttatctaaatcttttggagtcagattccatggtaatggaagaaaagtggatatatggtttgtggggaaaatatgtggagactgatgaactctcaggggatccttctacatagagaactatgtattattgtgtttacctttcagtttattctatcatggatggtactcctgtcctaactaaaattttataatcagtagtcctcatttcacaataaatgatgacaatgatggtggtgatgatagtggtggtggtgatcatggttataatgattatgatgatgctgatgaacatatatatatatatatatatatatatatagagagagagagagagagagagagagagagagaaagagagagagagagagagagagagagagctctttccatgtgccaggtactacataagtgctttatactttttatctcatgtaatcattgcaacaaacttgtaggctaggtgttgctcactgaccctaactagtttagacattcacaactggtaggttctctttggcagataatggaaacactggagaagtgacaagtggtaaaagttaactgctgtactaccatgtcactaccaggttgtatgaaagagcaaattcttctacataaccatttaatagccagcaggcaccaaaaatccagcctgttttggtagcttggagataatcaatttatctgtctttttgggctttctaagcatttctttgcatgaaaagtttgcctgatgtagtcacaaacgattgttagctcattaaaaatcctaggcagtgacttttctagaatatggcttcacccactctatgagtacaccctttccaatgatgaggtcaaggaaaatgatcagaaagtacagagaggaggcagaacaattagggaagagagaactaaaatagaagtgacgggtcagacaaaaattcatttgggctacttgccacatctctaatttcaaactccttatcctaaatcgggtttgtttaactctcaagaaataggtgtggcccttgggacaagttggctcagattgacatactaccatgcatacacacacacacacacacacacacacacacacacacacacacacacactataagcaatactgttgcctgagacaggttgtttctgattaaataaggacaccctagcaaatagctcaatactaaagacttctaagcactggccaagttcagtaaatgtcctgaaaggaagaagtttagttctcagggtgacttgaaattagaactttttttgctgtttttgttttaaaatgctttgcctgggagagagcactatgtggaattaatatccccttctgtctccacagcaccacactagtcagcctaacttagagagggaaattctttgttgccttttttccaaatacctgttaaagaacttttgctggggcttacctctgtgtgttgatcaaactgaaaattttccaaggatctgaggcttctctggagggtaggttggcattaagatttcttcaatagtgcaaaggatgttgtttttcacaaccaacacagatgtgcatgcttacaatttaccttcagtctggaaacatgttagtgaggcatgaatttctaattggctacccacagatggatacggtactaagtatgcttgaactgaatcatataatttgaaggcatttctaaaggtcagttgacatatattgtataaaaaagaaagattatatatatgtgcatatgcatatatatgtagtatatatacctatacatagtatgtatacatcaatccaggtgaacagagtgtatatgcataatatatagtctacatatgtgtgtatccatatattatattccaactaaaatatcattctcaggcatttaagaaacctgctcttacctcatttcagattccccatgggtactggaatattttatccttggggatgattaagtaagagagatacaacaccaaagctgacttatcattagtgactcagtactggagaattgagaattattcagatgtgccgaaatctctcttctgaccccctacatggaggacaagtcactacactgaagttggcccttgtctgtccccttgtcctttggttaagaactttgatcaactgacttaaggcctcagatatgggagatcctctactttttcatgccctaatttggtcctcagtggtttctgtgctgtctttaagtagataagggaggccctacttcttactggtaaataaactgaagatataccaaaggtacctgcttcagcatgaccattgccttatttggaccagttaacagtgtgtacttaaggctcccaggcagtgaatatctttcatctcctagcagattacaatctgctactataataactccccatctctgttgcattgttagctgtctttgtgtgtgtgttgtgtgggtaaactatttgatcttgtatttcatcaacttttaccaaactacctctttgctattgatgagaacagtaacctttctacacgtaagttccacttattcaagaggactattaagtgatcatgtctctcagttgattagaacatggtgttactgaggtataatttatttttgtagtcgttttattaatgacaacagtaaaatatacacattacttgccatggaacagatcacatgctgagtgttggacttgccttatgtttctctgtgtaagagttgactccaatgatcactcaagtatttccagaagggaaaggtgagaagtgattggtcaatgcctaaggctctcacaacttgtggtctacaaccctgtttgacagtgagctgtttgggcctcggtaggaattttcccacagaaaggatgttctcactggcaggctcccaggaccgcccagaaatccatttaaccataacagagctgacagcactgtcaggactggagttggcttccaagtgggaagtcagcctagtattaatagcacagttccagctgcactgtgggtccagcagacttctgacggtccggcctgggaaccaaggcactctttgtaacatttatgggaaatggagtcctcgttgagaatggtgggaagacagtactgaggcggtacaaggcccatggcttctcacttcccctttctactctaatcacttccaacgccactatccagcaggacgagatggaggggaatcctagaggaatccttctctagccttcaagtctggggagagcctgccctgttcctggcctggctcacttgggtcgactgttctcatgtacaggatatttgtaagttgggtgtttctaggtcacgtgtatttagttatatgatatgaatgtttattttaatatagtagctcttgatccaggcacaaatatattagaatgtaaagttcatttttatttttaaaagatttttcttcattttgactaatttcagttctgattatgatctcctgcttctttaccagtttaaaggcatcatttttatgtaaataaaatgggtgtgcatgattgtagtaaaacattccgttttgtggttacaggaggaaatgagagaagtgggtggtgcactgtgtatgcatgcgtgtgtgtgtgtgtgtgtgtgtgtgtgtgtgtgtgtgtgtaatttgaatatgacctaaaggatgggggtgtttgttaccccaagacatacttcaaggaattaaaaattgtgttgtactaaagggaagtctttttcactaataacttagaagtattgcagaccatttaggtttttttgttggtcagaagtattatagttaacagatttttttcccccgggagctctttgaatacataatttctttaaaaagatttttaaagactgaccagcaacctgaaaattattttctgctaatcccaagtaaatgtctctgtaatgtaagtgctgctttaaagttatcttatggggtacatatgacccaaagggaaaataacttgtttattaagttgattttctttcttttttcatgattcacaaattgtcaaattcattctgtttgggacagtagaaatgtggaaacatgtaagtgagtaacaattttaaagtgtaaatcaactaaaatgtatatgaaaccctgctgggttcttaggcagtctcttgatatttctaagctacacttctctcttctaggattctgttttgggacatagtcataaacacaaaaggaagatttcagcaccaaattatattcatctttaaaatattggggcccttcagccccttccaaacactggaaaactctctggagtttggtttgccaagacatgggaaactttttttccgaatatttttaagggaaaattatattttagggttatgaatgtagaattataacacagataatttaataagcctctatagctaagtctaggttctctttaaaagatcttgttttttcacccagccccatagttacatatttgagggagtgaaactgagcatacaggatttttggagtggcaggtccatttgaaatcattctcgtccaatgttttcattttctagaaaagggaactggagcccagaggggttaagtgacttgagcaggctactgttggtgatggcaatagtaggagtggccatcatttactgaagatcttctttttctgggtttccttacgttttattttaccctcacaaccaccttgtaaggcagggggccatattccagttttataagtgagaaatctgaagtttgggaagtcctctagctgctcaaagtcaacaggtactaagaggcagagcaagaatccactgattctggatgcctggtggcttctgcctcagggtgttttccattgtaccagacatttcccaggcctaagtagaaatacaagaagcattccttctttatacatgtttacttctaatatatcaagagcatctgtatctaagcaatcaccctggttactcaatcttttggatagtagtctggggtattgggtctccttaccttagtttttctgacaaaaaataatcttcctcctactggatttcataatattccaaaatttgtcttcagtggatgcctcaacatatactttgaaatgtctattttatttagatctgaagaagagtattctttttttttgctctcattcagtgattcattcatttatttattcagtaagtatgttttgaatgcctactatgtgcagatgctattctaggctttggagatacagttctggacagaacagacacaaacccctgccctgatggtactttatttctagagggccaaaggatggccaatacatacacggtaaaaaataaggtaagtgagatggtgataaatacactagaaacaaaaaacaaagaaatttgtttaatgagtggaaggagacaccaggaagatggggtaggacttactcaaaaataactgagaggggaaattggggagtgcttcttatcacattgtcaattcagcaaaaaatgccagtgtctattttgttcagcaaattcctttccaaaaatataagttttcaatcccccaccaatagtaaaatgcttatcctaactctgtctctatccttatgatatcttcccatccaccctttatggaacccattgttatcactattataccaaaaaaaaaaaaaaacaggaataacaggagttatccacatatctaagggtaatacaatttgagagtaagagaagcttagtgcctggcctatttttcccaaacatctaatttatggaggagaatcttgaatctcagaaatattgaaatgttgggaggctggggcaggagagttgcttgagcccaggagtttgagaccagcctgggcaacatagtgagaccctgtctcttaaaaaaaactttttttaattagtaggtgtggtgcccacctggagtcctagcagtttgggaggctgaggcgggagaatcgcttaagcctaggaggtcgaggcttcagtgagccaagatcacattgctgcattccagcctgggtaacagagggagtccccgtctcaaaacaaaacaaaacagaaaaataaatgttcaaatgactaaatgacgacctcagatcaaatggcaaggtgcttattattttatttccagtaaatgatgtgctgagttcccatggtgagctaagtgattgagctggatccaggggcctcagcactgacttcagaggagatggtctgtggcctggaggcacagagaaagaactgatacagacaaagacttctgatcccaacccagtgctccttcccctatcccatgatggggactctttgctgttttccagggtctcacaacggtgagaatggggttcccttttacatttgtacttcccactctgtacttcacgtatgtcataggttaaatgagactacttgagctgacctacgaaccaaaaccactgtatctttatttctatgggaaaatgcatgtggactttgaaatatccagctatcttaacagactttcagaattgaggagtgtctgagttggaaaatataagcaaagatcatttagtgttcagtgaggcaaactctagctgcccagcctctaagatactgactatctcctagagaaaacacaatcctctgcagtcctgaaggaagcatcagatgagatacaaataagtagtaacagtttcttccaaattgtatggggaaagttttcttctcttcactatgaagaaaacctgatgatcataaatagtgaccattttttccacaaagtggcaatttgtgagtgtgtataccagccattctgtagtttgtcatagttcctagggctatggggacctatcacaggattgtagctcatttaatctggattcactactttgtgggctggacttatgtttctattaatggtagtagccagtatagtgtcccaaatgcatgttgaatggcgtggagtggaaggacatgttctcttagctattctgtatgctagcaagtgtcattttcctgtctgccttccataatgggaatgccatggacatttcagttcgtgttctacattcctatcatcacctgattgattggaatgatattgctatataataaggatttcgaacatacataagcattctgaggaaacatgaggttagattgaactgcagtggatgctctaccacagttcaagggcaagattattacagttgccttgacaaccatagctctgcactctctgttttattacatactcttttcctatttgggaatccttttgagaagaaacaaaagaaagaatgtcagtaaggtctcattttcaatttatgaggcttctggaaataatagagtcttatatagctacaaaaacgtctccatttcttaaaatttccccaaacattggaaagtccaggcatatgaaatgaactaaaaataagcttttacttatgtcaaaacacaaatatcatctttactccctatagaagtaattattttgtaaggactgaaagaaaagattacttttctatttttctctagcgtacagctgtgacttctatttttctataaaagggaaatatttttgcctataaattttcattagtatttttacctgtattacagttattcaactgcaaataggtatataagtaaaatagtcttactctaggaaatggctaggttgagagactatcaaacagtgatattttaacaatgtgttacattattaattatcaacacatcctcttttaggtttcctttgtagagcacactagtttgtttgtttgtttgtttgtttgtttgtttgtttttcaagagaaaaggtgacaatatttgggtctttataattgttttttctgtattaaagcaaaaatgtagtataaatgtatactactgtgtgactataaaagtcattgagaaatattattttttattttgtccacttgttattaaatctttcttttcttttctttctctctttctttctttctttctttctttctttctttcttttctttcttcttgagacagggtctcactgtgtcacccaagctacagtgcagtggcatgatctcagcttactgaaacctccacctcctgggttcaagtgatcctcccacctcagcctccccagtagctggcactataggcacccaccagcatgcctggctaatttttgtagagacagagttttgccatgttacccaggctggtctcaaactcctgggctccagccatcctcccctctccgcctcccaaagtgctgggattacagtggctctatggaacaaattcatatgttaataccctaggatgggagttagggaacttttctgtaatgggacagatggtaagtatttcaggcttttgaggctatacagattttgtcacaactactcaactctgatgttgtagctgaaagaagccatagataatatgcaaacgaatggactgggctgtgttaaattaatactgtattcacagaaacagacagtggactggatttgtcccaggggctgtagtttgccaactcctactctgggagaaaaattgttttgcttacttatctgtccacagtctacaggggagtgtagtgcttcaggcaaattgcttcttttataatatatgcctaaactgagcatggtggtgcacgcctgtaatcccagctacttgagagactgaggtgggaggatcacttgtgccccaggagtttgtgtccagcctgggcagcatagagaaaccctcatctcttaaaaaaaaaaaatgtgcctaaaagtccatcttttcactctgacttttgtgtaaaatgtccccattgctaccatattggttctattagagagaaaggcaggggttacacacttttgcaactcattagggagagtagaagcagatattgataataatttccttgttttaaaagctgttagagcacatgaaaaaaaaattcaactactaagatttccttacaccctagctgaactgctcagttagaactgctcttgaatatcaaaggctaacgtgccctgcctgcgtaaggtggcaatataaactgaggtagacactgtgggatgcagccccttggcccccagctggcctccccatccccatggggtctacatagtcacctggcaccaagaaaaacgtgcttttttctttatttttctttgaagtattcactggtgctttgttcaaactgattttagcatcctctttgagtttgaatcagatacttcaaagaaaaatatagaaaaacgaaaacaagtatctatgtatttgttactcagatttagtaactgttaacatttgttcttatttgctttggatatttttatcttttttaaaataaagaatccctttcattgacacaattgtaacccaagaattttccccattctttctaaagaggctattgtcagaggaatctgaattattttccacttattaaaattggttattgagaggcaaaagaatagaaagaatattgattttatagtatatattcagagcatcactggtgcatagtatgaacgatttgatccaatttgtatggttttctgcccatcgaagactgaataatatcatgaatctactcccaagagagacatagagaatgcatcacatctctttcctattgggaatgggatatgaatctaaaagacagtaaatataaaccatcctaattcataatagagagctggatatatttttcaatttcaatggcaactttgaaaagtacattatttttctctgctgcctttaacatactaattgccttgtggtataaatgctttcataaatgctctctcatctgatcttgtgtgatagttacaatagatggtattacagctctctcccaggtaagggtatggatgcactgggatgtctgtacagtgtttggcagtcttggctggacctttgtatcacctaccgagctttgaaaagatactgattctgagcctatccacagaggttcaatccaaccagtctgagcaacagtattcttttcttttcttttctttcttttcttttttttttttttttttttttttttgtgatggagtttcactcttgttgcccagactggagtgcagtggtacagtctcggctcactgcaacctccgcctcctgggttcaagtgattctcctgcctcagcctcctgagtagctgggattacaggcacctgccaccaccatgcccagctaatttttgtatttttttagtagagatggggtttcaccatgttagccaggctggtcttgaactcctgacctgaggtgatctacccacctcggcctcccaaagtgttgtgattacaggcgtgagccactgcgcctggccgggcatcagtattaattgattctactgtactgctgaggttgagaacccccaatggaccgaccagtggttctcaagtagggactatttgcccccgcaaggggacatctgacaatgggacattttttattatcacaactgagaaggggcatcccctggcatctagtgggtagagaccagggatgctgccaaatatcctatagcacccctacaacatagaattatctggccccaaaggtcaataatgcttatattgagtaaccctgatttaagctggactaaagtccctctgactctaagccatattgtttccccagtctcaagttgctagattattcaaattagtcatcctcttattattgctgctaataaaatatattttaattaggttgttcttcaaaacaacatttacaatgactttttagtttatcaggaaccaagtgatcttgtgtcataaccatactgggataggcaaaaatccttatattaaacattttcaattacttttatcagaatacaaaacaagcaagcaaacacacaaaaaacaacacaccatcaaaaagaagaaaagagctatttctcaacataaattgctctgtatgtattatcccagatgagcaatgtgtattatataaagcagtggatttcaaacttgagagtgcattgaagtcacctagagggcttgttaaaatactgattgccggcctcatctccagagtgcctagtcagtaggtccggggtggggttcaaacagttgcattttgaataagtttccagctaagattgacatttctctcctagggactatactttgacaatcattaatgtaaagaatttctctatattagcatttcaaatgaatattaaccctggggaccatctattaaggcctcaagttaatattcctaaaagttaaaaatcattttatcatagtatacaaataacttaaaatatgattcatcaagaaatatagagggcttcctaattctatagttacaatcaggacagccctatagaatcaaaccttttgctcccacttctaagagcagcaagagctagcaacagcaagctttgcttaagaacaagcctagtagttttatgaatgcacagctctctacctgatcggaaatgaagggatgccagttcactgagacatttttaaacgcatctggtcaatgagaaagttgatattttctgtttcctgatgtgtatccttcaaattatacataagtgcttaagtgaaaatgacttgatccaaattcccttagctttggatacattaacatatgctcatggaagggtggatgggatatctaaaattttattgaagtgtattgcctctctataaaataacaaaaccttaactccttaagtaattaaaatatttggcagaagtggctaaataatgttagattcaagtatggaatctgaagcccatttcaggtatttcaagaacaagtcaattattcatccagtctatcagccaaagacacttgacagagagcagtgacatggtgttttgtaaaaggcatttccatagtactagtgctctcattttgttgtcatccagtagaaagaagtgtacacatttgtgaagaaatgcatgaggtaataaaactatttaaaaatccacattttctcaatttagatggacttttcttaaactagtataaagttaggtgttaccatatattttgtaggcataaaaatctaaacctcaaagtggcagaattcaagagtacccatcccttattttctacaggagttcatctgaatcccttgatagtaaagattttctttctttctagaacctgacataattcctagtacataccaagtgataatgacactttcattgaatttacttaaatagctatatgagaggtccatgtatttctatatttcatgaatttcaaattatatatttcagtcccatttaaagttaggatctttataaagaaaatcctgaagaggatccagactatagcgtccaatgtgcaaatttttaattgtgagctagagattgagaataaaggaaagttattggaaaattttccaagaactaagcctttctgttgtgctggtattgatgatatatgtgtcagtcagcaataagactaccaaaggtgaactaaataatccggtgccataaaatgtcttataaaacttaagctgctaagaaaatctaaggattaaaaaatgtacctattcgcatacttctgctgttgtgtgtttaagagcaaactgagaggttgctatggcattacttatgcgtgcatggcaacagagcgaacttagtgattcagcttgataaaagaggaaattagctcaccatttcccctttccccaaatcagagtcagatatccaaatatttcattttgaaatggtatatccatcaacacgttctaatggatgaaagtcagtgggggtgggggtgggggaaatgtcataaggtgaaattcgtatgtcatgtgcttactttagggaatgcaacttgtgtctaaacagtctattcatatctctgcatccttctttccccctgataggatggggtttctcagtggcatctgttgggtgaatatacgatgatgagtaacactttggcaaaagacagcaatttatcagcccgtataactttgttctaatggaagtggatcatcccagaatttgagaaagaaacattgttcagctgtgaaactccaattccctgtgtgtaacagccctccagggaaggagtagattttgtcagcataatatgtgaagtttagtcattatcaactgcacaaagcagaggtcaggcgtgggcgtacatgtgggaggcactattatgaaatcaacccacagccactgccctgctggggtgatccaatacaaacagagccaaatgtcatgaataaatgctgacattttatcacatgattagtttaaatattattttactactgtgctttttcttgtattatttatctttcacatctttattttgtttccggtttcctttctttaaactgataaatgaaaaatagggaagtatgttttgagtcagtactttgaccatgaacacaggaagttaactgaaccctccaccaccagaacaacaacaacaaaaaaactctaaacctgtgaatcttggaatcttagatttgttctgggttgacatgggttttggaatcataattttattaatttattttttaatttacatagagtaaaattgaccttctggagggtatggttctatcagttttgacaaatacataaagttgtgtagccaacatcacaattgtgatacagaagaattctatatataccaccccccacccccacccccaccaccaaatctcttccttctgccttttcgtagtcaacccctcttttcaccctcaggctctggcaaccattgatctgttggaactgtattaatctgaccgtttttctccactctgtccattcatgcaacaaccgtttattgataatctatgctgagctccattttaggtgctagggatgaaatggtgaacaagactgacatagaagtttctatctggaaacaagataatgaacagtagtaaatcagtaattccaaattgtggcaaatgctgtgtaaagaacagaaatatttctgtgacaacagatatctgaaggcgaaatctttttttttttttagacggagtctcactctttctcccaggctggagtgcagtggcgcgatctcggctcactgcaagctccgcttcccgggttcacgccattctcctgcctcagcctcccgagtagctgggactacaggcgcccgccactacgcccggctaattttttatatttttagtagagacggggtttcaccgtgttagccaggatggtctccatctcctgacctcatgatccacccgcctcggcctcccaaactgctgggattacaggcgcgagccactgcacccggccgaaatctattttagacactgttaagaaggttactctgagaaggcagcatgtaatctgaggactggaggaggagaagaagccagctgtgtgaggtgtgggtggggacacatggggtaatcattccaggcggagggaacagtatgtacaaaagagagttgggagtctagtgagtgaagggagcaatgccatgaggtgctgtagatagataggcagagcttcactaaggtgtatgtacttcattgcattgcagtgagaagccattgaattaggatggggctctaatggggatggtttgattgatgttttgagctctgtgtagaaaatctgtggtagaccagcaagaatggatacaggggaccagttgatttgcagccaccatccagttgactgttaatggaagattgggcttggcagcagctgtggagatggagaagggatggatttgaaatatattttagaagtataagcaacaggactaagtgtttaattagatatgggtaaggggctggtgaaggaaaagggggaatcagatgtgactctcaagagcttgcttgagcaactgggtgggtgatgctatttactaacatgagtaaaatattgagagagaaacaagtttgtattggaaaatttaaaagctggggctttggacaggctgaaatagagaaacccattagacatccgtttggagatgtgatgcccctagatggggatatgcatgtagaattcagaggagagctcagagctgaggagagagaaatttgtgtcatcatttaacttttaattattcattatatcataaatatacaatttaaatatattattatattttgatatattaacgttaatataaaatctgtattattaacaatttattcactgatatttattgagggcccaccatgagggagacttagtgaggaaatggaggtatgatggtgagtgcaagcctgtatgatctgagacaggctggcagtagtcacacagatatgtgtaaaatttaagggacctcagtaccacaaaggagagggttctatgaaagggcacgagagggagattcgactaaatctgggtggaggtgagggtcaggaaaggcttccctgcgcattaaagaatgaggaagtgggagaggatatcagattaaggaaagaacatggataaaagtcggtgtggtagaagaccagagattttggttctcagatgcactgtgattccaatttagatgtccagaagggcatcccaggaacatctcaagcacttcaggcaattcacattccttcagcaaatatttgttgagcacctggagtgtgcctgagattctttcaggtgttgggaattcagcaatttatgtgcaaaagttctttccctcatgaagcttgtttctttctggtggagctgattcaggaggttcacaaattccagacacatcttcagaaggattgactaagagatgttggcctgcaacagagccatgaggagtgccagcatttagagctctaaaggagcagaagcagcagcaaagaacctagagcaagtggctagtgaaggaaaaagagagaaaaggggtgcgtatagcaaaagctgggggaggtccagatggcaaaggtaatgaatggccagctaggtttagtggtgctgagggatcaggtagaataaaagcagaatagtcgcccctcagctttataacatggcagcattgggaatttttaccaaaccagttttatctgaatagtggaagtagaaaacagattgagttgcttgaaggagtgtctgggaagtgaaaactgacaaagtgagaagatattggcaattgagaagtgaaaaattgctgatgactttagagaagtttgccttcagttcgggacttcattattttcctgcaggaaagagtcttctgttagtggggagattaattaacttatttttgcccaacttgtctatctaaaaggaagaaagtagtaatacattaaaagattgagactgctgaggatgaaatggggtagtatatgcatgcagtggatgctcactaaaaataagagcttgcatttatagtattttaagtttgccagtctcactctacctgacataaattttcagtaattatcttattaaatgccaagtaagattcaaattattattaactgatactcaagggaggaaatagggtaagttaagcaaattgccctaataacgctgctcataagccatggccctcggagaatttgaatccatattttctgtggtttggacatggtttgtttgtccccatcaaatctcatgttgacatttgacggtcagcatggtgatatcggaggtggggcatagtgggagatgtctgggttacagggatggatccctcataaatggcttggtgctgttctcatggcagtgagggcattctcactcttgacactagattggttctcaggggaattgattagttcctgcaagagtgggttgctagaaagccaggacacccctgggtttggtccctctttgcacatgtctgcttcctctttgaccttctcagacatattttaatggaacacaaaagctctgctgaaatccaagcagatgccagtgccatctatcttgtaaagccagcagaactttgaaccaaaataaacctctgttgtttattaactacccagccttagctattcctttatagcaacacaaaatgaagtaagacaacatctgttgacttggttctatgctgtgtttgctccacttggtgttgtaattttattcccctataagaattgtatctgcttaagtggagactgagtattcatctactttgtatccccatacttaccattgcatttagcccagtgcctggcacaaagtttgcagttgtgagtggcactgatatgaaatttctcagcccttggcccagccttcttgggctgctcttgtttttgaagctccagtttatactcaggagaaatgctttggacttcagacctccaaactgattcatgttacacatatcatcagtggagaaagtgggacagagtaaagggtggagatagctcttgaacacgacagtagaaatggtatgatgttagcagaaaattaatatgtgcacatcttgttgtactgagaaatactctaacattataaggaaacaaataaaactgatcattgctaggtgacgtattatatatatagtatataatgtaaaaatacatatatagtgtatgttgtatataatgtaattgaatattatattgtatattatatgcaatgtacatctatatatctatagatatctacccttgtgtatttttttcctacaaaatgaaatactttcaccatcagagagtaccaagtaggaatattcccaggagggtctgagattgggatgcaatctcggaacccattaaagagcctggggacaggtgggctgtaggagtcctgtggagagcttaaaaggtgtctcttacctcttgaaagaaatgactgtgaggggtgaagtaaactgacccggtgtacgtctccctgggatatattacttactaacttttaggtcttacctaggacacgtatataggaaatgttcctgaatcatgcttggctgcattatttccctgtagtggcaaaagtggcctgcagaagctgtgcattctgggtccttgctagaacccagatgaatgttgcttgggaattggagaggaaaaaaggaaacagagcactcccaaattctttcccaaatctcttggatcgaaacatcttaaattgccatttttatatgtccaagatggtcaaatagtaaccatttcacgcagctcaaccaaaaagtatgatccagctactacagagatgtggacattggaaggccttcttgttggtttcaagtttggccaattggtagacatctggggctgtatattaaggcatcttgattttgtgagccagagcaaaggccttcttgttcctgtctctatttgaatagtatctttggtgagagagtgccagcgtcatctatttattatccttcatgctcagtgactatgtgaaaagaaaggaaaagacctttaaagctggggtgattgtctagacagtcctaaaatagctgctccaggtgcaaaggaagccataaaatgcagacaaagcatgagactcctttggcgaaaatacagtgtgtttgaactctcataggctccctgtaaattatgaagtagaaaatgcccaggagactagattccaataattatgatcattagttattttaaattgccaccacttacttcacacagaggcattctctgtgtgctaaattaaatttaaaatattttaaaaataattatttgaataattcagagctgaaatagtccaggttgaactatttagcaggctgaaacacctgtgcaagctttaattcaaaatatacagagaagtgacttcatttttcactccactgtggaggtcttctaatacaaaacaagaccttcagcaggagtccatgccccctggttctgcaccttcttgccttctactttgtcctgtgcctacccactgcactctcaaggtccaccatgacccggccctgctccactccagccgtgtcctctaggggatcgctgccaccttttacctaggcctccccaccatggcctctgccagagccagctccttgtgggcccatgtggaaatgagacctccagatcccatcctgggaaccaccaaagcctttaagagggaaatcaacagcaaaaagatgaatctgggagttggtgcctaccgggacaataagagacccagttagattaccataaaaaatttagacaacagcaaagacttggaaccaacccagatgtccatcaataatagactggataaagaaaatgtggcacatatacaccatgggatactatgcagccataaaaaagggtgagttcatgtcctttgcagggacatggatgaagctggaaaccatcattctcagcaaactatcacaagaacagaaaaccaaacagcgcatgttctcactcataagtgggagtttaacaatgagaacacatggacatagggaggggaatattacacaccggggcctgtcacggggttgggggctaggggagagaaaacattaggagaaatacctaatgtaggtgacgagttgatgggtacagaaaaccactatggcatgtgtatatccatgtaacaaaactgcacattttgcacatgtaccccagaacttaaaatataataaaaaaatttagacaaggaatacctgcccatttggggacaagctgaattttccaaggcatctgcagaaccagccttgggtgagaagagcaaagtgttgaaaagtggccagtctgtcactgtgtggatcatttctggaactggggtttaagggttggagccagttttgtgcaaagatttttaaagtttttgaagacagagatgtctctgtccaaaccaccctggggaaatcacacacctatcttcagggtagctggcatgcaactacaagattatcaattctataaccccaagacttgcagttttgacttcacgggtgctatggaggacatttcaaaaataccagagcaaagtgctcttctcctgcatgcctgggaccctcatgcaaagcagtgaaaggaaataataatagtggcaaagaaaaagaaactgcgttctttgatatggcctaccaaggctttgccagtggtgatggtaacaaggatgcctgggctgtgtgcaacttcattgaacagagcattaatgtttgtctctgtcaatcatgtgccaagaacatgggctttatatggtcagtgtatgagagccttcactgtgatctgcaaagacagtgaatgaaaccaaaagaggggagtcagttgaagatcctgatccatcccatgtattccaacccttctctcagtggggcctgtattgcctctaccattctgaacagcctgggtttgtgaaaataatggttgcaagaagtgaaaatcatggccaactgcattactagcatgcagactcagctgatctccaactgcagtaaggagagttcctcacacatctgacaacacatgactgactaaattggcatgctttgtttcacaaggctaaagcctgaacaggtggagaagctaaccaaggggttttccatctgtatgacaaaggatgactgcatccctgtggcagggatcacctccagcaacacgggtaatcttgcctatgccattcaccaggtcaccaagtaatgtccctggtgtgagggaacaggtacaacttttctgtcttcagctgctgctaccgtgagcttcacatggaggataagggagggtagatggtggtgagtagatctttttttttttttttaaccacagtgcgtaatactgagtgattgaatgcatttctcagaaaagaacatgtagcgacattgggcagaggcatctgtggctggtatctggaactttgtgactctaaaccaaactctcccccatctttttatctccaacttttccgaaagggtttacatgtgtgagaaactcatagcaccaaaaaacttgtcaattatgccactgcaatatttcagaagctttaactgaagcatcttacggtgtcaggggttcttcatgagaaatagcacacattagaggctttgagagaagacctagttctgtcattaacagtcagcctcaagtttgtcctcccatgatggagcaaccttatcaacagaccatatcgcagaagttgtgttttatgaaaaccaatgagtttgctgccactgcagcaaggaaaataaaaggtgctttttcctctcatttaagaaaaagaaaaggctatctcttctcctttttcatgctattcttttccttatgcacaaagatttttaactatcctagattttcatcccattctactgctggattgaccatctaccctgtattagtccattttcgtgctgctaataaaggcatactggagactgggtaatttataaaggaaagaggtttaattgactcatggttcagcatggttggggaggcctcaggaaacttacaatcatggtggaaggggaagtaaacaagtccttcttcacatggcaggagcaagaagacttgctgagcaaaaggggcaaaagccccttataaaaccatcagatctcgtgagaactcactatcacgagaacaacatgagggtaaccatcccattgactcagttacctcccaccgggtccctcccatgacatgtggggattatgggaactataattcaagctgagatttgggtgggaacacagccaaagtatatcaagccccatcctacttggatttatttaagaataaagaacataattttctaatgacgccatagccttactgttctcagtggagaaggtaactgcaatttatctgagcatcttcttcgatgattgtgtaattgtctcctgctggatgttgcctctgcccagttggacatcctcccttcattgaatatggaaagcagattagtggttgctagatttaagaagatgatgagttgagagggaggtgcaaatagctgtaaaggggtagcaagaggaatccttgtggcaatgaaactgttctgtgccctgactattgtggttgtcacacaaagatacatatgtgataaaattgcatataactaaatacacacacatacacacattcacacacaaatgataacatgtaaaacttgtgaattctaaataagatagttgaatcaatgtcagtttcctggctgtgacattatactatagtcatgaaagatgttacaactgggggaagctgggagaagagtataggagatggctctatattatttcttacaaatgaatgtgaatctaaaattatctcaaaataaaaaagtttagtctaaaatgcattcatcaacatgaacttgagtcaaaccatcttggaagagaggcactttgatgtattcacttcacaaagcatagggatgaagatctctggtagtaccagcaagccaaaacacatgactttctgctgtctgtaccctgtggccctgcactgtggataagggaatgtatgtgtcctctagaacatttttgttttgattgctttgtgtttgtttgcatcaagaaaaaagttgcaaattaatgagaatatatgtgtatatctctaagattcatcagcacccaaaataccagagcaagccagacgtcatagggaagccctgagcagaatctacaaaaaaggattgaataatttgattattcagagaaagcatatttctaggggatggatctaagagtagcttgatcatgaaaatggtgggaaaaatatagcggcaagagggtcactaggtggaagtaatatgtctagtttttttgagaaccacacttgagctaaacctttaaaatccaatcaaagaatgaaaatgaatagattagtgtgaggaggtaaacgtatcatttgaaaatagccttggacttgggtactttgctctcattgatttagcaatatgccccattttgttagttgtttatacagagcttcacagttttaaagtaagcatagccagttatgtctatgatttctctgtattcagttatatttgcccaggaaagtctaatcaacaaacagttatcagttatcttacccatgacaacattgtgagatgttgtgagatgccaagaatagaccacaagagcctctttgtgatggtctcagacctccaaaaccaataaagaagaataacacagtaaatcagtaacatatctatagcatttgaattcacatagagaatttgtttagtgggcctgactaaatgccttcactttgcagcttacaggggcttgtgtttattctgcctatcttaagcatggttttactcatttagtgggagcagttggctcatgtcttttacctatttcatttactaactctaagggagtcaagaagaaacttcccctttgcgctctaaagggtcactgaaaatatactggcatgaggcagattgattaacagaagaaaaggcatacacgtttatttaacttgtatacacagaaaccttcggaatgaatacctaacatacaggggaaaatggacagttgtccatttttatgcttaggttcaacaatatgtggacagccatgtagaaatgtgattggacagaaagggtctgatttaaatgctaatggactgagtaggggaaacccagtaaggcctgtccatctagattattcttggcctctctgagaagcatttcttccttcttgatgtgagagaggaccctgtctggaacaggagtcttaggatctacagtcaaaccagttaggtcagatcatttcttcatggccagtttttacgtagaatatttttaggttttatgactgactttcaggaaaaggggttctgatttgtatgatctatcttggggaaaagggattctagtttccatggctatccttagggcaaaatgggactgagaggaggacaggagaaggtcaggagaaacttttgcttctgaagctgctcagcagcagtcttcattttgagatactgttttctgagccccaacaaaattcttctaacatgctgaacatgtgccaggcactattctaacatccatgagaatagagaggaaaggaagagagggatcctgcagctttccagttgggtgctgagatgatgacaccattcactgggtgactccaattgatttgctaaatctattctctgcattttgactctgccaccttcttaccgtgggtctatgagcaagtttctccactgttctattaaatatctgtgaaatgggagcaatggtggtgttgtgatgattagatgagtaaacacatctagagcatagagctctatgcctggcacaaacgaagccctcagttaatatttgcgggatgtgtaaaagattgtgtttatctggttttcaagaccatcctcctcagagacgccaaggagatagttgctatgcttcctggcgttctaagacccacatgcatctcgttaacccttgagaaatctagtgggctctcagaatttttaaaattatatattaataaattataattgtatttatttggtgaaaagtgatgttatgaattttgaatacaatgtggaatgattaaatcgagctgattaacatatacatcccaaatatttaatctttttgtgattagaacatttgaaatttactctctgtaattatgaaatgtatggtactcagttattagctatattcaacatgctgtgcagcagatctcaaaaaaaactcaaatgtcttcctcgtttctgaggctttgcaccctttaaccccattgctgacatcccccagcctcaccagcttggtggaacaccttgagatgtgcttataacagtagctgggatgtagtcagtgctaaaaaattgttagcttttgctgttgtgcatgtagttgttgttgttattgtaaaatggtggctggaatccacttgcgaatatgcagtcatgttacaaatgaggatgtttctgtcaataatggaccacatagacaacagtggtctcataagattataataccatattgttactctacctttctatgtttagatatgtttagatacacaaatactattgtgttacacttacctacagtattcagtatagtaacatgctgtacaggtctgtattacaggagcaataggctgtaccatctagcctaggtgtgtagtaggtttgtgtaagtacatgctatgatgttcacttcgtggtccactaggtcactagtaagcctttctgtacctttttgtatgtaactctttgtatgtctgccacactgtatgataatgcttaggtgtttgtataaatacactctatgatgttcacaatgacagttttctcaggatatatcctcatcattgacacgtgattgtactttaacagagatacaattcttgaacatcttgttagaaggagatgggagaaataacagaaataaaggtagtgtcttgcatttttcaattattaaactaatcaattcattaaaacagctgtcattaattacttaaagtcaggcaggtgagggaaagaatggcttgacgttttctaatttatcactctttcctgttgcccctgactaaacaaactgtggctgctgctacagctaagtatgtcaaactgttgaatacccaagccaggcttttgaaatattgaaaaatgactactcccatgttgatccataaaatctttaccatcttacagagagctgatgaatcatctctctagcaccaggttcacgaacttcccataatgatctcataactctggtgccaacattgcctgggctcggtaaccttcatgaaatttattattaaagtttgaaattcgttcttgtgtaggtgtaatgggattagtcgaattgcaaagatgatagggctgctatttacagaaaaagctcctttctaacacttgccttttctaatgagtcaccataatacctctgtaattattacattgattgtcttttgcagaattagatttttttgtaactctgggagattttgattagaacattcagttattatgtctgaagagtgatctagctacatgagttaatagtctttggattgaatgtgttgaaaattaaattgaaattagaatttttgtacatcaaggcttcaggtgccctttagcaactttgggagacgaagatatctccacactcagaaataggttttactgaaaagtttttggtggtgaaaaaaataaaatacctcaaacaagctgcagaaacaaagattttcccagaaattctcaacaactatgaggatagactagaagttctgcaagggcagacacttgtacatcattaatccttgacagaattggtaggaaacctttggattttagccagtgtggcagagtaccctgagacgtgacagaaaagagtggtggtggtcaggcactgaattcagttaactgttactggtttctaagaactcatcatgcattcacatagaatctttgtcaacttcacaaaaatcctagtagagtgagatttttatccccattttaaaagtgagccatgtaggtaactcgctcccaaattactcaataaatgctgcatctgaattagaatctatcggaggctggctcccccatctggacttcagcatgacttcattaatgttccctaccctctccagccctatgctggtccactagtcactggtgtaccttcctataccataactgtatctcctgtacagaataataatgctcagatgtttggagatgtatgtgcaaagttcagaaatgactttagacaacattttaccttccttcacgatgaaatgagaaaaattaacaccaatctaataccaaaacaaaataatttaccacaaaagtgattatcttgtaatgtgaaggattcaatatgaactatcactgaatatggtttgaaagggttccatattaatgcatgtcagagaagcaggccagatgctgactaaatcagcaatgtctttgttgatgctttttggcctgtaaagtacctgtaaagtacctgtaaagtacctttaaaaccctgtaaagtatcttgtaatggtgtagaataatcaaagacttgggataacttctgtggtcacaaagcctgttgtaaatgaataaccaggacttttgttttgataaatctaatctacattcctctgtagcacacgattatactcaaaagcaggttatgattgcccccaaattcctaggtaccattgtgaagtcaggctcagacctgactttttgatatctttttacctgagcccctacatccctggcaccaatagaggacatggtaatagtcactaaatgaacccataatatctgtgtttaggaggagtgacattttttggcttattgctggtattcaaatgcctctttactcacctatctttgacaacatccctctggattatggtactcacttagtatgcccttcccataggtgttcaacattccaaaattatttgatactttgcaaaacatccagcaacatcaaatattttccaatctttaaagggctgaatttagtttggccttagaacaaaacaatctgattgaagtaatgcatactaaaaagtgaatgacgaatatgttttgttttgtattatttgaaattttagacaaacttttcccttacaagtctttaaaacgaaatgtgtgagcaagattttcttttctttcttagcaggaatgaatgtcagatgtccttttcttacctcaacttctctttactaccccattcagaaacttgacacctttctcctgaagtgttgatgacatgtaatctaaagaatatcttggacatttaggaaaattaaacacataggaaacttttttttccttcctagcatgaagttttctatttttccttcctttgggtgggacaaaacattagtaacttatacagtgctactccctaatgtaaaattataaagtcatttgtatttagggatgtaggggttttttttagatttaatgtgtacttatcatgaaatcagtggatgattgggtcaagtctatgacattatttaactaagcggtctgccatggcattatttaatgaaataatttttaaaaatgcttttattttactgtaagccattgaagaaaaattttactcaaagtttaacaagtgtttagttcatgatgaggcatttgcagctgtaagcaatcatattactgtgccatcatttagttttatggaaaatgaaaacgtttacttaaggctgttaaaagtttgttttttaatagtgcctcctaagcaatacaggctaccacttacttttgacatcgagggaaaaagagttactcagattcattcaagctttagttatattgatttctacgatgggtttttcttagcatgtcaagtgattcctgttttatagtgaaggcattactttgagtcaatatcaaagtacatgatcccctcaaccttcaactgtgtttcctgctttgtgaggtgccaacaatagcaagaagggataatttaaattccgctttccataggaaaaaaaaaaaatcccagctgggcgcgatggctcacgcctgtaatcccagcactttgggaggccaaggcgggtggatcacctgagatcgggagttcaagaccagcctgaccaacatggagaaatcctttttctactaaaactacaaaattagctgggcgtggtggtgcatgcctgtaatcccagctacttgggaggctgaggcaggagaattggttgaacccaggaggcggaggttgcagtgagccgagatcatgccattgcactccagcctgggcaacaaaagcgaaactccatctcaaaaaaaaaaaaaagaaagaaagaaagaaagaaaaagaaaaattcctttggtaaaacattatatactctctaaacagggattctcttcacaccattttgaattgcgtgcttcttgccttgttgcacagattaaactgggaaacaattttatgtgtagcagggtttctaaacctcagctctattgacatttgggggcagatcattcttttttgtgaggggctgtcctgtgcattgcagaatgttgagcaggatgcctgatttctagccgctagatgccagtagcaccttcccctcagttgagacaaccaaaaatgtttccagacatccctaaatgtcttattgggtgtgaagtcatcctcagttgagagctactaatctagcaaattagcatatttctagcaaaatagcataactacttttaaaaataagtttggtctaggatgtttttctctttcaaatgaggtatattttagataattttcacttcaataataaataataattacagaaaccaaaatacaggtttcagatgttatctgtgtaggaatgtgaataacagtgacaacattttctgaaagaaaaatttgtatgtagagactaacaaaggtgttttttctcatttgtgcatttaattatgatacaataatttgattatatttagtggtaaatgaataatcttcattagaaaattatacaaagaaatgaacaattcagaaaaaaataatagctttcatattttgtcctgtattattgaagtaagcatgttgcacccacttgatatgcttattattcttaaaaatttcccacatttcttggtaaatttgagtaattcctgtattgtcagtgaatacattataattttaatagtgattgataagcattttgatctctagatttattatcattaaacaatgcagtcacacactttaaacagaattagtagaaacattttcttatttttcttatttggaacatttatcagactaaagaattttaagtgtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagtcgagattgcgccactgcagtccgcagtccggcctgggcgacagagcaagactccgtctcaaaagaattttaagtgaaaccaaccactactttgtgctgcatatatgagagcacttcaaaaagttcatgggacaaattaaatgaaaagataagaaataataaatagaaactttctcagcatcaagctcaagacacttttttgatcaatgatacccgccattttagtccatctctaaagaactaagggtcctgggaattttaccatgtcattgcaatcttttttattttattaactgaagacaaatgggtgccctttagattttttttttttttaagattagtaagcaaaaagaagtcagaaggagccaaatcaggactggaaggtgagtgcttagtaatttcccatagagactctcacaaaattgcccttgtttgataagaggagtgatccaggagcattgttgtagtcatttttctgctaaagctttggctaactttctcaaaatactctcatagtaaacagatgttaattgagttttggccctctaaaaagtcaacaaacaaaatgccttgagcatcccaaaacgctgttgccatgacctttgctcttgaccagtctgcttttactttgactggaccacttcctcttggtagccactgctttgattgtgctttgtcttcaggatggtactgggaaagccatgttttatttcctgttacaattctttgaagaaatgcttcaggatcttggtcccacttgtgaaaaatttccttcaaaagctctgctcttgtctgcagctgatctaagtgcaatggttttggtaactttagggcgtaaagtttgcttgactttaatttttcagtcagaattgtgtaagctgaaccaattgagatgtctatggtgttggctattgtttctgctgttaatcattggtcctcttcgattagagcatgaacaagatgaatttttttcctcacaaattgatatggatggcctgctgctgtgggcttcatcttcaatatcatcccttcttcttttttctttttttttttttttttttttgaaatgggggttttcactcttgtcaccagactggagggcaatggtgcgatctcggctcactgcaacctctgcctcccgggttcaagcaattctcctgcctcagcctcctgagtagctgggattacagctgcccaccaccaagcccagctaatttttgtatttttagtagagacagggtttcaccatgttggccaggctggcctcaaacttctgacctcaggtgatctgtgcacctcagcatcccaaagtgctgggattacaggcgtgagccaccacactcagccctcatcacttcttaaaatgagtttttcatttgcaaactgttgatatctttgggggactgtcctcataaacttttaataaagcatcagtgatttcaccattcttccacccaatcttcaccataaatttgatgtttgttcttgcttcaattttagcagaattcatgtttccctgacaggggctcttttcaaactgatgtcttatctttcttagtgcctcaaactagatcttgttaaggcaggttataacaagttagtaagaatttattttggtgtaatatacatttgaaatttttgtatagttctttcataatgcatattttctatgaactttttgaagtcccctcatactttctctttgttcattttactagcgtgtttgactaagataagttttaaggacaaaagtatgacttgtatggtttttataattaagtatttctgtaatattccacattattgccagttctgtccagggagaagtttttccagctcattcctgaataattgttacaaaccattcacattcatctaaggtatttctgataactaatatcaaaaccttcagaattcagggtatactatgcttagcaatattacttggagcttctattcaaacagcagaaacagattgttttcctttatccaaaatataatataagttacatcatgtaaagcagtgataacattttgggttaaaccccaaatcacaacttctgggtgagaatccttcaaattttaatataatcagcagaagcattctagtagagtttaaaaatgtttatacctaagaaatagtcactccagatttgtcaatctattgtgcttaaatatgaaaaatgtgtacatacaacacttaggcaaaattcacagaatgagttctgtatgaatataacattgtggacaattttatcctatttaccacatcaattgatcaaataagtttatgtgaatgtatgctatcttggaaggccaaggcaggtggatcacctgaggtcaggagttcaaaaccagcctggccaacatggtgaaaccccgtctctactaaaaatataaaaaattagccaggcatggtggtgcatgcctataatcccagctacttgggaggctgaggcaggagaattgcttgaacctgggaggcagaggttgcagtgagctgaggtcatgccattgcactccagcctggacaacaagagtgaaactctgtctcaaaaaagaaaaatatgctatcagtgtttttcactggggaaattttgtacctccccccaggacacatttgccaatgtctggagacttttgtggtcacatttgggaggggtgatttgctactggccaaggatgctgctaaacatcccacagtttagaggacagcaacacccaccacaaaaacaagtgatctcgcccaaatagcaagaatgccaagattgagaaactctgtactgtagagatgatcaataaaatgttttctttattctccagtgattttcttgagatgttcttcagatttgggacattttgcaaatgttaacttgcatcactgtatctgtgggtatgccaacagtcttactcacatatgtcacgtcacagcagaaagaaaagataatctcttaattgtcattttatcttattttccagagcgccactttaactgcaatttcttcacaaagatttctcaccaggaaactggcagctgtaatatttatgatccgtttcttttttatttttaatttgttttaatttttaatgtttgtgggtacatagtaggtgtatattaatgatgaaagtgcgccattcctgtggcaaatgtttttgaatttttgatgcagacttgttttgaacatctgctttgtgctttatttgtactctttagaatcttttctttttgaataatatgaaaattgctataatggctgtggctaaactatgcatttttggtgtgatggacagttacaacttcttttaacacaggcttatttttaataggataacattgaatttgaaaatgtgtgcgtatatgtgtgtggctgttgaagttctgggagctcagatctgagagccagcaaatttagatgtattattttattcaatcattcattttattgagaagttacttgtgagtagcatttattgcactatttttatattcaaaatattactatttttagaaaaggtacttattttgaaaaatgttcacttttcctgctttttatactaacttttacatcaaaataccactgtgcaactaaatttgtgcccaattgaacaaatttttaaataaattagaactacaggccaaattgttacattagaaaacacttagaaattgttaccatttcttctattttgttgcttccagtaaatttccttcatggcacaatttacaaaaagtaataaatattgaacatgtatttaacattaaaaacaccgcttacatccatatacagttatggctcttaaaatgcagacttttgtattgtagcagtctatgagctgtctcttttgcaaaatatttttctttgtagtaacagctttatttcaatgttggctgactatatcttttattcagggactatttgctgaagtatttgcaactaggggcattttggatgtttaatgggaacaaggagaccttatatataattagaattattccataaggtctgagtgtgtgtatgcatgtgtgtatgcatgtgtgtatatgtaggtgtatgtgtatatatatacacatatatgtgtttgcgtttatatatgtgtgtgtgtgtatattatacacctgtgtgtgtgtgtgtgtgtgtgtgtgtgtgtgtgtgtgtgtgtgtaaagagatattttctttgaattgagcaaaacacacatctcccttttcttcattagggcacaagattttttcctattcctttaactattctgttctgataccataaaagccattcacaataggttgtaggtggctgtaatttataatcatttcagtagtaaaattcatcatccctgggattattccctctcttgtcacacgttaattcctggctccagattgtctttgctgtgacttcatctgtaaagatttgcttcccttttcaatgtccgccttttgctttctggagatataacctttgtttctcaagatctgaatgcatggaatatgaaactttccccaactccaccagcacaagtgacctctttctctcaaccctgcagttgtttatccattaaaattaccaattaaatttccttttatacatgtcttgtctcccactaattggtagccgctgaggtctgagacagcacagcccatattctttaacttgaccctgaggagatgccggtctagcttttatttaggttagggttggcatctgaggaactgtgttcctattgcatgctgcagtcatgagctaacagaacgcttaaatcaaaagctgtcaacctaacatgaagaggcatccacagagctgtctctgagaagctttattctttgactcacatctccaatgtgagtaatgtggttgaaacctagcaaagtcaaaatttacttgaagtgatatggtggatccggtgctgtagatgatgattgtagacctgaaaaaaagaagttacgcgaataacatctgcttttctgtgtgatattttcccccccagctgtttagagaattagaaattgctctgtcaagggtttgtttacaaaagcctggccaatttcaaaatgaagctgcctttgagttgtccctgtttcatctcactgtttggaaaataaatctgaaccattaagatgtaaatacatcaagttagaagccaaaggcagtgaaaaccaagtaaaagcaagaaatgtaccacgatttaagtattctcctgggaggaaaaatatacatggtaataatttttgtatcttataattttattattaaattaaggggagagaaatttgaaatcagcataatatctattttgtgtagtatttaacactgtgatgtatattgacaattgataatgaatcaaaatatgtgcgggtaactgtatgttcattaaattagagtttggtaatgagatagaaagagagaatgagaggggtacaggtgtaagcagcagttctcaaagtgtaatcccggaaccatcagcagctgcatcaccctgaaacattagaaatgcaaattctcaggccctgttgaagacctactgaatcagaaactctggggatggggcccagtaatctgtgttttaacaagccctccagaggattctgatgcatactccagtttaagaagcacttctatgtagatggatggatggttggatggctggcaagatatgtgggtacaatgacacatacatatgtaagtacaagtataggtatgggtataaatacaaatatgaatacaaatacagatataaatacagatattttgagagagagatatatagatagacatagatatagatatagatatagatatagaaatgtggagttaccatcacaggacttttttagaggagcaaattatttccttttacttattatatgattgaataaaagctgttcttttctctaggcaatgggtctatcatttataaactgagaaaatctactggtggtccatttgttgaaccattttccattaggttcacttaaagtgtttgttccatcaagtctgccacctgggtggtttccttcactgcaaaactggtttgctcttccctcccctctgtcttcttggcagctgctgtctgccctggttcttatccattggtagatctgattgctttggggactggatcaacagttgaatcctcacaggattttgaagccaacaatatcctacatattggtccatttttcagaatttcttcatttgtgttttatccttccatttttctttctaagcatatataatttatttagattggtgcagaagtaattgcggttttgccatggaaagtaatggcaaaaaccgtaattacttttgtaccaacctaataatttcagccaactattcatatgcagcactgtttacaatggggatgaataagtaacagctaaatatctgataaaaggggatgttttaaatatagtagattgcaaaataatatgatactttttgagaagaaaatttcaatatgcaaaaaatataggggataatattcattaagacataatcaatgattgttggattatggatgattttaattttactcattttgcttatttttatatttatgattacattagttgtaagctcaaattgctgttataagcaaagataatgcagatttatatgtatatatataaaacagtaaaataaattgattgtattttttatcttcttcctttccccactatgctatgaacttaaagtccagcaattatgccagctgtatctattcatcatttttcacattaaaagcaatattgctggatagtagaattaaatgacaactctgcttttggaaatgacaggaagtctgctgtaaatagataattgatgtagacgttaaagccaaatagaatttccatttatggagaagggaatatttaagggtatgtggctataagaaaatatttccttttgcttttaacacaagatgtaacatgacttgtcatgctcaggatgtgttttgaagtggataatggcactttccctaatatttggaggcaccgggcttgatcctcttttgaaggccttcctttgaagataaacatagacattggttttagcttaattctccatccctaaaattccttcctgctctaaaattctataattccataacaacagtgtataagcaataattatgaaatggaaaaatgagccattctacttgccatccttcatgtaaagctgtactatggaatcctgctctaaggtggggccggtgtcatttctccaagcagtatgatgccctggaagaaagcaatgtacagtggcctgtgattctggaccttggatcactttgatgcccttggcttataataaaagcaaaatccatttaaaccaccttaaataattaggaattttagaggctcatgtcaccaaaatccataagtatgtagggtttcatccagtgacttgacctttttcctgcagtgctcttcattttatgtccctctaagtgtcacctctaggctgatagcaacagaacctgtggcagtttggggataaatatgacgatgtctaagctagtgtttctcaactgtgggtgaccaccccaggagacatctggcaaagtcgggaaacatttttggttgtcacaagtggagaggtgctactggcatcaagtgagtaaaagccagggatgcttctaaacatcttcggtgtgcaggacagccccaccagagagaatgatccaacccaaaatgtcaatagtgctgagtaactctggcatagaagaagaaaggtttcctctgcctataactcacttacattctaggaaacatttccaaaggcttccagccacatttccctcacatgctggtgcctatagtacaaaaggctttaggcctgggttctgagatcaatcgtgggtggggaacagtattaccaagatcagctcactgagccccaaaatgcatgtggcatgtccatgctatacactgtcaaccagaacaataaatacccgtcatataatagtactattttgttattagcaagagaggggaattcaggcatcattactattcagccctaaaaaagaagaaattcctgttatttgcaacaacatggatgaatctggaggacactgtgttcaatgaaataagccaggcacagaaagcaaagacaaatgctgcactttctcacttacatgtggaatctaaaaaagttgaactcatagatgcagagactaaaatggtgctttccagaacctgggggtggggctgagggttggagagatgttggtcaaaggatgcaatattttacttagacaaaaggaataaattcaagagatctattgtacaacatggttactataattaacagcaatgtattttattttgaaaatcactaacagagtagattttaagtattctcaccacaaaaagtgacagctatgtaggtaatgcatatgttaattggcttaatgaagacatttcacaattgtatatgtatgtcaggacatcatcttgtacacaataaatatgtacaatttttatttgttaattttttaaaaatcctgtgaactgctaaagaataaacatactctccaaacctttctgtgggatttggggaagtgtttcttcacctgtatttttttctgggttatctgcattaatatctttctagaaaaggatatgactggaagtggcttattgacaatctggattttcccaagagaaattaccttcaaccaggagagatgactactttaaagaagggctttgcagaacctatgtctttactgagtcattcagcaatccaagtgagagatgatgatagcttggaccaagatggaaccattgaaattatgagaagaggtcagattctgacatattttgaaggtacagccaacaagatttactgacagattgactatggattgtgaaatggacccattggtgatagagagtggaagttttggcctgatctactggaaaaattgagttgctattgacttagatggggaacactatagagaagaatattgagaagaagttgaagaactcagggaattcaagaaaaaaatgtcctagttggagatataaactaggtaactatcagtgcatagatgtcatttaaagatacaaggttggttaaaatcaccaaagaggaattgcagatgaaaaataaaggagattcaagaacagagccatggtgaattccaacattatgttacattcagagaggtgatagacactcaaaagagtgtggcatccacaaagcttattctcacatttgttaattgacgtcaaaaacatggctggttgttttgtttttgtttttaacttaagctctttcaaattctggaatttgggtatctttccctaaaagagaaaaaacagccttcgtcttttgagcaagccaggaagcctcttcctgccgtcaattattaattttcttaacatccacttatcatctaaaacaggggttcccgacccccgggccgcagaccagtaccagtccatggcctattaagaatgggactgcacagcaggagtgagcattactgcctgtgctccgccgcccgtcagatcagtggtggcattcattagagtctcataagagcgctaactctattgtgaactgcgcaggtgagggatcttggttgcaagctccttatgagaatctaactaatgcctgattatctgaagtggaacagtttcatgctgaaaccatccccgccgcactgtctgtggaaaagttgtcttccacaaaaccggtccctggtgccaaaaatggctggggtcagctagtctaaaacatagcgaagctatgggctaaggaacttaccttgcttttgtttttccatctgggcaaatggttcatcctgcccctccagggtgagaaatgcctgtccctttctctcaatctgtatatgcaggctaacaaaagatatttttcagagatgatttatttcaccagaacgattattgataatttgcatttatggacacttggtgatcttatcaatatttttatgttttctcttttttagcttttaagttcaagggtacatgtgcaggtttgttacatggataaacttgtatcatggggttttgttgtacagattatttcctcacccgggtattaatcctagtacccattagttatttttcctgttcctctccctcctcccaccctctaccttctgagaggtccccagtgtgtgttgttcccctccatgtgtccatgtgttctcatcatttagctcccacttataagtgagaacatgcagtatttagttttctgttcctgtgttagtttgctaaggatatataccatggaatagcatgcagccataaaaaagaatgagatcatatcttttgcagggacatggatggaggtggaggccattatccttagcaaaatgttttccctttttgtgggacattatcttgaatttctcagaaatcaaccacaaatttaaagagtgaacactggatatctattgcaaatttttctaaaataacatacataaatctagctatgagaaaaacagctttcaatttttattttgcataagagtttcttggaaagtttcttaaaatgcagattccttgacatcagaagttctgttatgatcaatttgggactggactccagctggtccatttcatccatcccacaccattatctgattacagggcagaggatccacaagctgttcaggagctcatataaatttctgcaagctgaaaaggaaattattgactcccaaagtaatgatgtaaatactcacctatatatctaaaaacatagcaagtgccaatttcattgtcaactagtatttttaacaatctcatcacatgtaaaaacaattcgtaatgtacattttgttctcttaacaagtattcctgaacacgcacaataattacttaaaaaatcacagccaaacgagaatccgatgaattacttattgccaaatcatgtcaaaatcaaaattgtaaaaattcttgataatacaaggagatgaacctcaaaagtaagtgcttaaaatagctcagagctcctggaactcacttttaacaaaaagtaaccccaggtgattctgtatttgatcttttgcccacacttggagaatctaaggtctgtgtggggatgcttcatatcatcaaagcgtacttgtcttccttcaatcatttatcaaaattcttagcacctaaacctagcatcttagcatgatgctagattataaaaatacagtgataaacaatctttctaattgtgaagcctccagcccagtaagagagacagccaatagacaaatgcacaaacaagtaaaatcaattataggttgagataagtgctaagaagaaaatcaacagtgtgttgagatcaagaagccaggaaacattaatatcagattggggaagtcaaggaaggctttttgagcagatgatatttaagcagagaccagaaaaaggaggagccagccctgtgactgacgccttaggaaagcagttcaagcaaaggaaacagcatagacagaaacccctaatcaggacccagcttgccttgtccatgagtgtttgaagaacaggaggaaagagaggaggcatgaaaggtgaggctaaggaagttggtccagaccctttgacataggcaagttctatgtggatggattttattctaagtgcaatggaagcccgttgatgatctttgcttgcttgtttgttgttatttttttaaggttggatatggtgtggtactttgtgtagcagttgaacacataactcgagccagactgcccaggcaggaattctggctttgcctcttataggcagagtaaagttgagcatgttctaacctctcttcactcacttcctcattgtaaaatggaagtaataacagtacctacctcttaaggttgtttagcagatttaataaatatgtgatatgctctatgtatgtctcaaaatgaagaattgtctttaagaagattactgttatttcccccatgaacaaattgagtaaggacaagagcagatggctaggttgtctggaaggctgctaaatttgtttgggagaaatgtgatgggggctggaattggagtgatgaaagtaaagatggagaggaggggtcagattcctgatttattttggatgcagagttgacagaagttggtaatagattaaaagtagaacatgcagtgaagaggagaataaagaaaatgacttagttcctggctcaactaactgggtggataaaaataatcattatttaataataataataatcatcatcatcatccacaacaacactgattaagcgagtgctgcataccaggcaggcattgtgataaatgctttgtaaacacctctaaagatgtgggaggctaggataccaaaacatttgccagaagagaaagtcaagagttcattagtggataagggaagtttgagatgaccctgagacaccaggtagaagggtcaagaaggcagctggatagtcagctccataaacacaaagatgattggtttggagatagtatttgagagtcctgaactttgcaatgggatttaccaccatgtttttttgtataatggcttgggctgttacgataatatttttgtcttttttggtctaattctttttagttcaagacctgctttgtaaaaaccttagtgtcaatcaaattttcagtcagttctccatagtgtaaaataaagtattgcattaacatttctgactctgaaacaactctactgaactaaactacttaatctgaagtttgtgttgtgtgtgtctgaaacatttcctcatcaaaattcaaagaaactttagttcaagttatggcctgaaatcaacagaattatattaattcatatggatatagaaaatcatttatttacagtatttaaattgacatttaaacagtttttccaatcccacacagttagtggcataaggtcttgagaaagcatgaaacattttttttttatcagcctcatatttcgttgagcttgccaaacacagttcattttccatagaaatttgcaaacctgagtagtggccaaattttcagagtcgctgaatgtaagccaatgaataaaattgttaaaccctttgatttccccccacttttttcccttaaaaagtaacatagcgtgtgcctgagttttattttttgacatctattacccacaacactcgagtgtgtttcagaatcagcctgtatggacatttcagtacaaaatgaacacagccggcgctttggggaacgttcatttgcagctttgttatccttagacaggaagccttctcctccacactttgatcgacatttttcagaaggcaatggcatcaacctttaaaaatggatactttcaagggtttaaaggttgagatttttaagacaaacccagaataggcaaaagttacatattggccaaaaatgtgactccagaaaccatgtgttgtagctaactggggccactagcaaatctttcttttgagacttctgtcctgttagcagaatgcactgatcgaactaaaccttgagcatgacacaggatagaactagttattgttaagaaaataatgttcaagggcattggtccattgtacccaggaatagtttggaaagatgaaggatatggaaacaaacaagcaaaaaaagaagaattaaaattaataattaaaatgtcagtaactgtaatgtatttctcttagtggatgataaaattacataagaatgtcgaccttttctttaacccaatgaccatagtggcagtctcttcattggactgcttccttcattggcatcgccttctaatttcatttttacttatgatagtgaaaatgcacaatggcccctggaggcaataccctaatttttttgtttaagtgctcaaaaaagtatatcctttccctgcgaaaaaggcagagggtcacaattaattactgaatttcagctatgaaaaacccactgaactgtgagagtccattgtgcttaagttgcatttaatctctttggagatgccaactacctgatatacaagagcaactgtaagttccaaaaaaactctcacagataggaaccatagacatggagagaagggagccactactcagaaatgaaggagttggggaggagtggggctgaaccatgaagccagaacagaatttttgtcagtggcctagaagcaaagctgagaagaagggtctgaatgtgctggggaccagtggttgtagctccacactgagatggaagcctcctctcactgtagcttctgccaaaacacataggtaaatttgcaggagtaatggtgacctcggaagagcctggtgtaattggggaatgattgttgcaagggaataagagccagtatttcatttggtcttttgtgtctggcatttttcactcagtataatgtccccagggttcatccatgttgtagtatttatcagtacttcatccctttttgtggctgaataatattctattgtagggatatgacacattttgtttattccttcatctgttgatggattatttgggttgttttgactgtttgactattaagaataatgctgttaggaacattcatatgcaagtttttgtgcagacttacatgtttttcatgtccatatttcttgggtatatacctaaaagttgaattgctgagtataatggcaaatgtatgtttaacatttggagacacattctcaccagcactatgtaagggttccacatccttaccaacagtttttttttttttttaaagctatcctagtgggcgtgatgtgataattttttttttttttttttttgagatagagtctcactctgtcacttaggttggaatgcagtggcacaatcacagttcacttcagcctcgacctccctgggctcaggtgatcctcccacttcagcctcccaagtagctggaactatgggcacgcaccaccacaccaggctgttttttattttattttaatttttgtacagacgaggttttgccatgttgctcaggttgatctcgaactcctgagctcaagtgatccgcccaccttggcctctcaaaatgctgggattaccggcatgagcctcactgtgattttgatttgcatttccctgatggctaatgatatcaagcatcttttcatatgcttatcagccatttgtatatcttcttcagagaaatatttattcagattttttttcttatttttcaattaggttgtctttttattattgaattgtaagagttcttcagattctggatacaaatctctcatcagatatgtgagtgagcatttttttcaaatgattttttccctccagcaatcatactgcatttctaccatctactgtaaactgccatatgtctacctcatttatctcaactttttaactttttaacttttacacttttcttcctagtgggtgcttgggggctttcagccttctgtgcctggggaggactttcagaactaagagctccccagggtgtctgactcagaggatcacagtgacccaaggctctctccctccgagatcctctagttgtgcattccagacagggagactgcctggccggctcctctagcactttgagcagtgtccctccctgcctcctgtctccttctctgttcccacactgcacaggggctctgcgtggggagtatgggggctcgctactgcctggagctgctgctattgctgaggtgtaagaaccctggagaggtaagaagatacggtgtgtgtatttcaggctctgtgtttcgtgcctactgctagaagcaaggtaggacccaagccaggaagacgtgaaagattccatggggtaataatcccagagcagcatctggaaaaggtgaacataagtaggaaagaaggagggaagtaatagcgttggagggatttgctcaatgtgtcctggcgcttgagtctcttttaacatcaaagctcaggtggttcaaatgacagtcacactgcctctgcctgttgctttaagagtaaattcagagtcttcaaaccaggcttattggaatattacataccattgccaagacgtgtatatttttattgaaagttcagagcaaatcatagtaaggacccaccatttcttctgcaccattccttttggctattttctcagtatttgaaaatcaatggaatttgactttaacatgcacattggcttataatgttactgttgcatgggtcttaatgttactgttccagtccagtgtttttgtgctagaggtaaggaaactgaagttcagagtgaatcaggcattgccaggatcaccagactaatccaggatgagccaaaacatcattgctatggagtgtctctttgggtctcaatcattgggtactatataatgactgacgactggggacaagggcataggttgcccttttccttagtatgatgaaggatcaagattctataacatcgataactgattagggtactaatgtggaaccacaaaatgtggttcagctctgtcctgtggccactccatgcagcaaagacagatggctggttcagaaaactttggttttgttgtttgcatacaataaaggtagcatctggtgcaaattttattttttttaatgattccagggttttttctttaatgatttcatagaaagaaccttaaaactcatcttttcagaatattaatttagattgttaccgaagtgttcacagagcctaattaaatacttgctggtttcatatagctacaagtaaaagctgctttgaatccttcctaaacttatattggtttatttggtgaattgtgtgttaacaccaagaaagtgaaatcattggcttttctacagattggtgatctattaccttaaacaatatgatcaggccacatcaattcatttgcaaatttcttcctctctctatcatgtgcacatgccaccataggtataaagtaattaaaatatatacgaattatttagtttgttaaaagccaagttgcttttgaagaaaatttgctgctcttagattatgattatttacagtttgttaagtgatttcattttgtaggcatagactttttattgtgattctgattatttacagtaatagcaactatcaaatcaactaatgtggtggtgattgcagatttttggatatctattactgtttatcgggaacattttttcactaccagaacggggaaaaaaaagccacaaaagcagtaaatcccattgctttccaagtgtcattgtaaatcctgctgataagaactgcacattttagcaatgtttaataagtactttaaaaattgagaattgtctcaaaagaaacagattttgaagttcctctgttgtacctacttccagattaagaaaaatcatttgtggaaaacaagttgatcccaagttcctaatcacagggagaagatgggattttgtaaacctgcagagcctgaatttgttattgcatgcagctgtgcaaatttgcaaacatttccttccctagtcaggaccctatggaaggagccagtttggactgctgccttgatagctaacatttgtagaggctgcagtgcaggaagctattggggtacctgaactttgtcatctattttaatctgggcattagatgccaggtagagagagtatgcaagccaattagttctgcttcaatgtcatggtagggatatatcagtagccttattattcttgtcattctcggtgaatttcagaatgctgcttgaaatgggctttctgtatgcgttgagtgtgtgttcagtgggctgtctgggaaggaagatagcggagggccaaggcctgggtctcctaaaacacatgattatttcattgaactaatcagtgagagaaagacagggccttgtggtttctacgagcactggacttgcgtttctttgttttccatccatcctttggaaccagagaaggcatgaggaccatccatgagcaggttcacactcaaagctggttgcccttaccctggttgccatggcaatgttgtcctagcgtaggggatacttgcctatgtttgtagctgtctcctccccatctttggcagtttagcacaagaggcaactccctcatgcaactacagagcatttaatgagttagggattcttcattttgagttacagttagctctctagtatatttttgggaggacaaatgggcaggaaaaattaagtcacaggagacaagcttcatgactctaatggagttgaatttacatttgccattaaaaatagctatagattgtttaattagaatcctagaggcggatgacgaattagtttatctttcaaatggtactcataaaaaatggggcagtgtgtgtgtgttttaaaagagcctaacttcttgttaaaatttaaagttcaaaccctcatttgtaaattggtgatagagacaattctataacgttgtgagaattaaatgagctaatacatgtcatgtgcttagaatagtgcctgaaatataataagcccagtaaatgttcagtgttattattatcattacttttatatgacagcatcctgggtgtttaatgctaatgatggctcattgagcagatattaagcatactgaccagtttccaggtatttttccaaatctgcctcaaggagcttgacagctaagggggagacaaaagtagaaagaagcagttgtttgaaatagaggcatggtcaacatatcctgggaaacctctgagcctgtgcactccagccctgtggactagcgagagaggtttctagaagaggtgacattgaggtgttggtcattgatggctgctcccagatgtgtggatatgggggcaaggagacaggggaacctcacttccaggagtgccagccaacgtagagcagtgagagaagatttctagaagaggtggcattgaggtgagggtcactgatggctgctcccggatgtttgggatacagcagcaaggaggcagggagatcctcacttcagaagtgccttgagttggttatttggacagatagggtgttcgatggcctgggtctgtcagatattctcagctgcccaaggtcagtgcttaatcatcttctctccttacaatacactgctttatattctccatggctgtaggggttttattctgtaacaattttgtaacaaaaacttcttaatcaaaagaatcattcttttggagagtggtggttctgaaaatcatgagaattaaggcatcttaaattactgcccactttatggacagaaccactcatttctcattattctgccagatccaagcaaatctcagaacagaacttatcccagactaattgaataaccttgaattcagtagttacactcatggctaaatttattattttctcctctttatcactcgggtagacacaatcactttcagaggttcttcagtctgatttacaattagctccttagcacatctttggaaggtcaaacaagcaggaacaattaactcacaggagacaagcttcttgtaacctcccaagaaacaaatactcacttctaagtaagttctgaagaagcaaataactattctaacttctgtcggacggtttttaaaaattttgttttaatttactttttttattttatagatttagagggtggacatgctttcttacatggatatattgtgtagtggtgaaatctgggcttttaacaggatagttttgatttagagacattagctgacttaatcacgggacagcactttctttattttgcaaattctccttaacacccctaccactccccaagctgttttgatttgtttagatccctgttgtgactccagacattgccaaaggtcccctaggagacacaactgtacctgcttaagaaccactcatctagaggaaaacggtttggtaaaggccgggtgcagtggctcgcgcctgtgatcccagcactttgggtggctgaggcaggcagatcaggaggtcaggagattgagcaatcctggccaacatggtaaaaccctgtctctactaaaatacaaaaaaaattagccaggcatggtggtgcctggctgtagtcccagctactcaggaggctgaggcaggggaatcgcttgaatttgggaggtggtgattgcagtgaaccgagattgagccactgcactccagcctggcgacagagcgagactccatctcaaaaaaaaaaaaaaaaaaaaaaaaaaaagtaaaagaaagaaaaatgaaatccttataatgtggaattagctgaattgtgccaatgccagagtgacaagggaagggtctgagttgggagtcactgtacacaaaggctcagccctagaaagaaggtaaaaggaagacatgcagagagaggtggtctcaagttctagcctccacttagtggagcgcccccatgacacttgcctggtgttgctctcctgttaccctcagagtggtgaattgaggatgaaggcttgtcttggaggcagcaaagaacagtgtctggggatatcaggtaggagaaggcaaagatcatttagggtcacaatcagtaagggaggtgttcaggtggctacactgtcagagtgatgcactgataaatgacagacatgggccgggcatggtggctcacacctgtaatcctagcactttgggaggctgaggtgggcagatcacttgaggtcaggagttcaagaccagcctggccaacatggtgaaaccccgtttctactaaaaatacaaaaattagctgggtgtggtggctcactcttgtaatcccctctacttgggaggctgaggctggaggatcacttgaacccaggaggcggaagttgcagtgagccaagatcatgccactgcactccagcctgggtgacagagcaagactctgtctcaaaaaaaaaaagacaaacgtgatgtacttcagtgcctgtggcatcaaaaacttccatgtcatatcctaattttgtatcactcctgcttccaactgggtagtgttctctttgggagtctacagaggcaggacaaagctctctttctgattacaagaactgtagctaacatttattgagcttggggctcattaacatgaaaagactcagagcagagcatgatattagtacattttatagacgagtgtactgagccatagagaggccaaaaaaattgtccaagtttccacagcagataggcaatggtcatgattgtgaatcaaacggtttggttatggaggctgcaccccctaccatcacactggaaagccggctttgtgcttctgtggacacttaactgacacccccagagcctgcacattccatggccaaatatgaagcatggaaaattatttggagaggcaaacaaaatttggctgtttggaggaattgagattttaatatcgttcatttttaaaattaatagtaaagtgaattctgggtcctgtggtgttttttgttgaccataggacaatgatatttgcaaatgggctttattaatttagattttgtgatagaggattcaagtgtgatttattgaggtaaatgtttcgaacccaaatgaccactcctttcttctctcttcaaatcctcaccactcccagcccaatcttattcctcaataattatttatcgtctggaagagtcaggtgtttcaaatgaggccagcatggacttttcccaacagggaggtattttttaatatctaaatgtcggcctatggcccttgctgttaaggctccagatcaaataggggcaaaaggaattgaaagccaaatcacaaaaataagtaaaaactccaactaacaagaatttcacaacagacataagctgatgactattttattaaagcaatgtggagtactactaaatgctactatgttctggaaatgtaggaaattggttgaagtcgtttttctcttgttagtctcatgttaagctgttcatactaggatctcttgggttattttttcccaattaatacagttgtctactaatttattttctttttaaaagtcttggccttaaactcagtcttggtattttcagctattgtttactaccaaaggaaaaacttcggatttagagaaaagtctgtatttttattttgtgtggagttgagaaaggggatggtaaacttgacattgcttggaaatgaaatgcacagcttgatctttttttcttgatatgatttttgtattggaagaactgtagtatgtcttggtggtgataatgaataccataaccacataatcattctctaaatgattgtaatggaaagaagttttatttaaaatttcaagttactcaaatggcacatgtctccacatgtgtctttttactacaggtaaacccagaaagcatgcgtggttatgggtgtgtgagtgtgtgtaacgtgaatgtgtgcctccctctatgttatgttgcactattagtttgaaccacaaaatagaaaagaatgtaaatatcttctgaactctggatttatctgttctaaatgaaagctagaggggaaaccattttagtatgtaaagtttggcctgaggaagagaatggcacttctacagttcttagaaaattctcatagaggatcaggattactggcatgcttggggaacaacttgctgtgggtagctgagattttcagtttcaaccagcaaatctgttttgtttcatcttttgtttaaaatatttgaattaataagaattatttttcaacttcaagaagtagtacatagagcaatgctgtctgataaaactgaatggtgatggaaatattctgtatctgtgttgtccagaatggtagccactagccccatgtggctatttagcgcttaaaatgtgtctactatgacggaggaattgaattttaagttttatttaattttaatttatttacatttaaatagccacataggacaggactaccatatttgacagtgcaagtattagagtataattaccagttaatgtatgtctctggtttgaaacattcctctgtattatcacactacgtatctgaattttgatttggaaaccgtggctgaatgctgggattgattccagctctgccaacaggaaaggagtggtgaggaaagctgttggacagctagccaaggatatttgccatatttgccagagtgttttgactgtacttctgtcatagtattaataccatttggcctttttaattgttatttgtgggcttattttacccctttggtagattctagattccttaaggatggggccttgctcttttcaccagcacatggaatagtgccttgccctagagtgtgcttaataaatattgactcaattgattagaattggtccatgccaattgattaaaagcttttctacctttaaaaaattgaatctaaattctttaaaatcaagttatttgtttgaatattgacaccctcccaataaagttatgtttattcattccagaaaatgattaaggggccttaatcataaaggtactggaataaagttaccatgggtttgtgtaatataaaccctgcaaagactgtttacaattctgtgtgggtgtaggaagaaaaaaggattcaaatataaatatgagtgagaaagaaaacttgttttgagtccattttatgcatttgttaacattttgaagactatacagtacaatttatcttaaagttatgaggtgaaagaaatgacttgtgtttaaaatcactgcaattctctatttgaagctccattgataacattttttgaggaaaacaaattacttgaataactttaaattcagtacattattatgcatatcacataatttcatttaaaaatcttttttccatagaatgagatcaaaagaccagattttgattgccagtgtggtgtgaagtgtaaagccagtgttccatgtcctattttgtttcataatataaacattcttcaaaagtttatctttcttaatgtaaagaatttttcatataaacttcccttcatttggttcaggttttagttattgtacatattcataaattttcattttatcaactgttttaactgatgtataaactttgttttttaaaaaagatttgagacagtataatttaaattttctctaaaaagaaatatattccttatttgcttgccaaatggtgaatttgtatgactaaatgagcagttcctacctgattcaagaatactcattcataatatatcatctcaaatgataggaaaatttaagtttcattcaacacaaagacatgaatgatttttaatgcattttattgtctgctaatggtacttttttagttacagaatttgctaagtaaagtgattataagcaaaaatcattgtgttcttgtgtcactcctgaaagcatctgaagtattcattcccctctcatcttctgatcttttaatcctgaaaaaaattgcaaaagaacagttaaaataatttacaaatgttcctagtgagtaccatttacaataacatgtctggcttcagttttgtcaaaacaatgtacaaccatttaagttgaactctataatttctgaagtttctttgttatttcgttgtcattagatattaggtgtccatgaggactgcttccaccttcaggacacttaaagcctattattttataataaaataacaattgctacctttttggggggtacgtcttgcatgtcaggctccaagcttatcacgctattttgttttccataaaacaactctaagaaactatcaatgtttatactcaaattttacacaaaaagaaactgagttttaaagagttcaaactatctgcccaaagtcacctttccataaatagctttgtcaagatgtgagcacattataaagttcatggtattaattattcataaagaagtaaatgcattttctatgtacagagagaacatgtgccttggactagaatagccaatgataggcaccgattacttgggattcaatcaattttcaaaaaattctgccccatattttccgtaaacatgctcacaattatgaagccatttatgacatatattatgatttttttaaattcagaaactatggtatttataattggacagagacttgaaaataatctgatttcgtcattttcccccatttaaaagaaaataaaacaccgatacatttgaagtaacttttacaatactgcctcgtctttgagggcaaagccagaattggaacctttgtgtcctggcttcttatcctggtcatttccacctcacttctctcttcttctcagtagcaaatcatcaataacatgtataaattggaattacagttggatacatatacatgataggatcacataatctcgtatacatagaagtaagactttatggatgtagattaagtttgttttgttgactattcccattcatttgtaagagctacctgtaatggaagatttagtgctaaattgcagtaacttcttgctaaaagcttaatcatctatagaaccccagtacagaaaaggaatctaacagtatgtttagtttagccgcctccaagttagattgaaaactactggaaatggggaatcttcctgtaggtttttgaagagatttcccgtctaccttttgtagcctgttcagatatttgcactctcaaaattatccgctccctcttgtcttaagccttcagtgcaactctagcctattcttgctagtcaaacctttgaaatataaggagaactgatattcccttatactgttgcccttaaaattcatggggtttagtaatatatatttctattaatgggttttggtaatacatattctggtagaaattcagtaatagtaaaattgaaacctaccataaaaactgtggtcttaattaccaagccatttagaggaatttgtctttaacataaaggtatagcatattgcttggactaatagaatcatagacctgtaactactacaactctagatccttggttgtcggagaccttagaactctggggcctattttgctgcaccattttcacaggatttgcattgtagtggcttcaaaatatactcaccacttcctcccgcttggtcttgtctgttgatggccaagcttccagagtcagatcaggaagcatgggaggcaggggctgcatggggaacatcggaggcagaggtggctgtggcggcaggggctgcatggggtgcacaggtggctggggctgcatgggctggtgaggctgtggctgaacaggctggggctggtagggctgctgggcgggcggagggaggtttggctggtggtgttggattggagtcatggagtgttggccaggaacgggcatcattggttgctgggggatcacgggctgctgagctggcaccactgggatgtggtgatgaggctgcagggtgtgagtcggggggtgctgttgggacagcacggggatgatttggtggtgcagccatccacccatgggctcgtaaccataggaagggtactggtgagaaacagagaggcaggtttaccattggctcaggtgactccaaccagagaagcagcagtgttttctttgccattatggctataggaatattttattcatttttcctttgcaaaaatttgtaactgtgtacacagatatgattttttacaaactaaatttcccattaatgtctgcatgtggagtagacatgatatttcacttaatatgggaattttaatgcatgcctaatattttcagggaataaggaacaaaatgtctacataccggtggccttatgctctggtaccacttcaaaggggtaagcaccttaagagaaaaagatattagaacccatttgatttaatttactttcatccaatatagaaactcactgatgcagtaggaaatatagactcactaatgcagtcctgtcaacattgatagcctgagaatgtgagttctacaaaagaaagaagaaggtaaaaatttgttgggtgcttcctgtgtgacaggcactgtgtttacatccatcacacacattcttcatcttttcttatatgctaggaggcaagtattattactctcactttttagataaggttatggggagttaaagagattcattaacttgactgaggttacacagggagtaaatctgtttaattccatagttccttcttttcattgtaagagcaaaacaaacacaaaattatgacataataatatgacatgatgttaatttcatttttttctttgatgtcacaatgggaaaaagagaggtgcaaacactgtccctcatcctagaaacacagattgactgatcagatgtgtcaatcttttcggttcaacagaaaatcttgcctcaaaatcttactaacatttgtcttcagcttttataagtaaataaactcatagattgttacctgaacctgtgagagaagtaagaatcttattcctttctgaacagtatatatacttggttagccttaggtttgaggattcttcatatagtaatacggcatttaatcgatacaaaaaataatcagtaaccttgctcatattatacttgacaaagcacttttcatattcattaactatattactctccaaacaatattttgaaatatggttattataattatttcctttctccagatgaggaaaccagggttccagaaagaggaaatgatttgcccaaaatcacaaagttagtaagaggttgaggagaacctcaaacccgacgtccaaaactcatgcattccgctgttctgcggagtctctcctataccacttagtcactaatatttcagcagaggcaagcaagagacacacatagagtgtgactatcttagaatcaggagttttttgagctggaaagagttttaaataacatcttacctaatccttacattttactagctgggttagaaccaagctggtcagagtttactttttgccctatcatggagcctccctgagtagtggttcatgatgggtaagcttacggccatatttaggaggacagactgagtcagagtggccaggcgggaggctgctgggacgacacaggcttgaggccaaccatcagagcttaaactgggaagctggtggtaggaactgtaaaatcaggaccacttgagaaacatctgggataaagaatcaacacactattctttacagagcccagggcattgttaacgcaaacaatggtcaaaattagtaaagagaaaaattacctcatagctgaagttgatataaccagggtgcccaggatgaggtggtagcttttacagggaggaggggaggagaatagaaagagagaggaagggagagagtgaaggaagagaagagagaggaagagattaagtcagtatgcaattgttcacattaaaggagactgaagctactttaaaaaaatctatatagtgcagaatatacttgaggtctgtttttagtttgaacaaatgtgctgtatagaagaggagaccttttattttaaagaggttcagaacagctaaatgactgttcctggggttatagccttatggctggagacctggaagcagaaaccagcacacatttattctccagtgatctttggacagcatcccacccccacgcccagtgttttcaatgaatcctaccctatcctgcccaacagtttacttgctgataaaactcaccccataatggggagagaagtgtgtttctctttcacaataaagaaatatcaacaaggagagaattgtctcacgaatgttcccttgtagatcaggaggtggtcaagtacttttaagtatcaaagggatttctcataattgacatgcaaagtaaacaacacttccatacaacaaaagaagccacaaaagaaaccacaaggtgggaattattgatgaatgccagaacaagatgggtggagcaaagtggaaacattataaatcccatggaaaatgaaagagttgatttatgacgtttaggccgatctttttttattattctgccaacggttttatggcagaaaaattttcaagttaaaaataaaaggccacctgaatgatgatctgaatcaggactgtctgtcctctcaaaagtggggcccaagtgtctggtgcctgtattgtggaactctggttgtgcctggggtccagggaggagagacggtcatgcagaaaatctccctcagacattggcctcatttaggattggctctattatattctttaaaaatgctcacatttcatgggaaggtttattctctctcatctggatgtgaatggttttagtcaggtcctataccctcttgaacaataccatcttagagagtgggaaaagggctgaatttgtaaggcagggacccctgaggaaactaggaatcgctgcaatgcaggatttcaggaagtcagagcacagaatcttggttttgtgggtgagagaggaagagaggaggcaagggtgcaagcttgctggcttctggttgtatcaactgctctttattccaccaaaaagcagatgcagcctgcttggcatgcatgtgatctaagttctctgcccttatgcacctgtgtccagacagagtgggtctaatgtcctgatctttaatacatttgaatataaaatatatcactatgtattgggtgtaggcaggatcccgggcaaccacaaaaaagtcacgtactcatcagatgtacccaaaggggtggggcctctgagaacaggaatgtggctcaaaaagtggattcctaacacaaaaatcttaccccctgaggggtaagagcagcaatatgtggagggcaggaagagatttggaatcttgagaggaattgggttttagacaaaactggcatctctgtaatatttgtccaaagctggttaagcactttctctggagacctttcaagggtcccttccaaaagcttcctccatctagagatgggtggtgatatttacaagctaacagttccaacagaatctcctggggtgcttataaaaatgcagagtcctgggccccgccccagctgtaccaaatcagaatttttggtagcggcatttgagaatatacctttttaaaacaagctcctgaagtgtttcttcaacccagagacatatgaagacatctgatctcatactgttttaaaccctaatttcaccaactatgagcagatttttatgtccaagtttgtgaaattggacactgacttatgcaaggggtgttttactcacaggcatggcaaaagctgctcccaggaggcaggcaaataaaatccaggtccccatttcttgatggttctgaaatgtaagtcaacatccacttttcttatctcttctgaaacatggatgtaatgaatgctccataaaacacacataatctacattagtctattgctagtaagaaggatggagccattgtttgtgaatttacttcagtcatatgtgatttccagctctcagcctatttcattgtttctggagtcacagtagtgataaagatgcatttaatttaggttgagggctaaacaagttacagggacatgaatgatctatcttcatatgactttgcatgccattttcctatgcctatacagcccttagtcatagaagctaaattgtatttataattaatgattaaaggaataaagttggctctaaaggttgggaagatcatcaaagtgcacagtattttataattttagaacaaggaggcacagaaatgtctcgtgcacagtctacctggacattgctactgttaaaaacaaggactaatcatttgagaaaatatattaatttgccaagatagattttagttccagaaattcctatctacagaacttcaggcaagaccctccagtaacatctctgagctccagattgtggagcaaaagatgtggctgaaccaacaggagaggatggtacgaattttatgtgattcttcaatgaattttgaatactttctccctaagaggtttcattttctttcaatggaatcttcattttgtttgatgttgcactgtaattattctataaataagacccttgggacattaagcaaaacaggtcctcctaaaatgtgcacattgatttgtggcacaaattactgggaaaactgtcagaagaaagaccttaaattttgtataagaagtgaatattacatgtgataatgctgtctatgaaaagtacactaaagttttctaactcctaaatttgttttttgtttgtttgtttgtttgggttaatgagaaaaaacacttcatggatggttctattttatgtaattaaataaaaagcttttcaaagtagtagatcacagcctgtgaatgtattatttttactttaatcgataattaattaaaataaatattttactgtgaaatgtggccaagaaagacctttggaattagacaagcactttgttgcattataaagttaaaaatcatttcagtaatcagagtctaatttaattatgggccaactaaaaagtaactattgatggcatatagtattagaaatgtagaatacatttatatcttttaaaagaaatgcagagaaagaaataagcacaataaaaaggatatcaaattataaataaaatccacatacctttgaatgtattcagtgcaagtttctgtttgaaactcagggatgcttgatcctttagatttcttccaactataagctcaatttatatcattcatggcatctgtaacaaccaatccagtttctaaaggaaaaatgtgttgagtataactaaaaatccctgtatcatgattttttagaagctatgatcagacataaggctgtatgttgtgattagtgcatatggaatctttcattatgggcaataataggtttaacaggcaaagagtttcatcacgctattttgaagtcagcaaattagttgactgtacatgttgatatattcagatttatttttaaaaagcttctctgccatcgccttttcctcagttctagcaaacaacgttgttctttacaaaaatcaaggtaggtggttgagattctctagtgtaatctggatatcctccaggatttttccagccctttcagatcaggagaaattgattcaaattcccatttgggtaaaaccccaaagctctctctagtttctctctgaggaattataattttgggatcaccactgctctattatctgcttccattgaaggtattttttctctgttccccttggctactcctttatcacccctctggtgtccaccaaaacaggggacaaagccccttctcggccccatgctgaaacccatctaccgtaaaaacaatcaggaacttaaggttcttgcagtagcaaagcttttactgatgatctatactacaaggcaaggagtgcacaccagacagcacattttaaagtaaattttgttttttacaagcaaactcatgtcacaggggatgttgtcctttgcctcccatctcacagagcagcttggcctctcagtatggcggcccttctttgcccatatccttctggcccaatcccactttctcatacaggcaaacccaaattcctctctatttttcagagtctcttaactgtctggctagctactttgtttccatgttctcagcagcctcccctttccctaagcaatgaccaaagctattcactttctaaaagaacctctgatcatctacctattaaattcatgtgtgttttacccctctaccttggtataacacatgggctttttctttcattctggaatttgattagattgatctaattgagcaaagttgtaattagtggcaggagctaactgacgagtcgtccatcaatattagatcaataaaggagatactgaatatctacccagatacagttgatgttatacttggatctctttgaatacacaagtaatacttataaagtttgtatatatacatatgtttatacgtatatatacaaattacttagcctgtctgagcctcaatttcctgatatgtagaatggaaataataacagaacctagctcagggaattcatgtgaaaagtagatgagtgacatctctggggaaatggaagtctatttattactctccccaaccctgtcagctggcatacagtaaatgtttaaagaatgctaataaacaagattccaagatgatctttggggataaatcagtagggatgaatattgcaaagaaaggtaagaccttccaatcagggagagagagattgcaaagaaggaagtagaagattataacaggtaaaatgtatgcatgaaaagaaacatagaatatgattctaaaagccaaatgtccccaggatttggctttatttatgaatatatttattggtgaattttatagcagagacaagaaggattccctttgaaggaagttggaaaatggaccttaggaggattggcaggggtgtacagcaaggtggtaagggagaggaaggaaaatgtggatcacattttattcactttcaatctttttcccccattttatataattacatatattggagtgtctgaaaggattcaggatattttttttttctacaaagttgtgggtaatctctactaatgaagtcaatgatgaattactagtagccttgtagttttagaaagattgatcttatactttttctcaccttctaagaatgagaggatgatatatttggccataatgatcaacaggatgctgccttaatgtggcattaattcctctggaccactggatagtgagttaccgctaattcaccatggacagttgaacaagctttgatggccgattccatagaaataattgattttcccctactgcatatcctgaatcataggacattaaaatatggatctctgtttgaaatctcttccactaatttaggccccacttacacagcttaaaaattggtaaatgttttgaggaaaatgaaatttcaattgaaatatttttcctataagcaattattttatttatgaataaattgactgcataaaatagttcttttgctcatttttttgtagtaggtattctttttcttgacttgcagcccagtacgttttgctgttctcacaatgcttatgttagcaacttccccacttctaatttgctgcttctaatttacagtatgctagaaaatcatatgcccaagcttgttaaaagtatgcgtgaactgaaagtaaaggaacactctaagtggggctggcctgggagggcctcgcctgtgagaaaagcaaatgaatttcggttttgtgacacttatttttgactgctgggagggtgtttggtttgttttggggttcctctccactggcttactgcctgggtttcaacagcactcggggtatgagggtggcctttggataagtcaggtattatgagtttgcaaagcctttcctatcatctgtaagagttcaactcttgagccttcttttaaagcatccccagggttatccaatattctggaataatttcaacagtgagtcttcttaagtagctggagccaaagctggcttttaaatattttctctgtagatgtttacttacaagaaaacatcattctctaggatagcttttttttttttttttttgctggggtagagttggagttgtatgatcttcagatcttaggcacaaaaccaccgatgaattccgatacacatcgtaactttgaccccaccgcaacccttagaaatcaggtattgtgtcttatactttcttgggagctccttggtacctagaaaaagctcttatacaaagtaggtgctagataaatgtgttgatgaattaatgaaaatgtagaaaagttttccatgacattgtaaacatagaaaatgtggattctgaaagaaatcctacagtgatttagatggaccttttcaatagctaagatggataattcagcattgctctcaactgctcctgtggacttctgtgcaaatgacctctgataagtatctgaaaagggagatgctgtaaaagcgctagaatctattatcctaacagtctcattacatttggctctgacctcttagttcaaattataatatactccaaacaaatacactatgatagataattttttgttgttgtttttgagacagagtctcgctctgtcgcccaggctggagtgaagtggtacagtctcggctcgctgcaatctctgcctcccgggtttaagtgactctcctgcctcagcctcccaagtagctgggattacaggcacatgccaccatgcccagcttatttttatatttttagtagagacggggtttcaccatgttgtccaggatggtctccatctcctgacctcatgatctgcctgcctcggcctcccaaagtgctgggattacaggcatgagccactgcgcctggcctatgaagtaacatttaaaacaaaatgtctaccaatagcggggctggttcaaatcgattatggcacaaatagcattcaagatgaggatgtcactctgcgtttgtcaacataaaaagatgttggtgatacattgttaagtggaaaaatagattttttaaagtccccttctctaatttttttctccctccctccctgctctcccttctctccatttggggagatattcgccaaaacacagtagttatctagggactccttgaaaatctctgggtagccgaggtttaaatttatttcttttaaataatctgtgaatgcaacaaatgcaggggaaatacgagaagtttggagtatgatatttctcactcatgttcagcaagagagatgagtaagtgatagtgctacttgcataggccctgggtatatccaatgttcattcttagggggaaaaaaggttcaacataaaatccaagacaaaaaaaaacacacgattttttaaagtgagagagcccttttaaatcatgagtaggaaatattttaataatataaacattcacagcaagagttcatacagcttgtaatttgaaaagtccgtaggcatttgctaaatatcaggtggaacaattttcaacaagggaaattatatgcagttgaagagtgtgttgtttggattataattaactggtaactgtcaggagtgaaaatggtacatctgtgttaaaagaggtaggacagtaatgtaaaaacaagcatttttattcctgtttattgggtaaaatataccaaagtaagttcaactttcctgctgaggttcagtggagacatacatagattagtagttttttaaaatattgttcagccataaaatggaatgaagcactgatccatacagcaacatggatgaaccttgaaaacattacattcagtgaaggaagccagtcataaaataccatatactgtatgactgtataggaaatgccaagaataggcaaaatccatagaaacagaaagtagattcatggttgccaggggttgagggaagggggaaatggggagttactgctaatgagccccaggtttctttttgtgatgatagaaatgttctggagttagacagtggtgatggttgcacaatcttgtgaatatactaaaagccactcaattgtacactttaaagtggtgaatcttatggtatgtgaattatatcttaatttttaaaaggacacatattatatatggtatgatatcggccctcaaaaaatgtacagcctttatacattatgtaaaatatagattaaaaggctaaacacggtgtaatggtacagaacaatagtgtaagtgttgccccacgatgataaagttgatgatgacgactatgatgaagatgaaactaacctttattgccagccatggttctaagcatttaacatgtttaaatgtttattggtcacctcccgcatgccgggtatattctgggtttatgttttacatcagtgattaaaacacacaaagactcctactcacagtctcacagaaagcaactatgaacaatggatataataaataaggacagcagaagagaaagcctatggaaaaggaaaaagtagagcagctaagaaggattagacgtgctgagttgcacgtttcaatagggtggtcagttttaaacaatttcttgaagaaggtgaggtgttcgcctgagcatctctgggatcagcacaaaggcaccagcatggaagtggcccagtgtgttagctagctggcaggaacccagcactgctggtgtggtgcaaggtggagggcataagaggagctgaaggccaaaaggtgacatcttctcatgcttccatgatcttagcaattaaatgtagaattccttgcctaaaataattctattgttcattgtgtgccaggggcttcaggctttggagatgtgaaggatttggatagacatagaggctatttcctcacagggctgagtcattggaagaaagagaaacgggaatgggcagagcatgcttggtgtgcagaaaaagaccagctaggcagcagcagaggttttaggtagaaaaagggcaatggcagatgggctgttgggaacagagagaccctgaatgttggacagggaaatccacttgtgtcccctctgcagtggcaaagcactgagcatttgtatccactgtccttgcttgctagggtttctacaagaaagttcgtctggaagctcagacttgtgtcaagaatgagaaggtagaaacacaaagcaatcagatgacttggctgtcttcacatcacattgagagtcagagcagacgcaagacccctgggctctggccctggctcagacactcttcacccacttgctcacagatgaatgaggcataccttggggccccagatcaaatgataacattataagaacaactggaaatagataagtctttaaaaatacagaacataatgtttttcctgtgaaatatagggttgcattcaaaaactgttaccagagaatattctccagagaaacctacagctattcaaaactgctctacaatataagctcttgtttagtaagaaataaaagctatttaatgaaaggtctataaaaacggatttaataacttaatacataattatatgctataaagttcatgtgttgaaagggtacacttgagtgggttttagtatatttttaatgtatttacaaagtttgccaccatcaccatagtctagttctagaacattttcatcacctgaaaagaaatcccatacccagtaacagtgaattcccattctcctccccttagcacaagacaactaccaatctatttcctgtgtctatggatttgcttatttggtacatttcatagaaatagagtcatacaacatatggttggaaaatgtgtctctgagaacctctacaaaaaggtttgtcggtgttagcactcttggcatttggggccagataattatttgctgagggatgtttagcagcatccctggcctctaccttctaggtgttagcagcaacaaccctcgctcttaagttgtgactaaccaaaagtgtctccggacatcgcatatgtttgatgggggagtgagggggcaaattcgcccctagttgaaacccacagatttacagttacctaagaactgagctgggtgtaggggtgtataaagtgaggtgggtgcctggacccagggtgctgttgtggaaagacaactatttcagggtctgtgaaggtccaaagtttgtaccccaagttccaaaactctgtgattcattttagcaaataggaaagagatgactaggggcaagaggcacaactgttatttagatgaagttattgttcaaacaatagctggtggggaaaaacactcattttttcggtcactaaaaaagatagagggtgatgggtgcaccaaaatctcacaaatcaccactaaagaacttattcatgtaaccaaatatcacctgttccccaaaaacctatggaaataaaaagacattttaaaagatagaaattgttattttaaaataaaattcaatagtatatgccagtggtctttaccttccttataaaggactggaatcatggtgtcaataattcaaaaagtgtctaaatttggatttgggctgttttatgttacaacagtaagaattaatggttctcaaagagccttacttaagtcagctttaacattactctgcagactataaacaccccttgagcagcaaaaggaagcatgaaatttgatttataccgtagctaacgaaaacaagtgggcaatcacaatttgatcataccctactaatctaatttagtctcaggaatggactaaaaagaggaagcttgtggactttagaaatatgtacatttcagaaaatataagtgtgacctcttttcttttcagaattgtgtaagtgaaggaagctgtcatcctccctggtaaatccatttgtaaataaacgggctaaagaaatcatgactgtggtcctttctagttcttaggatctgtcctgctcagagtgggaatcacaaagtgattgaggtaataactggtatctttgttgttctcagtttaaaggaagtgttctctcaaactgccttagactgcgcagccttgaccctctaggacttgatgccctgtgtatggcattgttatcagatgcaagttagtaaacccagattgtgtttacaagtaggttgtcattatacagtggcttctctgtaagtacaaaatgtatatttcctttttatttatcatggactatagcaattacagaatgtagctcttgtttttatcagggatattactgaggcccttaaactcaagctgacttacatttattttaaaatacatgttccaaagatgtttttaaaattttaaatatgcatatttttaagattttcccctttaacctgttctcccatcctgacatttaggatggggaatagacagaacatctgagggagtttgggtctcacagatcggctgtaaaattgagtaagagcaaaatgtttggaaaaaaaaaaaaaaaacaatctgtgtggttgttcatctggaaagatctgttccccactcagtagcttacagaaggctcaacatgatatggatcagctcgaattcattatctgaccaaacagcaactcaggaatcttatgtcctgtccaaggtgtgctgtgggactcaataatctctttccagatctattatatctacataaaaatatgcatgagaatcagataaactagtgggcctcaaccaggaatgattgtgcccttcagggtacattttataatatttggaagcatttttggttgtcacaattggaggatacggatgttcctggcatctagtgggtagaggccagagatgctgttaaatattctacaatgcacaggaaagccccccaaataaagaattatccaaccccaaatgtcagtagcattgaagttgggaaatcttgttcaaggaaattcccagtgcctcaggttgtcttatgagatgtggagcatgtcaatatccacagttgccagttgtgccatatggaatgctgcaaggagaaaatatagatacacatgaaaatgtgtttttgggatttggggaaatacatctatggatttgatactttggtgttccaaagatgtggctatttttgcccacaagtgttgcccaaaaccctggggctatgtggtgcctttttcacagagcaagtacataaagtacagactgttaaacagatcactcacctgctataaaatgtcagttaataatgaggtcctatcatggatattagttgaatgataagtgccacttctttcctcttacatgtttattagtgtcatctaaagcaatggctctcaaaatgtggtggctggaccagcagcattggtatcacctgggaacttgttagaaatgcacattgtcagccccctcccacacctactgaatctgaaacttttggggtagggcccagcaatctgtgttattttaacaagcttccccatgattctgatgaactttaatgcttaaatcggagaactgttggggaccaccagcacctgggagcttgctagaaatcacatgactaggccaggaccttgttgaaaggcagattctcatttagtaggcctgagaaagggatcaagatttgggactacagatatgatagcttgggtaaaaactacaaaatttctcctttttgagccttctatttccctcttcaaaaattgggaagacattgtattggttccctgttgctgctataataaataatcacaaacttagtcgcttaaaacaacacaaatttattatcttacacttccagaggtcagaagtctgaaatgggtctcactgggctaaaatcatggtacctggtgactgtaggggagaatcatttttcttgacttttccattttctagaggctgcccacattccttggctcatgtttccttcctccatcttcaaagccagaaatggcctggtgagtctttctcatatcacatcactctgacactgacccttctgcctccctgttccacatttaagttgctcctgtgatgatattagtcccatatacataattcaggacaatctccttattttaacagcatatgattagcaacattaatcccatctgcaactttaactcctctttgccaggtagcataacatattcacatattcttgagatttggatgtggacatattttggggggcattattctgcttcctacacaaataattttacctttattctccagcaaaatttgtgtcatagagaaaaatcttggaaggaatccagtcaggaccaatctcctaccaattcagaaatcttcctgcaaaatcctccaaacttggccatgtgatactagcttctcagctagactgtaagctgtatcctacagaagaccctatcttatagttattctccatctcctcagtgcctagaagagaatttagctcataatagatacttagaaaacattctttgattggtacactgctttcaggcacatagagcacgatatgactatatagactgtggaatcttgactttgtgaaactgagggattgatgctgaatctctgtcaagccttattaccctcctgtgtaaaatggggataatattacattctgtataggattgttgttggaatcaaatgaaatgttgtaaatagagcacatggagatatagatataatttacatgaaacgtctgaaaccataacatggtagaatactaccttgtgataatttgctaacaaaactgcacaagataaggacaggtggtattgagtctctttacataatgcttactgaagtgtcgcctctggcttcatttataacatcaatttagaagcagtgtttctcaacatagactatatttttgaaccattcgtgtagcttttaaataatatttttgcctgggttccattctacctagtttctgatttacttggtctaagcattggctccaactcttgctatgtttttgaatcccctggggaagcttttataaatatcgatggccaggtgccacctccagaaattctgtttcgatcaaatataatgtgtagccatggttgagatccattgaacacaacttattctaccttataaattgttacatctgccagacctttactgtatatgagaagttgtagttttatcaactttgcctgaatcagtggatgtttttctaatttccattcaatgtcattggtggaattaagaacactcaacataatgacatttgcaattataaaggtggtatcacatccccagagttttagcaggatggcagaaccacagtgagcactcagaaaacgtttgctaatgatgggccaaaaaaaagtgtcttttatggtctcttgatttattcaggaatattgcattgcagttgagtctctcacagagtccacttgaggctgctaacatgttgatttaatgaatgggtgcatttcatgaaccacccatccgagtgaattactttgggtgtagctgttttgatttttccttcctctgagtatatggttttgttaatttaaacaaattcagttgttttaccattttgtagacacattctttgtgtggccaagaatcttgtttgtggtggccacaccacaactggatttgaatgtagagcaacccagcaaagaagtgctaatttgaagcaattgttaacattgccagcaacaaaccaaagtgacctccatcaatgggttcagttagcaaccctgaaggcaagacactctgtttattccattatcgtttccttcatctatcagaaaccctaatcttcatggatgatgaaataataacaatctcaaacttaagatatattttgttcatcttaattttctaaatgtccttttttcccctcagtacaaacataatacatgtaaataaattccaacactataaaaattcattaggcagtgtcaaagtcccacaaatcccatcctccagtgatggccactaataaccatttgagaatatataaccccagatctccctgttaaattataataaacatttatgtccataacttgtgttctgcaacttctttgtttaactttacatatagtggatatctttccaaatttattcagagagaactactccactttttttcatgactgcccagaattccactgaatagataccccgtagtttagttagccagttgctcactgatggacacttaggttttttatgtttctttaaacatatatgcatataactaatatataataaaattaattatatataagtattaatatatatattttggtagattataatacacatgtagagaagtgcacataagtttacaacttaatgaatttctgcaaagtgaacacacctgtgccagatggagaaccatccctgaccagcacctcacagggatcccttggactcccttccagtcacttctccccaaaggtaacccctattctgtatttttgtagcatatattggttttatctggttttatagattacattactggtatcctacagcatgttattttttatgtcagacttctttcgctcaacgtgatgtctctgggattcatctgtattgttgtaggtggttggagtttgttttttcattcccattactgcatagttttccattatgtgatataccacaatttattcagtctactttcacgaacatttggataatttacagttcggggctgttttgaataatgctgctatgaacattctagcacacatattttggtgaacatatgctcacatttccgttgtttttattggtgactgggtttttttgctatcagatattgtactgaagtgaatgtctttgcaaatgtatcttgcacattttgcaagtattgctataaagtagatattagaattgctgggtcaaatggtattcacagaactgctccgaaaaaaattttgattttttttttttttttttttgagacaaggtcttgctctgtcgcccaggctggagtgcagtggtacaatcatgtcttgactgcagcctcgaaatcctggactcaagcagtcctcccatctcagcctcccaaagtgctgggattccagatgtgagccaccatgcctggcctaaatattttgacttttaagctaggtctggacctcaagtaacctattgtggatacacccctttgctattaccattatctgtgacacagacgctgctattgtgtcttcctgactacaaggcaagactaacaaaaaccagaatcttctggctcttttcagtcacgctctagtgagctagtgcctctttcatgtatccactgagggacaaaaagataaaatgacctagtgtcccaggatgccagcttaaacttttgagtacattgatgctatgataatatacaccaaatggactctgtggctctaagtaccatccactccagattgagataacctcctttcccaagtagagaaagaagattctaacctggaggtgagagccatttgcatgtcttaccaaaaaatgtcccattcagaatgagctgacattgggagacattaggttagagcagtgtttcccaaccttggaactgttgacatttagggtgggatcattctttgctgtgggggccgttctgtgcactgtaggatgttgagaagcatccctggactccacccatcacaactggcactttcctcctcagttgtgacaaccaaaaatgtctccaggcaatggcaaatgtcccttgaggggcagaatcaccccagtagaggactactaagctagtgcttatagaagaccccagctctaaatcagattatgttcagattctggctcagccactttttatgtgacctaggacaaagtacctaagttctctgcctcatttggctcatctgttaaatatagatattaatagtaatatttacctcaattggttgttgttgagattaaatgagattattaatgtgatgcacttggcatagtctttggcaaaaaaataagtgtcgaaagttgttaggtttattagtcataatctttattattattaaaaaaaaatggaggggtggaagaaggggtcccattgtgtatcctggaaaaaggatgaggataatgcatatctgaaaaaacatcaaaggacaaggggctcataactcttggaacacaggcaatgggaaatggaaatgtggagaaaacattaagtgctatgatggaagacaatggcatttggttgtctctctctgttccttctcaagttaacatttggaaactagaatttgtggaaaatagactttggcagcagaattaggcatttttaggaacaggataaatcactgtggggaaatattttattgtattactcttgttaatatgaagttattaaactttcaatagtgtgttgaatgcttttatcttaaataataaaatatattcagtgctaaagcagctgtattgtttttgatattattaagtagaaaaatttatctgttaggagctttgttgggttgattttcacctgataccctcttctcccaccaaagatctaactttcataaattctggcaatagaaaaacaagtcatcatgttaagctaggtctgaaccttaagaaacacactgtggctgcatccctttgttattgccattatctgtgatgcagatacagcaagacagagtggcatcctggacgggactccagatggagagtatgagtccagggttatgtctttgtgttgccaagctgcaccttggcttgtcacttcttcccattgtgcctcaggttctgagcagatggaattagtttagcatgtcccaactatattctggggaattcgagtgatatggagagatggtctgaaaattaaaaaaaaataaaaaatagaaggaggtgagattatagcaagtgtatttaggaggtactccgagttatgatttcccctctgcaggacttctctattattcttattgtttattgtgactacttaagttgaagctaccatgcacaactttttcaaatatatttgattatggaacagcttggaaaatcctgcattaaataatgtatgtgtcccttgcaggcataaaaatattctgatttcttttgaattaatctgtcatcatggctgtgacaaattaccataaatttagtgccatgaaacaatacacatttattatcttaaagtgctgtaggttagaaatctgacacaggttgcactggacaaaaatcaaggtgttgacagagctgcatttcttctggaggctctaaaaccacccacactccttagctcatggcccccttcctccagcttcaaggccagcaatattacatctcttagatcattattctatagtcacatcttcctcaaactctgaattctgctgaaaggggttgtcctattttaagggcctgtgtggttacgttgggcccacctggataatctagacttctgtccccctctcaaggttattaacttaatcatatgggcaaagtcccttttgccatgtaaggtaacacattcccaggttccagaaatcagggtgtggaaaccttaggggtgagagatattattctgcactacctatcctagtggcttcttccatttctcaaccctggagggtgtggggtcgtgttctgtagagccaggaagaagttcagcatttgttcatctgcttttgaccctagcaactcatgaaatgtgcaatgactatcttgtaaggggtattaaattcttctggcttttcctcacccagtaagcaataaaatcaaagaggacaagagtaattaaagcaagcctattgatctattttgtgtagcattctttttagcttctcttctgatataggcaagaatatctccctgaaaggaactaaactctgaactgtactttaacaagtaaaattgccatgctggatatcaacaattagtctttagagttaaaatataaacataaatgattaaattagttaatctactctttgtggtatagccattacagggctaatttttttttaaaaaaaaaaagaatactagaaacctctaaatttttcaagacactcatattcatcagactgtaaaaagcaaaagaaactgaaggattgtgttccttatcacagcttggaaaaagctctgatggctgatctatatgaagtggaaacattgcatgagttttcttgtaattgttgatatctcatgtgaatggaatgaggcggaaaacaagttttgcactaaaataagtgtttgaatcttgctatttggagtcatgttgtctacgttttttttttttgtttttggctacatagttaccatatgatccagcaattccacttctagttatatacccaaaatcattgaaaacctacgttcacacaaagtgtgtatgaatattcacagcagctttattcataccagtcaaaatgtggaaagaacccaaatgcccatcaactgaagaatggacaagcaaaatttagtatatctatacagtgaatattatcctgccataagaatgaatgaagtaatgacacatgctacaacgtggatgaactccaaaaacatgctaagtgaaagaaaccagacacaaaaagcccacatattatatgattctacttttatattaaatgtcaaaaacatgcaaaaccatagagacagaaagtagattagtggttcccaggggctggggtgagaggggaatggggagtgactgggtatgggctttccttttggtgtgatgaaaatgttttggaatcagtgatgatggttgtacactatctatgagtatactaaaaagaaacacagaactatacactttaaagtggtaacttttatggcatatgatttttatgtccaagctcttctattattttactataatttatttttgaaaatgtaaatttcaatatgcttcattgctcagagaaagcatgattttctatacatcagagcaaaagtatttacacaggtctgtgaaatactgtgtaatttatcattttaaaagtcgtatattgaggagaaaacatttttgaaaaataaatctgaaaagtggcagctagaaaatcagatgtgaaccagtaagtgcagatggcttgttttcacgtcatacctgcatttggtgtcatacttcatgttggtttctcccttttcaattttcccttttacatgtttgtctcttaatactaaaagtcaggaagcaagattttcttttttttgcatttttactggaagtgattttagctactttaaaataaatgtcctaaatataaatattccctgctggtcttgtttccatgctaatagacagaaatgattttctgtatagacagaattgctactctccttcaaattttctttcaaccagcaaatatacaaaagcacaaaatgttagtgctgtttctattcttccagaacctacagtctagccagggagaaaaggcacaaatatagataatcaaatagctttccaatgtttaaataagagtcaagaaaatagctgagatggggcagggtcggggggagatgagtgtgatggttacataggagggacgtatcggtgacgttagagttttctggaaaaatagctgacatttaaacattcccacccctcctctttcctccctcaatgagacatcacaagtgattgtctagacatctcaagtgtctaggtcatttggaaccttgaaagaagcagattcgccttctttaacaaacataaggtgaatttcctttggtcatgttttggtgttccttataggtccatagtaaacttgtttgtgttttagatggtatgattttcttgttaatgtgatgattcatttgtaatgtccctgtagggggacgacagggcttctcagaggaggtgatgctcagtaagcattacagggtgagtaggaaggcatggggaagccatttgggctgagagcacccctcaccctaaccatgaagtcctctgggctcttccatgtggctgaaattaagggatgtgaagtaagtgaggcttggtgaagcccaagagctaagcagtggccagatcttgagcgatcttgtgttttcacctcagagttgagaacttcatctggaaagctaggagcctcaatgatggctttcaaaagggaagggacaagatgagttttgctttgtagggagagacagcctacaagagtgtggaagtgctggtggacattcccagagaggaagtgttaaaggaaaggacagtttttaatgaggtgggatccacagaaactggtgactttctgagtgtgagtaggagagacataggaagcaatgttaaaaatgattttgcttcagttttcctgggtcactgcagggaacccatactgatgtatttgaaccacagaatcattgcccctaattttattgtgtgtattttcaaataattggtttacttaaagcaagatgcatttgcatacgtaccctttacccactgtgtattatcacatacctattataaatatttgtctatataagatagaaatatgtcacatatataattcatcatataataaatatataatagtcaagagatacatatagatacacatagatgtagagatagttaaatctatttaatatggagacaaatctataatgtttgtagtttttaattacaagtttctcaggccggccatagtggatttgataggcatcactctagtatgaatgtcttttctttcgagaatacttggaagaaatgctgattcctaataagtagctcataccaaatactaaagtccatgctactgatttcactttttctccctgagctttttctcattatgtgcgtaaaagaaaattagacattgagtgatctctgtggacccatctgctcatacatacagagatgtcacaaacatagttttaaaaacatgtggttcctggacacaggaaggggagcaacacacactgggtcctgtccggtggtggggttgggggagggagagcatcaggataaatagctaatacatgctgggcttaatacctaggtgatgggttgataggtacagcaaaccaccatgtcacatgtttacctatgtaacaaacctgcacatcctgcacatgtaccctggaacttaaaattaattaaaaaaagaaacagaaaaaaaatgtggttcctttgctgtttgaaatagtgaaatgctccaccatgaaatgtgaacattgtcatcccctatgtcatatatctggtgatttcttttcagtgggtccagatctggggtcggcaaactttttctgtaaagaatcagatagaaaacattttaggtgttgcggatcatactgtctgtgttgcaactactcaactttgctgttgtatcggaaaagcagccacagacaataggtaaatgagtgggtgtggttgttttccaataaaatttgattacaaaaataggccttaggctgtcctttgctgaccctgctttaagtcaacagttgccacctcaaggtcaaggcatgcctcagtcaatgtgttagaagtaatttattacctataataattaagttacaaactttagaatatttgtaagaaaactaaatgagagagaattagagatgagcctagaaccacctcatacagttattttgatgaattttcttgagtaggagagcaaggtgcagaaaagtagcataggatagtggttaagaccacaaactcaggactaaggtccctgagtttgaatttcagccatgccacttgcaatatgtgtcctgggacaagttacttgactgccctgtgctttgatttcttcatctataaaatgggcatattaataaacctcacattttaagattgtttaatgattaaaaccatgagtacaccataagggactggaataataatgggtacacactatatgtacaagagatgatagtcattccccacatatctaaatcttttggatttagatccaggacatagctctcagcttattttatctgtgctgtgagtcactgatgaataatccttactgtgcaccactaattagtagttgtggtgactacaaatttttatgttgctaatgggttgtaattttgtagtttctgaggttaaaaaaaaaatctacccatagatggatacttaacaagaaagaagcagcaaaactctgtgtagaaaatgtgaacgtgcacaaatcagtaatgcccatgagtgaaaatgacatgggaacatgttgttagggtacaacagttaaaattaccaaaaggtcaacaaagcgattatgtacttgaacattggacatcatgttctttatgttcatatcactgaattctggaattctgagtctactggttttttttttttacaaatgaaataaaatgtagctatgtttacagcatacccttccttgtccatcctattaatattaactggtggcatggaagtcaagaaaaatgactcattaaaataaaaatttttaataatttttaaaaatcagattaccatataattgatttttttgtaactgttttcaaaatggtcttcatattgccacgttaatttatcaaatacttggaacatgcttttagggatttcatgactttctccttcaaaagttggccccgctatttgctttatttaccaaaaaaaaagggtgaggtttggggaggggtgtagggaaaaagcaatcaaaacctgggtctatcagcgcatgtgacacgttcatttatcataagtgttacatgcatagctctctcctccctacaggactattttatctccactttacagagcaggtaattgaggcttaaaagcgttggatactcacatggctagttatatgctgaacttgaattcaaacacaggcagccagaaggagagtcctccctgtaaccactgtgctataacactgcatcccatttgaatgaaacagtggcaaaatgaacagataagatgaaagctgcttaactgtgctactgttcaaaatattccccatcacatctatggcagagctcatggaaagtgacatctggatcaagcctgtgcacgtgaaaaacaattttaaattatggatgtatgtgcttggagacttaatctcttaattggtagcattgttaagttttctttctgctgtcaatggaagagaaaggaaaaaaagaatctgagctttgagatgagggcacgttatgctctcggtgtgggagaaatctggcagaatcagtcaatgaaggaatatatggagagtgcagtcatcacatgagtatgtggaagggtgcaagaaatgaggagtggaggcaggagggagggaagcaaaggtacatgacaaattcttagtggaatttggagaaaagttatggatcctggaaaaagttcaaggaatttgtcttccctgatagtttcattaagctctggccattacaatggttctcaacctggactgcaccttagaattttggggaaagctttataaatatatcattgtctgagccccaaccccagacagtctaattgacttggtctatacctgtgctgtccaatacagtagccactatccacctgtggtaatttaaatttgaatcaattaacattaaatacaattaccaattcaatattcagtttctctggccatatctcaagtgctcattagccacgggtggctagtagccaccttagcaattagtactgttaacaaaaatgtccattgttatagaaaagtctattggaccatgctgttcttggggagagggacatggtcataaaaatttttgaaaactacagcaagtaattataatgtgcaatgaacttagagaactgttggtccttggagaatacatttgttctaaaatgtatcaccacttgtatctgaggtcattttgctttggaagatgattctgaaaatatcattaatgctagactttttctgcagcctagaaatgtagccgcatatatttttatttaaagcagcttgcttgctcatttactctacaagatttagatgagttaactaccagactgcaactaaaaatgaataacttgcttttccccacttagaatgaagtggtacaacaattcatgtagattttgaattacttattaaaagagtttaataggataaattatcttacagtaaaaccgagaggctcattgtccacagctcacattttaggcaacagattagaagcaacgtctatatatttgatgatatccaaaattaatttattaacttaatatgtttatgaagtcgcatgtaattttgaggaaattgttttcctttctcattagagaagaaccccactgagaagagacttttgcaaagtgccaaagtgcaattgatgaaacacaatgtcaccaaatatagcattgaaatgagaaagtggaaaggaattcactttggcattttttattttgcctagtttgtttggcctaagagttttcaagctcctaaatacgatattcttctatccttaaggcttgttttatatcctgctgatttgtaaatatctgacttgggattgggttcttcagtttgaggtgacagtacttcagcatccctgtatcttttaggtaatcttgctctgaaatccattccatgtttaatgagcagtgaatatacccataacagaataaatgacctgccctacaaagagttcacatgacatcttacctagaatgagtgccctcttatctgagtttccttcttatttcaagaaacctgaagcatccaaccttataactcagcgttcctcactacatgagtagaaggagcagctacaaaataagtaccattctctgcagtgtggtagaaccagcgatatacagatttctccataagaatcaagataaaatgcttttctctaggtcaaccctcctgggcacctaaaatgagatgcaaatttcacactctgtactcaaaggtatttctccagctataatcttgggcttaattttctggggatccatatttattggaaaaagagagggactctcataaagaaagaattcctagagtcagcttgttttattgctgcctagactcgcttcttatcagttcattccacaggtagagcctccgtttaccggttacattgtagactcagtttgcttcctctctttatccccttcctatcagttctgcaccactcggcctcattcatctttcctaaaacatctctttcatggtgttacacccctacctaaaactgagagtggctagttctacttgtaaaggatctggcatccaggaggttttctaacatggctgttccttttttctttaaatgaaatacctgtccctctccttattcctggaggtcattgccccatctattggctttcttttctctgtttcatcctggtgccctgcctctgtttctgcatatttctgtgtctcaattccacagggctttgagccctgagctgtcatctatgtatttaccaaaattctcccagttgcagagaggccttccagtctctgttggatgctctgtgtcatacttactttgtttataggtcttccaaggaagtgaataaagaaaaggttgctggcatgctgtgatattgcctaggggttaaaattattgcatttgaaaacagactgcctgggtttgagtgccaactctttacttgccagttgtgtgacttctggcaagctctttacgctttacgctctctttgtttcaactttcttatctgcaaaatagagataattctagtgcctgcctcctagaggatagcgtattcatggagacaataagtactcagtaaattttagttgttctttattgtggttttgactgtttcagattcatggtcttaaatagctttccagttactagatttgctttgatggtagagtttagatctgaaggatccaaaacattctctccgtgcaaataggtcacagtagcatcagaaggacgctagcaattagaccaaggtcagggtgctaggaatggggaaaggacggacagctacagttaaggaagcaaatggcagcaatgagagaatatacattggcttatcacctagcccctggaagttctgagcaatacaaagatagagtctgatggttaaactgatggtaccacattttcactgagcactgtaaggcagcagatgaactaaaatgtctctcacaatttgcatttttatatatagtcttaaaaaatattaagaccttacatgcgaactctatgctacactcaaaaaaggttaccaggaccaatggaaggtttatcagtaatgaatataatctaaatgaaatttcactgtgccattttatgagtcagtcatgattttgaaagataaaagcattacctatttctaaccattggctatatattattcaaaatctgaaggatgtcattagaaatatatttgtcttcttttatattaaagactttctacatgctcagcaaaacaatatataaagagcaatttttactttaccatccagttgatcaactactctgtttccaagtgagaatgtaggaagggacgaaatgagtcatgatgtcgttcagtggggagaagtataggaggagtttcaagcgcaagggctccagatcaggctgcttagatttattatctgtgttcatatgggaagttcaggaaagtgaggtcagctgctatatcagatacatccccaaatttcacaacataagtctatttgtcattcatactgttagattggccacaattggtgggacagctgtgctccaagcaatgattctgaacctgggctgcttcttcctttcattcagctggaggtagggtgggctggatttaggttgagacattggggcaactaaacctttcacgctggctatattgcctctccacgtggtctcttcaacatagtggctacacctatgtcatgggggctcaagggtcctatgaatgcaaaagcagaagtttccatgccttcttatgtctcaggtccagaatgggcttggcatccccttctgccacattcagttggttaaagtaactcatagagccaggcgggcttgaagggcaggggactacactaggcaaagaacactgaaaaatgtggtccactcctgggactaccacacatggctatgcaggttgcctggatgctgtctccaggtttttatggactggggctagaaatgaagcttgtcacttcctctgacattccattagctagactccagtcatatgaccactattaactgcaagagaggctgggaaatgtagactagctgaatgcccacgaaaaaggggctacgggcttcatgagcagtcagtgttttcctcactgtgcgccatccatttctgtgcctccatcacttcctctataaaatgaaattgttggaggcagtgaatacatggcacacatgaagtgcttagcacctaatacatgctcagtaaacttctactgttatcattcactattatgtagtggctatttgattttattccatctaagtaaaagcacaccgcactggataccaggctaaggaatttggactttgtcctggagctaaggaggagacatcaaagggttttaggcaaaagagtactgtaatcagaaatgtattcactcaaaaagtttgacagtgattctatgatatttttgccttaaatgtgcaaaatatcaccagtgatataaacagaaataatccagaataagagccaagaagaaggtggaatgaatgcttaatggcatagattcttaggctataaattgtttcttggtatgcttagatatggagggttaaatgggaaaaaaatgaccattgtgctctcagcactttttgtgattagcgaaactcttccacagatggaaccttttagttgcttcctgatatttatttccaaggctctttcagtgactctttggtctcttattggttttacttaaagagttgttatttaaatcttaaaaaggattccttatctttatgttttgtttttctggtttgaatgcattttccaaagaataccaaatatacacaccttctccattatttctgcacttcctcttaaggcctgccttgcttccactcttaaaacagactaggaatttcacaagatgttgtctctcgggattatttgagattattcacttagtcaccttcttacgaaacatttattgacctgacagtgtatgtctccatcaaataattgatttaacagaccactctagtgttaggtaaacattcttatttcatcactgtctcttccttattagatacttataacatggctcctactagtactgactctgaactgtggttttgtcttccagttaatttgtaagctcatagtggttgggatgacagccgcattacttatgagctgtgaatctttgagcaagtcacttaactcctctgcgcttctgtttcctcatctgtaatatgaggataataatgtaacctactgctaagaattattttgatggttagataagtcagtgcccataaaatgcctaaaacaatgcctgacacttagtaagtgctcagtcagaactacatgttgctgtcatctatttataaactaaaggatcatttgcctaataataaaaaatgaattacatatttatcaatttcatgtgaaataatatattaagatattagatatattgatattaagatattagatatctttaaatgaggatgtaacttccattgatgagtatccagtatgagccatgttgactgtctactggaataatgcgtattttcaacatcagtttttaggatagtggtggtggaggtatgtgcagtaacaggtagattttactctgaatctctgtttaagtttaatcattctagtaaagaaaaccacctggaatattttactgctttaaaattccttccttagcagcagcagcagcagaggctatgtgtggcttacatgattagtttcacagaatcctagtaaaagcataccgagtccttaattttgaatcagtaagatcttccatgaaatcatttcccggtttgtaaattataatcacagtgattcttttgttggaattcacttgagacccatgagagaactataacttcctattgactgggaaacaaagatgtcttttcgagttgtatttggttcagtgccatgtggaatgcatggagatcaaggtaattcgcgattggaattaatcttcccttttctctctgctcttcatggatgccacccccaacccccaccccaacctgaaccctcttagatatggccatgtgggtatattcactctgacctccacaccctctgttcaggaaatgaacaacttctcaaggactgctgtcccacaaagaggataaaatacagagcatgtgttatgcttcagtgtgaaagagaatgaaaacttttgctttttagtgtgtgtggctagtgttagaaaaatggagtcagtagttttaaaatataatttaagaactgagaatttgtcctaaacaaagaaggcatcctatgtgctttatcttgctctcaggggtttcaccagtggcttccaacattctttggttgattcctaataaggacagtttgcacagttacaatccaattaccgtttgtagatccctgtggaaaagaggattttttttagaggaatccttttctaactcgagtatatttcttcaaaatactctcattctttttgtcccttccctcccctctttcctcctccccaactctctctctctctcaccctctctctctctctctctctctcacacacacacacacacacacacacacacacacacacacaggcacacacgcatacaaacacacgcactcactcatttgtgcacttactcagggacacagcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatgggtaagcaatataaatatctatacttacactactttttcagaaaataattgtgataaagttttgtgattctttcacatccatcttgtgatttaggaagaaaactggaatgatcagtgtctgagatgtgtgacagctaaaaactgtctgtgtcaatatggatttatgagaaccttatttttagattaatgatgtggcagcttgaaatgagcaaactcaagcaggaaaggattgtgtcatgattaacagaacagcataattgagctaatttctgtaaaagattcgggcacaggctgttttgaagtctgaaagggtaaagtggtttatctttccctcttaacttcttgaatatgggtgcaacattttagttgctgtggctgtgataaatatgggtttaggggaacagtttggatattaaataaggctaataatacatcggatgtgcttgtgctgtcttttacaaaagaggaaactttaagcctctgaatttttaaacactgtctggctttcattattataagggtatgtctcataatgaaagggcttggtggtggaaagaggggaacatgaccctgatgtcccagatcccattatgccactgcagctgctttgctcatttgtaaagttagaggtttggattggtttatcatgaaatgttatgaaatacatatagtggttatgagtctaaattctagaacctaaagcctggcttcaaatcctaactctgccacttaattggtgtgtgctcttggcaagttacttaagttctgtgcctcagtttcttcatctgaaatatgggaataatgatggtaacatagtccttaggttgttgtaagaattaaatgagataatataaataaaaggcttagaacagtaactagcagagagcggaccatctataaatgtgagcagtatcttcaaggtctaatctatctccggaggtcgttctaatttcagtgaactaaatttaattagagaaagacaagtagaaccatcagctgctggccctgtcattaagaaatttctaattcatgccagtgtttccagtttttgcaaccctgagatttgtgcaggccatcttaccttcttcctcccatccaagactcgagagaagcttagaactgagaattaaattgatggccattagaaaagtccacaattcaactgggactacacagaaatgaaattgaccttttgctctgacgtttttgcccttgaggacttccagtatgtcccctctatgctaaccactggaaaggttctttccactggaaacaagatgtaagtgacatttgattttttagatggtgttagcccagccctgggtttgacaatgttcatttctacttctttagtttatcggtaacccaggtgaacaggccatttgcagataaccacttctatttcatgctagcatttgcatattttctaatatgctaaattatgttgtttgatttttttttttacaggctctctgggatgtttctcagagacaaaatcttaggagaggaggaaaatggtgatggcaaaaggcagatcctaatcatagatgtgtctttacttttagtccagtccaggggtcagcaaactttttccataaagggccagatggttacctttacggaagggcagcttcatggactgtgcagtctctgttgcaacaactcaactctgcaattgtggcctgtaggctgccacagaaaataacaatgaatgagtgtggctgtggttttcataaatcaataaaacttgatttatgaaaacaatcagtaggcagtacttggctccccggctagtcagcttgtatcagcaaaatccctgtcatcatccccatttcatagatgaggaaaatggggcatggggaatgtaagtagcttgctaaaaagccacatggctggctagtaagtggcaaaactgggactcaaactcaggcagcccagcttgccaccccttgcttttagccaccaggctatgctatacctatgtcaaccagtctctgcctgggctgctgggctcccaaaacctgcctggctcattccctcacctccttaagggttggtgcaaaaatcatgttctctgtaaggctgtcctggtagctcatgcagcactcctattcccctcaccctgtgctacctccttctctatctcttatcaccttgtaaaacttgctgtgtaattcagcacacatttcttaagagtttttggtgtctctaatacttccaagttaagatgctgtgttaggtccttcttgtatcaccataaaaatacctgagactgcgtaatttataaagaaaggaaaagaggtttaattggttcacagttctgcaggctatacaggaagcatggtggtgtcatctgctcagcttctagtaatgcccttgggtaacttgtactcaggatggaaggcaacagggaaccagcctgtcacatggtaagagcagaagcaagagagagagggaagaagtgccatgcccttttaaaaaaccatatctcacatgaactcagagcaagaattcactattgcaaggacagcaccaagatattcatgagggatccaccctcatgacacaaacacctcccaccaggccccacctccaacattagtgattgtatttcaacatgagatttggaggggacaaacatccaaaccacatcagatggtgatgcaaatttagagtggtgatgattaatattaattataacttaaatttccatttattcaggtcttgtgggagcttataagccttccacaagaaattcatttgtattgtctgatattatccctacaaactgagagttaagtcttgttcttttctccatcttaataatgagaaaaccgatgatcagagattttctgaatcttaccaaagaactgccatctatctgaatccaagtcttcaccaccatgccagtgagactcaacttttattatgcaaaaagtaagactcatctggggatgctgctttataatggaggtgcttgggacctattccctgtgactctaattctctaaatctaccttagagccaaaggaacctacgtgtttaacaatgatcattctgcccacgtgattccgatgccttgggtccacaaaccacattttgaacagccctgcctcaccccttgtttggccctggggagtttacagttggatgagattaaagagatgctgcagttagagactagccccaaggatgtaataaaacaatgtggtgtagaacaaaaccaaaattatttcaatcaattttatttcatgggaaaatcaagtctgtaaaggtgcaacttagctcaaaagaatgactttctgaataaagcatagatattagattgtttgggttttagtttgtcttttgcttctttttttctaaacatagagacatatacttctggtgggaaggaaatctctttagttaacacttttggtgagttgttctccagttaatcaagactctattgttttcaaactttttttggtttgcttcttttaattaggtttgtagtgtttgtacttattaatactagcttaaaataagccctatgattctgtttatgtgtataatacgtagaaaaatacatgtaaaatacacatagtaatgcatgatatataaacgaatatatagtacatatttttatgataaacaaaatatataaataattgttaatatttccagcaccatcattttaaggagattatatgtaatctgggcttaacagcagacttatttatgctaaaccaaggtttctcaacttctgcactgtagacaagttgatccagatagttgttgattttgggcagtagtcctgtgcattataaggtgcttagcagcatccctagcctctatcttctagctgccagtatcaaacgctgccccagttataacaaccaaaaatgtcttcagacattgctaaatgctcactgggggcaacattaccccaccaaggaccattatcctatatcattttatcatattgctgccctttattaatgctgtcacatagtaccctagaatagaaagatgtttttacaactgccaaggtctttagtctatccagagacattggatgaatttcaatttcatctacatttataaaatctaaacaaatttgaaatcatccattttcaatccttaaaaaaattccatgatgatcactcaaaagactagattcagaaagccttcaaatgagtcattcatttataagataaacagtcaccaaagaaaaatgctggtctggaccatgcatgtgagccttgagaaaccaccagaaacatattctagactgtgctggtaggctttggtgcccttcctgggtgcttgtttatcactttatggtccatgccatgagagtcaaagggagactatgacctttgtgttcatgtcttactgctcctatgaagtctgatgggtgggtataggtatcacggattaactcttccccgcgtcacctattatcacatttattttctcccctcatgtactggcatgggtttttcttggcttatcaacaggctatttcaaaagactgtctcttaatggtttattcgaatccagaatacagtttcccacatatatacaacattgtatgggttggttaggtttccaatttatttaactcatgatggggctggttcattagtccctagattgacaaatatttattcagtggctgttaagtgccaggtactgccttagataccgagaacatcaaaatgaataagccagacaagggtcttgccctcctgaatctagctgttgtatatggctgataatgcaaggccctaggactgggttgctggaatatggctgtagatgctacacaaatatgtgtagggcactacatgaccctaatctccatatcaggggttggcaaacaacagccagtgggccaaaagcagcctgatgcccgtttttgtatgacttgcaagctaagaattatgtttacatttctaaatagttgaaaaaaatttgaaggaaggatattttgtacacataaaattatatgagccttgacttttcatgtcatagataaaatttttggaatatttgtttatgtagggtctatggctgtttttgccctacaatggcaaaagttgagtaactgtggcagagaccataagacccacagagcgtaaagtatttactatatgtaattttctataattctattttatgggaaaagtgatttcagaattccagtcttgggacctctccagcacaaatcattggtgatggtacctgtagtatgaagcagcaccttagcatcaggtagcagggagataagaatctgatggaaggtcaaaacctacttttttaagtgtctgcgagcatgcccttcaccccaccaacttccttttctaatgctcccccttactcttgaattcatttcctattgctgccataacaaattatcacaaacttacaacacaaacttacataagtctcatgtgggcctcactgggctaaaatcaaaggccatgttccttctggaggctccaggagagaatccttggcttttcctgcactagaagctgtgtgcatttcttgtcttgtggctcctttttccatctgtaaagctagcagccaagctctttcaaatctttctctctcccacctctgcttccattatcacatttttgtctcgcttctgcctctacctctctccttgtgatgacattgcactcgcctggataattcagaataatctccccatctcaataatctgaaattaatagcatctgcaaagtcccttttaccatgtaaaataacatactcacaggttcctgggattcgggtatggacatctttaggggagacattattctaccaaccacaccttccacctgattacgccttactgtacttctctctacctccacagaacaaaatgtgggcagaggggcaactcacaagcttgcaacaaccagccagaatattgtagtggctaagagtggcttctgagagtgtcaggttcaagttaatttttttgttgagtgaaaaaataaggattatgtcatcacttcatttgtttaataaaagaaagcagggtcatgcttactctcagtttcagaaagtaacgtccttactattatgactgtcatagaaatagctttctttcccttggtagatttgtatctttctttgacaatggaggacttcttggattttctagacttactacatagcacttattatagcctaactgaacaatgtggatgcacactcaaactagaatctattcaagccttgagctcagtggttctcaaccctggctgcatgggagaatcattagggaacttcaggaaaaaaaatggacaaagaaaatgtggtacatatacacaatggagtattattcagccataaaaaagaatgagatcctgtcatttgcaacaacatggatgaaactggagattgtcatgctaagtgaagtaagccaggcacagaaagacaaacatcgcatgttcttacctatttgtgggttctaaaaatcaaagcaattgaactcatggatagagagtagaaggacggttaccacaggcttggaagggcagtgtgggggatcaggggaggtggggatagttaatggctacaaaaaataattagaattaatgaataagacctaccatttgatagcacaacagggtgactatagtcaacaataacttaactgtacatttttaaaataacttaaagagtggaattggatggtttgtaattcaaaggataaatgcttgaggggacagataccccattctccatgatgattattatgcattgcctgcctgtatcaaaacatctcatgtaccccataaatatataaacctactatgaacccacagaaatttaaaaagtaaaaataaggaaacaaaaaatacagatattgtcttggtcactgggtctgccataacaaaataacctcagatctctcttttggttaacaattccaaatataacaaagaagtttaaaaatccaagaagttaagaaccgtgggctgcaatatataatggactaaagtaaacttgaagcatcgcactttactttttattatgctaactgtagtcatttgtaaacagtttgaaaaaacatatattatttgattgtgttggaactgttttaattgagagtacaaaatcaaagctcaagaaaaatataaattggccaggttctgttttgccagacttagtaatgttttaattctgttttttcaaaagaaaataccattttcaccatgtccaaaactgggtgatcttccttctccccctgcaaacataattccctctgccattccccatcttggtgattagtgttactgtctgcccagttgctgaagctagaaactcaagagtcatcctagattaccccttctcttcccctcactgcatccagtttattctctagcatctatgtggttctaagtttctcccgtgtctgttcaaattggaatcagcatcccacttagcacggagtcttttctcatctccacatctttgacttgctctcccctttaattccttaggaaacttgtttccagtcatcttccctatatttcaaatctgctcatgttcctctctagctcaaagttcctgaatgactagccatcgtctatggaggaaaatctaatctggtttgcattgccaacagagacagccctacagaatctggccctgacttctgcttggcttcacctcttgcccttttcctccttccagccttgtaattccctgaacaagcctgttttctcaaactcatttgcctttgcacctgctgctaaagttgcattgctactgggcgaaccctgccccctcttactcaactttcaagcctccattgaaacactaccttctctataaagctttccttgatcctccagatagataacaaagccttgtctcctaggcattcattgcatttagtacttacttctagtaccacaatctctgtgttttatggattgtttgtgttcttcctacctgaaggttaactctgaggacgaggactgtgttgtcatcttaatagtcccaagcctaccacagagcttagcatctcatctgtgcttattaaatattgtttgaattaattaaccaggaggacttagtaaataagaacaaaatgtcccttctaggaattactttatttcagtcataagctatagttcacaggttgggaaactctagcccgccagccaaaaccagcctgctgtttttgtaaataaagttttattggcatatggccacactcgctgatttataaattatctgtggctgctttcatcccaccaagccagagttgagtagttgtaacagagatcacatggctcacaaagcctgatatattttctatgtggtctttacagaaaaagattgtcaaacccctactacagataattaagcccattggaggtcacatctttgattgcttttaaagaataggtatgtaattctgttttgacacttcaaataacagtcagctcccgtaggtacctaagcttgatatctaaaatttataaactcatctggggactttctatctgggagaaaataataataaaaaaaattccccaatagtgttccttgtagttctctaagcttagagggtgtgagtgaggggtacacccaaggcctgagtccccaaccataatgtctatatgtcctattttttcttagtctggttataccaaaaacataaaagaaagaaaaaattcaaaatacactggccccagaagaattttcttctgttcactgaatgtgactgcagcctcctcactttgactagatttgctcactcactcctctccccacatcccctcctgcatcaccctccctgagctcctcctgggttcctgctagtcttcatcattatccactggatataattcatacatgtcaaggcaaagaaactaaaagccataacttctttaacacttgctcaaattttgccttctcagtgaggtctttcctggctgctgtctctaaaactgcaaattcctttcttctacttccccttctttgcctttttctccttcctagcagttatcattatttcacacaccattccttttacttaccccgttcattttctgcccctaccagagtataatatattcatgtattaaatgagtgaatgaaatcccagataaagagggaaaatatcaaagaattaacatcatgccattcacttttggaatgaatacactagacaggaatttgtcaccagtgtgaaacaaagtgctatggcactttgttgctgggaccagtctttctgtctcccttctttaaggtgagtgacttcttttttatgtttttaagacagagttttgctcttgttgcccaggctggaatgcagtggtgtgatcttggctcactgcaacctccccctcccaggttcaagcgattctcctgcctcggcctcccaagtagctgggactacaggcatgcgccaccatgcctggctaattttgtatttttagtagagacgggcttttgccatgttggccaggctggtcttgaactcctgacctcaggtgatccacccacctcagcctcccaaagtgctgggattacaggtgtgagccaccacgtccaggcgagtgacttctttaagatggtgaagtcttatgggattctgttaagtgttccatttattgcaatgagtccctgcgtgggccagtacctctccttccctgatagaacttttctttcttgatcattgagcaacagtagctgcctcctcaaatctgttgcagcatgcctgatacatgagattcacaagaagtctttagtaaggagacactgggtttcagaggattgtaaagtactttttctttggacgtcactttcttactgtctgcattgagggtggagccatttaccctcagtggcctgcaagggtgtgcatgtgtacacatgagtacacttttaggattgtggaaatctttgctttgactctttgatgtggagtattttagcatcaaatgtctctataaatactgaacatcttcctgttgatcataactctaagcttattgtgttcacaataactcatgagagtgctacaaatagaacctcagtggttacaatattagcatagagtttaaagccctacattcttagcttgagtccttattccaaatcttataagttttatgatttggggagaattacttaacctcctcaagactcagtttcatcatctatattatattggtatatgttactatactattcatataatatgtcataagtataaactttactattataatatattctcatatattatactagattatattattaaattttacatgagataggtaaaaaatgttaaccacttcataaggttgttggagggattaactaaaaagcccttgactatggttaacagtaatatatgatctcaaatagctagaaggaggatattgaatgttagcaaccaaagaaataataagtgtttgagattagttactaattattagaaatatatatctaataaccatatgtatagaaatatcaccatgtgccccatgaatatgtacgatttttatttgccaattttaaaaaatgcccttggtgcagccgctggcacatggtaggctctccatacacactcatccccctatatctgatgtgtgtgatggcaattagcagcagcacagtgtttcacaaaagttagaagttcccatgtgttcccataaaaaggaggaagtaggaccctcacagtatctttctacatagtttcctcaggcctatatgcataatgagataagatcatgtgacccagcagatacttgagattttgacatttgcaactaactgagaaaatccacagtgaactaaaagaggatttgactttgggaattgagacccaattttggaacacaaaggtggtttgcttgactttattactaagagaggatgagatttgtgagaggtaagtgaactctgtaactcttgattttttttttttttttttttttggcctacagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaaggtaaggcctcttctgcctttctgccggggaacactgcaagtcaaatattggctctgccaaagccgtgagctgtgaactcttctcacacctaatattcacacaggaaggaaactacagcttcttggttgttggctggcattagtgtccatttgaaggacatgttcaagagggacaatttgcatgtcaggtaatacatttatttaaagggaaggtcaacttggagcattacaaaggaaagctgtgtgtatatcaacagtctatatggattctgaacaaccaattaaaaataattttcaggaaggtcatcttaaagggtcagaagaaaagctgtgtctatctcagtttggtttcaaaataacccatttgaaaagaatgccttaacactctgttaaacttgtcgtttgaccctatgccaactcagaatcagggattttaccgaacctaactcctttttagccagtttttcagctggtgtgttgtatgttgcactggagccagtgcacacctgattggctgatgtttgttttttaaacagatcctgattccagtaaagatgagacacatgtacttgaattccttgaatccataaaactttgtctctgtatgtttactgttgtctataaaggcactttttttttttttttgagatggagtctcgctctgttgccaggctggagtgcagtggcacaacctcagctcactgcaacctccacctcctgggttcaagtgattctcctacctcagcctcccaagtagctgggattataggtgcacaccaccacgcccagctaatttttgtgtttatagtagagacaaggtttcaccatgttggccaggatagcctcaatcccttgaccttgtgatctgcctgcctcagcctcccaaagtgctgtgctgggattacaggcgtgagccactgcacctggcctataaaggcactttttaatttgtattagtatgtagcagacagctactttgaggcagaatgaaaaactatgatgttatacacataaagtaaatctgccatgaaaagcaacattgggcagggtgcctgaaacttaaaggaaagcagaagagggataggaagcttctagaaactagaacatttccacggaggattttggtatctgcaaaacttctcttctactttgttttcttttggaggaggtcgaggggatgcttcatgaatatttattcataaatagttcatatatatatacacaacatatgtgcatatatatgtatacacatatacacacaaataggtggttctcaagcagggttgattttgctccccatgccctggggacatctggcaatgtctggatatacttttggtttttgcagcttaggggatggatgctcctagcatctagtgggtaaaggctgaggatgctgaccaacaccctataataaataggacagccccctgcaacaaaaattatcaggccccatgtgctgaagttgacctaccttgctgtacacacatacattcacattctgtcacccacagtgccagtggtgcagttctcttggctcagctgtggctaacagaaagaatgctggcttggaggtctaaagactaggacttgtgaactcatcctgtcactcctcacacctgtgagcttgggcgacttgcctctgcggtaggaggctcagttctttgaccagaaagagtagcacaaaaacactgaccagagtttttctttggatagtgagtcttagggccacgttttttcttgaagcagaacctgagactccattggaggttatgacagagttcagaagagagagatagacaaggccaatgggctgacaagacatgcatatttcactggcatatgccttgcacctttggctttcttgtcacggtttgttcactaccacaaccacagcatgttgtttccaagaggaaatccccaccctgttttattttttcatgctaatctcacacatagagaccctcagctcaaataagaagaaaatcacttaggcaattgtgaaaaatgaatactagtgactgtcaggccgtgtcgctcttatccttgagaaacgccctcctgccttacctggtattggtttggttgtagggtggagatgaggcctgttctccctccaacataactcacaaagtggcccatgtggggcccgggccaagagttttgtctccctttaataagcacagacattcttttcattcctaaggaaaaaaaaatggcaatattgttagcaaacttaatttgtagtgaagagaatgatgactttgaaaagtttttgaaacttggtttgaatgcacatcagataagatatcagggaacagatactctctgtggctttgtttttaaatccagttgatttttttctttgttcctgcttgttaaagagtccactaaacaaataacctttaccaaaaacaattttataaaacttgtctactagaggctctgtctccattaattatttctgaggctgtgtggttatccgcacatccagagaaagatttgtgctatcgaaatgtttgaagatattcccaggccacagcagttattttcatattttctgtcaaaataggaactaatgatttacaaataattttctcatttatagaggagagagggaattgtgtggctggtgaaagaaacaggcatcgcatgagggtttctgaagctactgaattgggcatatgaatatagacatcaaatatttactgagatccttggaatgtgtggctggtggcaagctctatgacagtagctttggtctaaatgtggccacttgatccccatgcaaaccttcaaatggaggttctcaacagggtcagattcactgtgtgaataattttcacaggaaaataaatactgtagccaggacctaaagcctaaagaaatgatgccaaacctaataggatataatgaaaatcatgatacaatgaaaatggacacatagtcaagctcacatttctgttctctgtcacattaggatgatcatagggatttatttgtggttatctatttgtagaaccctctcctgtgagtctggtgcttccagggttcaaatgaatgctattataacatgatcatcagctgccagaatttaccatagagaggaaagaattgaggatgggggagttgggaaattactgggtgatttcctagagtagaccacaagggtgggatccagagcacaagtggagggtttgaccttcttttacactataatgatagatgggcattagttatatggacactgatgcaagtgagttagaagatggtgggagggcacgtgggattttactccagattgcgtctcagcgtccaacaaaataggaagcaatttaatccactaggcgtgaggatggcgaagaggtcctggaggtttgaggaaagaggagaggagtggaagagagggcagctaacgggccagcaatgtcacaggattgcaggacaggccaaaaggtccgtttgaggttagtagctgggaattttaaatgaaaaataaacatcctggtatctaaacactgttaagctaaatacaccatatcggacttttaattccccagccttagttaatccaaatatcctcttttgagttaggacttttctagttcaattcaatgaaggtgaagagggacatggcagttgagaatatatctgtagtaggcaaaataatggacccccaatgatggccacatccacatccctggaacttgtgaatataatacctcacaggccaaaaggaactttgcaaacgtgatgagttaaggtccttgagatagggagattatcctggattgtctaggtgggctcaaactaatcacatgggtactttaaagtgcagaaattctcccagctgtaatcagggagatatgtgactatggaagcatggtcagagagatgcaatgttgccggcttcaaagatggagaaaggggccatgagccaaggaatgcagatggcctctacaagctagaaaagtcaaagggacaaattcttcccaaggggcctccagaaaggaacaaagctctgctgacacctcaattttagcccagcgagacccatttcagatttctggcctccagaactgtaagatgataaatttgagttgtttaagacactaagtctcttgtcattagttatagcagcactaggaagctaatacagtatccaaaggaatgattctaatcccacaacacagagtctcaactggataagaaaggaaattaggaagtaattcaataatataaagctgtaaattttgtcattaattatctataagctgaatgtgattccaaaataaagtaccaacagaatttttctttttgatgattttactaaattaatctaaacatcatctgggaaaataattaagtgaaggtagtcaggggaaatctgataaagagataaaatggagattaaccctgtccatttattaaaatgtgtcacaaaactgaagaattaaaaatgaaccaaaatacatatgaaaatttattacgtgataaatacggtatttttgtaaagggaaaaagatgggttattattgtatttgagataatgagacaatcatcattaagaaaataataaattgatatggaagaaagatttaaagattaaaaaatgaaactataaatgatgcaccagcagaaaacataggtagatatatatttttttacactagggaaggcctacccagaaaacataaacaaagagaggaacaagtttcactacattttaaaaaaatagaattatctctgacagataagcaaataactaaactttatagcacatttgacaaactaaaggctaacttctctattgcataaaactttattacaaattaatataaaaagaaaatctaaaatatagacaaattacaggtggctcacagaaaaatacaagtggtataaatagatttgaaaagatgctctccctcacattcattaaagaaatgcaacctaaacaccaaggagattttttttttctctcagagtggcatggctccaaaagttggatgatacacttcgtggggaaacaaacactctcatacactgttggtagaggtgtaaattgttgcaacagggtgcaaggcaatttggcaacatttgtctaaattgtatttatttatttattatttccatggttttttaggaacaggtggtatttggttacacgaataagttctttagtggtgatctgtgagattttggtgcagccatcacccaagcagtatacactgaacacaattcatagttttttatccctcacccctttcccaccctttctccctgagtccctgaagtctattgtgtcattcttatgcctttgcatcctcatagcttagctcccacctattagtgagaacatacaatgtctagttttccattcctgagttacttcacttagaataatagtctccaatcccatccaggtcgctgttaatgccattaattcattccttcttatggctgagtagtattccatcatacttatatatataccacagtttctttatccactcattgagtgatgggcatttgggttggttccacatttttgcagttgcgaattgtgtggctgtaaacatgtgtgtgcaagtatcttttctgtataatgacttcttttcctctgagtaaatgcccagtagcgagattactgggtcaaatggaagttctacttttagttctttaaggactctccaccctgttttctatagcagctgtactagtttacattcccaccagcagtgtagaagtgttccctgttcaccgcatccacaccaacatctattattttttgattttttgattatggccattcttgcaggagtaaggtggtatcacattgtgattttgatttgcatttccctgatcattagtgatgttgagcattttttatatgtttgttgtccatttgtatatctgcttttgagaattttctattcgtgtccttagcccactttttgatgggattgtttgtttttttcttgctaatgtgtttgagtttgttgtagattctgtatattcgtactttgtcaattgtatagattgtgaagattttgtcccactctgtgggttgtctgtttattctgctgacttttccttttggtgtgcaaaagctctttggtttaattaagtcccagctatttatctttctttttattgcatttgcttttgggttcttgcatttttctaaattttaaatggcccaaccattctacttctaagactgtatctcacagatacatacttgtatttgttggggtaggctaaccactcagtgccttaacaccactacaaaagtatatttcttactgaagcactatctaatgcaggttggcaatggggtgagaagggcaaactctcttccaggccgttattcagggacccaggcttcttgcatcttgtggctcctccctcctgtatatccatttagcctggagatgtacacactgaataactaataagataaaatagctgatgagcttaatttgttaccccttctaaacttaacatggttcaaaaagagacttttgaaaatgcttttgagaatctggagacatttttagtggttgaaatcaggaaccaatcattttccctgtgagcccaaaattactccatggaggcaagcatggactatctgattattcaaatggctactcttggcataggctcttggatcagactatctagtttgtaaatggccaactcttagtcacagaaccaggaaacaaatgtaaaaaatagtcaagaaattaagcaaaacctaatggtctacacaaacttttcacttatttaaaacacatccaaagagcactttttgtatatcaagtagtatgttaggtccaattaatattattttggtaacattttaatacaaatggtcaaaatcaggggttagcaactgaaccatggccaaaccaagcttaccatctgtctttgtaaataaagtcttactgaaacacagccatgctcattcatttacaattcgtctatgcctgttttcactcaatgtcagagttgagtagttgtgacattgtctcagaagtttactatctggccctttacaggaaaaatttgctgatgcctgatctaaggtaaaatgaaagaaaataacttattcctgccacaatcactatagcacgttagtgtaggcattatggcttaaccttattatattgtaaaccaatatttacagttgaatggttctataagacagaaatgcatatttgtgttttctttagagctgttttcttcttgtatcagttcatttctgatatcacaattgagaaaggctttgtttatgcattttgaaaacagtatcatggaatgaggaatagctgatggtttaagaaaatatggagaagagtctcataaaagagtaccccaatgcctcaaaattgctcaattatatggcttccttataaaatgatccctcgccattatcccttaggcaatgtcaaatccaagtacacaactcaatgaaataaggaaaattacattcttgctaggccaacactgcagctgtcttcagtttgtgatttaaatgttgatttagaaaataaaagtaacctggtaggcaaggaaattgagattgggtgtttatataacaacccttgacagaaaaatttaactgtcctatttctgttattctttctggcaatgcccagttgaagaggtgatgtgctagaactgtctgccaaagccttttgtgtaagtaaaaataaggttgaaacctggtgcagaatccacaaaatccactgtaggtagaaatgccaatgggaagcaaacaccaccaaatagggatgatcacggaataatgagaccactgtgcccagaggccctcaacaaaggtctctattctgtgaactgtggagctgattgtaccttctgtgtgtccacaatcaccttttctgtgatcttcacacaaaggatggtgacttcccatggagtagggctacgtcttattggtctttgatctggaacatcatctgtactgcctaatacacaagtggccctcagcaaatctttgagatgtgaatggatgcgtgcaggcatattatttaataataagcttttaaattaagctctttctctcactcttccccatatctctaaagagcatcgatcacctttctcccactgtccccagtgtctccagtaatgattttaaaacaacctcaacacttccttactccttcacttcatgctcagtttccagctttcattgatggtctcatagggttgatgtgagatttaaatgaaataataaccataatgagcttaaatcacttcctgacatcttatatactctccataaaacttatccatcaccatcatcatcatcatcattgtcatttttgccatcaccatatcactttgtcctgtatctcccctcaaccctatgtcactgcatcattatgcttgattttaattatagtcatagaacccctacctactttcctcaattcagggcttctcctctattctatctaccacacgtaaaatcaccagagtgaaacttcaaccacagtggctactcctttgttggaaaaacaaaaagcaaacaaaaatcccaaggctccctattgtctactgatcttactatcaaagccattttatatgagatactatctatttcatataaaagaagaaatccatttagtttgcagcctgttctcagaatgcaccacagacttttatttgtttacttgtcttagaacagcaggttgcagattttttgtccacaacctatctgcagtgagaagtacattttacatctcagcccaggaaatgcatgaagccaaacagcttatctttatcagagatacatttggatattctttataatattctctcctatcctcttctatctgattctctttcattttcaaaatatgttttcatgatccactgaattttcttgatttattaataggttataaaccactattcaataacacagtcttggaaggtatatggaatagagaacagggaatcacaaaggaagcaacaaaaatatcagtatggaaaaattagttgatctttgctgtggctctcagggccttgataaggtggacgggaacttctttttccatagggccatggtgatgaacctaaggctagagccatacctgagtatcttatgccttctctctctagagccaaactgagggagtgacacccagagggcttcctacaaggcctcacagctctttcctcataataccaagggttatgcaacctgaaggagatacatatgtggggctttaaggtctagctgcgatagaggattcaacactatgtcaaaaggagttcctatcatcgagtagttcctagtcaatagacagagaaaacacagatgcatcaattatattaaaagatagagcagtggagatgatctgtccaagttgactttggtgaccctttagatagaagctgcctcatccacccactctggtaaaagccaagaatgacaaagacattatcctgcaggttattttgtaattttcttcttggatgctcttcctagcaccccagggtttttaccatgtaaagttctcaagtgtctgctgccactatatgatgctatgttggtgccaagcaggtgtgggattctttaagccatgtgctttgtaccatggtattcacaaattacttcctttatgttctcagacaatatcgttttctatccaaggtcttgtctcaactggtcatatttatacatattcgtatgtcttgttggagcagcaaccactattgcacaagactttggcatcttgaccaaaacttctgtcactgcagtttctgaaatattctggcacctttcaaagatttcaagactgcactatattctcttttgggatcatagcccaaaataaacttgataattatgaagaatatcccatccttcaaacatgaacattttgccttttttcttggtttccccatgggcaaaataaaagcaaatacgtatacgttgaaatttaatgctgagtgtattttttaaccaatcagcctttttaggtcatttggaatcaagccctcaagattacttaaaaattcaactagtgggtgttactagagctttacatatggaaagctctggaagagtagtttaacaggttttcacttaagatagatgtgggcaaactaagctcatgggccatagccagtccattgcctgtttttatatttttattaaaacccagccatgtccatttctttctgtattgcctgtgactgctttagtgctacagtggcagagttgagtagttttgacagagaccttatggcccacaagatcaaaagtatttattctctggatctttacagaaaaaaagcttgccaacccctaatttgaaattaatattatagtaattcattgttattttttatgcagttgttcaactatactattcctgttcatttcaatttcttcattattttaatttcatgatgtagtaattgtgtgctttttaaggatcagacctttgttattcttagatgttttagtgcttatattacagtcatgcattgcttaatgacagattcatactgagaaatgcatcattagatgattttgacagtgtgcaaaacttaatagagtatacttacacaaacctagatggcatagcctactacacacctaggcgatatggtagagcctactgctcctaggctataaacctatacagcatgttcctgtactgaacactgtaggtaattggaatgcaatggtaggtatctatgtatctaaacatagaaaaggcatagtagaaatattgcataaaagataaaaaatagtatagctgtatgaagcacctccattataatcttttcagaccactgtcttatatatggcctgttgaccaaagcattgttatgtggcacatgactgcatatgtgaccaaatattttttcaaggtgagatgagttcctttggtggcattaagcaaaaaataaaagtcaatatttttatgactggtttaaacaactgatgccaccatgcagtctatagacacatgagttatgcattaaatgggtaactttaataagtcaatcttcattacaagttattactttcactattactatcttgtttgatgactgagaagttagcaatattcccttctcatgtcctagaattgcaacacctgccagtgcccaaatcaatactgggaagtagaaataaatcactgggattggcttgaactaagggttcatttcccgagtttggggtgataactcatcccaggatgagttgcatggaggatgagcaactgacaaaatggagcaaggaagaattgcagtgagtaggtggaggggagcaggatagagatggatttagattaaaaactactggtatacggaagaacattgtcatcttctgccattgcagacaagtgatagagaggaaaccattcttattttatttgctttagcgtctagcacagtgccttatacatacctacagcacaataaatatttgaaaaattaaatgagatacattaaaaattcaatcatagcacatttatgtatatagtgtttccatagcatatggaattgttttgaatggctcaaaggataatcaaaaacatggaatggataagaaaaggataggtagtataatagtttcatttaattgcatcatcttttcaggtactgaatcagagagagctgttttcatgggagcaactggcaggaaattctaggcatttccaagactttaacaagtaatgataagactcccaaaatttgggttttaattttcttgagttaaccacctagaatatttattagggaaaaatgatttttgtatttttgttctcctgcctacttcctttcatttacactccaggaatgaaatgtagcttaaaaaaatgacttggcaaaagccattttccctgccccgatatttggaaactcctgtctctacaaatacagtgcctacctagactaaactaaaagtattgtcctccatttaaggactgttcaatgaaagatacaaattcaggagcctggaaggacatactagctcctagatcatgaaaagtcagcagcagagctgcccctttgagacatgtgctgaaagctttgaaaaaaaaatcttctttaaaaaaaatcatataacttgactgtggaaaaatgaaagcaagtaaaagatccttctagggcataatttgatcattagcagttcttacagcaagcagtgattacaaagaacacctagttaaggaaaaaccatagttgagcctttaaagctatggcatctaaaccatgagatcagcttccctacctcatgttttgacggaacaaggagacgtgttcaacaaatcaaatatcttaatgatttttctgtaatagaaaaccacttgctttgaggttcgaggatccagaagttttttttctcctcttgaagatgatatagaaaaattttagaactaatcaccctgccagaataatttacacaaaacagaataggtttcttcttagtgtttaactgaaggcatggtgacctccaagagtcgactttctctacagcagtgagagactcacagaatgttcttattttctgaccacacctttgataatttcaccaccacttcaacatgtaaactgtggggattagtacatttcacaagtactttggggagcctcagccctaaggagaggcatcgctattgcttaagaataccataaaacattttcttctccagggaaacatagacactttggaaagagattttggaaatcctagcccacaaagtgctagcaggaaaaagaaagtgtttaattcactgggacttataccaacaaaagtgaaccaatcaccctgttcctatctgcctttgtctatttcaattaaagttagtggaagaactgttaagtataagttaataagcaaaaactttgataacatgagtttggttaaataaccaacaatctagggtatgaaagatttcttgaagatgacacacgcgcacacacacacacacacacacacacacacacacacacacacacgtatccagcattgcctgaatgatgggaccagtttgggcttgaatacgttttccattattttccatatagattgttttcttccacaattattattttcccctctcttgaaccctggttcccacttaagaaactagcaatccactcctgaatttgcaattttctcatctttttcaccaatagaatgcttagttggtaaagggttggattataaggaatcaaacattaaaagggatagggtaatcagaaaggaaggatgtcctaaactaagctggtggaaacccccaccaaaattcaaagaccccagagagggataacttcatcccttaaggttgaactcaaacattagcctttgcaagcagaactggaagcagtcttctctcttttgtcctggcacctagtaaatgtcttctcctcactgaagcatttcttcatattgcttttttttttttttttgtcgcccaggctggagtgcagtgacactactctgtcgctccggctggagtgcagtgacacgatcatagctcactgcagcctcaacctcccaaggctcaggcgatccccctgcctcagccccccaccccaccccaccccacccagtagctgggactacaggcacgtgccaccatgcccagctaatttttgtatttttagtacagacaggatttcagcacgttgcccaggatggtctcaaacttcttagctcaagggatccacctgcctcggtgtcccaaagtgctgggattacagatacgagccaccatgcccggcctcattttgctttaattaggtttccacatgtctatctctagcactgaattttgaatttttcaaaggcagagatagcattcattcatctgggttcatagcacctagctcagaatctcacctattgatcaatcaaagggtggatgggtggatggatagatcagtgtatggaagatgacatttaaacagataactattatattgtaaataatattcccaagccaagaatagtcatcatgttctatggtacaacatccctgggcagagaatacttgcttaagaatagggaagagatccctgttttggctcccttcctaaatctctgggattcatcccaggttaactcttaaaccagagcattgcattggtcccactgttttccctttcctggtcccactggtttcgctttcctagattactattcctcttttctatcagagctgctatccattccatttcttgggatagactttgaatatgaagcaggcaactcaaagtagaaggagcaattttgaattcattccactcggggtggcaatggcagtaagtggatcctttgtccagcctgacttgtcctcaggtaacacctgttttcctatgtaaacttactgggccaatttaacttatgttgctgggattaatcattagaaagcaccaaacatggagtacaggcacaatgaatggctcccaagtgccaggggtcattaataatattgttacttctttaacaaacctcctgttccaaactggaaataaaatatctggttcagtctttctcttgccttattttttgggaggtctgtggcttgaaagccacaaagaaaagccctcaaagtgagaaataatgagatgaaataatgaattttagttttaataaaggacaaaatatggtattactaaacctttttacaggatatccacagatcatataactcaattcacatttatatgtacatatatatgtaaagagatgttatattttattttaaaaacaatattttggtttacagaataggcattggagcttaaaaatagatttctgtactaatcaaataatcggtgttcatgaatgcaaatgaaaaatactgtctggataacttaagcagaaaaaggatttagagaacctaagatttagaatcttacaacaacctaataagccacctatgaaaaaatcaccagccccataaaaacaaatctggtccatcttgttagctgtccactccctttccagcaaacaggctccaccagaatggcaaacataatagatgtttcatgtcagcttaggcacatgttttctttcagatcaaggagatgcaaataggagattatttcactagtttcagcctggcttgtgagtcacctcccttcttgtcactaaactgagctttcagttctgtggagcacttcagtgagcaatacaggcctccattttctcacatgcttgataagtgagtttccaacctttgcttgaatacatctggtgcctgggagaaaggacttatttttttttaattttggaataattttagaattacagagagttatgaagatagtatagagttcccttatgccccttacccagtttgccctgttaacataataacataacctcaatgctattatggtaacattaataccataaatgtattaccttggtacatttatcacagctaagaaaccaacattggtgcattgctatcaacaaaactatagacttcactcagatttcaccagtttccacactaatgttatttgtctcttccagaatcctattcaggataccacattgcatttaactgggcatcttttcttatctttttatttttatttttcaaataacaaacatttatcttgtaaaacagcttctgtgaatagcttagcttgggtgttctggttcaggggctcctgtgaagttgcagccaagcaaagatggggctgcagtcatcttagggcttgattggggctggaggagcagttcccaggctcactagtatagctttcagctggagacttaccccttagctttttgcatagggctgctcctgacctggtttctcacaaagtggaggggtgcaagacagaatacaaccaaatggaagccacaatgaatgatgctttgttttgaggcagctcattccactggttccatttgctggctagactgtcttcctatgatatcttcctgaattttcattctggcccatggagggctggccagtaagtctcttcatccaccatgtttagtcctctaaataaaaggaaagaaccacaatgtctcctgagtcttctctaaatgctaaacatccattcatacaactgttgactatcagagggtgttccatacctgatcctgccccacccaaggagaaaaaaacagttcatataaagaaatacaaggctatttcctcaagaaacttggcttattcccccatctgtagtcctagaaatttggtagaaagataattatatgcagactcccatttcttcgtaaattaaagaaaattgctattgtgtcccaaagtcagtgtgatacataaaggcttcataatttgtaaacacttttacattgttctgtttaaaacagaaactgagataaagtataacttgagcattgtgacaagtgggaaaatgtgaatgttttgttcacatttacatgatttgggttcatagctgctctctaagttgagttatacatagaccagtggttctcaactggagtaagtttagtccctggaggacatttggtgatgtccagagacatcgtgtgtggtcacaacagtggtggggtgctctggcatctagtagataaaggccagggaatgctgctaaacatcctacgaagcacaggactattctccactgaaaagttatctggccccaaatatcgctagtgcctaggctgagaaatcctggcacagattatatgcagtttctaaagggccacttccctactctgccacccaagtgtatctttttaaatcattttcccctcactttttcattgagctctcctcattgcctatgaatttcattggtttgctttctccgagagtcaattttattggtccaaatacatagtaaggcagctgtggctaatgaaacaggagatggtgccaaaaagcattccttcagtcttttctcagcaggatttttttcaaagctttgaataagctaggaccttccttttaggctagggtaggttcacaaactctgaggcataccaggtaatgtaagtgggtacagtggcccagggttgggtgcctatgctgccttggggcacatgtgaggaatgtgggacccagtgttgccagctcttccactttcctcaagaggctggaactctagatatgtatgtgaactttccaagattttgcattaggacttaactttttataaaactttgtgtgggctaaaaaccacctgaatagtaggggactggatatggccattttgcacccatgaggctggaaatttgcctgtgtgtgtagcagcaccagaggaggtctttgtccccagcagacatttagattcttttccaccctcatgtcatatttcagtgcaggtgatttcctttcctttccagtaatgtaatctttattgagctctgcaagtgaagaaatttaaaagggcttaaacattgatgccatatcccacattcaggtgcacctgtgaattgaggctgtttacactcattccccatgattgcctggatgagaaatgagccttagcgcttcttgcccatcatccagacttctgggagggcagagtctaaatgcattgcacaaatggatgtccgctgttttacaaacacctcctggataggagagccctgaaccatctctcatgttgcaaaggcaaagtgaccttaaagaaggacttccagcttctcctcataggcatctgggttctgctcttagccacacctctcaagacagaactgcgcttattggaaagaacttgaatttggcattgaatgtcagccctgccacctaccagttctgtgattttgagagaatttgcgttaattctctgattttcagttctctcaattgtaaaatgaataaatcaaaatgctatcccaatggatcgtgtgttgacacgtattaggtatatgatataaatatttcatatcattaaaaaaaagtacttcttccagtgccagtgcatatttagagcttggaaattgttagtttttcattcccctccctctctaactctatgttaccttgggcatgccagttcatgtatctggctcttactgtcacatccctgaaataggcaccacatttcctccactacagcgtaaggtagaggttagagcatgatatggtttggctgtgtccttacccaaatctcatcttgaattgtagttatgggaatataatacccatgtgtggtgggagggacccagtgggaggtaattgaatcatggggactgttacccccatgctgttctcgtaatagtgagttcgcacacgagctgatggttttataaggggcatcccccacttcgctctgcaattctccttgctgctgccatgtgaagaatgacatgtttgcttccccttccacaatgattgtaagtttcctgaggcctccccagccctgcgaaactgagtcaattaaacctctttcatttataaattacccagtctcagttatgtccttatagcagggtgagaatgcactaatacaataaattgataccagtagagttgggtgctgctataaggatacccgaaaatgcggaagcaactttggaactgagtaataggcaaaggttggagccatttggagggctcagaagaagacaggaaaatctgggaaagtttggaacttcctagagacagagggctcagaaactttgaaacttagaaagtttgaaagtttgaaacttcctagagacttgttgaatggctttgaccaaaatgctgataatgatatggacagtgaagttaggctgaggtggtcttagatggagatgaggaatttgttgggaactgaaataaagttgactcttgctgtgctttagcaaacagactggtagcattttgcccctgccctagagatctgtgggactttgaacttgagaaagatgatttagggtatctggtggaagaaacttctaagcagcaaaaccttcaagaggaagcaaagcataagagtttcgaaaatttgcagcctgatgatgcaatagaaaagaaaaacccattttctggggagaaattcaagctggctgcagaaatttgcataagtaacaaggagccaaatgctaaccaccaagacaatggggaaaatgtctccagggcatgtcagagacctgcacggcagcccctcccatcacaggcccaaaggcctaggagggaaaaatggtttcctgggcctggcccagggccccccggctctatgcagccttaggacatggtgccctgagttccagctgcttcagctccagctgtggctacaaggggccaaggtatagctcaggctgttgcttggtgcaagccccaagccttggcagcttacatgtggtgttggtcccgtgggtacacagaagtcaagaattgcagtttgggaacctccacctagattttagagaatgtatggaaacacctggatgtccaggcagaagtctgctgcaggggcatagccctcatggaaacctctgctagggcagtgtggaagggaaatgtggggttgaagtccccacagagagtccccactggggcactgtctagaggagctgtgagaagagggccacagtcctccagaccccagatgtcatctatatagcaggaatcatacaggctgcagcctcttcagattggcttctttcacttagcaatatgtatttcaagttcctcttgatcattttgtggcttgctagatcatttcttataatttctgaatagtattccattgtatgaatgtaccataatttatttatgcactcacccattgaaggatatattagttgcttccaaatttttgcaatgatagataaagctggttaaacactggcatacaagtttttgtgtggacgtaagttttcagttcatttgggtagttaccaaggagtgcaactgttagattgtatggctcagctatgtttagttttgtaagactatgcttagtttttgcaacatttggcaaccctattctcaatgagttgcacctcttttgaagaggtaaagaacaagcatatacttcaatgagaaaagccataaaggacatctgaaagtcatgttcattcattcatacattcattcattcacttgatatttgagcacagtcatgtgctagaccctggaaatacaaacaaacattggcaatggaaaaaatgcatgctgtaaaacaaagcaaagcagcataacaagggcagtaggaaaggctccaaatatgcaagtgacagaacaaagatggagaaattttccctgcagcagtttcaagagaggctcagagaggtatgaactagtgaagtaacacattttttacccttctcctacactgggtctgaggacacagctatcgtgaaacaggtgaccccacgcaggatcctacagaaaaacaactaaatcacgtttgtgaaactcagaactacaagctcttcctcatgatttggacaatagatgctttcaaagagtggttatttttcctatattttccttcccttctcttaatggagaattccttcttccaccctgaaaaggaaatacgaccatcagtttcccaaataaaaagagggaaatacatatgtgtataaacggtggtgaccacctagtagaattttaagcctttgtttaaggatattttccccctaaggactgcaatttcctaagttgagtcaacattcagaacttcagttaccattgtcctatgtgagatttgtgtgtcttgtatccaatgtactagttaggtatttctttataggctttttaagatttacaggtgtacctgatcaaaaatagctggaaagatctgagatggtttttactggataatttattccatgtgtacccaacagccaagcacttggcaaatgaccaaaaaatatgattttaaaagccagaatagctcatgcaagaaataagtagctgagagataaagaaaaaatggcaacgttatgctttaatggcaatgtaaactatctagaagggacatttatcagttcaacaagaattaattttcttcactctcaactcctatgaacaagccttctccttctaaaaggtaggaatgtctgccccagtaattaattgtttatgggtaactagtacatcacgaaaatctctataagacatctttctctggcacatattttatctttatactagatggaagataacaaccaagtgagctgtttgttgaatagggcacacttcaaagccaggtatggatatctgatttaatgcgcattagcaggacatcagtgcaattgttgtgtgagtactgaggcaagtaggcaaatggcggggtgaacttcactccttaaaatagtgagctaaacagacgtgaactacctaagttgtttgaatttgttccacatgctcttttaaaatgatataagacaaaagagatttaactggttaattagtgaaaatctagtaacaaaaaatgtctggttaattcatggaaaatgggaactttgaataaatttcaagataacgtttgaattaggccaataaagttaattcttgtgtttgcataaacacaaagattggagaattgctgtgtattcaccatttactctttcaaatgaccattactttatttagtacgtgtgtattgtgcacctcctgtatggctgggaacataccagtttccaaaaataaaattaggactatgataaagtttttacactctagggtaacagttcagtaaataacagccacaatacagggtttgagaggtacagaaccactaaaagagaggaaagggggcacaattttgtttgagaactaacagggtccagaaaaggtgaagaactaggtggtctttgacacaagtcttaaaagagtaagtaggcacttgccacacatagaggaaagaaagtgtagcagacaaatagaccagtcatgattattaactatcaactagttcatcttttttattttttatttttttgttcctttttgagatggagtctccctctgtcgcccaggctggagtgcagtggcatgatcttggctcactgtaacctctacctcctgggttcaagcgattctcctgcctcagcctccctgagtcactgggactacaggcacacgccaccaagcccagctaattttttttttttgtgtgtatttttagtagagatgaggtttcaccatgttggccaggctggtctcgaactcttggcctcaggtgatctgccggcctcagcctcccaaagtgctgggattacaggtgtaagccaccacacccggcctgtctttaccatttacttgcttttcattcctggacaacactgatctcagggaggtagtgagtagaacggtggttaccagagggtggaaacagtagcagggttgacggggataaagaaatgctggacaatggatacaaacatacagttagagagaagaaataagttctagggttcaatagcacactcgaataactgtagttatcatgtatttcaaaatacctagaagacatttgcgatgttctcaacacaaaaaattgataaaagtttgaggtgatgaatatcccaactactctgatttgatctttacatattcatgaatcaaaatatcacatttactccatacatatttacaactattatatatcaataaaaatcatgaagatattggtaactaatagctaacatttattcaacatgtaccatatgtctaaccttctcaccatcattgtttcctgtgacacagtaaccctctgacacagataccatcatcactgttttacaaataaataagaaaaattatttcaatgtgctttgggtgagcagcactgagagagccctgattcacctggataagaatgcaatgtgcggcctggctcaatttgacatctcagagcttttgtactctgagtgcaataaatcaggtgtatgcacagaaatcagggcagacttaagctcctcctaaggagtgagtcaagtattttgtgatttgactggatcaccttaatttagatatcttcacaaagatataagcctaggactccaagatgaaattttaacatcagggaaatgagatggtcctttccctctgctatcaggagaaaccctctccaagaggcagggaggcaaaagactgtttctcttcagtttcagttgctgaaataaaggacttgccactggtctgtgggcaaaatttcttgggcactgtctttgcatatgacctctgaattttgttcagtacatcactgctctaaggatatatttagtgcttttactttgcattttaacattcagctgctgagtgagacaatattaggagacatgatgctcttgatatcagccattcttcaaagcgggtgtttattatggaataaaagaaaatacgtgcttcagtctagaatttaaaagcactaactgcaatttttcaagcatatgtatgtaaattaaagttacctgtcttaccattttcttgagaaaagtgtatctttacgtttgttttagtgcgacttgtttctgatatcctaacctaaaatttcatggtcacaaatatataaattaaacgttatcttaatgaaaaaataaaacaggggctatagcacaagagatgtgaggaaaatagtcacacacacacaaaaagtaaccaagagtgaaccctgaagtaatctatggacttggggtgataatgatgtgtcaatgtaatttcatggagtgcaacaaaggcaccactctggtggggtacatggatagtggggaatgctatggtggcagaacagggggtaaatgagaaatctctagaccttcagatcaatttgttgtgaactaaaaacaattctaaaaaacaaagtcatatatatgtgtgtgtgtgtgcatatattcacatatacgtatatgcatatatatatgcatattatctatatacatacatgtatatgcatatatacatacacacacacacatatatacgtatatacacacatttatacacacacacacacacacacacacacacactcctaataacttttaaggtcaaaaactttcttcccttcagaatatctgccagagtgacttcaagtacacagttactcatttgaggtactaaggggtgacataaatatcaacttttggccgggcgcggtggctcatgcctgtaatcccagcactttgggacgccaaggcaggcagatcacgaggtcaagagattgagaccatcctggccaacatgctgaaaccccgtctctactaaaaatacaaaaattagctgggtgtggtggcgtgtgcctgtagtcccagctactcgggaggctgagggaggagaatcgcttgaactcgggagacagaggttgcagtgagccaagatcatgccactgcactccagcctggtgacagagtgagaaagactccttctcaaaaagaataaaaataaaaataaatcaactgttccatcactaaataccttgtggtgtctttctcatccttccactgtagaatagtcagatagcccagtatgtataatagaactctcacatggacctctgcagtgcttattttgcctctgtaactactgaaagagatctcaaataaggatcttcttagaaacttgaagtagtacttagacttacacatcaacacatgctttgggtaaaaggaaaatcctttatgaaaatgcaagctttaagaattaaatgctccccataaggattcacttattcctgtataagtgactgtaggcagaaaaacagaatctgaatgaactttttttttctttaacttggaaaaccttgaaaagataagagtggtatataggggccaattaaaatgaaaagaacaagggaaaatgagagtaagtctctcctctcctcccaatgagggtattgtgttctgaacaattcatgaatggaatttcagaaactcagcaaaagaatacatttaactgacttattccaaatatattctgaatttcatatttactaaagtgtttccaaatgaacattttgtatgttatgtgcaaaaactgcacattaaaaaggaaaggtaagagagttcatcatacaagattttagatgcatgcatacttaaactaacttccacatactccacaaatactaaacttaaaaaacaaagcaccctacataatttaccttgccatagatgtgaagtaattgttaagcatacataaatgttaataaaatactttgaatcaatgctgaggggtggtatcattgaatggtggaccaaaacaaactaaatggcattttgatgtctttggaaatgacatacccacaagccaatggctcagcactgacatttatatatcctgctcagttgtctcaatcatttatagtagtttaatttttttcaagaacacagatgttaaggtaagtttaataattttgaaaggccatagagtatatctattttttgaagtcatactttcattggaattgtctctttaacctaatgaataaatacaaagaatgcacagataaaataagttttgtcttcttttattagagaaaaatgtactgttccatgcctgtgctttctacagttttggaacggatacagatccacagaggccaaacctaaaactaaattatctttaatgttaaaatttaactgaccatgtatataactgtgcaattgctgctttctcacagaactgtctagggttcattcaacagatcacagtaacgaggtctggcatttaacaaacaaactaatgatagaggagatacactaatttatacgagaattaactaaatactgtcatgtggtttagtgtagctcaagttatgcttgtatcatataacataggttcaagttttttcatcagccatcagaataacagtggttaaagagacatctgaataagtgccaactcttactgcagttgtctcaaaaaaagaaatttaagtaattgcaatatacatttctacaaataaaatattccagtgcttacatcaatcctgagtttttaagattaaatatgcagtacttatggtctccgacacaattttattttggaacacggtgatgtattttttaagttgactttcttcaccactttcttcaccaaaaagagggctttcattatactcttccaagtcctcaatactctaaaacaaaaagtctagttcactgacaaaccatcactttacatctcaggttttaaacagggtaaattagatgtcaaaggaaacagcttttaatattcaaaggatgctggttatttatttcaaatttaaaaactgtaatcaatacatggagctccaaatacttaaattttttaattccagatttcagtgaaatattattatagcaggtccaacagtcatgtagtttgcttgaataaaatggcttgatgaacatgttacagacaagatggaccaaagacagaaaaagactgtcagtcttatatcatggaataccatattttttcaccaggtagtgaccatttgttatcactaatagtccacataacgtggttttcattgaagggataaaatggtctgtgatatgacctaatcaagttggggaaaacataactacgtatgaaacatatactagtccctcaacaaatagttcagcagttcatagtccctaaaatgttgtatgttaatactgaggaagacgtaaaaaatgagtacacaatctcttccgtattcctgtgacatgagcaaatgcacgaataaaaaaaaaagtaatacaaaacttgtgttactgctatggaagagcaactcactcggacatgtagccaaaaatggagactgatgtcgacttagttggcacaagatttcaatcagtcaaaaaaaaaaaaagaaaaaagaaaaagaaagattttaaaagcatttggagggaagggcatgagcaaagcatgggagtaacggtgagttccttcagggaaggctgtcaatctggagagttgggaggaaagacagagggtggcaaaacaagcctaagagggggtcatgtaaaggggagagtctctgaatatctaagaactgagacatgggcaccactgacaggctgggaagagggaagggctaggaagcattttagaaaggggagagtgttaggaagatagtattgcccatcagtgaaggatggctcagaagagaagagataactcagaaaagagcttaataatacaagcaaggaagaatgaggtcttgaactagggcagcctcagtagggatttaaagaaagaaattaaaggaccattacagcggtaaacgtgcctcgcaataactgcatgggaaggataatggactcagaggagtccaagatgataccaaagtttctaccctaaggggtaacatgtagcattaacattgacaggataacttttctagtttaatgttcataccaattaataaatagtttctgaggaacattatagcaacatgttctcttctcgtgacttctatgtaaataactgtttgtgtacagatcatccttaagttgcttgaaaattttattttcaaacgcttttcctagtttatttaacacatctcagttagtgtagaggagtgacatatgagcatgtcttttcacaaggttattaaaaagaatacctcccaaaagaaaattacattgtttcctaaataatatacatctacatgaagaagaggtcattgtccaataacgattagctaatatgctatatgacagcagataattcacaattcacaaagtgttaataatctgctggctttcacattctgttatacatctgaaccatctcttatgattacaaattttcatgtaaaaccattactagtcactaatagttttgaaagggaatatgccataaaacactcctacattccagcaggaaataaaagagatactcagtagtcaacacttgcctacttcctatttaactaaaactgtttaaacaagacaagtaaaaaagacatccagtaaggatttatggacttcctgcattccactaaagatctgtcgctgatctcctaaaaactgaatatgaaatcttcattaatgtattcataaagtatcaattttatacacaagatttatatttccaggtaaaatttccaatttaccttttcctgttttaaataactcccacaaaactattcatgaatcctaaaaatacacttaccaattatgttaaatctggaacaatacaaagtgaaaatggtaagtaatttataatgtataaccaaaaggtctgtccacttggaaccaacccaaatgtccaccaatgatagactggattaagaaaatgtggcatatatacaccatggaataccatgcagccaaaaaaaaggatgagttcatgtcctttgtagggacatggatgaagctggaaaccatcattctcagcaaactatcgcaaggacgaaaaccaaacaccgcatgttctcactcataggtgggaattgaacaatgagatcacatggacacaggaaggggaacatcacactctggggactgttgtggggtcgggggagggatagcattgggagatatacctaatgtaaatgacgagttaacgggtgcagcacactaacatggcacatgtatacaatgtaacaaacctgcactttgtgcatatataccctagaacttaaaggataattaaaaaaaaaaagaaactctcggggccaactgaattttataaaaatgaatttgttgtttggtgaaaaaagtaaaaactataaatcctagaagtcagttaaaggatacctgtaaagctctgtggaacaaatattaataaagtcaaactgatcaaaaaaaaaggtctttccatacattcagaaacaagcagactgtcttctatttttgttcatgagttgtattttataagaacgtattgtgttaccaaatagaacagacctttgtgaattgctcatgtggcggctcaatctctttcagttcctttcccatcttgttgccgtctcttttgttgctcttgaaatattctctagaagcacaaaactaaaaagtgattaaaatcggataaattttaatacttacaaaacataattctgcattagctttaaatggatactctttaaatcaatacttctgaacactattagacaacatttatgaccaattttaaacagttgtgttcaccactcatatgctaaaacaacataatctttctcatcagtcatggagtaaagaatattctttcttatatatattcaacatgtatgtcctaattcttggtttcaaatgaagagtatttgatgacccttcctacaatttgttgaccacagatagttaatttctaatacagatctttcttacctaagaaacattcttttttactaagattttaaacacttggtcatttcagtatgcacatagatgaaccttccaacaatgattgcctttctgcaccttgacctaatctccaacaacagtgttctcctctcctctatgtggcactcactcacacagtcatcccctagattttgtcattcccaatggctgcaacatctcccgtaataataataatagcaatgatagcaacgataaagagcaaccatgggtgagatcgcatcctgaaaattttaaataaacccattacataagaaccctttaatccttcaaacaactctgaggtaggtactcttaccatgtctcctttcatagataaggcaactgaggcacagagataaataatttgcccatatttccaagctagcaatggtcaaactggagttggatcccaagcaatgtggctgcagagtcccagcccctgaccactccactcagctatttctccatcttcccaacatacacagccactacctccctgtcactgtaggtcactcacttcagtactacagctcaggaatctgtagggacccaacacccaatggatggagcacttttcactgcccaatgcccacccccatgtgctccggtaactcagtcccagctgaaattccacagccagtcatcataaccgccccccctccaccaacatatatgccctgcccaactctccctctatcaatgtgctcagctacaccccaacccaggaaattccaaccctaaagttactcttgcacaaatatgccatctgggctgactttaacttcttaatccctatgacactgacctcagttggacccctaatgctgcatggcaattatattcccctagtccatgagtccactaatgggccccgctctctgggttcatgctctcttccttctttgctggatttctgcatgaaccattactacctgagacattgatacaataggttaattgtaaagctaagcctgataccaacaattagttcttctccttcttctctcttcttcatctttctgctcacctgtgatgtattcttcaagggtattcggctccttcttctttcttcttcatctttctgctcacctgtgatgtattcttcaagggcattcagctccttcttctttcttcttcatctttctgctcacctgtgattcaaggacagtcagcaacttcagagaacgtccataactacatttctgcctgtaacacataataagtaacacggtcatatgtcatagagagatgaaaaattaatcctattcaaaccaaaactgacttcacataatttatactataaagtagcaagggagtaatggcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatgtgggttctcataagtaggttcaagaatatcatagccattcatcccgtaagatttcccaaaagaaatacttcacttaactctctctccactttggtacaacaatgattttctaaaaggaatagtgaaaacaatttaactaaaatagataacctatttacgacataaggttgtccctttctacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatacctcaattctgttaaacttaggttataaaacaaagaaacttacctgcttaaggaacaatcaagtaaacatattgttcactacagacaccaatatgtacaagatagtttttgaaattatttgcaccaatgaatacaaagaaatgatagaaatatccttattcaaaaaagccaacaatcatgcatttttagttgtattgttctcaaaatacgtttaattttgttgtttgtttcgttgcaagcttttgcaacgctttcaatcctttttctctttgcagcaagaccctttttaatgtcagctagacagtaaatgaaaatgcattaaaaattaatgttgaaaagtagtttatttgcagatattgaaatcaatatgggacatgatggttcagcaatatcagaaggatatttaaaatgcaaaatggaaagatcgtttcaaaaaagtaagatttaatccttttctgtaaaacctttcaggtattaataatagttttccaattccaattggtataacagcaaatcacttaattgacagatgatgaaaaaaagcaaataattaaaatagtttctattttttaaatgtgcagaaagggtaacaaacacagactttaatttctacatcataaaatgtccaacagttcaaacgacatgtttccatgaaatactgtcacaactcattaagtaaagcacataaaagtaagaccatcaaaagggtagacataacataatacacaataaagtatttttaagcaatctagtgattgatgctattaactgtattttaataaaagaagcaatgtccatgggtataaaaatttaggtttaagtagataaagaaatacacttaaaaacacgtttgaaatattttctgggagctttttatatgacatttttatccacaatgctgtttctgaaaactgtattactgcaaggaatgctttcctaaacatagtttcacatcagagatccaccatcaattgctaagaatagttttctgcagtcataaaagatctgcaccataatacaaatattttttacatacagtatccatctatagtggtcgatgtattaggcagctcacaaaaccagcactttgtcaccaccaagcagagcaaagctttccaaatatactgcttatatgaattattgctatagaagaactgaaaactaaagtaagctttttaaaaataagagtgttgtctccatcgtctctacagaaattttctcaaacttttttgaataaatggtcctataacagtcagtacaactaatatttcacatggcaatataaagtttatgagtttttggatccaattaattacatgtttctcactgggtagaaaagttgtctttacttttctactacacagtttattactggaataataatagaaaataatcattttagagaattcaattttttctcatactttaaagaaaacaaaatcagaaagctgtgacaatagaatagctaaattaggaacatgaaaaactcatattaaaaattctgagtacatatggacaggaagaggggaacaacagacaactgggcctacttaagggtggagggtaggaggggagggtgaggatcgaaaaccacccatcaggtactatgctataacctaggtaacaaaatacaaaataacaaaataacaaaagtatctgtataccaaaccactgtgacacgcaatttatctatataacaaacctgcacatgtaaccccaaacctaaaataaaagctaaaaaaactgatatgtgacttaatgtgtgtacactaaaaggaacgaatagagctgtttctcctccagtgtcctctaatatcccccaaacattaaatttccacgtgtatgaaagaaaagccatccctctcacttgcccattattagaagcattctcacattccacatcaacaataaaaaaggaagtaatacagatttatcaaacagactatgttaaatgctatatatgagaagaaggcatttaagacagtcttgtccactaattcgtacagcctattgtaacagttgtatgattgaaaacaattttcataaactacaaatagctcctaaaacatacctgcaatatcttctagcttctggatatcaaccctgtaaaaaaaaagttacatcagggaaatttatagcactaaatgcacacaggagaaagcaggaaagatctaaaatcaataccctaacctcacaattaaaagaactgcagaaccaaaggcaaacaaatgcaaaaactagcagaagacaagaaataactaagatcagagcagaactgaaggagaaggagacatgaaaaactcttcaaaaagcaatgaatccaggagttggttttttgaaaagattaacaaaatatatatttaggatagttagctcttcttgttgaattgatccctttaccattatgtaatgtccttctttgtctcttttgatctttgttggtttaaagtctgttttatcagagactaggattgcaacacctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagtcgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttggctgtaaagtattttatttctccttcacttatgaagcttagtttggctggatatgcaattctgggttgaaaattcttttctttaagaatgttgaatattggcccccactctcttctggcttgtagggtttctgccgagagatccgctgttagtctgatgggcttccctttgagggtaacccgacctttctttctggctgcctttaacattttttccttcatttcaactttggtgaatctgacaattatgtgtcttggagttgctcttctcgaggagtatctttgtggtgtaaaacagcatggtactggtaccaaaacagagatatagaccaatggaacagaacagagccctcagaaataaggccgcatatctacaactatctgatctttgacaaacctgagaaaaacaagcaatggggaaaggcttccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccggaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaagtaccatttgacccagccatcccattactgggtatatacccaaaggactataaatcatgctgttataaagacacatgcacacgtatgtttattgtggcattattcacaatagcaaagacttggaaccaacccaaatgtccaacaatgatagactggattaagaaaatgtggtacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagacgacgagttagtgggtgcagcgcaccagcatggcacatgtatacatatgtaactaacctgcacaatgtgcacatgtaccctaaaacttaaagtataataaaaaaaaaaacaaaatagactgctagccagactattaaacaagaaaagagacaagaatcaaatagacacaataaaaaatgatcaaggggatatcactactgatgccacagaaatacaaactgctatcagagaatactataaacacctccacacaaataaattagaaaatctagaagaaatggataaattcctggacacatacaccctcccaagactaaactaggaagaagtctaatccctgaatagaccaataacaagttctgaatttgaggcagtaattaatagcctaccaaccaaaaaaatcccaggatcaggcggattcacatctgaattctaccagaggtacaaagaggagctggtaccattccttctgaaactattccgaacaacagaaaaaaagagactcctccctaactcattttatgagtacagcatcatcctgataccaaaacctggcagagacacaagaaaaaaagaaaatttcaggccaatatccctgattaacattaatgtgaaggaaataagagaggacacaaatggaaaaacattccatgctcatggttacgaagaatcaatattgtgaaaatggccatactgcccaaagtaatttacagattcaatgctatccccatcaagctaccattgactttcttcacggaattagaaaaaactactttgaatttcatatggaaccataaaagagcctgtatagccaagataatcctaagcaaaaagaaaaaagctggaggcatcacgctacctgacttcaaactatattacaaggctacagtaaccaaaacagcatggtactagtaccaaaacagatatatagaccaatagaacagaacagaggcctcagaacaatgccacacatgtacaaccatctgatctttgacaaacctgataaaaacaagcaacggggaaaagattccccatttaataaatggtgttggggaaactggctagccatatgcagaaaactgaaactggatgccttccttacaccttgtacaaaaattaactcaagatgacctaaagacttaaacgtaagacctaaaaccttaaaaaccctagaagaaaacctaggcaataccattcaggacataggcatgggcaaagacttcatgactaaaacaccaaaagcaatggcaacaaaagccataattgaccactgggatctaattaaactaaagagcttctgcacagcaaaataaactatcatcagagtgaacaggtaacctacagaatgggagaaaatttttgcaatctatccatctaacaaaaggctaatatccagaatctacaaggaactgaaacaaatttacatgaaaaatgacaaccccatcaaaaagtgagtgaaggttatgaacagacacttctgaaaagaagaaatttatgcagccaacaaacatatgaaaaaaagcttgtcattgctggtcattagagaaatgcaaatcaaaaccacaatgagataccatttcatgccagttagaatactgatcattaaaaagtcaggaaacaacagatgctggagaggatgtggagaaataggaatgcttttacactgttggtggaagtgtaaattagttcaaccattgtggaagacagtgtggtgattcctcaaggatccagaatcagaataccgtttgacccagcaatcccattactggatatatacccaaaggattataaatcattttactataaagacacatgcacacatatgtttattgcagcactattcacaatagcaaagacttgcaaccaacccaaatgcccatcaatgatagactggataaagaaaatgtggcatatatacatcatggaatactatgcagccattaaaaaggttgagttcatgtcctttgcagggacatggatgaagctggaaaccatcattctcagcaaactaacacaggaagagaaaaccaaacactgcatgttctcactcataagtgggagttgaacaacgagagcacatggacacagggaggggaacataacacactggggcctgtcgggggtggagggctaggggagggatagcattaggagaaatacctaatgtagatgatgggttgatgggtgcagcaaaccaccatgacacatgtatacctatgtaacaaacctgcacgttctgcacatgtatcccatataacttaaagtataataaaaaaagaaaaaagttacatcaaaattttaacataatgctacacaaaatgccatgtttgtttaagaagaagaaatgtcttatgtgaaatggtgaaatgttctgcatagaacagtgattatatgatccaaagctgacttctctgcctcccagattcaagcaattctcatgcctcagcctcctgaatagttgggattacaggcacatgccaccacgcctggctaatatttgtatttttggtgagacagggtttcaccattttcgccaggctggtctcaaactcctgacctcaagtgatttacccacctcggcctcccagaatgctaggattacaggcgtgagccaccatgcttggctccaaagctgatttttcttagaagacgttatctgacaggcaaaactgacttaaacactttaccccttgtcttccgcatcgatttcagcaaaatggtctcttttccgctgcttatcaattgctggagtctttcctgcattaaaataaaaaagacacaccttttttttttttttaagaggaagacgctgttgtggacatttttttgtggagaaatgtactatttgtggacccttttggctctctgcccattaaagctttaaagcagcgctatacatggaatcactgggaccctgaccattttacagaggcatttttgcaagctctttgcggtttaagtcccagtaaacaaggcactacgtgtcagatcccttggacgtcaggaccgcatccatcgagaagagctgctctaagagtatctgtaaccctggtatgagggagaacctcccatgggaaacctaaggctcttgagcctgctttgaaaagcttgggcatcttagcacgtgcaaggtgaactccaaagcaacataggggctgggggcctcgggctgactgtctgctgcctgtgtgccccccgcgcagagagcagacaaaccgtccccttgggcgtgcaccttcttccggctcccctggactgtttttaactccatgctccatttcctggttggccgtaacctgagcctccactgggtgaggccttcgcaggcttctccatgagcttcctgcccacgggctccatggctggttgtcctcggatgttagaggtgactcctgaaccttgtgagtgcaaagatacagtaaggaaacagggtgtgtgaaaggagagctatcgggatggtgggttcaagaagcgtggggctggcccgccccgagtctcctgtgggagcaggagggatcgcggagaatatgtcagcatcccctcctgtcctggcctgtacagcctgtccctggggctggccgcagagctcgcagctgccgcgcacacctgaactccgcggcctctgggggatcctcgcggagccattgagacagagctcggccctgctcctgggtcccccagcgaccccgtgtggccggaagagctgtgggatgacagaggatctccccagctatctcagtgggagtcacccggtgtgcacctgtttcggacaatcaagggtgggcactgctactcgcccgcctggatgcccaggggacctccggtgaccccaagtgtcctgtcctgctgggcagccaggcaggagggacccacaccgactccccaacccctgcacatatgcacaggcccctggggctgctcctgggccctgggaaccacctgggcagctccagctctcagccctggcccaccccggcctgccctcagggccttgccctgattcaggccccagacaacgacactggggccatttcctcacaggtcagcctggggcagcccggtgcttcacacggtcatccccaaagggcctcatgccggctttccccgcctccccaccatgggcacaacacctgagggaccccccacattgctccctcagtggacctgcagacgctggcaccacaaggctcctctgagggcctgggtcctcggttctcttgagagcagccagcctgcctgcccgcactcctcgctgattggtcgactcagtgcacatgtgggtggtgggccgctggggccacgccccctgcaggcatgccctccccctcagggaccacccatggtagctgtggactcagggagagggtggctttctgaggtctctgtccccacgatattccagctcctcatcctggcaaaggaagcaaggacccaggagtggggagtgccaggggaccctgccctaaggaatggaggccaagtgaacggggcctaggaccttgcccccaggctcgttccagccacccctacccctttggatgcaatggccatcaccctgagggtggagcccaggctccctcccatgccctgtgtgcttccaacatgcccaactgcattctttttatcaatggattgtgcttttatgttttatctaacaaaattgaagttgcctttggagggtaaaaatatatatatgtatgtgcacacacacacgtgtgtgtgtgtgtgtgtgtgtgtgtgcttaagcaaaggttttccttttatattcatagattacattgcagaggtataatggcatactttttatattcatagatattttatatccttttatattcctttgtatttccttttatattcatagataaattgcagaggtataatggcataaaatgggcatatttaagcctttgggtacttcagttagagaatattcctaaggcaagaattaagatgtattcatgcatcatttctctttataattctgttgtcaagtattatagaaatgtttgtcggtttcatttttatcaccaggaatgattttaaccaaaagctttcaaaaaccctttaattttgacccagcaaaatcaaacatttattcatgtatttatttatataagtttaagggctacgagggcaattttggtacatggatctattgtgtagtggtgaagtctgggcttttagtgttcccatcacctgaataatgtacattgtatcctttaagtaatttctcaacactctcccacccttctgagtttccagtgtctatctttccactctctatgttcctgtgtacacattgctccgttcccttataagtgagaacatgcaatatttgtctgtgttttacttgtttcacttaaaataatggtctatagttccattcgtggtgctgcaaaagacatgatttcattctttttcatagctgaatactattccattttacatataaaccacattttctttatccagttatccgttgttgggcacctgagtgttgattccatatctttgctattgtgagtggtgctgtgataaacatatgagttctggtgtcttcttgatgtaatgatttattttcctttgggtagatacccagtggtgggattggtggattgaatagagtgacatatgctggggagaaacatttagtctatagcagggagtcaacaattttcttagataaaacataaaagcacaatccattgataaaaaggatgcagctgggcgtgttggaagcacacagggcatgggagggagcctgggccccacccacggggtgatggccattgcacccaaaggggcaagggtggctggaacgagcccgggggtgaggtcctagggcccatccacttggccttcattcctcaggacaggattccgagcactccccattcccggctccttgcttcctttgccaggatgaggagctggaatattgtgggaacagaggcctcagagagccacccttgccccctaggtcctcagctaccatgggcatgcctgcagggggcgtggccccacacggccccactacctgcatgcacactgagccgaccaatcagcgaggagcacgggcaggcgggctggctgctcttgcaagaacccgggactcaggccctcagaggagcctcgtggtgtcggcatctacaggtcctatatatatttttttatttaatctttattttatatatatatattttctcaaagtatgtaattttgtggctgaatttaattttatctttgtgcatagaaatctatagacaatcataatgcagggacactttattagcatgacctaacctttgaaatcttgtctaggtgagtcacgaatttagttcattatcagtcagttctctcctagctgggaaacgttcatgcagacacacatggaactcaattagactgggtcagtgtgatatctgcaggggctctagtgatgtgtgaaacacacagggagacggagatctaattttatgatcttcactgtcaataggagagaagaaaaggacttctgaataacatcaccgtcaactgcctcacaaaatctctgaaagcagtgctctaggagttacagtgattgcatcaggagctgcagttttgggggcaattgagaaggaactcctttctctgtataggctgcagagttcctgaaacttctccccaattagaaacatagaaaattattagccttacttaccagtgccatatgacctgggactactcagaggaaagggctgattagttaaagaaaatatgtctagaaagaaaccaaagaacattactcccaaaaggcaccttcaggaatccaactataacatttttgggtagattaatatataatacatatatagtctaatattctaataatatagtaaaacggatgaggtttagaacaaattaggagacacattctgtgtcagatgccaactgcatctgcaattttgggcaaggtaattaactacctggagtttctgctaaattgaggttggcaggggcactgggttgattaatttgatcttgaaagtgccatgaggtcatggactatcttcttatctttattagggagctatttcttacatttataagactcctttactaagttaaaggtgttttccttcctctaccatatacaatttttaaaaactgttcccagctgggcgaggtggcgcacacctgtaatcccagcactttgggaggccaaggtgggtggatcacgggtcaggagttcgagatcagcctggccaatatggtgaaacctgctatctactaaaaatacaaaaattagccaggtgtggtggcgggtgcctgtagttccagctactcgtgaggctgaggcagaagaatagcttgaacccaggaggcagaggttgcagtgagctgagattgcgccactgcactccagcctgggcgacagagagagattctgtctcaaaacaacaacaacaacaaaactgttctcataggccaggcgcagtggcccacgcctgtaatcccagcactttgggaggccaaggagggcggatcacgaggtcaggagattgagaacatcctggctaatacggtgaaaccccgtctctactaaaaatacaaaaaattagccaggcgggctaattagtgtggcgggcgcctgtagtcacagctactcgggaggctgaggcaggagaatggcgtgaacccaggaggcggagcttgcagtgagccgagatcgcgccagtgcactccagcctgggcgacagaggaaactccatctcaaaaaaaaaaaaaaaaaacagcagttctcgtaatttatctctatttctgttttgtatttgaatgaatgacacttaattcatcgagattttttaaagagcattgcagaactctcataagatgaggctggttgtatcatttataaaatatttacagcatctcagagagctctgaataataaatgacttccattcaaataatagacttttaacattttcaaactcggcttttcagtagatatcaacactctcaatctcattccatttgtgagtctactttaaaatacctttaatcaaatgtgtaacttaatagttctattgatagaaatataatttttctctatatgttttgttttgtttttcataataatagtagcaaaagatacaaaccaaaatcaattttctagattaatgttggaatctcctggtttcacttttgagaaaccactcctagtctaaaatgcattattacattgtttgtaatgatatttaaaagctggaggaacataaactccgcaataactgcttcatttttaaatttgacccatcttcggtttgtggaacgtgtctgaaattgcacagctgtttttatttatagtctaactggggaatttcacttgtgaaagatgctgtaacaaaataaatgtccctgtgtccgttgcattctgtggcattctaagccaacaaaatgtcaagaaataccattcaaatcctttcagctacaatgaggctgaattatcattcttttcaagttcttgtttttgagggactgttatagcagaaattcacatgcaaaagaattgctttaatttatgtaccatgctactatttttaacttagaaaaaaaagtcagactcctctttggacctcaatactgacaactttcatcagtaataataggctgtactgttattctgtactacctttattcagcaggaataacaggctgtactgatggatgtactacagtgatgcaaggactccagtaaactggcaggcagtgaagaggtatgcttcaggagtgtcacaaaagtggtgatgactttgcagagaacagagccacccgtttatcggcctgcctctgcttaatgcatgttgctcaaatgcctctatgaaaatactgccccaaatacaaaactatactattggactgcccttcctttataactttgagggatggtcattgccacttgctaattgccaagctctcttacaaagtacatattcaatttatttccctgcctgcaactgtatgatgtatagttgtttccaagaaatgatgactaagaggtactgagagatttttgtcattttttcttcaaaaaaagtcaactggtttcctgctcattctttccatttaagttggccatagaaatcccagtggtgaccctcaggttgtcaaaggcctttcttcttgttgctgtgaggttggcctgctgatagtaacagatacaccccactcacaattatttcaggatcaagtagatccattggccatggagtgatggtcttttcaagtaaggctattttgagaggtaataaaatattcatacacttaatttttcttttgtacttgcttgttttaaaatacagttctgtacataaatatttttgacaagatgagcaatagatctattttttcacattataaaacaaaattattataaagataagtcaaaaatgactaagtagaacattctatttggttattaattttcactggactttcaaaacacttttctgtataacatattcatatattttgaattcagcagtgcagtcagatgtttcatgtaagtggctgggcacagtggctcacacctgtaatcccagccatttgggaggctgagacaggcagatcatttgaggccaggagtttgagaccagcctggccaacatggcgaaaccccatctctcccaaaaacgcagaaaaaattagccaggcatggtggcacacatctgtaatcccagatactcgggtggctgaggcacaagaatcacttgaacccaggaggcagaggttgcagtgagcctcgattacgccgctgcactccagcctgggcaacagagtgagactctgtctcaaataaaataaaatatgtaagtgtaacatgtaagagtaaacataatcttacgtagtgattatctgaattattttttctttacttttattctacatgggtattataaagagttgtgtgttcataataaaggctcccttttctacatagttggtcttcccttcttccctcaacattttaaaaaaattctacagaatttacacaatcaacattcttccttttaagctacattattaatttctccccaaaagaattacagtttttcagcagctgggaaatggaaccaaatgatgtttaattctcccagcagtgaggtgaggaaacatgcacagagcattgctgcccagggagctcccccaaccctggcatccagtatggttttggggcgtgtagtcatggcagactgtctgcatgactgaactcagttgccagcccctccagaggtcaagactgatacaggtggcccaaagcttccactataaatcacattgttagcattaactatctagcataactcaaagctccaggtaaacaaagacattattatcaggcaggatattccaagggcttagaggttatctcctggaaggctgtcaaagagcagatgttctttggaaagtgcagggtttggacaacacagatctgctgagctaacctactactgcactcttattcagctcttattctgaattctctctctctcttcctaaaatgtgcagatccttacggatggatgggaaaatctgggaaacacagcactcactgtaaacacaccatgcctagaatttggctcctcttcaacaacccgggcttttgaactgggtcgaagtcactatgccaggatgacatttttttacgttagaatgaattcccccctggtggctcctcatcctccaggtatacaaggctcctggatgacccatggcctccacggggcacaccacagtctgaatcacagctgattttctggattgcccttggactcagcaggatgattccacatcttccaaattctagatatcctgatatcgcaatattttttatccctgtttcttaatgaaagggtaaatggaggtagaggtgtttctcaacaacctgcaacaacacatgtttctttcaattattcagtacttaattggaaatcaaagcccctttctaatgtatcgataacattgggaattgatgactattgtgtagttgtacttaatctacaccatgctaattcctaacatgggctatggaggcagcagagcggcaggtgacaacatatgcacttctctccctctctgcccaaagctcctggtaactgtcaaatgagcagaggacggggagacaataggaatattttaaaactgtggttttcaggttgggaatatattaatatcatacaacctaattatttccttactttgtctatattgttgtatattacccaagcttcagagctgtcagagcaaacctcaaagatgaggagccagctggcaggtaaaaagcaaaacaaaaacagcccgttgctcaatgactaggatttttagttcaattacatttccttgccatctaaatagccagatgcaatgacccatagatagagccagtgtagaacagatgcagtgacccatagatagagccagtgtagaacctaacataataatgtctaaaggggttagtaattgttctactcaatttgtttcagccattctattggaattcctattaattggaattgatggtaagtatatggaatgtcatgtagtgaaacaaacaaacaatttagagcacaccaagtttcatggacaacaaataacaaatcactttttaaaaatcaataccaaccaggccaggtgtgatgactcacacctgtaatcctaacactttggaggctgaggtgggaggattgcttgaggccaggagttcaagaccaacctggccaacatagtgagacccccatatctaaaaaaaaaaagaagaagaaaaaaatgaataacaacgagtacagtgagatcaaagaacactagctaccatctacccttggtttaatactcttgagaaggctggcatatgtggagtctctccaggaagacatttgaggcagaaaaccagaataggggcaggaaatgtattatttcatcatctgaaatggggactttattaactctcctgagtataaagtcaagaaagaaggtatttttcaggactgtttaattaaatgtcattctgtttatcaaaacagagaaacctggcaggcatttctaaccatatgggatttttggaaatacatgagaaacatgtgattacgtgtttagctgaatattatttaaaatgtatgcaaaatcctgagagggcttttgaactaagttcctaaaatcatcctctgatgcatcctatttgatatgctgctgtgtgcctaaaattattccagtagaaataaagcagagcctcaataaaaccagccccttttaatgagctgcttcttgtaattataattatccataatcatttattttgactgtaagtaatataacaaggcaaaacctataattttctaaagtaatataatcaatataaaaacaaaggtgtttcatactactaacggaagataaatgtatcctgcaagctgaatgttggcagatcagcttgtgctcttctaaatcatctaaatatcatcagtgcctttgattacagcctcgtgcccagtgctttaaaaatcaaagtttgcttttaagaaatgtaatttaaaaactgctgatcatctaaatcttgggaggtcaagggcactcttatttcctttatacttacaagtttaatttgatgttttccaaaatagacttgggtataaatttcacatcaatatgctaagcagagccccatgcagaatatttctgagtgggatttattgaatataaggttatttttatgactgggacattacagttgcaatcatcaatgaataaaaaataaatttaaacaactgtctctagcatcaagttgaaactcaagtctcaatagagcaagtttcaggaagaggtgggatttcaggtaacatggagaacagcagctcagatccttttcttaaaggacgattcccccttgacatgaagccagcaactcactctgcatgcagaacatgcaacacatttccatgccggggagagaagcatgtgacgtcattcattcactcattcagtcattagtcattcccttattcgtctatctaatagctgtcaatactcctagtatgtgttgggcattgtactacatgctaaatatatagaatctcttttctaaactcaaaaagttataagtagatggtagtagtggtcagggtaaaatacatttgtgaaaggaagaaattacagtgacaagtcctataatagatggcaagtgatgtaggatccataaggaagaaggacaaattatttatagtatagatagggaagactttacaacaggagaaattatctgagattagtttggaaggataagaacaaaaaggtactccagtagaaaattgggacaaaaagtagaaaaatggggcactttagtctgggagtcataaaaggtggggtatacttggaaagaataaactttttgtagaactataagagatttcagggtctgtgtgagttatagtttcaggagattaagttgaagatatttgggtacaatatattgaggtatatcataagccaagagagaatataggttttatttttgcaggtcagttgttctcaactgggggcaactttgtgccccctccctgggatatttggcaaggtctatattttgctgttacaactggagaagggggcaggctactggcatctggtaggtggagaccagggatccactaagcatcctacactgtacaggacagtccccacggcaaagactctgccccaaatgttgacagtgctagggtgagcaaccttgctctagataatggagagtaactgaaagattttacatatgggaaagaagtaaagaggtactttctaggaaggtgatgcaacacctcctaggaggtttgccacatcacggtggtcatcaaaacactgggtgtcaataagagaaaaaatattcgcctgcagggagaaagatcaactaacttcttgagcatctactctgtgctggacattcaacgtattataccaatctccccatgatattggcaactgctactttctgcagcaatggggactaccagatgaaacaggatgagactagaggctgggagaccattatagatcaatgttcactctcacatggaaacagtggaggtctggactgtagcagtgtccatggagatggagatgtgagagcaaagaggaaggtcaaatcaaaaggagttttttaccaattaaatgtgagaagggtttaaccaccaaatggaaggtttacagaacgactttgaggtggctggttcagaagactaagtaggtagctggagagactgcaaaaggaagtctcagaggacaggtacagggctacccatacttgtgacctttggggtgcccatgggaggttcagatgtagatgcctggtaagcaaagggaaaaataagtctccagttgtaaagagacctcaaacagatatgtgtttaagagtttgcaacatcacaatggtcatcaaaacactgggtgtcattaagagaacaatatttgcctgcagggagaaagatcaactaatttattgagcatctactctgtgctggacagtcattatgttatcgtctcagtctccccatgatattggcaaggagactgaatgcagacaggcccagggaggtgctcaaagtcaggcagccagtcagaggcagagccaagcttggaatagtgtctcaccaaaaccaatccccatccattcattctttcaagattatttataaagtgaattgctgcgtggagaagagaagccacagaacaggttgagaaagaagaccctgagataggaaaagaaaaagtgaatgatatcatcaagtccaaaggaaggaagagcttcaagtaatagtttcagttctcaattgtaaaaagattcagagtcagaccagaggatgcttctgccataaattgctatccaaatgatatcaagtcatgcacacacacacagagtttatatcagagttagaatgtgtacactgcattagacactgagcatcatcagggtcttgctggagggcaaggagcaaaaaacagaccataattggtagaaaagtacttagagtttgaggaagtagagccaggaagaacagaaggaaggtagggtggttgctaaagggaagatattttacagatgaagattcagacttgagcgtagatgtaggctgaaggacttgagtggaaacaccaaagtttgagtatgtaggagtgagggtctaaatgagagaatgaaggagtttggccttggtgtggagaagggtccactgtttgtttaaaatagtggtcttcaatcttgttgggccagtagactctcttgagaaccttgtgaaagttttagatgtcgccccagaaaaacatctgtaaacatttacaaaactgggtatgatcttagggagttcttgctaaaatctcctaagcataaaatttaacaggctctccttgagagtgaagaggtgctattaatgttattacagaggacaacagcctccatctaagcttcaagcaatcccagattggtgaattggaagtggctggagaatgtgatgaactggatttcctctgtgccggcattgattattgtggcgtgactgaatcacagtaagagttcccctgaaaagagcagtttgagtttgttagaaaaatggcactctggaaattgatttctttcaaacaattcaaccctgtgaaatccttgcaatatccttgtgtaaagccagggttatgtggatgacctctgaaagccattgatgtggaaattcctaatttagaaaagttatcagaaatgtttctggaaatgtttacacctagaagagcaatttggtatatcccgggggaagtatccagagcgaggaaatcaacaggagcccaaagttttgcattctatttattgagtaaaaatatattgattgctagccacatgacaagacctgttccaagtgctttatgaatgaattcattaaatcttcatcacaagcctactaggtaggtacagttattatcctccatttcacagagagggtaatggaggcacagtgagatagcagggttgatcttggtttgggtcagggagtagatttggaacaaggctgtctgtttccagagtctgacctcccacttttactctatattgagaaagtttacatattataatatgttcacacatttactcagtcagttcttttttttttttttttttttttttttttttgagacggagtcttgctctgtcacccaggctggagtgcagtggaacaatcttggctcactgcaacctctgcttcctgtgattctcctgcctcagtctcctgagtagctgggattaaaggcgcccacaatcacacccagcaaatttttgtatttttcatagagatgggatttcaccaggttggccaggctagtctcgaactcctgacctcaaataacctgcccgcctgggcctcccaaagtgctgggattacaggtgtgaaccaccatgcccacccaattcttataagctttcaaatatcatatttgtttaaacacctgtattctttagtgttgtaaaggtaactatccatcctctgacagggactgtagatgagaggaaatgcatccaggaatctaatttatcacaccagggtcctatggatagatttagggttatgggaacagtacctcatcaccggttatagattttgagagccttcaatgagccacctctgaagcctttttaaagatggctggacatgcttaggcagaaggtctctgatttgtgtgctaaagctccttcaaatgaagaagtttcaagtgaacagaaattctcaggtgttaaatgctgctacaactccggaaagactgccaactcctgccaggtgaccagaaactcagtcaacttctctgctaactgacctccaagcaactttacccataatagctaagaataccagccaatacttgctgagtatttcctgtggaccaggctacacacacacacacacacacacacacacacacacacacacacacacacacacacacagatccagatgctcagtttgcacacagtggtacagtagtggagggtcataaaaataagcatgcaagttgaaaccacctgatatggttgggttatattccccacccactctcatcttgtattgtagttcccataatccccatgtgtggtgggagggacccagtgggaattaattgaattatgggggcagttacctccaagctggtattctcgtgatagtgagttctcacaagatctgttggtcttataaggggcttttcccccacttcactctgcacttctcctcgctgatgccatgtgaagaaggtagtgtttgcttccccttctgccatgattgtaagtttcctgaggcctccccagccatgtggaactgtgagtcaattgaacttctttcttttataaatcaccgagtccgggtatgttcttatggcagaataagaatggagtaatacagaggacctgctttgacattggatagtcctgtgagcaagttctgaatttatcatctcacagctcctgcccatgtacaagttacttactctgtcctaatctcagtctccttatctgtaaaatggaaagaataataatattggcttcatagaattgctgtgaggatgtaataggattttggatactaagcacttagcttatagtacttactcaataaacactatttattactactgtgtgctgtatcacagggaagttgtggtggtcagatgagatcattggcattcagatatttagaaaagttaaacacttcagaactttcttctgaaggactttgttgctgagttttcagccccattcagtgaatgtaactaactctcatattagtgcgtttctgcaaaaatgatgaggtcttttgttattactttcattgaggaataacatatatagtaatgtacataaatatgaatgtgcacaaatacagctcgataggtttttaatatgtgaatggcatgttactaccaaccagatcaagatgtagaacatgctcagcaccccggaagagtccctcataccctctttcaggtaatatttattcctcaaaggtaacccttactcttccttctgtcacctaaacaaatctttccttggacaatatttctattattatctctagaattaattgtaatatggaaaatactgttttataagcctcattctctgaatctgatcactttaaaattaggaggtatgcacttcattgctcagacccaacccaagagttccatctgacttcctggctttggacagtgctgacaagtcctcagggcatgccccatgctgggctattcacttggaaggagacaaatgcctaggaggcctggtttcaccctcagagagctagtctaactagagaaagaagccttaaaatggaataccatccctaacagcaaatgaatccataaaaatcatgtctcagggagcaatctcatgttttcttgttttcgaccgtcctgaagacactgtttggtattggtctttcccaagaggatgcccagattaaccacctcccacacagttgggtcctttgctttggggtcactaggatgtggaaagcttgctgccttgccatctgctattgtgtcacaggtgtctgtgaggtctctcatgtaggacatggtttcctcttgacacattagtgaggacttccacaaaagagggcaaagggaggccaatccctatgtgcttattccaagatgtattctatcaggacatgttaccccagttgttcctgcaggtcactgttgtctgtaagacagtgcacacactgggagcagttagcaagcatgcactcatcaccatatgcaccatgaaaacacttctgtgcagtattggtagttgtggagcttgcatttctttaaaagacagaatggcatttaaccacacttattgccatccaaggagctggtggaacataaactgttctgtatggttgcaagcacataagcctcttgagcaagttttctatgctttatgagaacaaaagatgagacattttattcttcaaaaatgggggactccaagacaaaccacagattaatcacaaaggagaagaggaataagcagttgcattgtgcatctctggtcattttgctgaggattttaaaagagaaaatggtgtgctaaagcaatgcttcatttcacattattgcacgtcatccatcattttgtatagttacctattcgtaacattcaccgctatctaattaagtgaaaaaattttgttgtaagtaattaagtgttttttaataggccagcattctcaaagatcatactttgcctgtaaggagacttcaagatgttgtctggagttttggagtttaaagtatatattatccttgtgagattatgtaaactctcatatttgtgggaatacaaatgagcaaaactattttgaaaagcttgattttaccaaataaagtctgagattgcatatacacagatccagcaatgcaacttttacatatacaccctggagtggtggttccagactttaatgtgaaccagactttaatgtgcaccataatcccctgaagggtgtgttcaaacacacattgctgggtgacaccccagagttccagatttagcatatctggagtgggaccatagagagtttgtacctctagcaggttcccaggcgatactgatgctgctggtcccagaactacattttaagaaccaccgtctcagggagacttgtgtacatacacgctcataagaagacatgagcaaaatctttcaaaaacattgttcctaataaccccaagctagaaacaactcaaataccatcaacagttcaatgaggaaatgaactgtggtatattcataccaaaaacccctactatatagcaatcaaaaggaatgatctacagctacctgcttcaacaggatgaatctcatgaagtgttggtgaacaaaataaacaaggcaagaaacagtatccataatgtgattccatctgtatgcatcccaaaacaggaaaaacaaaatcatattctttacaaatgcatgaacagatggtaaaactatgaataaaatctgataattgatcattgcaaaagtcagactagtaattatctggggctaggaggagggaagcatacaggtagtttctcaggtactagcaatagtctacgtcttaacttggcttaacttggctattagatatgttggagttggacttacgattattacttagacagaacatttgtatttatacacatctacatagaatacataagttttaagtatttaagaatcattttatcttttaaaaataatgtcctctatctggtatgtattctgacttttggcaacttgtttgaattttaggatctgcccattggttatgaaaaatcaaatcttttaagctttaatagatggtttagttattctgctgggtcaactattgaaatgaaagaatttttgttactgccaaatacatttgagatatgaactagctatgaacaaagtgttacagagtaaaagacctgtaaggcctaattggagaacagattagaatcttgtacagttagcatgtttatggtctgtgtaataagtcatgacaggccctagtagatcatcttttagatgttgttcatatctatgaacacatacataatgggagagattgacggctgttgccatcaattacattacattaaaactgatttacataatttccccaatacaaattgcgtgactacaagagtgaagattcttatgaactattttcttttggtggcaggagagtcatttttgaaatctttgaaaagaaggaaggattgaatgtgcctgttgattatattgtgatgttctttttccttccaaaaatgaggagtgggggacatctgtaactctgtgaggataccaggaatgctcatttctgtttcataatgcttactctgttttatcctgatattatagtcttgcttttaaatgtattgggctgaatctctttctttacatttttagtgtgtcctgtacaaacaattcttaatcatttttttcaccatatgtttccttgtggcatggtctgcatgtcccctatttgatcacagtgtggattctgaatttgcacctcccacatgctaagttgacagctgcataacctcaaaacgcattctggcaatgatgaatgccaatattttatgatgacagcccaagaatttgattgcagctgcccactgatataagtggtatctttattatttggtgagttaagcagacacattaagtacatttgttgcaaatactagactgtaaaagaatgtatttctgacttattatagtaaacagtaagaaacaaccaaaatgttcatcaatggaggaatggttaactaaattgcagtatagctataccatggaactccccacaaagaaagtagcctgaactgtgttagactccctatgaagagctttatatgtgttgtttcatttaattctcacaacaaccttgtgatattcccattttataaatgaggacacaaagacttgtccaaagtcacatagtaaattgtgcagcaatagttagacctaagttctatggacctccaaatccattttcttatccagttatactctcctagctcgtaaatgtcaaagctatacatgctgttgattctcttctcatggagattaggttcaagatgaacattaagttatgtaaccacagagaagaggaagagacttagataatagtaaaattaaacctatctaaatgtcaaagctaaattacttccaaatgaggtaagtttcctatcattccatgactgaaaggaaattcaagaatatacaccaaaattctggtaatatgtggtatccaagtcaggattttcatgtattctcagagctgttactctgcttaaaatgtcaaattataagtgaagtaagagaaaagccatgcttttgctcaaatgtaattatcgatactgtaaaatatcacttatatgtttatctttataacttctccttttaatatttacagatggacaaaagagaaagaaatctttaagaaagaaactggattcactaggaaaggagaaaaacaaagacaaaggtaaagggtaaagtacccaatgtaaatgcatcttccatggagcataatggttaaatttggtggggttattgaattgcatagatatacgtggttcaactctgttatgaaaactggatttctacagtggaatgtcattaagggctgttttggtctactcttctgtgtttgagcagccctgtactgaactgatgaattcagctggtttgaggagagtgtgacctcggccaagtttgtggttccaattattattttgaccaatcagctatacataaagaggacctgggttgagaagctatggagagcatctctaatgctaaccagctgtctggcaaatccagacaggcagggttagtttaatgagagtttgaattcacctaccaccactactggaaagaaacagtctcatcctcatgggttactgaagataggccattctcagcattttttttttcacccagttgaaaaatatttatttgcaactaacctgaatgcttacattttactttgttacattgcctcagccaagataggttaaagcaaatgcccttaatattttgggggtcacagagccctttaagaatcattgacaatgatgatgctctatcaaaggcctgaaactcacccaatgcccaccctaccaccccctaaattaagaattcccagattagatattcacttgagttaacaagtattttcctttttaaagatccaggaactttagggaatagtcagtggctattagtttttttgttttgttttgttttgttttgttttgttttgttttgttttttgagacagagtctcgctctgtcacccaggctggagtgcagtggcacgatcttggctcactgcaacgtccaccttccaggttcatgccattctcctgcctcagcctcccgagtagctgggactacaggcgcccaccaccacaaccggcttttttttttttttttttttttttttttgtatttttagtagagacagggtttcaccacgttagccaggatggtctcaatctcctgaccttgtgttccacccgcctcagcctcccaaagtgctgggattacaggcatgatccatcgcgcccggcctagtatttttttttaactcttgttttaggttcaagggtacatgtgcatgtttcttatataggtaaattgtgtgttgcaagagtttgttgtacagattatttcatcacccaggtaagcaccatagtacccaataagtggtttttcaattctcactttcctcccaccctccaccctcaagtaggctccagtgtgtcttgttcccttctttgtgtccatatgaacatgtttagctcccacttgtaagtgaattctcagcatttttatgttagatcacagtatactcatcttttgcttcatatgttttgggaattgtttactctcatcttactgttttgtgtccccttgtgcatatatttaggaaactaaaactttagccactctctgaggtatttatggtcatttaaaactgatattcaagctcacataatggacacctgagccccattgacgcagtccaattttttgtgccttttttttttttcaagacagggtcttgccctgtcgcccaggctggagtgcagtggtgcaatctcggctcactgcaacctctgcctcccaggttcaagcaattctcttgcctcagcctcccaagtagctgggattacaggcacgcaccaccatgctcagctaatttttgtattcttagtagagacgggctttcaccatgttggccaggctggtcttgaactcttgacctcgtgctcctcccgcctcagcctcccaaagtgctgggattacaagcatgagccaccgcactttttgctgcttatttttatagtctgttatgaagtggttgctgaatggtatggttgtatgcatttattttcactttatgtgacacagtcaacgagtcttgaatgagaacagccatacacatctcatcttggagtccttttatataatgatagaatttctgctttaaaagtaatggaaggcgatgaaaccaagggtattaaaacatgcattgggatcagtattggacaagagctattccataccattgatctcagtctctacacctatatcttgaacagtcatgacatttggttctttagactaaaaaaaggtgaagaattctaaagaatggaaaaccattgttttacttcctttggagtgaggttactcaaccttgctactgttgtcattttagactggataattatctggggtaggggctgtcctgtgtattgtgagatgtttagcagcatccctggcctctactcattagatgccagtgacaccaccctcaacccaaatatcttcagacatttcaaatgtttatctcaaattggaaaaaagaaggtgaaagtgtcagtgatccgcacccctgactacacaatagaatcacttgtggaacctttaagaagtccaagacccacaccccagggagtctgagttcgtgttcttcagggatacctcaggcatgggtgtttttaagagcgtctaaagtgcaacttctagataagaattttgatccatattaactaggatactcaccaggccacattctgtcacagcagaatctgctgctggaataatgagggctaagggttgtccagctagctattatagtctgataaattgtgttatatttaattgttgatatgtttgtgcccttatttttgtaatgacctaaatattaatagccagcattgctcttttaaactagagtttttgctcattctattcctgcagtagagcacttttatgtctccagattagagcaattttccatatgtatagagcatattaaagggatcactcaggttggtattagtaatgtattctcttttaaacttggtttattctaggatgatgatattgatattgggattcaaatacatctaatgtggactttaggtgatttttcagaaagtgtccatttggctagactaagcagaatgagcatttttgcaggaggttccctcaacagaatgatgagatgttccctcaacagaaggagatgtatgtttgcttgcatgtattatatatacaaagcagcaggaagcaagaatttgaattaacatggaaggaagggctagggaagtaatcgaacaatacatactgggccattatagattttttaaactaaatcatatttacataggctcagtgaaaactctgaaatgttctatagtgcctcgaaggtagctaagtgggaaaaggaaggcagatcctggtggttccaaagaaaagacatatcacccacccaactaaggggagaaatatcaggcttcatggcaaaacaaaacaaaaaaattttaagtagctttaatgtttaaaaacaaactaacctaggcttaagtgaaggttaattacatggcatcttttcagaacataaagccctgtccatgtcaacactgagagtcattacatggatatcctgggaaccagggtgtgaggaggacggggtgccggtctggcacagatgtaatctattcacattatttccttccagttgcgtattagcatttggatttgtaacagctgcacatgtgaaaaacgatcatttgaatccaagagtaaaagaaggaaaacaggaaactctaaatgatctcttgagttaggtcatctaaaaataaatagaagcagccttttagaatcgaattgctctcccaatagtgattcataaatggttgatatgctaccatattaattgatttcatcagaatgaatcatatcctgtatgttatttaattgccttgatatacagcagatcttgtgacactcctatgttcctcatgccacttaggcagtgcccatgtgacttttgatttacatatgggaactaattcaagattgacactgatcagaaaacatattttcatacagaataattccaagtccttaatttctcttagttatatttcttggcaaccaaaagtgtttttaaaactttcagaacttcagaaaatttctgtgtcaaaagtaattttaaaattaagtaattttaaaaatagctactttgttttattaatgtgcttcctaaactgagcacatggggaataggttttactatgatgtaactctgggagattgtaccccccacaacccctgccaggacattttcagattatgccatatatgtatctacatacaatctggaaagagttcaattctggcactgttctttttggtgaaagcatattgtatcatgttttcttttcctcactgtctaggtatgtaactgtatgtgagctgtgaagtaacactatatacaaatagctcatacaacttttaattttgctccacattaaatagcagaataatcaagttatcagttatcactatgtagaaattctcaaagaacatatattgaatgttgtcattgagtgctagtacttctaggataagaagagaagaaagaaccagggagtgtgtggtttctgagaaggttaggaaggggccagctcacacagtactgggccacagcatgacttctgatttggaagttcaggagaaagataatggtaccttaggctagggtgggagtgatcgtggaagtggagagaagtaaatggaaaaaagagataatgtgaaagtgacatgataaagatttgatgacggagtgaaaatgagatgtaagaaggaatgaagtatcaaggatgactctcagatttctggttctcccacatgaagaacaggcaaacttttggaaatctgagtaagacctgataagggaagatgaagaataagaaatgcctttgggacatccagatatgaaggtggaagaagtggttggtgctcaaggaaggggtctgagctagaggtagcaatgaggtgtgaaatatctatggatggaagtttaagttacgggcatcgtgctgtcacttacagagagagaccagagtgatgaggatggttaagattgagctctgaggaccttccacattgaaaacccaggtagaagatgataagccagaaaaaggggcaagaatgtagccagagaggtagagaaaaacccagttagtatatccaggatgcaaaggacagggagcatttcaggaaatggcgatcagggttaaaggctgacagaagggcaaatgaaacagagctgtcaaaaacactgaatttaatgaccctgaagacagcaatgatttagagggagctgctttagaatctaatggaggtaccagctagacgggatgaagtgaggaaagagtggtaggtgagaaagttataagctagaaagtaaagggaacactttagacaattttaactgtggcaaaaggagagggggtaaaccatggagaaaagaaaagagtgggtcgaaggttgtttatttttttaagaaatagctgcttgaataaatttagtacaaaatatctagtagaaaaaaagaggttgaagatacaggcacaagaagatgtaatttatagcaggggtggcccaccagccgtctttgtaaataaagctttactagaacacagccatgcctattcatttacttactgtctgtggctgctttcctgctaaactggcaggtcgagtagctgctacaaagactgcaacctgccaacagtgcggaggctggagtgagacaaattgagcccctaggctacagaattgaaagaaatgccaagtctgcatgctgactctgcacttgccccacgctgaatgcgagcaccttatcattttgcatcctagccattctaagccccagccgtatccacaaagcctaaaatatttactatctggccctttacagaaaattgctgaacgctatttatacctaagagtattaggataatttttttgagctcttgagtgcagtacaccattatccatggtttaaagttatccatagttgaatggcaggtgggaaagcatgggaaccagggagaggcagaaaggctggcaggatgccaagtcacacctacatctcatgcaaaggagggtggtggagggcacaggtacagcaggtgtgaagagttggagcctttgcacctgctggttgctcttctcctgaaacaggaggcagaattatttgctggtggggaagatctgccccagaggtataagaagtctctaaacgagtctggttggttttccttagatggaaaaaaatgactgggaaagggctcagtagtccctatcttatagtaaatccctgccatgcatatgcccacctgagcagacatgtcacttgctacatttatcaatgttcttttcactcttattatcccctctgtttctgttatttcatgtagctgtcagccttaccatccacatgtttccagactcttccaaccttttaaaagtaatatttgatcatttctacagacaagattatatgtatgtgtgtgtgtgtatgtatgtgtatatatagagatatatctatatagatatatgtatatatatatatatatatatctcctcagggtacataacaggaggtctggtactatcccctttggtttctaattttgctagtagtagacacagcctattatcaatagtgagaattacacctcactacactgtctaaattgatcactcaaaggagaagtacctaattattttttattaccatatatcacctagcttgttgctaaagaatggcaagcatcctctgaaaatcccgaaatactaaagttttgacttttttacttcaaaacaaattgcatgctttgatagaaccagaggtgcaggcttttcaagtagcatttctgcttttaatgtagacttggtcattagcccagtgatgtttgaaatattgccatggatcaaggaggaaaaccttttaaagtctctttctacctgatttaatgttagctttttctttcaaagaacaaccaaccttagaattattttcccttgatcattttagtttcattcatagggcttataaaaacaatggagaggttagattccaacttactgctgctaggagacctaatttggagtctaaaaagaataatacatttgattacattatttagtgcctttcagcatgaatctaaaatattgccaataaaactcctggccctaaggatccaaggtacatgtatacaaacagatttacgacagaaattcagaaaggaactctatgtatgtctccaaataaagccattgatttctgcactatgcccctttccccaaattctccttactaaaggatttaacaaattgtttcctgggcctcccaccagatatttagtggctgagtccactctgcatgtggccagtagaatggcttgagtgtagatcacgagagtgacagccccaacatagctggctggaaatagaatgtagggatgaggaacacaacgaaaacagagtggacttcttcccaaccagttcccaagctgctcctctgcctgtcaggttatcatttcacatgctaactcttactgggaacctcaaagtgtattcagttaactaaatttcagccttagtttcatgcatctctctaacacctgatactcactctgttatcatgatttgcatttctgattatccactccttcaccccaacccacactctgaacacctcaggagaaaggactgtaccttttataagctttgcgcctcccattgcctagcttgttgtggcatgtagtaggcattcaataaatgcctgttgaatgaatggatagacttgaaacatggagaaaaactagagacctaaatgtctaagatgtgtgtttataaatactagttttctttattgaaatggaaacttgggccattctgattaacacaaatgtcacctttttgattgatgagtcaattcttcagaaaacattcctttgaatatgtctgttcttacttaggtctgaaacataaatgagagtgttcactggaccagtcagtctctgaaagtgaatgtctgttttttgattccagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggagggtgaggtggccagtatttgctctgacaccagtgctaggaaaactgaagatgtacagttattctttgcgtttttgttcatgtgaaaactggatatgtagttggtgttcaggtatctgtcaacaatgccattaatgaagaatgtgcactgggcacgtggcaccttgcatagcctcagaccttgtcctgactcctcttgaagctgttgggtgtccctcctttgtcacatctttgctccatgctctcctaaacattcggcaatatcaccattaattctggtctcttgtaatctgtcagtcttgccatacttgcccactagactgtgaggctcgagggcagggcctggtgttttagctattaatactttcttcatcaccagtctgagaacatgcctggccaaatgaattggcggtgggtcttcataaacaatgagctttttctttatcaatggagcatttctttttctcaaacagaaccatagaatcctctatatatcctctttcaaatactctaactatatggtaccaattgttaagtactatgttctaggtactgtgctattatttgaattgttcatgcaaactggttggtgattggctgagtcagttgataagcatctctaaagcttccaggtcactggaagatcttctctcccttttgtaaaacaaatctgcattttatttttatcttttattttttgactcagggtcttgctctgttgcccaggctggagtgcagtggcatgatcactgctcactgcagcttcaatctcccgggctcaagtgatcctcctgcctcaacctccccggtagctgggactacagatgcgcaccaccacgcctagctgttattattattatttttagtagagatgtggtctcattgtgttgcccagactggtcttgaaccttcgaattcaagtgatccaaagtgctgggatcacaggcgtgagccgccacgcctgaccctctctccctttttcctctgtcacgtggagacctgaaatttttgccacctccagctgttgaagactgccctagttaaaaccccagacacttcccacttaaaaccaacatttttcaatcagcccctaacatttagggcttgtccaaggtagagggggacctgatccattgctgtttttgcagtattgactatgtttaaaaatgaagaaattacaaaattatggaattcctgaagttgcatgatggaattgttcttctaattctgtcattgtgtctcagactgtgtattgtcgtacaacaataacactaaaactctaaattttagctttctgggaatgtaggactcaggcaatggttttcccaaatgccctctcgtctgtccaggcctggctagccaactgctttctcagtgcttcatcaagtatgggtgcggcaaatgcgactggtgccctgctccctttccctgaccctttaccattcctagcatgccagctcatcttccatctgccaacaccttatttatttgctgagggctttctctgatgccagaggcacccagcctatccaaatggcaggctgtaagtacttaggagataatattatctctctgcccccaccagaggctacccttaagcagtgattcctgaggcctggtgtataaataccccagctctctcacttgatagggatagctctaaggtgcatgatctacagctgtctcctagagctccccagaaagattgagctccagttgcccacaatgataataggcttgataatgctcccttcatcagctgcctttccttccttgtctcatttcccccctcccctacaggtgtttcccaggaccacttctctaataaagcactttgtgttgtttctcgggaaaactaagctaaggctgttttgtggaatcattctattttaaaaatatacttcctagagccatagttgagttttttatttacaagacttctctgactacctcattgattgagtatgtaatttttttcttgtttcaagaaatgaagtggttgggccaaaatactttaattatatgtttcccatcgcttgttcttccatttggaaaatgttgtctattgttgaaattgtaactgccattagcttgaggaaatcttgtagaggttttctaactttttcaaaaggcatcttttttcttttaatttacaaacagaacaattaaagaaatcaagcagtagtatttcaagtgtgataaagagtcatgagcaaaagtatgtattggttagcatctgggggcagctgggttttttggctatctgtactttatgttcacggctctgtgtcacttgcagggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggtaagtagacttgtctgtctaaagtactaaggactttcatttattcaagcatcattcactgaagtacccaatgtcaattctgcttgatcaaatgatcaagctctgaactgaaatttactgtgtgaaagtgtacagatgtgagtgtttgcttaagagattgtggggctaaacaagattggagaagagggtgaatcaacttgatgatattcagactgcttagctcccagtagtcctcagaagttaccttggaggccaagcagtttagggaatgatcagatctgttgggctgggtttgtcaccaggacctctttcaaacagaccagagccacttttattgtttatacataaaagtagcctaggaggttactcacaaagtttcctttaaaaagtaagagtccaacttaaaaaaaaaattggggaatcattgcttaagtgaatagaaaatacatcatttttgacaacaggtttacatattgctatttgcatttttgtggaagctgtccacttaaaatttctccaagccaccctttgcaactcaattctagttactaagttgacttaagaatgatatacagttcttcaaaaatgtttctgaaatttagacttctggcttattaactgccattttcataaactaagtttgtatgctatagtgtttgttagcacgtgttttatatacatgggaaaagcttaattactttttttaactgtaaaaataatatgctcattgtaataaaaaagtaaacgtgaaagcaaagaaaattctgaggctaccatatagatataactactgttaacattctcatctatttccttctaataaaaatggaactttattttaaaatcattaaggatatatttaaatttcttaattcattacaatggaaatcataggataacatatggatgacctaataaaactaatgtagcaaaatcttatttgtttatacaaaattttaagtgtaggttcttttaatttttttcaccttatctttcacttgcctgtgtatcacctatgtatcttgaatatacatctctttctctatacacacacatacacacacacacacacacacacacacacacacacacagtcatgcaccacataatgacattcccctcattgactgactgcataggcaatggtgattgcataaggttataatactgtatttttactgtacctttactatatttagatacacaaatacttaagattttgttacagttacctacagtattcagcacagtcgcatgctgtacaggtttgtaatgtaggagcactaggctctaccatatggcctaggtgtatagtaggctataccatctagggtggtgtatgtacactctatggtgtttgcacaataatgaaattgcctaatttattgcttctatcactttggaagcttgaaaaccggataatcacactatttagaataaaatacaggattatatttcttcatctgcaaaatgaacgtaagtacccacctcaaaagttgtgcaatgattcaattaattaatgtgcatacagtacttagaatagtacctggcatatattattatatagagagaaatagactctgagtgaactgaatgaatcttctatgtacgaaatagaaaacttcaatagtaggtcacagtaattttaattttggctgcatttatttttttattttcacatggtttctgaataattaaaatttctacagaagcaagatatcacataaggacattttctacacaggtgggactattctctttctaccaagagatagaaaacacaactaaaacaaattgagatgtttactttgtttctggatgtaaagaaataatgttataaagatttaaggctgggcaccgtggctcacgcctgtcatcccaacactttgggaggccaaggcaagaagatcccttgagcctgggagtttgagaccagccagggcaatatagcaagaccccaattctatatttaaaaaaatacaattctttctgatttaattatatattgtactagtcataaatttttcagtggcaagagaaaggaactcagaaaaaactagattaagcaaagtgacctcccccaaataacaacaacaatctttatatactgggagcgtgatctagatttaggcacggctggatccaggattcaaacgatgtcatgagtgtcctctgtttgctggctttattctcagacagttctcttcatgtggcttcaaatggcggttagcagctccaatatcccatcactctcataactgattgtctcaaatgaagagaaaatgagccaccaatgaaagaattaatatacatgatgctcatcaatggcaatgatcaatgactggcatagaaaaaggagagccattcagacgtttcatgctcccaaaggaagtacacaatactttttgtgaagtattcttgccctataaaatcacaccgcaatcagagtaatgtctggctctagctatctctttacagaaaataaaagagggagaagaacatacaaatgacactatggagtgtccaaatccaaacaatatgaagatctacagtaggaaatcactgagatttcttcaccaaaacaattataaggaaaaaggagacagagggaggaaacacagattaagagactaaaaggcacatcgaccatatgacagtgtgtgacctttatgtggatgttgactggaaatttaatgctattaaggaactattgttgaaatttctaatatgtgatagtgaaattacttgtgtttttaagagacctaattttttagaaatgagtttctcaacctcagcactgacactatattttcacatctaggacatgatcctaggaaaagcaatcagaaatgtgaacaaaaacgtgtgcacagaattgttcacaatagggtcatttatagtagaaaaataagcatgtatattttggggacctgtgcaccattcagaggggaatatggagtaaattatggcccattcatacaatagaatattttgcatcttttttatatctccatagattttgggggaacaggtggtatttggttacatgagtaagttctttagtggtggtttgtgagattttggtgcacccatcacccgagcagtatacactacacccaatttgtagtcttttgtcccttttaagtgacatttataaggaattgttactagcatgagtgaaaattcatgcgacacgatagtgagggaaggcagtaacattctctctgtcaatagatattatatatatgcagtgtgatctcaactatgtaaaaatacctacattcatgtagaaaaggctggattttaaaaaatgaaagattagctaggcacagtggctcacacctgtaatctcagcaattttggaggttgaggcaggtggatcgcttgagcctgggaacatggcaaaaccctgtctctccagaaaatacaaaaattagtcaggcatggaggcatgtgctggcagtaccagctaccctggacgctaaggtgggagaatcactgcagcccagaaggtcaagactgcagtgagccgtaatcacgtcactgtactccagcctggacaacaaagtgagaatctatctcaaaaaaaaaaaaaaaaaagaaaaaaggaaaaaaaagaaagaaagaaaagaaaagaaaatgaagagtgattatttctgcatcaggtatttctaaaagtatattatttttacatttttccgcattttctagattttctttaagaagcacactttaattatgatcagacgaacaagaaatatcttttagaaattaataaagagttagaatccctataaaatgtgtgtttaggtaataattctggataatggacaaaagctcattttctctgataaggagaagattagaaatataaaatatcacaagaaaaatatttgatcagaaacatttaacgtaaaattctggtgcttaaagggctgacctttaagtatctggataatagaaatagtgtgagatgaaagaagcattactgtatgctgtcaagttactattgctctacatgttacggcactgtgctggcattctgctctgtattttgatttcctccagggtctcaagccatgaaacaagactgttcattttgtttgcttatttgcaggcctccagacagtggggatattccgagttggaagctcaaaaaagagagtgagacaagtaagtgaaaagtaaagattatattttgtttcacatgactttcaattgaattaccttttgcaaagttcaagtttatgcaaattccattttgattatctttttttttttttttaccctccaagctattataatataattgaattccaggaggtaaaaggcaacaactcagaaatgttgttacagttaggatcaaacacttgaaagcaaaatgtctggatgtatctgtgccacgtgcagccaaacaaaactaatttataaacatcttattgaaaattgcaaaagcaggaaattcagagtgactgatcaataaatgatataaagttgtatgtagcacccgcttttactaaaatgtgatatgaaaaatgccattaacattcccttcacataagatgctatgtttatagctttactttatcaaaaataaataattcttatgaagtttccatagaaccattgacccccagtttgcttttcacatagagactgtgctcctttgtttccttcagccctgtgcaacattcctgcaactgaagtttgatattagaccttcaacaataggttcctgtgatgaggcaggtatttgtgttcatgatggcttcataaaaggcaaaccatcctttgagaaaagagttcatttgttggtgaaggaaaattaaagcattattttcttcctgttgttttcaatggaaggagataaggaactcagcaactcaaaaatgaattcaaatgaaaataaattttagttggaagaagctgaagaaatgatatttgttcatattattgaaagtaattgaaataaatacctcatttatcttttttgtcaagacaaaaaaggctttcaacagaaatatgttttctgattggttggttggtttttattcttaatagttacacaagaaacattaaatggatcaacatttaatgtttcacaacagaacttgcaggaagaaagatagtacagtaacatttctgtgcagaattgcagaatatttttacaaatattatctcactgaatctgccaaccggctgtgagtgtagcccctttgacccacttctgtcaaggcttatagagattaagaaacataattcaagatcacacagtttaaccagtcaccattaacttcataggccaaactctttgcatgttccattctttctgcatgtacgtatactcagaaaagaagcatggtgtgtttgaatgatcacaagttggaggagtgccagtggaagtcttctttgttttggctgcctgacacacgctgatggcgtgctgtctggaatcaatgagtagttcaggacagtgatgggtattcattctcatcaggtggacaggtagcgagtgccagaaattactcatcagttatatcgggatccattaaaggggaaacctttgcatggagttgtatttaaggattacccaataaaaatataattagtgtttacttagaagtagatttcaagtatgaaatatgccctaactcactcatcattttactttgttatataaccccttagcaccctgcactttttccttagatcactagccacaatgttaagagtgaattatttgtgggattacctgcttatcacattgtttctctagagggactttgcctctttactcactagtgtattttgtgagcctgtaacagggtctgacacaggaaatgcgtagtaatctttgttgaatgaatggatggatgaaagattgaaaacaaatgaactcttagagaagttttttgcatagtgtaggtttatgaagttacataattatttctacagcagagaacaatgcatacgaaaagttgagctgctagagataaaagtagggtgtggagttattactcccttgctactgtgttttcttgctgctgcaagtgataatagacctagtataatgattaaggcagggaatccttctggtaattgttaataagactactttgacaaatctaagacagcttttatttagttattgtcatcttttaagtcttagtcataaatgtgttatcagggctcttaatttcatttttgcagaaaaaaaaaatctctttgctttcttatagagtgactcagtaaaatatcaacatccaaacatggcaggattggtgacacacagaaatgctgtgtaatagattaattcctccctcccacatttatagctgacctaaattgtcttctacctcttaggtgttcctcctaacctggttgtcattaccaagcccttctgcatacatcattaacaataaatccacagatagttttatttaataatgcttatatatatatatatatatgtatacatatacatatatatgtatatacatatacaatacatatatatacaatacatatattgtatatatgtatacatatatacatgtgtatactcatatatatacatatatatgtatacacacacacacacacatattcatagctggactgtgtcaactcggcagatcaaggtgaggatgttgtttgcttccccttcttggggtctgtgcagtcttaattccagatgctacgtgtcacagcacttctcctgctgggcactgctcattgaggtatggtgttatgtgactgccactcgaaccattgttcttccagttacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctctgtgcgtaatacagccatatgtgggaaagtggccctggaatactaagatgtccaactcattcatcataactttatgcatatgtttcctgataactttttgtccttatttatcaatctctaaagagtgagctatttgagggaatttctcagatttaccctgggaataattagcaagaagaaagttacaataaaacaaatggaaatagccaagaagaatttgagatgctttcaaataacccaagaacagtaaaaagtactatgagttagtgcttagagtaccaacaagagttcacattgagtctgtgcctaaaaatgagtttgtgtttctggtacgaagaaggagggaaccacgagaacccagagtgagaaaggagggcagcaacattccaggagaagcaagatgccatagcccagtgccagggctttcaacatagctgcttctgggctgtagctacagatcccatgaagaagaaaaaaaggaggaggtagaggagagataggccaaacctgggtcaacctccatacatttcttcctccaatgctgccattcaaataggatcacaacggagagagaagacattggctttgctgtatcttggttattgccaacaaaatatctgtcccttgtgaattgctcaacagaaaagagccttaaatccattataaactcaaatttcagaatgttcaccaattttcagccattgttaataaatatttaccaaaaatggaagactgaaatccttaaactaggtgatgagtaatgccagggaaggggggagaagaaagtaagggaaattgagttaccttttttttttttttacctggattacagttatttttctaggtattacacttctcgaggtctaatttggctttatatctttcatagaatcttgctggtaaattgctaaagcaatgggcaaatgagtgaaggcatgaaatgggaattgccttgataatccctttcttaagacaattgagaggaggcctttcctctgtgcctgaatagtatgggctccccttttatttgagtacctctttttgccttgcttagtgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtaagatgcctttgctgccatagatgccgtgactcttcctctcccctattttaaaagggcataccaccaaaatggccattttgcctggaggtaatgatgtctccccttctccaacctagctgtctctgtaggaagagactaatgcagggccttctctggaggcacagttcctaaaagtgcatgggccatgagcctccttatatgtttcaagtatgcttccaaatgaggctgtcattttccatggtgaggctttactcaagactctgaacttccgtttgtaaagaagaaaaacagtgaactacagaagtgcttgcaaccatgtaaaagtggaatgatgggggtgggaggagattgttatccttataattgattttacctgcttctataacttggagcccaaatatgatgtcacctctttattcttccagtttatccctggagctcccatctgcactatgagcaagaagtctagtgtctccctttcaagggatcctttcctttcttaaactctccccccaaaacagggacttgctcgatgcaagggagggtcagtcctgcttccaaaccaggtgtggaggaaactgggtctgatctgctgaccattgccattgtgtcttgatgtcacatggtatcaactgctcaaagcaggttgtacatagtcccacagactctttagaaatgttcttgttggatctgatccccactcaggccccagtgtgccccccccccgcccaccaaatctaagatcttgggttctggttctctttggttacactcatatatttcaagatttttttttttgtttcacccttggacaaatgagatgctggcttgaattttaagttgcttacttatgggcaacgtatttaatcttcaccttaacaagagacacccccttccctctttgataccatgcagttatacctctccctgacctcggattcctcaggaggttttagactccttaataagctaacatgcactgtaaatcaataagaaggggccagaggcattccaaacttacttaaccacagaaacttttttgtaaattcttgttaaacaaagctcagctgcactgcagcttcagttctgtgtttgtcaaatttctttcccaaagaacgtggttatgtataatttttttcactctaatccagaaaggcaattctgcatttcttctcgtcctcctccttacgggtgtgagaatggaactctcctgacttagccatttatctctatagcagttataattagtgaagccccagatggcttcaggtttcataatgtggcactgacaccttatttcagcatacacagctctttgatgggcatactataattctcataattgttaagtagttttattactcatttggatgccaacctctatcaactacagttataacagaagctgtagcatgatctgcctaattgctgggggaaagcagagctctgtgtttaaaggtactccagttacttctctgacatttcttaagtactgtgtgagaaggagaaaattgggtctcaggtaattaggaaggcattgaggaaagcaaaagttccaatcgaactcattgttgcccttttagaatcattttcagacattctttccattcaattgctgaacaagtctccattgcctatgccaaaaagaagaaaatattcttggacaggtgtaaatgaaacagcatgctggaatattagctaccatttatgtctctccttccatgagctggctttgtgctaggggagatatatatatatatatatatatatatatatatatatatatatatatatatgcatgcaaatacatataaatatataaatatatgcaaatatatatatatatatatatatatatatatatgcaaatcctcttaacaggcaaaagagatatcactgtctccatgtttcagaagtgaaaacttagggccaggggagctaagtaacttacctagcaacccacagagagcttccacttaaggttgtacgagtggcatattagtgcatttcacaactctaggggaggtgccatggaccccatagtcactggagatttgcagagttattaggacagtatcccagtggatgatagaaaaagatcttgaagaaggacaatgtcgttatactggttaatgggttgggttggtccccttactagcaaagtccaagctgtgcatagaacctgagccagtctaagagaaaagacgtacagaataggaattagaagaaaaaaaaaatgtactggggtctaggtcatggtttctcagcctctgcacaattgatatttggagctaggaattctttgtcatggggccgtcctgtgcattgtaggatgtttagcagcatccccggcctcttcccactagatgccagtagcagtacatctcctctcccaccaagttgtgacaaccaaaaatatctccaaacatttccaggtctcccctgaggagaagggttcaaaatcacccctggttgagagcgcttgatagctctttaattcactgaccatgtgttgttagaaaaatctattaaccttcctatacctgggtctcctcatctgaacttgaggaatgaaaattcttcaaccagccttgaagagtggttgagagacctagtttactgtaaggaatatggaattatcctggtgacagtgaagttgtaaaaggaagccagggtttacgagggtttctagacactcttgacctgaacattgcatcaaaatgaaagactaatagccaaagattaaagcagcaggagaaatataaggaaagcattgcttccgtgaaatcgttagcagtgacaggagagcaggcagctctcacagccattgtgaactgtagtaaaggctacggagcagtgaagtactgagggagacaatgggaaattgggccatgttcataaattgctgaatgcctctgtgcagggcaggtggttgattcttttaagctgtgaatccttggaaggattcaactaatgggtgatatgatccacgttgtagattggctagagacaaagggagagtgagttaggaggcttttgtatcaatagtaatatggacaacagcaattcctattataaacatttccatgtaagaatggccttggcgggccaggcgcggtggctcacgcctgtaatcccagcactttgggaggccgaggtgggcggatcacgaggtcaggagatcgagaccatcctggctaacatggtgaaaccctgtctctactaaaaaaatacaaaaaaaattagccgggcgtggtggtgggtgcctgtagtcccagctactcaggaggctgaggcaggagaatggtgtgaacctgggaggcggagcttgcagtgctccgagatcacgccactgcactccagcctgggtgacagagcgagactccatctcaaaaataaataaatgaatgaaagaaagaaagaaagaaagaaagaaagaaagaaagaaagaaagaaagaaagaaagaaagaaaagaaagagaaagaaagaaagaaagaaagaaaaagaaagaaagaaagaaaggaaggaaggaaggaaggaaggaaggaaggaaggaaggaaggaaggaaggaaggaaagaaagaaagaatggccttgggatttgaatcatgcatgtcctgagcatctaccctaggttcctgtaaaccaacgactattgctcagaaattttctaatgactggcctcaggatacaatggcatctaagaggtggaggaggtgaggacacaaggcaaatatagaattagggaatgcactgcagagtcattgcagacattcggagaagtgatgagcatgggccagaaaagttaggaatggcttcatggaggaggttgaatttaagatgcacatcaaagggtgtgtagggattgagtacatggaccacataagcacagcattgggatgggagttagccaaaccccttctgttagaagtcaagggtagagggagaggatcaagagaggagttatttattattttttagttgatttggcatgagcaggtagagaatatggaatgggcagactggagtaaaactaaataccaaattgtaaaatatggtcaaaaaccaatatttttcaacttcttctcttccctatttttttagtatgtattatctatttgttagggtgttgtttggggggattgcaacatagatgaaacctgaagcagattgtcaagaagcttgaaagctcacacaggttctgccagcaccttgctgcataacttgtctttatgaaagagaggaagaggaaggaaaacagagttgggatggggggtggtcttagcttcctcatctacaaaatgaacataatattttctctttgatatgtgcttaaaattcaatgcatcattcactggtgagaccttaaagatgtctaaaagaagggcatgagaaaaattgttgaccaatcagtgcttttttgggaaaaaatagcagtattttattgaattgtggtgttttgctatcttgtgtttgttttgttttcttctattttgtttagtttgctatttgctttgctccttagggaaaagagaaattcccaagtgtaagaaacattgcatttcttcaagaaagaatatagcaggaacaaaattgaaacctcctgagcagtggtttttcagagttcaagaaccccctggcactgcctggaaaatgtggtgtgaatatgcacttgtttggtgagagtccgtagctggcattgagttctcaaagggtctatgaggcaaaaaaagaagttacaaatcaccagtgtagggccatgattactaatctctgaggaggtacatgcctctaggaaatggtggttggctttggaacttagcaagacctgtgtctcccctcaccctcattcagccctgttttaaagctcgttttcccgtttccccatgccatggctgggtctgcccagcaagaggaaacaggaagagatgtagcaatgggatgaagagagtagggctgcctagagtggggccaccagcttcgcttctttctataccatctcctggctctgagctttggacatcacttccctcgtctataaaatagggacaacagcagcagctgtttcttaagcttatagtgagaaagaattgaaatggccagtggaaagcccctagcctggtacctgtacatattagacttttaacagatatgagctattcatatgaagcttagaaatgatctaggatgttcatttagtgaagataaaagttttcttgaattgctagctaattaaaaaatgaagtaatggcctggctcgagtgtacgttgtattacctagacacagccgtatagtatatatataaatatatgctgaaacacatggagaaaaggtggatgttgcctgggagcaactcttctttccctgttaaaaaacaataaaacaaaagaaaccccaaaagtgttaacaaaccccagcagcttggtctgcagctggaatctgtgtgcagttttacagatgggttgtattccattcccagaatagcaacaggagaaggaaagagcggaaacagagctctagattgttctcgtatgaaacattcttttaaaagaaaacaaaatcttccatttgttaatgttttttttaaaaaatgagaaaaccctaatatgactttacaggggtaaggggaaacactccaaatacctctgagttctaaagggaggaatttgaaaatgacacgtatttgattttcaccttaaccatgaatttccaggaaaagaaaaattaaatgaaaacttgtcaatgaaataaaaaacttaccaatgaaataaaacaaagaaaaatgattggacgatcctacataaagggcactttctttgaaattgtcagtgtttatcacatgaaatgatatcccttggaggccaatcattcacctgaaaacagccttgccttctaaaaataatacaactcgtgtaccaagctgggattgcagggcagggcagccaccagctcatgacgccacaggatgagagtggggttcagagggctttgtttcagctgttcattgggactcctgaattctatgctgggcacccaggtgtttctcaaaatctatgtagatcttcccaggcaaaagatccccaccaagcagacgcagttcccatacttatcctgactctcaactgatattgacaagagaaataaaaattcacatagaccagtggttctcaaccaggagcaattttaccccacaggggacctgcgaccatgtctagagataattctggttgtcacaactgtgggttgagggcaggggtgctcctggcatctagtgggctgaggccaggggtgctgttccacatcctgtaatgcacaggacagcccccacagcaaagaatgatctggtattacatgtcactagtgtcgaggtagagaaaccctagcctagagaaacttactcagactctcccgttcacctgaaagaaagacaagtagaaaaaattcccaaacctttgaaaacgttcatattccttattacaacaattcaacttgtaggaatttactcctaaaaagtgctcacccgagctcacaaaatatcttttcaaggatattttttgtaccattgcttataataacagaaaattcaagacgacatcaatgcctattagttgactgtggttaaaaaacatcatggtttattcgtgcagtgggattctaggggccaatgaagcctgaagacaggattttttttttttttgtagtggaaagattattgtagcatgttgttaagagatagtaagcaagttacaaaataatatatggatgtgatcccagttttaaagaagaaaatatcaggtgtacatgtatatatgtgcacaggaaggcataggaatggctgattcttggcagtggtgaaattatgggcatttttttttcttttggcttacctgtgctttctaattattaatatattgaatgtgaataattttttatgcttcaagcaaaaaatagttcccttccttcaccccgtactcccctttagctcctcctacatttcttcttcctccttctctgtgatatcttttgaagaaagtgtctacattcactgtttccacttctgcaactgtggctcattcctgccacaccactgacatgactcttagctgggacatcagaaccatcagagagtccattctggagggaagggtcacatctcgatgaccctctgccacagttgataactcacttgaaactcccctgtcatttcttcttggacacaggtttcttttatggtaacttctcacccattattggcctccttcatcagctgctccttaagggtgctggagtctccaggaaccccttttcagcccttcatgttcctcacttaactgtccttccattttttcatttgttaaaacacaagatccttaccctctgcattatcctcttcaccccctccgtaactttggaagctgctcttcatccctacttcttccttcctagttcagatgctagctgctgtggcctagactgttgtggtatgtcccaggtagtcctacttccttgcatcccccatcccctgttccatagattgctcttcctgaaatgcagattccatttccattctgctctgttcagaatcctcttgcccttagatcacagtttgaattccttggtctgacacatgaagatcatctcacctggcccttgcctgcctttcctgcagaactccctaccacactgagcttcctggggctccatgacgtattttagatgtttctgtctttgcatgtgtggtgctttctccattgtaaaattaccccctagcccagatcctttgcttttcagcctagcaaactctattcttcttttgagagtttgtgcaaatgcttccgcctctgtggtagtgaccctggggcctttggagttgagagctttatactttgtactcattacctgtaagtgataggtttatttcctccctagaatgagagacctttaaaataaggactatgttgtaatcattggaaaaattttaaaataattacaatatatgaaaaatgcccagcctatgataggtgctgagtggatggatcagtggtgagattatgggttgatgaatgaagggatggatggagaaatggatagatggatggatgggtgtcaatatttcttaagtgcaaacaggatagaaattttatgtagtacccattttacaataaacaacttagagttgcaaatttttattcaatatgctattgagatgatcactgaactgtgagcttcaatccaagatattaaagcaaaaggaaaataatgatgccctccatggattctgacagagaggatggcatccttgcaggattaaaaaaaaaaaaggagagtaaaaggtttcattgattgttgaatcacccagtatcttgaaaggcaaacataacaacagtccttgtgttctgttctcttataggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggtaggtggcccttctgtggcaggacatcacagcaaactgcctattggtttcctctggaggcaggatgaaattctagtagaccaccctctggggtgcagtgctgctcactgaattcattggaagtcaggcagtttcagcaggagtagaaatttgcacaactatgatgtcattttgagtttgtgactccatgtttaaacaaacatgccaaattataattttcattttgttgtcctctaaaccatggtcacattttggagtcacttaattataaagcagtgtccttgctcaagacattaataaaacccttctttatggaattgtgtccctcatgaattcatgtattcataagcatcctcagtggtttcacctcctccaaggtcaatcttgacattttacctcctacatgaagcttcacctctccttcctttgtccttcccatgccacttctctgtcccctgaactccattactgttcttactgatgtttatcttgcccaacattgtgtatagtaatttatgaccatttcccctagtagagtataaatgcatttaaaacaaggactgcaccattgttatctcctctccatatcctctgtacacttttggaaagccctccatctggcaggcactcaataaatatttttttgatttgtattgaattaccagttcctgttttccttcatcaaactgcattgcttgctacaacttcccttgaaacattaaaacaaatgccaactctcttctatttctgttcaccactaatattgcatgtcaaaatttacaggaaccttcttcatgttttttctcccatttctcttgtcaatttgcaaacgctataaagcctgcctattccactagagccttttgtggctccttccttcaaccgagaattctagttacctcttttaaatttctttagtagtttgtctacacttatcaagtgctttgcattagatttatgtccatgcttgtcttatactaattactttttgtaaatttgagacccagcagtttagagtatttgccctctgtgtcttacctatgtgattgtgaccaagtaattcaatactcattatgcatcaattctagctttagaaatgggaaaaacaaaatgatgatgtaattctcagggtggtgaccagaatcatttgatacgtgaaagtattgtgcaaactgtagcagtttatgcaactgttaattagtaattatattagttgggtaacacgtgctgcctcaaaagtcagtactttaacacaaacataaatatcactctgacataaagtttaatcaggtgttaagtggacagccttccaggtggtgatttaggaatcccagctccttgtattttgaggctctgacattttttagagttttacgggcaaccccagaaaggtcatccatcttgtccactcaaatctcattggccagaacttatgcacaagccacacttaacttcaagcgaggcttgaaaatgtatcctggttggatccccaggaggaagagcaaatgaaaagttcactgaggtagaatggcatcttgttcctgtttgtgtctctgaagcactgtccctgggttgcacatgctaagctctcaaaaaatgttgaattaataattgactctatataaaatttacacatcagcctaaatcctcataattaactacatatttggatgaatcaaatgtctgaacttttcaacattttcatcaagtttaagtcacatatcatcttgccaagtagtcttggcattacttcatgttctctggatttttttaacaaaataatacttctcatcaaacttaattctattatctaagcaaagttctcctttatatgaaaccacatatcatcgagcatttcttttcaactcagataccaacaaaagttttcctggcttctttgaaaatatagctgctgccattttaattgtgccatccctcttctttccatttcctgccacctgaattactaagaacagtataaaaacatcagtattctaccttttccagcttttcccaaatctgatctttgtttgccattctctgtagggattgatgtcggcattctctcatatttttggtctccagttatagtctttacttctcatagaggcctttcctggccaccttgtctaaaatgcacctccaccctccatcacacacacacacacatcatcactccctatttcctttccctgctttttccccttagcactcaccactgttaacattgggtcttacaaatttctcgtttatgttcgccactccctagaaatgtaaactacatgacaggatgatttttttggtccatttctatctatagtactttctttactgcattacccctgtgcctgggacatggtaggaacacaataaatattggttgaattaatgaatgactcaatggttgttctgtgacatatgatttccatattaccaagccttactccttatacgtatgaaaagatttgggcatggagaaattaaggatacctttcttggagtaagttaaccattaatgtaatcattcttgacctctttagaaggattctggtaatcatatattcagaaaaataacagtggagtgggaggaagagggagacaaatatctcaagtcttggtctatgaaaagaaactgactctggaaccagaaaatttactatcgtcctgtccctgttatatattggctacatgacctcatcttcttctatttctttagttatcaaatactagatttgaatgaatgatagccaagaccccttctagttgtaaaatctgcatggtgctatgccctagcactgacttcccttccttcctttttataaagcacaggagaaaattaatctcatcacattttagattatcttggcatatttggcagttgagaaactagtcggctataccaaggctggtggtttgtcagcaaagctgatctgcatgggtggacaaaaatgtaatcttgtatgtcgctatgttgttttgttttgtttggctttttaaagaagctttcagaattattataattccaaacaaagaaggatgaagctagtcagggcctgatggttaaaagtagttagtaattgtgcagtttcacagtccttgggtttaagagctcggaaagggaggtgtcacttctattagcattagaaaggaagacttgttaggaaaggtagctgtgagcttgtcctggaaggcagaacagacctggaggcagtgattccataaaataactggtggaagggatgtagaagctcacagaggcctggcagggacccaaaatttgttctgggtgttctaacatccttcatttcctgatgctgagactgcctctcccaagtggccactctctgagttaatgggaaagggcggaaaagaacctggcttcgtcctgtaatacagaagaggaacctagatgcagaggttgacacacaatttaagagtctggctaggacagtcttttgcattggttgtttgcttttcaggtactggtttggaaatccttgagctggaaatagatcataatagcagatatcatgaccacagatatcaaaatacgaaggcagtagattataatggtggttctcaaacttgagtgtgcagcagagttgcaaggaaacttagacattcagattcctaggatgcactcccgagaatcagattgagtagcactgggatggggcccagaaataatctgcactttctagtgaagacctccacagagttctggtagtttcctaaccacacctttggaaaccatatcttgggaaacactggtatggtagaaagaccatgtgcattggaatgagctaccaaaattcaaatccctgctcagccacttatttgctatgtaatcttgggccccacagttaacttccctagccaaaagatgaaacaatgtgacctaatttacaggactgttataagaattagaaatgacattttaaggcacctagaacagaattaacatatattaggcattaaaggaagatttctgctattattacattaaagggataaggtgcctgctctatcaaagcgtgtttgggtgttttcttggaaatcaagcccactctgcccactgtgtataatgctgtgacctgatcccacacatatatactcctaggcccttactctgctctttttattccatagcatttattaccttttaacccactatataatttacttatttttatgcttattgaaacctaacagaatacaaaccttataaaggcagagatttttgtttgttctgttcactgacattcataccacctagaaagtatatggcaaaagatgggtgctcagtaattatttgttgaataaatattgcaattctgtattactagaaaaaaaatgtatttttgtttcgattttgtccagtgtccatactgcttatattcccttacctttaaatcatgaccctccacttctgatatcaacacctgttgaaaaactggctaacataaaatgatactctgtgggagcactggaaatcaaggataagaatcattaatatctacacaaagtcattggtattatcctaaccagaaagttctcactgactaagtcattgatacatgaattgttctgaaagttgttacttctgtaactaatattgggaattccagagaaaactcatcattgctcttgggattagtaagaacttcagagcagaatggagaaaactgtcagcttcttctaagggctgatattaaacgattcttactaggacttcttcttaggagaggggcaagaaagagaagacaccacccttgtaagctgatgaaaagtccggagtgcagtggagacgtgggaaagccagtgtgttcccaccccactgagttgtcagcctgaactggggaccagcttagtgcacgtgggaaatttcaaatgagcactactgggagcaagggtcagaggctgtgatgaggattccgagtcagaagccaagctttgctttgtgttctcttcattccctgatgaaaatcgcattttcttaaagccactttgcacaccaagtcaaagagtcaagcattcatccaggtcatcaagcaagaaaccacccctcccagtatatccacataattatatatgatttccatttccttttctatatatcacaaataccactgtctacgtgccagggttgggctactcattacgtacattattggcttgtttaaatctcactaccatttcatgaggagtaagccaagtttgtttgcccaagtgatgcagtgactaaatgaattatttctacagcatgatgcctccttacacaaaagaagaggcattttgatgtggtatctcagatatggagtccatttgtggggaaagaacaagaaaatatgttttagccaatctggaaatgaggaatgaagacctttaacagcagtaatactgctggactaatcatagcacccctgatgttcaggccagcagatggcttccagagccagcaaatgttctgctatagtctgctcacttggccctgtctgtaaagacagaacatgtgtactgtttgtgtcccacaaaggtggaaggaagcagaagcaaattatgcctgaacctttcccactccctttaacctgttgccatggagcaaagactgctgatttctttcatctttgcttgagttatcctccaacatcgttccatgagccctggacccttccactgtatttgttcactaatgtacctgaattgccaaaacatgctgcctgacatgtatcaagcacttgagaaatatttgccgaatttaatgcatcttgaccctcccgtgcacccagaccccttaaattattaaaccacctgtcacaacagagccacgccaaaggttctaagctgggcctgtccttgtttgagcttttgctcccataaacagccaaagtgatttcttttagtgtgtttgttaactacaaaatgccatcatgatttccagtgctatttacttttgctgggttttaaatgctaaagcatccttcttggtcaagtgcaaagtggtggattggtgtggaacatccagtgacaagtgcagtagggctgggtcctgggaatagctcttcaaaaagcccttaatggtttattgtggtgacttagtaaatggagaaaactcaactcataccacttttctctctcagtggtttatggaataaactacctcatagcagttataccccaggcaataattcaaggtttcatttttaatttgatcgggtagattttaattgtgacagttttattctttcatatgtgcagtgtttacatttttttctctgaagcaggaggggccaaagttcttttgatttttggaacagcattatgctttgaaggaactcattaaaatctaaggagttgagtctccagataaacaagaccataaatggtacccttagaaaatatctagaattgttacaaggttgactaaagcccagtagagattttgatgtgaaacaatgaattgtaaatgaagaatcactttgggctgggtttcgtttcttctttttaacatgcagaattgcttgattttttaaaaaatgtaatatgtctttcactacccttctccttagttcccattttgctatatacaaaaatcccagaagcagaaaatgaaaacgttgtttaattattgagctatctttttcaaaaagttttgaagtttttgtattgataagaaaaatagcttaagaacttagaaaaaatctgatgataatcagttgggaaagaaaatgtattttcccactctagaaatgaacagcaagaagactgtgctgcagcatgacataggtaccactgataagtagagagaaacatctagacaagggcaacgtaacacatgcagtccataatcctgggtgattttagattattattatttttagccatttcagcaacattcactgcacatccactgggtagaaatcaccaccctagcttgtattctgaaagagcataaaattgagcaagagagtgtgtaagtgaatgacggggtgagggtcatagaagtgcaggtaagaccttccagagaggaaagagtaggaaggcaaagttagaggaggaaaatgagacatcatttaggaaacatttgactggcaaggagaacaataatcaactgcaaatggctttcgacatcagcatttattatgtgacacagtaaatatgggggggggggcacagtttcagtagctgggtagcactttgctctctctctctctgctctgccatcttcagctgcaaaatggctacagttgataacagcatctcttccagccatcattgcatcaattaatgaagagatgatgtttcttttcatgtacccattttcaatagggaagataaccttttccagaagctcctacatgccccacttcaggtaccagcatgtgcatacgtgatcttgccctagctttgagggaggctagctgaaagaaaactacaaatttctgagcctgtttcagttctgggtaaacaaatcagataatccctgccttcaggaaatttaccttctaatgacttgaatggtgggaagattcaaggtctagccaaaggaactggaagggtgaggctacacagagtctgacttcaagaccattgcagttgaagggccaagaggtcataggctgtaactccagaaattcagagggggattagaagcagaggcatagcaagagaaaatcccataactgagttacccaaaagaagtgttaagcaaaagagaagagagtgcttcttctctgaaagcgaatggatgactgttaataaaaactaataactgcagaataaatattgtccatctccatgttatctgcttttattttttcaagtgtttaacttacttatttcatctatttctaataaaacattttattactagatctctttgcaattggtaatctattttcatttttttttagcgcttttgattcccgtaacaccccccattaagtaaaatgaatatgcatatgttttcagatgtgggaacagaatcctaaagaaggtgattgatgtgtccaagtttatattaattataaacagcagagccaaaactggatttcaggggctgttgcctcagtcagatttttttttacagcatcctaattcctgaaaaggtatgcttaagtcagtggtctacctagatatttctttcttacttatttcaagctgctgtttcctatcagtttatttacttgacttttatttctccattaagtacctaaattaatagagaaataagtgttcatccaatataactgagccagtagtttgaaatttttattaaatgttaggaaacgaaatgtgcagttatagccaaagattagaagaattataggaaaacagtactgggtgctgttgtatgaacattaaaaaatcagtttcaggcatcatttcaaattttttacctcattttcccactgactccaattttctgaatcattcctttattttttagaatgtggtttaatcacatacattttgaagctgccttaaatcactctgtaacaaaatggattataaataaactaatgaattatatacaactgtagttagttttgcataatacataggaaaatattatttgccttcctgtaatacatggatctacaattttaaactatgtcttttttatgcatttgtaaatagtgtctccaagccaaaatggtaccatgggccttttaaaaggaaactgtagatagatttataactgtgacccttcctatttgcatttgttaccaagtaagagtcacatatgctacataaaatagacctcagtaattatgattgctcgcctagttgaatgaggaaaacctctgaattgcagactagcttgacaaaaatttatggaaagttattttttaagtaatgatacttctgaaacctattctaataatgcatccaagttgataatttatcttagacatactacatactctcaaagaattaatattgtcatgcttgcaccactctgaagggcttgcactctaactgtttattctttaattaaatccaagaatggattagtgcttggagcgaaattttttttttttttttgagacagagtctcgctctgtcacccaggctggagtgcagtggcatgatctcggctcactgcaagctccgtctcccggattcacgccattcttctgcctcagcctcccaagtagctgggactacaggggctcaccaccacgcccgactaattttttttttttttgtatttttagtagagacggggtttcaccatgttagccaggatggtctcgatctcctgacctcgtgatctgcccacctcggcctcccaaagtgctaggattacaggcgtgagccaccgcacccagccacgaaattttttattacatgtcaaagcctagcaagttttaaattaaactaactggatgaaaatgcaagtacttttcctaatttgtttatggaattttcttctaaaaaagagatcgggacatacatttttgtcctatattattttttgctctgctgttcattaaaaaaatatgagttctctttcctctcattttcaccctttaggtgttacgtttttaaaaactgttataatagcacatggctgttgggtgatgatctttggaaaaaatacagtaaaaatgatgtctttctgtttaatttatacagtaagagaataatctcacccttgacctaaatatcctgccctttcccttctccccattttcatacccaggccactgcagctggtcacagggttttaaataccatctatatgtgcctcttaaatgtctatgttcaacccagacctctcctatgaactctgaatccttattgccaactatctacaagatacctccttcatttggatgtcttgcaaacctctaaacattatcatatcaaaaccacactccaaaacttgacccccaaccttctcctcctgcagcttctccaaaccagtcaacagcaactccatctttctagttgcctaggccccaagcattgaggtcatcctttcttctccctctccctctcttctctctctctccatccaataaattaatgctattacctctatcctcactatgtccactgtggaaatatttctcatcacctcactgccctggttcaggacccatcatcttatctgggtagatcagcaggccctctctgctctccttgctttatctctggctccatgcattctactctcaactcagcagccagagtgatgctgcttcatgttagtcatctgttcaaaatctccagtggatccccacccactgcaagtaagtgcagaagtccttattatgacccataagactccatgacacctggtcctggccctatgaccccttcctaccacccgcctcctttcctactctcttccagcctcacagacctcctcatcactcttgactcaagacctttatcattggctttcttttccttccttctacctggaatgattttctccaactccttcatcagtttgagttttctgctaaaatgtcagcttctctgggactgacaatcctattgaaaactgcgtcttcccaagcatttctcattgcccttctttgccttgtgtttctctatgtttttcttgtatgtttgtttaatgcccgtctttccatatttgttaccagcttcatgaagacaaggattattgtctgtttggtttgtaactgaattcccagcatccaatacctggcactcaggaagcattcactcaacatttatgcaatgaatgaaaggaagggagggaagagaagacctgagggagaagcacagtggtgctgaagtagagcttgtgtggaatgactgctaggggagaagatgggaaagacagattgaggacagtatgcaagtggatggcttcagccatgggaataaaaagagtttccagtaaatgagtgtcttgaccatggcattctgacaaccacatagagaagaaatgtgctgcacatgttaaggaaatagcagacaaatttgaaagctgttgtatcaaaggttcatcaagtacgtatttttctttgcaatgcaaaactcaaactagcttaagtaatttgaaggctcacatagctgaacaatccacaagcaaatatggcttcagacatagcttgtcccgggactcagatgatatcaagacatcccttttatctctatttcttggtattgtttgctcaattgtcagcgcaatcatcaggcctcatatggatacaggccctgtatcctctcttagaagtctcagggaaaacctccagggttttcattgcctctgatggagtcacatgcccattgctcaggcaactatgatgatctgggaatggaatgctcaatagactttgactacgatacacacttcacccttgagctaaggcttgggtagcagttggtttaccagagggaacgtggggtataactattataagaggagggaaatggagacttttaatgatgaacagatgaccactacaaaaggctaatgagggcttgaacttgagtctctgcagttggaatggaaaagggagaaaagaagtaacagagatgaagtctagtaggcctcctggctctgaatggagagaggatgcagagaagctttagtacaattctgagatcttgagcttgcgtgattagaagttggcaatgtcattaatgaaggttcacgataaagtaggaggaacagatttgtaagagacagaacacatttccttgctttctcatccctgtttttattaataaaattgtttccagattctcagagctcaagaactgtagagttctgcaagaggcaagaagcaaattcttccaccaaccacttattttcagaagacttaaccctgcagttttaaaaagtcttctctctgagctcatgtgtgagagaatcagactgaaattttattttctctcaatagttttgagtttcctttggttgagctatcagcttctatggaataagaaaccacaagtcagagctgggttcaatcatctcttatagaacatttccacacagatgacttagggttgtgaggccatcttctaatgtactgtggatggattaggcttagagaaatatatgatgctcatctatagaactctactggatgcctaacaaattacaaagtgagaaacttttcatcactgatggaccaggtgcaagaaaggagtaaaggcaggcaccgaataataaagtgacatatgcaaatgtagtagccagcaattttttgagtatttaccattgaccaagtactgttttaaagtctcaacatataataagtcatttaatcaccatagcaatgcttcgtggtgagtactgttgttatccccattttacacgtgagcaaactgagatctaggaagatccttgtcgatgtacgttgtcaagggtcccacagctagtgactggcgtggctaagattcaaacccaagcagtctggctcaagggcctgccttcttaataaactgatcatatattccagaactgcccaatacagtcatcatttctgcctgctgccttggcataattataaatgtgaactctagaaagtgcccccattgggcaataaattatggacactatttctctgaaccatgatattttccttattcaaaaccaagaaaatctaacctgagcaataaaggcatccaagtggttcagttgtatctccaggcatatgaggggtgacattttggattgaatatgactattggtaatcatccagttggtcctaagaattaaagcagctgcatgggttggcgtaggtttggttttaaccagcaaatcattctgctgtcttgcagcttttagggctctgttttgtgctacagtaaaattgtcagtgaccatatgttgcctgtttctggaatggttttatttatgcctcaacatttggctccttcaggttcccccagatctccagaacgaagtgctgatcagcctgttagagaccgatcctgatgtcgtggactatttactcagaagaaaggcttcccaatcatcgtgagtattccagtgttccatcttctaaagccgcattggagatttctatttccatttctgagaaattggaaaggtttacataagtacatgcagggtgacctgaagtggaattttggcaactctttggcaattctgatcagtccatctaaccagaaaatgcttcgggtcccatcaatccacttaccaaattagaaaccacattacaagatttttctgttttattttcagctttctctagcctctcagggtccttttgacttcatttacagggaaaaagcacaaattactggcaagggactataatacacgtcaatgattctacttctagaattctgataagcgtgcataggggcccttaaggctgcgcctggatgcatcttgcttgtgcagctttaccagtgggattaacccattatcaaaccacaagacagaccttagctgaggcctaggtgcccatttgaaattagaggtgtgcaccttcttggctctcccactttttatagctagtattattttgataaaaatgcacatgggtttctacatgcactcatgtttgcaattagtaaaatgcaagccatgctgcaggctatggcttgctgccatttttgctcccaaaagaggagcacagagtttttgcattagtcagattttatggttacttccaatctttgctgcagaggcagagggtgtggggatgctgagcatttggcataaccagttaagggcataatatagcatcattaaccaggagtagtatcatcaccaggacaccaaacaataaatttgtgacaggaaaagttgttgctatgctcttacaaaattatcacttttgttatacttttaacctactaaatttcagcaattctaagatacgtttctcccatgacctatgatctctgaaattgagactaatcttataaccaatgataagctcctaacgtaatcccgtacctgtaaccccagcactttgggatgccgaggcgggcagatcacctgaggtcaggagttcgagaccaacctggccaacatggctaaaccccctctctactaaaaatacaaaaattagccaggcgtagtgacaggtgcctgtaatcccagctactcgtgaggctgagatgggagaatcgcttgaactggggaggtggaagttgcagtgagccgagactgcaccactgcactccagcctgggtgacagagtgagactctgtctcataataataaataaataaacaaataaataaaataatggcatgtcttaatcgatggtgtcttataaacagtaacacatgttaagttattcctgtatattggtgttgaacttgataaattaattttcactcatgattattgcagatacttaaaaagttatattatttagaaaaatttggtgaaaaggaattccatgttgttcaacctccttctttcccaggtcattacgttgatagcacagctaaattcagcttcactccatttccagcttagcagggaagaccttttaattggattatcctttcagatctactttaaaaaatctgtgtctgggccattcattatcaggccaaattctgattcaaataggaccaaattctgttgaaagtaaggcctggattcaagccccaagagccatgagtgaataaaattatattcaaattgtatagatgagctagtattttatggtcttgcttttcatatcagagaattaggcttacatttaaatttttcctagatttctaaccctcatcaaggtataagtcctaatttatattaacaaatggcttttcttttcagcagatcatgcaccaccataattttgataaactcatttatttccctcccttgtacagaaaagagacatgctggcatttccatttatgagcccctcatttaaactgcacttataacatatggttggtactgtgtgggaaagctacaaaacacacacttttgaggaaaaccactgatttttgcctggccaaatttctgcttttgtgtggcattatgagatagataaatactatactttaaagaacagttgatagaagtttttttacatggttttcaaatacactctttgcatataaatgctgtggtaaaaagcgaacctttctttctcttctattaggaaaaggaagaagcacacatattaagcccattccaagctgtacaattgtccagccccttctgttccctatccgtaagagtaagaagtagaattttaaagtgtaggtgagcagaccctagaccaagatcttaggtgagtgtcagggcttccaagaaaatagcaaagacttggaaccaacccaaatgtccaacaacgatagactggattaagaaaatgtggcacatatacatcatggaatactatgcagccataaaaaatgaagagttcatgtcctttgtagggacatggatgaagctggaaaccatcattctcagcaaactatcgcaaggacagaaacaccaaacaccgcatgttctcactcataggtgggaattgaacaatgagaacacatggacacaggaaggggaacatcacactccggggtctgttgtgggatggggggaggggggaggaatagcattaggagatatacctaatgctaaatgacgagttaatgggtgcagcacaccaacatggcacatgcatgcatatgtaacaaacctgcacattgtgcacatgtaccctaaaacttaaagtataataataataaaataaaaagaagaatgagcccataggagctctgtgtatgtcagagactagcattatcagtgaacagaaaacactgggggaagacttacttaggagaagaaagtgtttggtttttgtttgtgttcctctaggtacaggccaaggaacagcccagaaggcagagaatgatgtcatgaagtaaaaatgcatatgttaataaatgagtgtttacttttagtggtcttttgaggcttgagctccagagtgctacccctctagctgtagttgcctttttttttttttttttttttttttgagatcgagtctcgctctgtcacccaggctggagtacagtggcacaatctcggctcactgcaatccccacctcccgggttcaaacgattctcctgcctcagcctcccaagtagctgagattacaggtgcatgccaccacacctggctaatttatgtatttttagtagagacggggtttcactatgttggccagactggtctcgaactcctgaccttgtgatccatccgcctcagcctcccaaagtaggtggtctttttgtgttttaaactcactcactcatgcttctcaaactttactatgcatgggtatcaccagatcttgttaaaatgctctttctgaatcagtaggactcggggaggtagtctatgaatctgaatttctaacaagctcccaagtgatcctgatactactggtccatgatccacactttgagtttaaaaagcttaaaatatcaaagtatattcttgcttttaggagctttcagacttgttggaggaggcctccaagggtagaatgccaaacaataggtgctggcccactggctgtcagactcaccagccccttggaatcacctgggagcctgaagaacaactatgcctgggccacccctcagagattctggttcattttcataggctgcaatctggacattcggatttttgtttaaagtctcttgcatgattttaatgagcaaccagggttaagaacctctagcttagatctaccacgttggatatcacaaatttactatcatgtgggagtttgagctgggtgatttttgacattaaaaaggcatccttgtgttgacaaaggaagggaatcaatgctccagaccatgaatccacttggagtttggagaaggaaaagaggtgtgatttgaagtctcagagatagcttctgagaagaggaaggatttgcagtgaactttgaagactgtggaggatataaacaagcctggatatttggggagcttgcaccaggacctggacataacagtaaatatgttggctagctggggtcacaataaagaggctggccagcagtgaaggtagaagcccttaaatggcaggctgaggggtggtgcttaagtcaagaagcagtgacaatagattactgtaaggctaaattatagtaaattacagtaccctaaactgccagatggtgctggctgcattggcaagtcaattatccatcagtaacacatgtttgtgtagtcagttatctgtcaataacacatgcttgtgtagtttaatagactggttaccatttcagatccagagccagattgcctacgtttcaattccatttctattgctattatatatgcggtctattagttaagagttaatatctgttaatacatagatagatctctctctctagtttcctcatctgtaaactagagataaaaagtagcaccaacttaaatacagaattatgctcttagtgtatagtctggtatatcataaacatcaccaatttgctcatttacaactacttaccaaaggcgtggccatcactagattctactttggttttcatgagatagcaaccttccaggcaatatgacacaagagagaacccgttcactttaagttatagcattgtgtctaaaagcaaacactatatttgcttctaaccctttgatttttttttcctgaagcttctgttctctgccaccagttcacatacctaaacaaagctttacattcctgtgaggccaagtggaaactgcacaagattttatttggaggggaaaagaaacaagtttcaaaagagtgtaaaaccaagaacaagaaaatattataatttctgttttgaaagagcaaacatttagtgatatttgggaacttaatattttgttttgatttgggtttttcacttctttatgcaacatcggtattggaggagttaaaggataattccttgttttttctcgtgcttgtctgcttaagtatttggcttcaaccaaaacgggatgccagagggggattagaagagatttttatgactaagaatgcaagaccaggagtctgtgaccagcctggtcaccacagcaagaccccatctctactaaagaaaaatttaaaagttatctgggcatggtggctcatgcctgtactcccagctactcgggaggatgaggcaggaggatcacctgagcccggggttttgtggctgcagtgagccaagattaggccactgcactccaacctgggcaacagagtgagaccttgtctctagggggaaaaaaaaaaaaaaagaaagcaagactttgatttttaaaaatatatacttgtcaggtatgtttactagcattatatatgctcttttcttcaaaggtacttaaaatagttcccctaccctttgatttaaggatgtgaggaaatagggaatgagaatgggaggttaatcaaacaggacaggatatgttgaatgtgaatatttgcaacaaaacaaaggaatcacagtaggactgggacttagtgagaggcaagtgagacgcttgcctagacacagaatttaagggaatgccagaaaactcagtcagcaaaattgattatattgcaatgtaatattttttaaaaatccaagctaatgccaaaaatgtttgataaagaaaatatcaaaattttaaaaagactagccatgcttagtcatagaacctgaaacaaaaggtaaaatatgtgctgctgccttaaatggaagcaactcataagtcatatttattttttgagacagggtctcgctctgtcacccaggctggagtgcagtggcacgaccatggttcattgcagcctcaaccgcctgggctcaagcgatcttcctgcctcagctcccaaagcaagattttcaaaatctactttgtttatcttggttccaactgagagaattgctatgtttgacagtttctcttgaccaagtgacaatcttaaataagttctaactaaattaacctgaaataaaataataaggaaattctgtttgggcatacataaaacatttaaatttaatataaatattataggttcgaatgtatcttcttttcaatttttcaattttttcaactgctttgatgttctgggaaaaaaaaatatacacaaaaccatgtatatagaggtacacagttttcttttgcctgaggcatctcgggcccctaagttccgcataagggatgctttgcagaactaagcatgattaatgtgaaaatcccccataaatccagagctcaggagagctcagcagagctcagatcatctgtgacacagtaactagtttcagcaacaggtcttgtaatttttaaatataggcttgaggaaacatataaagatttgctcttattctatcaaacctcaggggctccccagaaatagaatattaattaaataaggctaagtaaagtatcttcccttctatactctggaaacaagatcaaaatagaacaaatttaactgcatttggagagaaggcagatatggatgaactaaactcaggtatatatatttaaatttcattgtggttaattctattagtagccttcacaaagtttttactggaaaaaaaattaaactaaaattaattttaaaaattagcaaaactggtgactagtgtatcaagagcatggttgaagatctgtactagtctgaaaaaaaataaaatttcagtactgaaaaataattgtattgtttagctagatgttcatcttattgaatgacaaatctgccttcttcattctgggggagcattaggctttcttctaatttaaaggtatcacatttaacttaccaaatatcacatagatcatttcttttaatctttcaaagctcatcattaaaaatatcttttttcacaaacatggagtgttatgtgacagattataatttctgtttttcttttactaggatttttcatatcagaaagggtttcaggaaattttcagacaagaaatctaactttaccagtacaatgtaacagcaaagagtcctattgagtggcggtagctgttggcctcaataccctggaaattatgaagcattaactgcccctgcccccctcccccaacacacatactccattcaagaaagtctttccagccagatagttttagaaaaagcttatgtggaatagagaattccataatgaaaaattctaaaatgtgtgcatatatgccttctatggaaaggcattcaagatggagggagaatgtatcacattaccccttccttcctcacaccttcactatgattcacagcttctttataaatttgcagaatgttaatttgaagatgtttttatcaggccctctgtaaataatgaaaacaacactgtctgatcttcacctgtcataagtgctccatttgccagagacattaggagggaattaataaggactaaaaatgaggggaaaaatttcaccaaaggcttatgcccagggtgttagcttcatcatccagtggagagtttagagccatgtcagttcctctttgaagtggggtacctttatccctagcaatctgtcaaagggaggctttgtagaactgatggtgattaatgtgcacattcttcatgattccaaagctgctccagcagtggattcctttcccagtaccattgatataatccaagatggatgatacaatgctttcagttccaacagactggaacttatcagtcatatgattaagccaaggatgaagccaacacacatttgaaacctccacagttcttcttgctggggtagctcagcaaggtgctgggcgggccccatccggtgattgaaccggagttttccatttgtccccagaacaagttctgtgcttccggctgcagtgcaggcctgcccacagtaccctgccagcatgtttacgccctgacctggagggaccagctaagggtgagaatgtgactcgctctccatgcccatcccttgcttgtctggttagctgagattggccatgcatgctgtatgtagatggtcctggggtttgggggtctaacggggaaaccctccatgcatggaggcaaacccatgtagactggtgacctgtccacccaacctcaatccatgatgctctgagactggaaagagaagccaccaggcacttttggatgccaacttatgtcaactggcaactcattcacccaacattctgaacctcaatccatcaaactccaagacatacaaagagatgtcactatgtgcttttagactattcctcatctagtgaatcactgatcagagtaaaaatttcatgtaaatagatacatgagtattttaatgcctttatttgggaccctgaactcaaaactatcttcttagggttggattatcctagagtcaaatctgagagaaaacattgtggttgcttatctcatttttcggacatatccaaaagatggtatggttttctagatttgacactgagtgtcctgtggaaaatcactaaaacctcccctcctgggcccatttctccaccagtgttcagaaattagagtgctgccaattggaactggtttgtaggaaggtaatgcccactcaagaagctcccagagctgactcacaatgatgggttttagccaccatcaggcaccctggtcctggcagacaaccacttctctgacagttgtagcctgaaaggtagtttttctttcttttctcacttttatctctaggtttcagggtcagagaaatttcctttcctataaacttttaccatccacatttccactacactacacccggatttattcacaccctgtcttcttgcagaatttctggattataagaatttgttttttgatttgtgatttttatatggaaaatcttacagaactttatagattttacctgatttataaatttgacaagctgcttttacaatagcttccataaacttagaaatgtttcagaaactgggatagaatagaaagatttagaagtggaaaatggaaaatggacagacacaggaagcacaggtgtgtaatgaaggtatccacaatgactggatgcccagcccccattacaggagagacatgctctgaaaggccctcacaattctgcttccaagtctctggaaatttctccggactccagcctccattcagcaatcctactctctctctgttctgtgtctttacttccaattgtatcacctaagtgggtgtatgtgtatatgcatgtgtatatagttgcatttatgtgtatatgtaatatgtgtctgtgtatatgtgtacatgtctatgtcatatttgtgtgtgtgtatatgtgtttatgaatatgtatatgtgtgcatatgttgatgcatgtatatgtatgtgttcatatgttgatgcatgtatatgtatgtgtttatgtctgaatatgtatatgtatgtgcgtgtgtgttgggtatgtatgtatatgtgagtatgtgtatatatgttgatcctggatttgcttctgacagatataaaacaatagaatgacactatttttttaaaaaatctatgaactgcctatgttgttatgagagttctgaggagtgaataaaacagcttttttttttaatcggtgtgctttcatgtgagaagataattcttggacataggttcttaggcaaatttggctgccacttcctgacctctgctaagacaataaaatgatagggaaatattttaaacattttaaaaggctattaactctaagtaagaaagagcattttactactgatttgtaataatgttgaacactatctaccaaataaattctagaagaatcccaaccctaactgcctctgctgctagagagcatggtattcagcattcagtcagctccttgtttctttcactcaatcccagactcaggtcaggaaaaaggagagttgttaacagtagcttagtacagtgcctgccacataattaactctgtataaatattaacttttactctcctcacaggccaaggggatatttcacataagtatatttcccaaactgcttgccatgtgtactcacactgtatctcctcccatggctgggatacactggggggtggggaaactgtgaaaagaagacatcgtctctcattggatgccccctctgtctatgtccctggctgtgaccccagccatcccaaggaggttcagagcctgtgtctactatgagacacctcatctacctctacctccagggattcgcttcagccacccccactgtttcctccctgatggagggcccagctgtggtcactttgccggcttgacttaggagactgaaccagaagagcagagaacactacactggtacttcctacccccctttcacttcaaaatgttctgatccacaatgggactacactacattcagttgtctggatcctgcttaaggcagacagaggaggtccaggaatcggctgggatggggacacccttcctccttctcctaactgtggcctcagtcaccccaaggtcaggaccaccacattcactcccagggcagccaatgctgcagttttggctaccatctttggtttccctcctgatttggctcttagcagacctttagcccactgtcacatctacagattgagagaggaaaataaggtttggttattagaggttcccaaacatccccgtgcatcagaatcacctggagggattctttaaaaaatttgctggccccaccctgagtttcccttttaataggcagagctgactttcagggctgtgactccacactcagaagaagcccacatttggtttactgatttgcagtggccatcttgaaatgcttaacgctttttaaacacggggcatcacatgttcattttgcactgggctccacaaatggtgtagccagtcctgtcagtaggtccagaatggagctgtagaattggcattgccaacaagttcccaggtgagacagatgcagccaccctgggatgcacttcacaaccactcaatgagatcttgcagacctggaaaatcatcctcatagcagtcctctggctccttcccataagattacgtgatgagagttcaaagaggaggcaaggaaggggcttctttattccatgttggtaggaaatgtcctcagcaaaagggttcaggcccgtgtttgcctcagttacggctgtggcagtatcacagaagctgggatgtttttcccggcgatattaacccctgctggaaacctcagaggaagctagatccctgtgaatgcacttcctccagtttgcatgcacaaaaccatttggttaggaaagtgttgttcaggcatgtgtttaccttctttaagaaataaaaaggatttgttttgaaaaattaagccaaaagagagcaaagactagtaaagagaagtgaagtaagggggaaaagatgtaggttctggaacttttaatcaatctgtgattgtttcccttcaagatgttgtcagggccagttttgaggagggtagaaaagaaagatgtttccaggtaagacttcccatgctcttttcacgttgctcaagttctcatttttctgttccacatacattttcactgttatttctgtttctgtgacaactcatgaacacagaactatgataatggtatactaattagtacatcatatcagtttgtaaaagcactagtgccttgtagaatcattttagatgtatttgaataaaatggagtctagtgagggtcatatatttattgtttttgtcactactttatacatgaaacacttattcccaccggtggcatcaacatctttatcacatgaaggatggatttatttacactaagtacagtaagtattttggtgggatggaaaagttgtccagaaagccataatgaacttcaagcaaagtgtcaaccatagttttatctgaattatttttaatgcaggatattgaggaaagtgaaagagttatctactagtgtatccttacctaatagatagtgagcatcagactttcacttaaaaatggaagcaggaatgagtccctgaggcacttagcgatgcccattggcaaatgcagggctccttgtcggtttcattctcaccgtgccttctccatcattgccttttcctgttatatctgttgggttttactgccctctgctggtcatatcgttgaaaccctttcacgtcatggatgtacatgtcttggaacattgctcaaaatggtctttttgtttcagcccgtgtccacgcatactcctccagtcatttgtgtaatagccatattgtttaaatctggtcactacttgttaacaaactcacgcacctgtaattgtctcattgtgccagaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataa

SEQ ID NO: 3029 - DNA, 290230 bp, human; identical to SEQ ID NO: 3022

SEQ ID NO: 3030 - DNA, 516178 bp, human; identical to SEQ ID NO: 3024

SEQ ID NO: 3031 - DNA, 527536 bp, human; identical to SEQ ID NO: 3025

SEQ ID NO: 3032 - DNA, 528157 bp, human; identical to SEQ ID NO: 3026

SEQ ID NO: 3033 - DNA, 528157 bp, human; identical to SEQ ID NO: 3026

SEQ ID NO: 3034 - DNA, 522304 bp, human; identical to SEQ ID NO: 3028

SEQ ID NO: 3035 - DNA, 516178 bp, human; identical to SEQ ID NO: 3024

SEQ ID NO: 3036 - DNA, 527536 bp, human; identical to SEQ ID NO: 3025

SEQ ID NO: 3037 - DNA, 528157 bp, human; identical to SEQ ID NO: 3026

SEQ ID NO: 3038 - DNA, 528157 bp, human; identical to SEQ ID NO: 3026

SEQ ID NO: 3039 - DNA, 522304 bp, human; identical to SEQ ID NO: 3028

SEQ ID NO: 3040 - DNA, 516178 bp, human; identical to SEQ ID NO: 3024

SEQ ID NO: 3041 - DNA, 527536 bp, human; identical to SEQ ID NO: 3025

SEQ ID NO: 3042 - DNA, 528157 bp, human; identical to SEQ ID NO: 3026

SEQ ID NO: 3043 - DNA, 528157 bp, human; identical to SEQ ID NO: 3026

SEQ ID NO: 3044 - DNA, 522304 bp, human; identical to SEQ ID NO: 3028

SEQ ID NO: 3045 - DNA, 225842 bp, human
tttccagccacaggacgaagtcttcaggctggccgcctccctcgggaacctggggcttgagccaggtgccgccctatggatgggagatgacggcaaaccgagatgggcgagactacttcatcaagtaggttaaacagatggcatgaacaatagaatccttggccaatggacttctttatctttgtttatgagaatgaacatacttaaattaggcactcataggcatttggaggccattactaaagcagctggatctcttaagccagctgcttatatttctatatatttatatatttatttctatacatttatatttctatatattgtgatgttgggttgcttcattcttcgacaggcaccatcttcgaatgacaagtcactgtgtagcatggtaagcctggctcagagcaaaagtttccaccgttaaatattaggccaagttgtattcgttgtctgagattaacaaccgaagttggacatgcaagaatctcatttacaaggttttctaggagtggtcaagacaggaatgctactttctcatctgtaattttttaaaaatcagctaaaaggattatgtacattatttgttttattgtaaatttctcacactaacgttggcttaggttttggatttttgtggtgctctggttttttgttaattgtggtatagagagagagagaaaaagagagaaagataacatgaaatttaccattttaaccagttttaggtgtacaattcagtggcattaagtacatccacaatgttgtgcaaccattcgctactatccatttccagaactttttcatgatacccgaaagaatctttgtacccattaaacaataattgccagttcctccctccccttaccccctggtgacatctattctactttctgtctccataagtttatctgctctagggacctcatacaagtgaaatttatatattttctgtccttttgtcactgacttctttcacttagcgtaacgttttcaggctcatctatgctgtagcacatgtcagaagtttttcctttttttatttttcctttttaatgttcccttgtgtggataggccacattttgtgtattcattcatctgttaatggacatttgggttgtttccaccttttgtctattgttactggtattgttatgaacatcggtgtacaagcatcaatttgagtccctgctttcacatcttctagacacatacctaggcgtggagttgctgaaacatatggaattgttgggtcaaaattaaaggctgtgtttaactttttgaggaaccaccaaactgttttctggagtggctgcagagtggtttttttgtttcgtttttttgtttgtttgtttgtttgcagttttgtgaaaagagcatttctatttctcaaaatggcaagggtccatactgccctttttctccaacctgagcaaaatatccttaattataagaaattcatgaaacagatttgaaatcaggaagtgtggttgggtctatcctgattataatagaggagagattggaggccagaaaaaaaaattatttcacaaccacatgctacattctttgttccagccaagttgattatggactgattagccaaacaccggatcaccgtgaggtgaggggtcatttttataaaaaatatctgccaagattgtttctaggggatttggtcttttgtaccaacccccgcgcaccaccacatacaagtgaggattgttggaaagtatcaacagggacaacacatgtgagtgttgtggacagtttctcagtctctgaagcccaaatctctctccttccctagaattgctgcacaggggacaggactcccaccccttcagagcacagtttctttctgacgtacttaactcctgggtccatcccaggaagatccagtatgcccttgaacatgactggaaagtggccccctggcttcccaaggctttcctaaggatatgctcacagagatactatcatagaaatggcagtgggagcagggcctcccagaaacctcaaagattagaagaaaggccaatagtttggctcaaaccccagagtttgaattcataatttcataccgtttgtccaagtcccttaggctgctaggaagacagtattttttaatattatattgtaccatctattttgtaacatggctatgattgtgtgcaattggctcagttaaggtgaactagatgctttgactcaaaacaataaaaattttgggctgaagaaatataatttttaaaagatatggatgatgggtttatgaaggtatgcatcagacttctctgattaaaacaggtgtttcttttcccctggttggatttgggttcccatacattccaggtcattccatcaataggtggaaacccaaactgaggccaactggttagaggttctgggaacgtcagctagctctgccttcatgcattaccattagcatcgctgacatttttaagagccagcctgggtgtcagtttaacatttacactggcctaatgcccactgttaaaacataagagcaaatcagcagcttaatagagaaacctgcactgattactaaatggcaagttttaaaaccaaagtcaccagtgttatttttccaaatccatgtggtttcattttacttgaaaagtaagtttctacagtcctctcagagaaagttttaagatgtcaagaacagtatttcttcggaaagtgtttgttctttatcactaatgagttttataaataatgacaatcattcttttcctttccttgttttttttttttttacttactaggtaatgtttattacaaagaggtattctaattatcagagttctcgggagcccaggtttgcagtgtggaatatttctgtactcattagttttagaagttaaaggtacaatttgaaaattaatctatggttgataattagcacctttgcattgaatttttcactctcttgcatattttttgaaagagaaatttagatgttttcttttttttatctcgtcttaggatgtaaataacccccatcagacaattgtttctgatggaggtacaagtattccaagtgacagacaaagctatgggaggaagttggcttttatgtgttcaaagttagagtctaacaactaaataatgagataattctaacataatgagtctttcagaacatggcccaggagagttcaaaatgtgctcaagtttcatcttccctcttccatacccaattatttagggtagggctgggtaacctgttatctatagagttactgattcacggggttaaatgaaggatgcaataaacacatgctaatatatgtttttataataccgtataggctgcaaactaatggttctcaaccttggccacacattggaatagactgaggatcagtaaaaaatcctgatgcctgggtctgggattgagcctggaaatagtgagtttcaggagctccccaggtaattctaatgaacagctatggttgctgctgtaaagcacttgtcaacacatgatctcatttatttggcttgaacacagaaatgattaactccatttttctggatggtagaactgagactcagcctatgagaaggaacaacttttgttgatattcttggagaaatatgaaatgcagttttaaggaacagaaaacattgtttaagaaatatgatagatgcaaatttaaaatttctcagttccttactattaccagttaagagagagcagagcaggggaagggaggaagacagatggaaagaaagaaactacaaggaaaaggaaagagtcatgggagagggagtcccaatgagaaatggataaaagagggagagatgaagagaaagagaaatgaagagaaacagagaaagtgagatactctaaggtgattgttacaataacagcatcaattaataataactttagatgtaggtatagatggagagggatgtagatatattatagatccaatcatagatacagatataaaaatagatatagatgtggacatacatatagatgatagagaatatagacattgacgtaagtattaatacagagatagatgggtatagatacatagatggatatagactataggtatagatgatagagctatagatatggatatgggtatagatgattagatacagatatagactatagatgagtgactatacagtcacattcacccaggagagtcctggtttatgggtatcattctgaagtaattacagacagcacctccttttgctctcaaagtgttctggtttggataacacaagataaggtattttaaaaatacatgtttaaaagtcagagaatgaggaacaccattttttagttaaattgggtaaaaatatgcttgtttgactgcaaaggtagggagagttaatgcaaagtaacatgattcataaatctggaactttggttttgtaaattacaggaaaaaattaaaacatgagcaaaataaatattaaaatactagctggcaaaatagattattatgatgagccaagttagagtctggggatagagatgggggttggagaggagactggagggtcagttccgaagcacatggcctgatttttcaagttataaatttaagaggctttttcttgttggcctgctggcttcctggccaccttcatcctgtgtacacaaaaagtagccctgtatgaggattggacaagacatgctgttctattattctaccagcaattcccacagtgggcaattaaactgagttactatctccttaatgcagaataattcaactctgaatcctgaagagtagagattagtaatgagatgtggaaacttccactttgttctgcagtatgggcttggctcaacttcggagtagtttagtcattcccatctgccaatctattccatggtcaatgtaaaatgtgtttttggcttatctatctatagaaaataataatctgaataaatacaagtaatttgtatgccctttcttatcaaccacagcagaagacagtcaagtcaacatgataggattctgtcatcatggaaattagaaatagaaaagccttacctcattcttctgtgtgagccccaaagtatttacccagtctaataggttatcttcagatattatttggtagttctagggctattctttggatatttttttcttgatttttactacaagatttcatgagacttttactgttattctgtggagtccctttatctgttactctgtggtgaattcccttaaactttttctcctctaaaaagttttttaaatgtcaagaagagttaaggtgtaaagttgggatgtggatattgtggttgtgcccatcatcccctgtgatatttttatatttggagcagacaccaatttcctactttatcaagcctacgttttaatacacacccaacaaaggacaaattgatctgagagattacacaagttgttatcttttgtctctgctaataaaatgctgcaggtctttgtggaaattaacagttgtgcccatgaaggaaataagagaaatctcttggtgataggttactctgttattctgtgaggtgtataagcatccaaagagttaataactagcaatatgttagaaaacaggcagtttgcctcattttttgtgggtgtttttgatgaacaattcttaaatatgttgcttttgagtacgcatgatgggttctgcataaaaagcaaatacttgcctcatggcaagagcaaatgtcatttggttcaatgagttcctagatcccaagcatccagtcaaggggaggaaagtatattgtaattttggaatgggggaaacgaagtcaatatgatagtatcattacatgaaatgaaaggtaattatgccctgttaatacaaaagcttcccaggctgaacattaggagctgtttattcccttcattggagcagatttgttttcttttgaatctgacaaagcacctatctgctgagttaataatcactgctcccagctggaaggtaagtttgcagagttgatggaagggcttttaacaggaaagctctgaaatgactctatcattccagatctaatttggcatatggcacaaagagctgtgctaggcaaacttctgcttcagaggctgtttcattttccctatgtttcttcttgaatgtttcttcttgaaactttgctggcttacttaatctggccttcactctaggacaaatccctgagttgctctccttatttgtccagcaggccagagtatctggagggattgtaattatctaaagttccttgggccacttgactacaacagagttggggcatgtacattcaagccaagctgtggacagcaggttagctagtgcactgggtcgcctctttcttctcctatgctgtatatagcccctagggatgtacaggaggtgggtcacaaagtccattcagtatcacagggatggccaacctgtgcaaaggagaagcacctggaggaccaggtttccatcacagcctgtaattgaaatactagcttggggctgcctgccacccttgatttttttgagtggcctctggacctcttctttctagattgagccaacccttgcagagagcaattttgatgttattgcctaaggctggggcacaggcagaaattctggcctgtgccaaatgccacgtgggggtgtgggtgttgctgccaagtaaattggctgagcttaagaggacatggaatcaccttggaggcaggtgccttttcagtattgtctgcactccagcataaaagaaggagagcagggccaggagcgatgtctcacacctgtaatcccagcactttgggaggctgaggtgggcggatcacctgaggtcaggggttggagaccagcctgaccaacatggagaaaccctgtctctaccaaaaatacaaaattagccaggcatggtggcacatgcctttaatcccagctacttgggaggctgaggcaggagaatcgcttgaatctgggaggcagaggttgcggtgagccaagatcgtgccattgcactccagcctgggcaacaagagcaaaactccatccgaaaaaaaaaaaaaaaaaaaaaagggggggagagcaactgagacgggagggctggtgacagaagtgccatactgtggtccaccaaaaggtgggaaactgcagttcctgccaagcccttatcctgtagttcctctcaaagcttgaataaagccttgttatcaatggccaatttctggtgaagagctccttcaattgcaaggatgataagagatcacactactcttggagccagtgaacactcggatcaatctgagtcacgagtagccatgtcacatatttgctgcacggagcatgccctccggctgctccataaacacaggtttggcattaggtgttcaggttgagaaggctgggagaaactcagaaatgctttttgaacttaaagggtgccgctgagcacatggggctggctccatgatttttaggacctgttgcaaaatgaaaatgcaggccccttgttcaaaaagcaggataaaagtgctggaaaaggtatgaaaatgtaaagcttttccccttcttctgtggtctctctgttaacatgtcatagagttttttatttcctatttaatgactttttttttaagacaaagtctctctctgtcgccaggctggagtgcaatgacacgatctcggctcactgcaacctccgcgtcctgggttgaagagattctcccacctcagactcctgagtagctgggattacaggtgcacgccaccacacccagctaatttttgtatttttagtagagatggggtttcaccatgttggccaggatggtctcaatctcttgacctcgtgatctgcctgcctcagcctcccaaaatgctgggattacaggcgtgagccactgtacccggcctatttaatgacatttcataataagacacatgaaaattttaaattattagcaggaattttactaatcatccttgtatgatgaaagtttcagatgaaaatataagagcattaacttgtctgaagaatcactgaaatgatacaatttgtatttcatagcttagacatgcatatgtctttcattctaatcagaacagtagaaatgctgcacacaactaactcaattgttttgattgtacttcttaatatgagcacatcctactaacactccctccctttggcttgctggtgagtaagggagaactgaaagaaaaagaacagtgggctgccctatctttccctttccttctgtcatcattttcactgtaagtggttggctaatacagggaagtaacacaagtaagaaaggatatggcagggttccttggtcattcatgtttcttagaaggccatgtctgttaacaactcattagcctttcaccatcacctcccaacctcacctcttgactctttttaaaaaagcatttctcacatggccttctcaataaaggcttagcaaagaggaatgattgcttttagctgttgactccctcacaaagcaatccccatgccctgtcaaggataggttttctcataaaaagataaatacttttcttcccccaccccaaggtaatcctctaagccaggtcagcaaaccttttctgtaaatggtcacatagtaaatattttaggctttggaggccatgtggtctctgttgtgactcaacagtgcaagtctgccatggtagtgttaaagcagtcataggaaacatgtaaataaatggacatggttgtgttccaataaaactttatttacaaaaacagactgggggccggatgtgacccatgagctatatagtactttgccaatccctactctaaaacatcatccatttgagcccattcttatatttttaattcactaattgataaattttcaaaaccctcccatgaaatgaggagctgacacatgttttatgtttgaaagaaactagggcagagattagtaaaatgacttttctgaggttgcagggagctaaaaatggacctcagagccccagtttgtcctacttgttgccagaaagctctatgatgtgtcttctgtcagcatgcagttcttgcatagctctgacacctatgacctaccttaaaggttgttctaggaacaatgtcaacattcaccagagaagtacaacttttaatatgaaaatgccatgactcctcccttccttttggtgggtgttcacagggaggaggtctgctaatcaatcacagggtttgcatctgctctcccactctaaccagcacctttgtgggaggggtacagaggacaggaaatgatagcagggggcagcccagtcacaatggaatgctgaatacaagtgcaaataattattaggaaggtgaaaattacatagcaatttgcgcttactaatggtcgacagaaaaacagccccattgtactttcaaaaagttaattgtccatagtgttttggaaaaatgttgcttattatcattgtggaattttataaggcttctgtgtaaatgtccttaactcatttttggtgatattctgttctagattgttctctcagcttctcctttctctcaccattctccttttgctccaagctcatgagaggttcctcaggtggttcttttttttttttaagctcaacatttaaacttcagtttcccacattatcaagcccgcattcctacataaaacccccaaaagggtaaaggattaataagttgaatatgttggtaccatttggttttggtccagaaattactggagactcatggctattctcctacaggagataaaggagaccaacaaaaatcagtttgcactgcctagaatattgtctgggaaatagtatgcagttaataagtatttgttgaatagatgtttagatgtatgtttgtatcagtagatgggtggatgaatggatggatggatgaataagcctgtttctgaagccttatattcagtgggccataagggaaaatgctgatacaaaaatcagtgagtatctcttcttaaattactgatgtagaaatgtcactagaagaatttaggcattagccaggtgtggtggctcacgcttgtaatcccagcactttgggaggccaaggcgggcagatcatgaggtcaggggtttgagaccagcctgaccaatatggtgaaaccccatctctactaaaaatacaaaaattagccaggcatggtggtgcgtgcctataatcccagctactcaggaggccgaggcaagagaatcacttgaacccaggaggtggagattgcagtgagctgagatcgcaccattgcacttcagcctgggcgacagagtaagactctgtctcaaaaaaaaaaaaaaaaaaaaaaaagaatttaggcatttagtgggatacaccttactcctgcaagaatggccataatcaaaaaaccaaaaaatagtagatattgatgtggatgcagtgaacagggaacatttctacactgctggtgggaatataagctagtacaaccgctatggaaaacagtatggagattccttaaacaactaaaagtagaactaccatttgatccagcaatcccactactgggtatctacccagaggaaaagaagtcatacgaaaaagatacttgcacatgcatgtttacagcagcacaattcgcaattccaaaaacatggaaccaactcaaatgcccatcaatcaacaagtggattaagaaactttggtgtatatatatacgatggaatactacacagccataaaaaggaatgaattaatggcattcacagcgacctggatgggattggagactattattctaagtgaagtaactcaggaatggaagaccaaacatcatatgttctcactcataagtgggagctaagctatgagaatgtcaaggcataaaaatgacacaatggactttggggactcagaggaaagagtgggaagcaggtgaggaataaaagactacaaatagggtacaatgtatactgctcgggtgatgggtgcgccaaaatctcacaaatcaccactaaagaacttactcatgtaactaaacaccacctgttcccccaataacctatggaaataaaaaaaaaattataagaatttaggcatttaggtaaagcctttattttataataagacactaaacgtttatcaaaaccttgtcaccaattcataagttagtgtggctgtttatcagaaattcaagatgcaataaaattatctttctggaaatagtgtcgttgcagtgtattttagcaacaagtggcatagaataataaagcacagaaataagagtaaaaaaacttggggtaaaatcccagctctttcagtgttagctctgtgatggtggattatcactaggacactgtgggcctcacttttctcattatacaacaatgtgtttggactagaaatctgtatcatctgggaatcctgtgaggtacaagcaacaaaaaattctaagtcaatttggcttcaatgataaaaataatttgttggtttatgtacctaaaaaataaatgataaaactgttacagccaaaaggagtctaaggatacatgacaactcaatgtaatatgctatactggttggaattttggaacaaataaaggacattaggtaaaacctaaagaaatctgaataaaatgtggactttagttaataataatgtatcaatattggttcataaattgtgacaaatgtaccacactaatgtaagatgttaacaataggggaaactgagtgccacatatacaggaatgctctgtactctgtaatttttctgcaaatctaaaagtgttctaaaataatgtcagacataagaaatacacaaaacaggataatgtcagcaagatggcggactaggaagcttcagttcctcattctcccacagagccacaaaattaacaacaagttattgaccagaataactttgtgagaattctaaagaccagttgaaaagttacagcatctagaccaatgtaaaaccaagaaggaattccagcaaaaaggaaaggaaacttttaaaaagttttgcatacctgttatcaatgcttctctccctatctgatttaggatagtgcaactaacaggaaacctcccaccttgggaatcctcttttaggatgaaaacaaaagagcggaccatgcatctagcatttgggctagtctggaggctgtctaaggaactggttcctgagttacgttactcagagcactgatgggacttggtgaagcactggtggccttctttggaagctgctgaaaacaagacatgatcctcagggcatgttatagctgcagttccaaaggcagacaccagcagaatgttcacaggcttctaagaagaaacaggaacaacaagcttcttaggaaattggagatgttttaaagcatagacacaaacgcagagaagacagcatatccttagaaaaagtttggagaggtcctagaatctatcgcggagctaatccgtgaagatttttccctgcacaaagtcagactataaagactaggagaggtggttgtttctcaaatgcccaagtctcaacaacagcagtgacaaatcccaaggcatactaggagagaggaaaaccaggcccaatcaaagtgccaaaataaaactccagaaactgaccctaaagaaacacagatcaattctccctcacaaagaatgtaaagtaactgtactaaacatgctcaatgaactaaaatggaacacagataaacaactaaataaattcaggaaaatgatgcatgaacaaaataagcatatcaacaaagagacacaaactataaagaagaaccaaacaaattctggaagtgaaaaatataataacagaacagaaaaaaattcaagaggtttcaacagaagactggatttgacagaaaaaaaaaacaaacttaaagacagattattagaagtcattattagaagtaatcaagtcagaggattaaaaagaaaaaaataaaagtgaagagagcctaagagacttacggacactgacaggtaaaccattgtatgcatgatgggagtcccagaaggaaaagagagggagtaagtgttatttgaaccaacaatggccaaaaacttttcaaacttgaggaaaaaaaatgggcatgcaaattcaagaggctcaaagaactacaaccaagataaattcaaaaagacccacaagaagatgcattgtaatcaaattgtcaaaagtcaaagacaaagaatcttgaaagcagcgagagaaaaataactcatcacatacaaaacagcttccataaggttatcagtggaattaccaatagataacttacaggccagaaggaagtgacaaagaatactgtatccagaaattgccacagccacccaaccttcagcagcccccaccctgaacagtcagcagccatcaacaccgaggcaaaatcttccgttagcaaaaagattatgatttgctgaaggctcagacaattgttgccacattttagcaatgaagtatttttaattaaggtgtgtacattgttttttaaggcacaatgttattgcacattcaatagactatagtatggtatgaacatattttttaagttctgggatacatgtgtaggacatgcaggtttattacacaggtaaacatctgccatggtagtttattgcacctatcaacccatcaccttggtattaagccctacatgcattagctatttatcctgacgctctccctccccccacaacccccaactacaggccccagtgtgtgttgttcctctccgtgtccatgtgttctcatttttcagctcctgctggtaagtgagaacatgtggtgtttggttttctgttcctgcattagtttgctgaggataatggctttgagctccatccatgtccctgcaaaggacaagatctcattcctttttatggctgcatagtattctgtggtgtatatgtaccacattttctttatccagtctatcattgatgggcatttagattgattccatgtcttttctattgtaaatattgctgcagtgaacatatgtgtacatgtaactttataatagaatgatctatattcctttgggtacatacccagtaatggcatggctgagtcaaatggtatttctggttttaagtttttgactaattgccccactgtcttccacaatgtttgaaactaatttacattaccaaaagtgtgaaaacattcctatttctccacagccttgccagcatctgttgtttctagactttttaataattaccattctgactggcatgagatgatatcttattgtggttttgatttgcatttctctgatgatcagtgatgttgagcttttcttcatatatttcttggccacataaatgtcttctgttgagaagcgtctgttcgtatcctttgcccactttttaatagggttgttttttcttgtaaatttgtttaaattccttgtagattctggatatgagacctttgtcagatggatatattgcaaaaattttctcccattctatatattgtatgttcactctgatgatagtttattttgctgtgcagaagctctttagtttaattagatcctatttgtcagtttttgtttctgttgcaattgattttgatgtttccatcatgaaatctttgcctgtgcctacgtcctgaatggtactgcctagattttcttctagggattttatagttttgtgttttacatttaagtctctaatcgctctggagtcaatttttgtataagatctaaggaaggggtccagtttcaattttctacatatggctagccagttctcccagcaccatttattaaatagggaattctttccccattgcttgtttttgtcaggtttgtcaaagatcagatcattgtaaatgtgcagtcatatttctgagatatctattctgttccattggtctatgtgtccgtttttctaccagtaccatgctgttttggttaccgtagccttacaatatagtttgaagtctggtagagtgatgcctcaagctttgttctttttgcttaggattgtcttggctatatgagctcctttttggttccatatgaattttaaagtagtttttgctaattctgtgaagaatgtcaatggtagttcaatgggaatagcactgaatatataaattacttcgggcagtatggccattttcaaggtattgattcttcctatccatgagcatggaatgtttctccatttgtgtgtgtcctctctgatttctttgagcagtggtttctagttctccttgaagaggtccttcacttcccttgttagctgtattcctaggtgttttattctctttgtagcaatcgtgaatgggacttcattcatggtttggctctctgcttgtctgttattggtgtataggaatgcttgtgatttttgcacattgattttgtatcctgagactttgctgaagttgcttatcagcttaagaagctttggggctgagatgatggggttttctagatatgggatcatgtcgtctacaaacagagacagtttgacttcctctcttcctatttgaataccctttctttctttctcttgcctgattgccctggccagaacttccaatactatgttgaataggaatggtgagagagggcatccttgtcttgtggcagttttcaaggggaatgcatccagctttggcccattctgtatgatattggctgtaggtttgtcataaatggctcttattattttgaggtatgttccatcaatacctagcttattgagagtttttaacatgaagagatgttgaattttattgaaggccttttccacgtctattatcaaatggtttttgtctttagttcagtttatgtgatgaattatgttcattgatttgcatatgttgaaccagccttgcatcctggggattaagccaacttaattgtggtggataagctttttgatgtgctgctggatttggtttgccagtattttattgaggatttttgcctcgatgttcatcagggatattggcctgaagtttttcttttttgttgtatctctgccaggttttggtatcaggatgatgctggcctcataaaatgagttagggaggagtctctccttttcaattgtttgcattagtttcagaagaaatgacactagctcccctttgtaccttaggtagaattcagctgtaaatccgtctggccctgggctttttattttttggttggtaggctatttattactgcctcaatttcagaacttgttattggtctattcagggattcagcttcttcctgattcagtcttgggagggtgtatatgtccaggattttttccatttcttctagattttctagtttgtttgcatagaggtatttatagtatgctctgatggttgtttctatttttgtggggtcagtggtgatatcccctttattatttttattgtgtttatctgattcttctgtcttttcttagctagcagtctgttttattaattttttcaaaaaaccagctcctggattcattgattttttaaaatgtgttttcatgtctctatctccttcagttctgctctgatcttggttgtttcttgtcttctgctagctttggggtttgtttgctcttggttctctagttattttacttgtgatattagggagtcaatttgagatctttctagcttttcgatgtgctagaaatttcccacttaacactgctttatctgcgtcccagagattctggtatgttgtctcttttttctcattggtttcaaagaacttcttgatttctgccttaatttcattatttacccaagagtcattcaggagcaggttgttcaattttcatgtaattgtgtggttttgagcgagtttcttaatcttgagtcccaatttgatggcactgtgatctgaaaggctgttatgatttcagttgttttgcatttcttgaggagtgtttcacttccctttatgtgatctattttagactaagtgccatgtggcactgagaagaatgtatattctgttatttttgagtagagagttctgtagatatctattaggtccacttgatccagagctgagttcaagtcctgaatatccttgttaattttctgtctcgatgatctgtctaatattgacagtggggtcgatagtgggagacttctcccactattattgtgtggcagtctaagtctctttgtaagtctctaagaacttgttttatgaatctgggtgctcctgtattgggtgcatatgtatatttaggatagttagctcttcttgttgaattcacccctttaccattatataatgccctcctttgtcttttttttatctgtgttggtttaaagtctgttttatcagaaattagaattgcaatccctgcttttttctgctttctatttgcttgataaatttttttctatccctttattttgagcctatgtgtgtctttgcatgtgagatgggtctcttgaatattgcaagctgatgggtcttgactctttatccaacttgacattctgtgtcttttaattggagcatttaggccatttacatttaaggttaatattgttatgtgtgaatttaatactgtcatcatgatgctagctggttactttgcagacttgttgatgtagttgcttcatagtgtcattggtctttgtacttcagtgtgtttttgtagtggcttgtgatagtttttcctttccatatttagtgcttctttcaggaactcttgcaaggcaggcctggtggtgacgaattccctcagcatttgcttgtctgaaaaggattttatttctccttcacttatgaagcttagtttggccagaaatgaaattccgggttggaaattcttttaagaatgttgaataatgccccccaatctcttctggcttgcagggttcctgctgagagatctgttattctgatgagcttccctatctaggtgacctggcctttctctctggctgcccttaacattttttccttcattttgaccttggagaatctgatgattatgtgtcttggggttgatcttctcatggagtatcttactggggttctctagatttactgaatttgaatgtttgcctgtcttgctaggttggggaagttctcctggatgatatcctgaagtatgttttccaacttggttctgttccccctgtctctttccggtactcaatcagtcataggttcagtctttttacataatcccatagtgctcagaggttttgttcattccttttcgttctttttttttttttttttttcctaatcttgtcgacctgtcttatttcagcaagatagtcttcatgctctgaaattctttcctctgcttggtctatttggctattgatacttgtggttgcattgtgaagttcttgtgttgtgtttttcagctccgtcaggtcattcatgttcctctctaaactggttattctggttaatggctcctgaaatgttttatcatgattcttagcttctttgtattgggttagaacatactcctttagctcagcaaagttcgttattacccaccttctgaagcctacttctgtcaattcatccatctcagcctctgcccagttctgtcctcttgctggtgttctgatcatttggaggagaagaggcactctggctttttgagctttcagtctttttttgttgattcgttctaatcttcatgagtttatctagcttcaatctttgaggctgctgactgttggatggggtttttgtggtgacttttttgttgatgctgttgttgttactttctgtttgtttttcttctaactgtcaggcccctcttccgtagggttgccatggtttgctgggaatccactccagaccctatttgtctgggtccctcccacacctggaggtatcaccagtagaagctgcagaacagcaaagatggctgcctgctccttcctctgggatctctgtcccagaggggcaccaacatgatgctagcaggaatgcccctgaataaggtatctggtgacccctgttgggggttctcatccagtcaggaggcacaggatccaggacctgcttaacgaagcactctggctgccccttggcagagggggtgtgccgcactggggggattcacactaatctggtgtgccgggattcctccgagccagcagggggaaagactaagtctgctgatccatggagactgtggcctcccctcccccaaggggctcttttccagggagatttgagttctgtccttaaacccctagctggagttgctgaaattcctacaggtaggccccgcccggtgagtagagaggggtcagagtctggcctaaagaggcagtctggccacgatctgccacagctgctgtgtgggctatggggtattccccctgggtccaaaccatccagtctccccagcctcagcagactggagctgcagcgatggtggccacccctccccctgggaggtcagtcatcttaggcagcaggcagccacagtgatggccgctgcccttctccatgggagctcaatagtcttaggcagtaggcaaccagagagatgacagccacccctccccctgtaaattggtagtcttaggcagtctccagccgagtggctgctgagaatctgcacagctatgtgcttgggacccaaggccctggtggcatgggctcaagaggtgaatctcctgattcccgggttgcacagattgtggaaaaaacctttggctgataccagacaaagacattacaagaaaataaaactagagcccaataaccctgatgaacactgatgcaaaaatcctcaagaaaatactaatatactgaattcaacagcacattaatgcagaaaaagcatttgataagattcaacaacctttcatgataaaagaaaaaacactcagcaaactaatagaaggaaactacctcaaaataataaaggctatctataaaaagcccaaagttaacattatactcaatgctgaaaaactgagtttttcctctaggattaggaaggtggcaaggacacccactttcaccacttctattcaatgtagattggaagtcctagattaggcaagggaaaaaaataaaacatccaaattggaaaggaagagctaaaattgtctctattcacagatgacacgagcttatatgtagaaaacactaaaaattacgtgcgcgcgtgcacacacacacacacacacacaaactgctaaaacaaattcagcaaagttacaggtcacagaacagtcagttgcatctcaaaaggaataatcaaaaaggaaattaagaaaataattccatttacaatagcactaaaataaaatacttcagaataaacctaaccaaggagatgaaagacttatacactgaaaactgtaaaacattgctgaaagaaagtaaagacgacaaaaataaatggaaagacattccatactaatggattggaagacttaatattgttaaatgtcaatattgcccaaagcagtctacaaattcaacacaattcctgtaaatatgacagtgaaatttttttcagtaagaggaaaacattatcctaatttttgtatgacagctcaaggaatcctgaataatcaaatcaattttttaaaagaaaaccaaattggaggattcacattttctgatttcaaaaaatattataaaagctttggtaatcaaaacagtgtgatagtggtataaagacagacatatagtccaatggaataaaatagagagaccagaaatataccttcacatacatgattaaatgatctttgacaaggctgccaaactgaaaaactcttaaaagagaacatgggggaaagctttatgacattggatttgacaatgatttcttggatatgacaccaaaagcctaatataaggcaacagaggaaaaaatagacaaatgggactacattaaatttcaaaacttttgtgcctcataaaacatgatcaacagaatgaaaatcatgcaacctatggaatgggaggaaatatttgcaaatcatatatctgatatgaggttaatattcagaatataaaaagaacatctacaactcaacagcaaaatgtcaaacaactcaatttaaaaatgggcaaggaacttgaatagacatttcttcaaagatgataaatgaccaacaaacatgtgaaaggatgctcaacatcactattcatcagggaaatgcaaaccaaaactacaataagataccacatacgttaggatagctactctcataaaaagaggaaataattagtgttggcaagaatgtggagaaattggaacccttatgcactgttagtgggaaggaaagtggtataactaatgtggaaaacagtatggcaagtcctcaaaaaattaaaaatataactactatatgatccaacaatcccactagtgtgtatacatccaaaacaattgaaagcaaggtttcaaagaggtatttgcatacttttgttcataggagtgttattcacaatagccaagaggtagaagcaacccagatgtccatcaacagatgaataaacaaaatgtggtctttacatatagtggaaaactatggaaatactgttatatgctacaacaaggatgaaccttgatgacattatgctaagtaaaataagccagttccaaaggacaaatactgtagattccactcatatgaggtatctaaagtagtcatatggaaaacaaaatggtggttaccaggagctgagggaaacagatgaaggacagttgtttaatgggtataaactttcacttttgcaaagtgaaaaagttctggagatctgttgtgcaacaatgtgaatgcacttaacactcctgaactttatactttaaaatggctaaaattacaagtgttttttccccacagttaaaaaaaaaaatacacaaagtgcatgccagtgccactgtcagaagaagtagtttaaagaaggtcccagaggcatcaggactctgtttcatccctctgagctctcttcactttgccttactctttgagtttcatccctgatatctgcatccctttccatcttcacattggccattcagaagagaaagagaacctgtgtcccagcattctcagaatcagccatgctactcactgattggactggtggaagccacacacccaaaactgaaccagttactatgggcaggagagatgggaggtgtgggttggcttaagccaagtagggcctgcctctaaaatggaaatggaattgatcccacccagaccacttggggaagagatggttttctaatgggaccaggaatcagcaaactttcccggtgaaagaccacacagtaaatattttaggctttgtgggtcatacggtttctgttgcagctactcaactctgccattgcatcatgaaagcaaccagagacgctaagtaaatgaatgagcatggctgtgctccaaaaaaactttacagacactgaaatttgaattttatataattttcaggtatcatgaaatattctttaaccactaaaatatgtaaaaatcattcttagctcataggtggctgataggatttggcccacaggctatagtttgcagactcccgttctagagaatatatccaaatgcctttttagcttggtgattatttttctttataattttaccggggttgccttcaatcctcctgcaatacctataatgagaccaccctcagctggtgtatttgctcagaatcctcaacccaactagcaacaaggcatttggaagatcgtgcaatctcttctcctttccccatctgcaatggattgtcacaatatgtttgttatcatagcacacttgggatatacaagataatacgctgttaaatattaatgataataattctcctcctccaccattattggaaattaaagacatgacttcaactccataggtacgatttatagagttaggtttaaactctgtcatgtggctaagcaattgttcttctatttttgttcacctttagcagtgacttttttcctagcttaaatatttagtagactggaactgtcttcaggatgatatatttcttaaaggctttattttccagtcattggacagagttctattatgtaaatgattaaagcaagtattcaaaatgtgagtttaaagatcttcagaatcagagggtgaccctggagagagagagataggaggtagagctgaacaataaagagaaaagggagaataaagtcaaggaagcttttaaattcctataaggagcaggtttggttgaatttctgaagaaagataaaaaaaaaaaactggcttgggaaaaagtaaaattcactggaatacccatggggctataggagggcaatgatatgttttaaaatgaaaatggaaaactgtggaattatttggttaaatgtattttggcagcctttggattttagttcaaatacctttagcacatataatgactttgttctttatgacctacctagttacttcttcaaaaaaaaaaaaaaaaattctgagcctcaaactagcctgtggtgcactcacaaaagccacccctttggggccattttgtcccagccagtggcatctttgtgctaagtttcaaggttctatgagaagactagatttcaacccccatttggctccttggacaagccccctgcatagccatttgcactggccggggtctgaggtgattcatgataaatgacatatctgattgggtagcagtgcacttgagttgctgttccccaggtagactttccaaacaaggtcaaaaagccattcagggtacagggctttgaaggaccacatagaattcacctctgttgacactaatgcatgtattgaatagaggacttagttgtctagctctttacaaaactaaattgtcctaattctggaagattacaatttataaactccagaactttattatagtgattgctttaatggcaattgattttcttttcctttttttttttttttttttttcttttgagacagagtctcactctgtcacccaagctggagtgcagtggcatgatctcagctcactgcaacctctgcctgcctgattcaagtgattttcccacctcagcctcccaggtagctgagactacaggcacacaccaccatgcctggctaatttttgtatttttagtagagaaggggtttcaccatgttggccagaatgggctggaactcctgacctcgggtgatctgcccacctctgcctcccatagcgctgggattccaggcgtgagccaccgcgcccagctggcaattgattgtctaatgcctattttacaattgcttccttctatgctctcttaagccctcattgtgaggcccactcaaggttaaggaggaacctctgactctttctctgagtggctccataatgcttttgctgtttactttatctgttttctccagggactttgttgttgttttatttttctttcattttctaaaatttaggactgccaaatgttaaactgtccccctgacatagcttttagctttaaatgtggcttctaatagcagccccttcataagatatcctgctgcctgatttccttttaatttgtagtttataacctcctgccaaccaggtaacaacaaactgaggttgttagaactatttataagataaaagttaataggctctaagtgagagcctcatgggctctcatgaaacattagcctgaggtttggtgctcaggttgtatgctgtctccttgacactcattcttttggtttgaattccccatatcttttccagtgcttgattgttgtattcctgacagttgcatttataggaaaatgacctctaaataatgttaaggtggaggctttttattatttttgaaataaaagctaagctgcaggaaagcctggtggttaggggtgtgaagtctagagtgaagctccctggggttggatcttctgtatcactttccagccacttgagggtgggcatgctgcctttctgtagtttgctttattcgtctgtaaaatgagcataattgtacttactccactgaattgtaagagggtgtcaaaagacaaaattaaaacaaagttagttatagatctaattggcttttatttgcaattcatgaaaccgggcagcctccattctataaaatggaatgagagctccactgggcaatgacagaacagtgagttttgtaaggtggcaataaggaaacagaataattgggaaaaaaaaaaaaaaagaacacctgctgagcatggtagctcatgcctgtaatctcagcactttgggaagtcaaggtaggaggatctcttgaggccaggagttcaagaccagcctgggcaacatagtgagaccatcatctctaaaaaagtttaaaaattaggcaggcttggtggcatgcacctgtagtcccagctactcaggaggctgaggcaggaggattacttgagccccagagttggaggctatagtgagctatgattgtgcccctgcaccccagcctgggtgacagagtgagaccctgtcacgataataacaaaagaaaaaaaagtttaaaaactgattggttaccttcaggttacttttatgggagggttaaagcaaaggggacttccttattaggctgactcagatggactggaatctcctgttttcaggaaaaactggtctattttggaatctatctccttccttaaaacttcagtttgattatgtgacatttagcatgagtgacttcattttggtttacactggtctgttggggcctactgcaggagctcagtccaaaacaatggcctcctataatttttgtttaacaagggttaaatgacttattcatatgaagtgctaagaacaggaagcactcaagtcttagcttttaatcaccattaatatgatgatgatgatgatggagagaaggaagaagagaacaagtaaggaagcagactctccaaacagacttcaaattaaatatcattagtgtgcctggtgtcttggaaaagatgatgtgtagtgtccttttctgctacctgtcgctctgaaatatataaagttgtagatatggcaaattttaggcttatcatgtttgaccttgatattctctgcctcctcttttagcccctgtttcctacagcatcatctccttgatgcccttcttcttctccaatgagaacctgcattgagaaatggatctgatagagtcagtcacactagagcaagcttgtccaacccgcaatccatgggacatatgcaccccaggacagctttgaatgtggcctaacacaaattcataaactttcttcaaacattgtgggaaatgttttgcgattctttttttgttttgtttttagctcatcaggtatcattagtgttagtgtatttcatgtgtggcccaagataattcttcttcttccaatgtgacccaaggaagccaaaagattggacacccctgcgctacagtctgacggaggagactgtgtactactcctcctgggggtatttgcattttcttaaaggaaaatgcctttaactagacaactgattctaatagtaaaagttctgataccaaagactaccccatcccccctcgccacttttctgcccacctgccaacctgcattcctataaacatacaaacactctgttttgaagtttaggcacaactgaccagcattaaggttaaaatagagatcataagactgacaaagcagactctttgtggcaataagataccaaattataaacatggcctatggtcatgcaaggcaacgttaagtcacaccctacaaaccataatatctcattaaacagatttttttattcaccaggtaaaatatggcttatgttccaacctgactctggcatagcatctcatgacagagcagatcctgaaggaaattatttcaccccaaaatatatttctttgacatattttgaaatggccatgcaaagctgtcttttgtggccgtttctactgcttaaacattcatgtacaagtctttgcatgtgaacatattcttttttatttttcttaagtagatacctgggagtaaaattgctggatcatatggttactcttttaaaagaaactgccaaatgttttccatttgacgttcttaccagcaatatgtgaatccagtttctccatatccttgacaatatttgtggttatctgtctttctgattatagccattctagtgagagtgaagtggcatctgattgtggttttgatttgtatttcccctgtgattaatgatgttgataatcttttcatatgcctattgaccatttgtgtatctgtttttggagaaatagctaatttcaagtcttttgcctacttttaaattgggtcattcatcttccaattaataagttgaaagagttcttcatattctggataaaatatttctttttatttcctgaaatattttgttataatctttttctcaagtctgagagtgctacagggtaggtaatttaaagttgagggccttcgaaatgcctcctcacaggagcagcactgattagcggttcccacaagcgtatagccatctgcaggctcccctggtgggtttgttcccttggtgtgaccaattcatcaaagtatagtctgtctgtgtcactctctccatagcaagagctgggtgcagtctgacatcagccatcatctgccctgaattttaattttaagcaccttcggtactgatgttcactcctgaaatctagagcagccagagtaagtgacaggagcctataatgagaaccttttctggaatattattcttaacacatgcatagatttgcccctctggtcacaaagagccccttggggcaaatcgcgttgttagcagttgacggagtgcagaaactgctgactccagagatttccatttctaaaggactttagagtaatcctattgtcagtttcactcatcacacctccctctggatccttttcccttttccctcccatgccaacctttataacacattctctaaatcttcctcttgcatgagctgtagccatctggtggtcaaatgggcattaaaagtgcctttgacagcatcgtggaaattgtaattcttgtgttttcaagacagatagctaacaggtgacaacaaaggttttcaacttccagaagttatcatatgagaaaatagtctgatattttactaagccaaaactatttcttatgctttaaaataatgttgtcttatacatcagtgtacatatcaacgagaaattactcacaggtggtgcttgttaaattctcaatctttcacaacacatttagttttaagtgctgctcttaaaatgcccaggagtctaagccctagaattacaagtttaaaaaaaaaagtgctttttcttatctacagtctgtcttcatctgctgtatccaacccagtttcatgggttatcatataaccaaatcaaattatggaaagctggaaaaaaaataagcaattcctaaagaaaacaatggctttagttgatcattttgtctttgagattgtaaactcataattggtatgcctcttgagggataaatgtttgagtgactgtgggggcctcacattcctcatagtgcttaattaaagcttttactgatttttcaattgttggagaatacaatgttagtggcatctttttggctgagtcctcacctagagaactcactagaggtgtttccactcatgttgcttggtatttagcctcatttttcccttcgttaatttacatctctgtttattttattgtcactgcttctgttaatataaatgatccttgttaatcctttgggtttaagacttgcaatattaattggcccttacccaacagcagagatctgagttacagtttttttttttttttttttgtcttccttctttgtgaaacataagcaaatcaccacacttttagaatctggctgtttttttgttggttggtgcattctgctttgcatttctgagaactccttcactcaggctaaatatccttctcccattttagacatctgcatggcaaccagatgtagacaaaagtgtaatctacactgggtcaatatacctgaaaacacccttgtaaacgttagttcctatctggagctcaatgacgacaatgcctatgctactttcatatgttaagtcctactagtgaaactttcttacagagatgggatgccgttgttggaatttttcctaagatgttagacagagcttctcaaattttcaattcaaggacattttaaggcataagaagtctttttggcttaatggggaaattgaaatgttctctcatgcaataacttctggcatttaaaaacttctctattattatccatcaaccaaccaattaacagaaatttattgattaattgccatatgccaaatgatgtagtaagtaccatgagaagtaggaagccaaaatgtgaccctgattttaaggagcataaatttgttcatctattcatttattcatccattcattcaactaatattaactaaatgttcagtgtgtgccagacacataatctagttaaggcaaaataagcatagcaaaaatatgtaagaactgtgtagcaggatatcagagataagacaaaactcccaggagctagtagttggcagagctaacatatcttatcttcctcacagtagccagtctgttagtctgtttttttttgtttttgttttttttttttttttttggagacagagtcttgctgtgtcacccaggctggagtgcagtggtacgatctcggctcactgcaacctccaccttctgggttcaagcaattctcctgcctcagcctcccaagtaactgggactactggcacccaccaccacgcccagctaatttttgtatttttagtagagacagggtttcaccacgttggccaggctcgtcttgaactcctgacttgtgatccacccacctcggcctcccaaagtgctgggattacaggtgtgagccactgcacccctggcccagtctggtaatttctttcacttctgatgcagttgcaaagcctccatggcctgacccagcctgcactgggctcctcatattaaaaacacttgccagagtgaaaagaaagataacagcattgctaagtggaagactcctctttgaatcatcttgaccgttgttccaagggagtattgtttgtagcacagatgtactctgtaaaaatccagtgttaggagtcattaaataaatctcacctgaaaaagccttctttgtattgacatttaacctggtattcaagattatccagatctatccttgagtcacttatttatcaacctacccagactggttctctcattctgttagttatctattgctgcataacaaatttcttcaaaacttagtggcctaaaacaacttacagttattctctcccatgggtcagaaatttgggcctggctaagtggatcctccaccccagggtctctcacaaggctgcaatcaaagggctgactaggacttggaatctcatttgaaagttagattggggaaggatctgcttccaagctcactcagtagttactggcaggattaggtttctccaaggtcgttggactaagggtctcagttcctcactgacagttggcctgaggctgccttcagtttcttgccatgtgggcctccccagcataactgtttacttcatcaaaacaaacaaactgagaaggctaaaaagagtttgctagcaagtagcaagatgaaaatcataatttttgcaatctaatcatagaagtgatatctccccaatgttgccatattctgttagttagaagcaagttattcaagggaaggagaatcctctaggtagttactatcaagaggcaggcatcattggaggccaactcagaagctgcctagcagatgcataattattttgttcaacaaacatttatccattatccaacatgttagtcactgaggtacaactaggattaataagtggctcttattctcaagatactcacagtctgcctgggaacatggatcaaccaatctttaacatggaaaatcttatagtagaggcagattcaaaacccaaatgagagcacagaaaagagagatgccttttttcatgaaggatcccctgaccagaatgccatttcacagtttaaaacaaacttaatgtgttctagtctattcaggaggctgggaagttcaagatcacaacaccagcaaattcagtgtcagctgaaggcccatttcctggttcagagatgacaccttatagatgtgtactcatatggttggggggtgggggtggggagcacaccagttctcagagatttcttttataagaaccctaatcctatgagagttgagcccttttgacctagtcatctcccaaaggccccacatcttaatatatcaccttggaatttaggatttcaacatgaattttaggggcacacaaacactcaggccatagaacttcttctgttggacctcctttgacactcttgtttccttaactacatttttaaaagaggtgacattagaggtggttcttaagaaatcaagtaagtagaaacagctttccaagtgtaaaacaacaaaatgaaagatgtagggatatgatgcaatgtgacacatgctaggaatgatggaattacaatatgaccagattgcttggatgtggtcagggatggagaattatcatggcaggcagtaaatctagaaacatgaattggagtcactggagaaaaggaaagtgaatgctatgtcaagatgcttgggctttgtcatttaggaagtagagagccactgaagatctctaattagtggaataatatggtgaaatgcatgccttacaaaggaactgcagaagcagggtggagaatttactggagttactagataagaagggagagataatatttcaaggagaattgacaacaatgaaaaagaggataaatatttttcaaaggccatggagatgaaaatttcaaaatcaggagatgttttagggctggaattgacaggattatcagatccagggaagagttgtgagaaatgagggggtgatatcaaagagccaaggatttccctgaaatttctatctcaggggaatagaagtctcttaaaagaaggaccatagcttagttgacttcagaatattaacattttaattgtgcttaggacttgtttggtattcactggattgacaggaggatggatggatggatggatgaatagatgaatggtggatgtatggtgcatagttggatgggtaggtaggtgagtcagtgggtggttagatgtgtggatggatgtatggataatgttggcagtcatccaaggaaatgcaagagggaagttagttttagggatagaggacagaacggatagaaggaagtaataagaatctcagatggctaagataatggtggaaagaacaaggagagcaattagaaaattaatctagttttttatggtaatccagtggctttgatatttctcaatggcaatttattgtttcattagattcaacaaatttcaagaaagagtagtttctttggagaacaaaactaattatttgtgcaaatcatattaacattgtggaaattcattcaatttctcggcactttgtcttaaaatgttatgcaaagtctggccatcaaagccatttagcatcccttcagttttagtaagggacgtgggaatattgatttattttcccagaaacgcaaatcaagaagttccctcctttcatatctcacactaaccttacctttaactttctaccagtggcacaaccataactcttggcaatcctcaagtttcttggacatcagattttctgaggcagtgcttctcaaactttaaagtgcatcatctggagatttaaaatgtgaattctgatttttgaggcctggctggggcttgagattccacatttctaataagcttccaggaagtactgatattgttgatccatgaaccacattttgggtggcaaggttcttaaggtatcattcaatattggtgacttggctgacatcactattgttgacacagttaggctgtcaactggctttcaattcaaaatttcatttacctcctacccctgctcataatctccctgggtgattttatattatctatcccttctctaatgcctccatttgctccaacttaataataatatgcatgggtagctccaacatgctgtcttcccctcctccagatccctaatgaagctgtcaaataggaccttcttaccactccctcctgcttttcctcactatttcttagcttaatgctttctttatagttcttatatttagtccttggtctcttgttccttaaagtcttcaaacactcacaatcgattaaggttcagaggtaaaggatcaagccccattttttgagtaagaatttggtatctaataacttacagtgtttggaaggtcaacaatgtatgtgagaaaaacaaacgacaaaagcagcaggcatgggtcactggggaatgatgttttcactagaaacaaggcagctcaagtatcaaccctgctgctgaacaattgcatgaccttgaggaaatcacttaccctacctgagccaacattttagcagctgtaaaatagtacattaaatttagatgatctctatggtcttttaaaattaattatgtagaggccaactcagcctcatatcttcattatatgtttaaactagaagagaggttcctaacatgaggttcatggatctccaaggactctgtggatagacttcagagagtccatgaagttggatgggaggtgaatttcatgttactttcactgacctctgactgtaagtgagcaatttcttcaataaggaatataaactatagactagagtagtattagcagtatctgtgacttggttaccgagacgcaacaaataaatattatatcacattaaagtttgtgtagatataacattcatgctcaccactacttcgaaaatttggtgcttattagactctccactacatcttcttgttgaacatgttagtgaaggagtacatctatttattatagcccagtggctgtcaataaggggacgttttgccccacaggacacacctaacaacatctggagacatttgggattgttgtaattggagaaaggaattctattggcatctagtgggtaaaggcaagggatgctgctaagtatcctgcagtacacaggacagcttttcagcagaaataattacccagtccaaaatgtcaagagtgctaagattgagaaacctgcgacagccttttaaaaatattattttgataattatgttttagtataataaattttctttgtaatcctgtgtattttattttatgcatttacaaacgttgttcttaaaagttgttcccatggccttgctagactatcaaaggaaactgatatggttgggctgtgtccacacccagatctcatcttgaattcccatgtgttgtaggagagacccagtgggaggtaaatgaatcatgggggcaggtcttccctgtgctgtcctcatgatagtgaataagtctcatgagacctgatggttttataagaggagttccctgcacaagctctcttgtctgccaccacgtgagacctgcctttcagcttccagcgtgatcatgaggcctccgcaaccacgtggagctataagtccaataaacctctttcttttgtaaattgcccagtctcaggtatgtctttatcagcagcgtgaaaatggactaatacagtaaattggtaccaggagagtggggcactgctgaagatacctgaaaatgtggaagcaactttggaactgggtaacgggcagaggtttgaacagtttggagggctcagaaaaagacaggaaaatgtgggaaagcttggaactccctagagacttgttgaatggctttgaccaaaatgctgataatgatatggacagtgaaatccaggctgaagtagtctgagaatgagatgaggaacttgatgggaactggagcaaaggtgactcttgttatgttttagcaaagagactgctggcattttgcccctgccctagagatttgtggaactttgaacttcagagagatggtttagggtatctggcagaagaaatttctaagcagcaaagcattgaagagatgacttaggtgctgttaaaggcattcagttttataagggaagcagagcataaaagttcaaaaatttgcagcctgacaatgcaatagaaaagaaaatcccattttctgaggagaaattcaagcaggctgcagaaatttgcacaagtaacaaggagctgaatgttaatccctgagacagtggggaaaatgtctccagggcatgtcagagtcttcacggaatcccctcccatcacaggcctggaggcctaagaggaaaaggtggtttcacaggccaggcccagggttcccgtgctgtgtgcagcctagtgacttgatgccctgcatcccaactgcgccagccttggctgaaaggggccaatgtagagcttgggctgtggcttcagagggtacaagcctcaagccttggcagcttccatgtggtgttgagcctgcaagtgcacagaagtcaagaatcggggtttgggaacctctgcctagatttcagaagatatatggaagcacctggatgcccaggcagaagtttgctgcaggggtgggacccttatggagaacctctactagggcagttcagaagggaaatgtgggattggagcccccccacagagtccctactggggcacctcctagtgagctgtgagaagaagcccaccatccttcagaccccagaatggtagatccactgacagcttgcaccatgcacctggaaaagctgcaggcactcaacaccatcccatgaaggcagccaggagagaggctgtgccctgcaaatccacaggggtggaactgcctgagaccatgggaacctacctcttacatcagcatgacctggatgtgagacatggtagtcaaagagatcattttggggctttaagatttgactgccccactggatttcagacttgcatggggcctgtagcccccgtgttctggccaatttctcccatttgggatggctatatttacccaatgcctgtactcccactgtacctaggaagtaactaacttccttttgattttacaggctcataggcagaagggacttgccttgtttcagatgagactttggactgtgggcttttgagttaatcctgaaatgagttaagactttggggaactgttgggaaggcatgattggttttgaaatgtgaagccatgagatttggaggggccaggggcagaatgatatggtttggctgtgtccccacccaaatctcatcttgaattcctacatgttgtaggagagacctggtgggaggtaaatgaatcatgggggcaggtctttcccatgctgttcttgtgatagtgaataagtctcacaagatctgtgaataagtctgacaagatctgatggttgcaaaaaggggagtttcccagcaagtttcttctcttgtctgctgccatgtctcttgtcttctcttgtctgctgccatgtgagatttgcttttcaccttccatcattattgtgagccctccccagccacatgggattgtaagcccaataaacctctttcttttgtaaattgcccagtctctggtatgtctttatcagcagcgtgaaaatggactaatatagggcctatggcacaaaacatgttaaaaacccctgagtgaggagataataaaggccatccagatttgaatctttttgtttgtagactaggaaactgaatctcaactacttgacccccgaagtcagcatgacacaatagaaagagcaaggttgttggaatcagataaggttcaaataccaaggttcaaatgtcagctccatacttactgcttataggactttcccccaacttaagtttccttggaattcatttttcaactgcaaataagggtaaaactgtctttcactgaaagcaggagtcagcaactatagctcacaggccaaatccagtttgcagcctatttttgtcaataaagtttcattggaacacagtcacacccatttgtttacatattgtctatgtctgcttttgcactacaatggcagtttggttacaacatagaccataccatacagcccacaaagcccaaagtattatcttgccttttatggaaaaaatttgcagacccctgacttggagtatagctgtgaggataaagggacaaaaggtatgtaaagatgtagctcattgcctggtacctagtaaacattaaataaatgtagtcattctcccctcttcaagacagagagacttttgtgggaagacagaacattgttctgggtccacaatgtatgatttctttgaactagagaggagcctaacagaaaatatataaggatatatatatatatatatatatcatatatataatacaactggtttataagtaagttctaaggaagttaaaatgagccagtagtatatttaaatatgattatatcctgcatttatccaagaaggccttaagatgatttccaactcaataaataacaatggattgaataaaatctaattgctccagaaggtagcatagtgcctgtaagtgaactttatattcagcattgagcttccaggcagccatggtaaaaagaaatcacgaaaaattgtgtaacacctgttataaggaaaaaaaaaaagtctacttgattatcacaggacaaaaggtttttatcctgacacaaattttaggcatcattacttacagaaatgtgtatagacacagtttagagtttaaaacaataattgaaactaacagaagaaatgacttttaagaatatcaaaattctccttgtctacgcacaacctcttaaacctacttgaacaataagtaaaaattgctgcaaatattaataatatggtaaaatagctctggaaagtaaagggccagtgtttgggtgagttaatacatttaacacagcagaacagttctgtgtgtttcggaaagaaggattgtttagtaggagagaatttgatgtctgagaaaaaggcaaaatgtttgtgcatttgatggttataactaaaaaatcattgtgccctcattcctctgtaaacagatgctaggaacacaagttaaaaaacaaaaaaacattgcaaaccagagccagaattagcatgaggcaagtgaggggggtcgtgtaagttcagagtcatatttgatctttatttaaaattttgataattccttcatggtggattctatgcattgattttgattttaaaacaatactgcataaaaatattatttatctagattactgagctttttatatccccttaaattttatgtccaaggcaatggcctcacttcccttctcctattcctggcccatatattcacgctactaagaaataattttaataaaaatatgtttaggaaggactcttccccaggctgagccaccttataggattcctgtcacctttcacatgttgatataaagtctttgtgtgtctaaagcagctttattcacagaaaagactcttcagggttgttttgttaaaatatttatcatttgatacattaaagttaaaaactccaaattcattgctctctggcttttaatttcagtttctaagaagagtccagactattttagcaacctgtttttaggggcctttaagtaatactggtccaatttacacacaacattatttaaataccttcaaaaattaaaaacatttttatgaagtatatgtgtattccaacaatatatattttttttttcctttttttttttttttgagacagagtctccccttgttgcccaggctacagtgcagtggcataatcatggctcactgcagccttgacctcctgggctcaagtgatcctcccacttcagcctctggagtatctgggactacatgtgcatgccacccgcctggcttatttttgtattttttgtagagactgggtatcaccatgttgcccaggctggtcttgaactcctgggttcaagcaattccccgccgcatccccccattccccacccttcacctcagcctcccaaaatgactggcctatatagtttttctattaatatttattctttaagcacgcctattgtctgaattaattaacaaaacttttccaggttctaaatacattttacaactcttgtaaaccaaacttataaatatggtgaaaaggtggttccaagatggccgaataggaacaggtccagcctacagctcccagtgtgagtgatgcagaagacaggtgatttctgcatttccaactgaggtaccgggttcatctcactagggcttgttggagagcgagtgccaaagcaggtcgaggcatcacctcacccaggaagcgcaaggggtcagggaattccctttcctagccaaaggaagctatggcagacagcacctggaaaatcaggtcactcccaccctaatactgcgcttttccaacggtcttagcaaacggcacaccacgagattatagctcgtgcctggctcagagggtcccatgcccacggagcttcactcattgctagcacagcagtctgagattgaactgaaaggcagcagcaggctgggggaggggcgcccgccattgctgaggctttagtaggtaaataaagcggccaggaagctcgaaatgggtggagcccaccacggctcaaggaggcctgcctgcctgtagactccacctctgggggcagggcatagctggacaaaaggcagcagaaacctctgcagacttaaatatccctgtctgacagctttgaagagagtagtggttctcccagcacagagtttgagatctgagaacggacagactgcctcctcaagtgggtccctgtcccccaagtagcctaactgggaggcaccccccagtaggggcagactgacaccccacacggccgggtacccctctgagacaaagcttccagaggaacgatcaggcagcaacatttgctgttctgcagcctccgctgatacccaggcaaacagggtctggagtgggcctccagcaaactccaacagacctgcagctgagggtcctgactgatagaaggaaaactaacaaacagaaaggacatccacaccaaaaccccatctgtacgtcaccatcatcaaagaccaaaggtagataaaaccacaaagatggggaaaaaacatagcagaaaagctgaaaattctaaaaatcagagcgactctccccctccaaaggaatagagctggagctggatggagaatgactttgacaagttgggagaagaaggcttcagatgatcaaacttctgcgagctaaaggaggaagttcaaacccatcgcaaagaagctaaaaactttgaaaaaaaattagatgaatggctaactagaataaccaatgcagagaagtccttaaacgacctgatggagctgaaaactatggcacgagaactacatgacgcttgcacaagcttcagtagccgattcgatcaactggaagaaagtgtatcagtgactgaagatcaaatgaataaaatgaagcaagaagagaagtttagagaaaaaaacagtaaaaagaaacgaacaaagcctccaagaaatatgggactatgtgaaaggaccaaatccacatctgattggtgtacctgaaagtgacagggagaatggaaccaagttggaaaacactctgcaggatattatccaggagaaattccccaacctagcaaggcaggccaacattcaaactcaggaaatacagagaacgccacaaagatactcctcgagaagagcaactgcaagacacatatttgtcagattcaccaaagttgaaatgaaggaaaaaatgttaagggcagccagaaagaaaggtagggttaaccaacaaagggaagcccatcagactaacagctgatctctcggcagaaactctacaagccagaagagagtgggggctaatattcagcttttttttttttgagacggagtttcactcttgttgcccaggctggagtgcaatggcacgatctcagctcaccgcaacctccgcctcccaggttcaagcgattctcctgcctcagcctccctagtagctgcgactacaggcatgtgctactacgccaggctaatttttgtatttttagtagagacgggttttctccatgttggtcaggctggtctcgaactcctgacctcaggtgatccacccgcctcagcctcccaaagtgctgggattacaggcatgagccaccgcgcccagcttcaacattcttaaagaaaaggattttcaacccagaatttcatatccagccaaactaagcttcataagtgaaggagaaataaaatactttacagacaagcatatgctgagagattctgtcaccaccaggccagccctacaagagctcctaaaggaagcactaaacgtggaaaggaaaaaccagtacaagccactgcaaaaacatgacaaactgcaaagaccatcgatgctaggaagaaactgcatcaactaacgagcaaaataaccagctaacatcataatgacagcatcaaatccacacagaacaatattaaccttaaatgtaaatgggctaaatgcaccaattaaaagacacagactggcaaattggataaagaatcaagactcatcagtgtgccgtattcaggagacccatctcacatgcagagacacacataggctcaaaataaagggatggaggaagatctaccaagaaaatggaacacaaaaaaaggcagggattgcaatactagtctctgataaaacagactttaaatcaacaaagatcaaaagagaaaaagcaggccattacataatggtaaagggatcaattcaacaagaagagctaactatcctaaatatatatgcacccaacacaggagcacccagattcataaagcaagtctttagagacctacaaagagacttagactcccacacaataataatgggagactttaacaacccactgtcaacattagacagatcaacaagacagaaaattaaaaaggatatccagcaactgaactcagctctgcaccaagtgggcctaatagacatctacagaactctccaccccaaatcaacagaatatacgttcttctaagcaccacaccacacctattccaaaattgaccacatagttggaagtaaagcagtcctcggcaaatgtaaaaaacggaaattataacaaactgtctctgagaccacagtgcaatcaaactagacctcaggattaagaaactcactcaaaaccgcccaactacatggaaactgaacaacctgctcctgaatgactactggatacataacaaaatgaaggcagaaataaagatgttctttgaaaccaatgagaacaaagacacaacagaccagaatctctgggacacatttaaagcagtgtgtagagggaaatttatagcactaaatgcccacaagagaaagcagggaagatctaaaattgataccctaacatcacaattaaaagaactagagaagcaagagcaaacacatttaaaagctagcagaaggcaagaaataactaagatcagagcagaactgaaggagatagagacacaaagaacccttcaaaaaatcaatgaatccaggggctggttttttgaaaagatcaacacaattgatagacggctaccaagattaataaagaagaaaagagagaagaaccaaatagatgcaataaaaaatgataaaggggatatcaccaccgatcccacagaaatacaaactaccatcagagaatactatcaacacctctatgcaaataaactagaaaatctagaagaaatggataaattcctggacacacacatcctcccaagactaaaccaggaagaacttgaatccctgaatagaccaataacaggctctgaaatcgaggcaataattaatagcctaccaaccaaaaaaagtccaggaccagatggattcacagccgaattccaccagaggtacaagaaggagctggtaccattccttctgaaactattccaatcaatagagaaagagggaatcctccctaattcattttatgaggccagcatcatcctgataccaaagcctggcagagacacaacaaaaaaagagaattttagaccaatatccctgatgaacattgatgcaaaaatcctcaataaaatactggcaaaccgaatccagcagcacatcaaaaagcttatccaccatgatcaaggggacttcatccctgagatgcaaggctggttcaacatatgcaaatcaataaatgtaatccatcacataaacagaaccaaagacaaaaaccacatgattatctcaatggatgcagaaaaggcctttgacaaaattcaacagcccttcatgctaaaaactcaataaattaggtattgatggaacatatctaaaaataataagaactatttatgacaaacccacagccaatatcatactgaatgggcaaaaactggaagcattccctttgaaaactggcacaagacaaggatgccctctctcaccactcctattcaacatagtgttggaagttctggccagggcaatcaggcagcagaaagaaataaagggtattcaattaggaaacgaggaagtcaaattgtccctgtttgcagattacatgattgtatattagacaaccccattatctcagcccaaaatctccttaagctgataagcaacttcagcaaagtctcaggatacaaaatcaatgcgcaaaaatcacaagcattcttatacaccaataacaaacggagagccaaatcatgagtgaactcccattcacaattgcttcaaagagaataaaatacctaggaaggaattcaacttacaagggatgtgaagaacctcttcaaggagaactacaaaccactgctcaatgaaataaaagaggacacaaacaaatggaagaacattccatgctcatggatagaagaatcaatatcatgaaaatggccatactgcccaaggtaattcatagactcaatgccatccccatcaagctaccaatgactttcttcacagaattggaaaaaaactactttaaagttcatatggaaccaaaaaagagcccacattgccaagacaatcctaagccaaaagaacaaagctggaggcatcacgctacctgacttcaaactatactacaaggctacagtaaccaaaacagcatggtactggtatctaaacagagatacagaccaatggaacagaacagagccctcagaaataataccacacatctacaaccatctgatctttgacaaacctgacaaaaacaagaaatggggaaaagattccctttttaataaatggtgctgggaaaactggctagccatatggagaaagctgaaactggatcccttccttacaccttgtacaaaaattaattcaagatggattaaagacttacatgttagacctaaaaccataaaaaccctagaagaaaacctaggcaataccattcaggacataggcatgggcaaggacttcatttctaaaacaccaaaagcaatggcaacaaaagccaaaattgacaaatgggatctaattaaactaaagagcttctgcacagcaaaagaaactaccatcagagtgaacgggcaacctacagaatgggagaaaatttttgcagtctactcatctgacaaagggctaatatccagaatctacaaagaactcaaacaaactcacaagaaaaaaacaaacaaccccatcaaaaagtgggcgaaggatatgaacagacacttctcacaagaagacatttatgcatccaaaagacacatgaaaaaatgctcatcatcactggccatcagagaaatgcaaatcaaaaccacaatgagataccatctcacaccagtcagaatggcaatcattaaaaagtctggaaacaggtgctggagaggatgtagagaaataggaacacttttacactgttggtgggactgtcaactagttcaaccattgtggaagacagtgtggcaattcctcaaggatctagaactagaaataccatttgacccagccatcccattactgggtatatacccaaaggattataaatcatgctgctataaaaacacatgcacacgtatgtttattgcggcactcttcacaatagcaaagacttggaaccaacccaaatgtccaacaatgatagactggattaagaaaatgtggcacatatacaccatggaatactatgcagccataaaaaagatgagttcatgtcctttgtagggacatggatgaagctggaaaccatcattctcagcaaactattgcagggacaaaaaaccaaacaccacatgttctcaatcacaggtgggaattgaacaatgagaacacttggacacaggaaggggaacatcacacaccggggcctgttgtggggtagggggaggggggagggatagcattaggagatatacctaatgtaaatgacgagttaatgggtgcagcacaccaacatggcacatgtatacatatgtaacaaacctgcatgttgtgcacatgtaccctagaagttaaagtataaaaacaaaatttttgagagagaaaaaaaattatggtgcaacaaaactagttttgttttatacatttctaaatgtccacataaattatttagatttcaacttgaaaagatcactcaattatatactttatctgggagtcacaagctattgtcttaataggctatatttctcttaactattcaagcatatacaaccccaagtttgtgcagatgccttaaccaggaaacatcgatacaatgtttttaagtgtcttggttatttctgttctcatttttaaagcttcccagagttgaaagctatgtgggcattcgggaagtgaaaggcaatctcagttactgagatgacttttaattagagattttaactgggtgctgagacttggaatggtagacatctaaggtgattcttctcataccaactgtgattttatcccatgaaatttggggtttgccttctcagtatcctgcaggttttgaacaatcagtgatttcagccaagagctcatcaggtccttctcaggaacctaaatgggttactctaaacctatgtacctagctgctactggtaaacccatagctttacaggggtgcaatcatgctgcccaggtctttggaggtgaattatatacaatacccaatcctttcttcttctacaaaaagactgcaaaccccacgtaagttaatcgtttgactagattctgcatacttttgtttctgtatcagtgtaaatgccccttctgtgtgagtttaagatcttcgaactaggtagaatattgcttctttcagattgtcaggccccaccctgttcgtggacagttatttccactcctattgaattctctacctggctgtctagcctgtcaccacaactggtaagcctcttctgttagcacacggaattgcagaattttgttgattctagaggaaacttgtccaacccgccacccgtgggccacatgcagcccaggacagcttcgaatgtggcccaacacaaatttgtaaacattctttaaatattatgagatttttttttaagctcatcagctattgttagtgttagtgtattttatgtgtggccccaagacaattcttcttccagtgtgacccaagggagccaaacgactagacaaccctgttctagaatgttctccatggctgctccaaactcagccgcttgctctgtattaactgcagaataagagcttttctcatttatgcctcccagtcatcaggaccaaagtgtaagatgcatcaaagtttccctggatggttggtgccctagggcagttgccatgaaccaagtacaaaaagaaaaacagacttttccaaaattaattcaaatgggcataactcttttggaaattgtgtagcacatgttgccaggctggggggatgggctgtgtgtgctattttaatgagactgcagactggttacatctacagcttcccatattttggcttattttagaaagagccagaaaatgatgtttaacggtaaactgcaagaagacaggcagggaggaggggcagatggcatgaagtaatctttctgcatttcaaggcataggccaactctttgttaaaatattctttccagtttggaagcccttggcttaagggaaatttggaaaaaccaagctcatgtcccaaccagcagctcatctagaaagtaaaaatgaaaactctaattatcagtcagtcagtggtttttatcgtgcaacagttaattgtttcacttaaaaccactgctggtaacagctggaaaggaaagtgactggagaacagggtcatttaaaaccattattttgagctacagtttcaatgtcaatgaaagagttgtccaaattttggcatatcactttctaacgaattttagttttatgagatagccatcatttagtgaaatatatcccaaatcgtgagaactgtatttcttgccaactgtctttttttttttttttcttttgagatggagtctcactctgttgcccaggggtggagtgcggtggcgtggtctctgttcactgcaacctccacctccaggattcaagcaattctactgcagcctcccgagtagctgagatcacaggcatgtgccaccacacccggctaatctttgtatttttcgtagagaccaggtttcaccaggttggccaggctggtcttgaactcctcacctcaaatgatccacctgccttggcctcccaaagtgctgggattacaggcatgagccactgtgcctggccttgccaattgtctttattcctcttctcttagtagcccatgggagactattgtagtgtgtccttatgaccagtgttttccaattatttgttagccagaaattggaacactgaatatactcttctataatgttaaaaatggtggcaaaatttcaggccaacctataagaggtacctggttaatatataatatagctgtagttgggaatacaaagggatattttttccccagtagtctttccatctggcagtatattatgatccattcatctcaatcttgctacctcaaaagcagaagtggcagatgaatccacccagcaaacgccatagaggtgggtccagctgaggctttacctggcactgaccgtgtcctcctccattaaaacactggtaccaggctgggtgagtgactcatgcttgtaatcccagcagtttgggaggctgagatgggaggatcacttgatcccaggaggcttcagtgagctatgactgtgccactgcactccagcctgggtgacagagcaagactgtctctttaaaaaaaaaaaaaaaaaaaaaaaaaaaaagcttattaaaacactgatacctgacatatatggctgttatggctgcggtggggattacatgtaaatatggcaagacctataataaaaagttaatatttattaaatacttatgaggtacccttcactaattaagtcgctcctgcaacgatgccacagaatggtgcttccctatgtcacagacaaggaaccaaagcacagaaatgtcaagtaatcggccgaaggacacacagctagcaaacagcagagccaattcaaacccacacagtctggctccagaagccatgctttggtcactatagtccaggggtcagcaaaccatagcccatcacctgttatggtctggcccaaaagctaagaatggttttaccaattttagagttggggtgtagggagagagaaatatttcatggcatgtgaacaaagatattaaatttaaatttcgatgttcataaatcgtctcattggaacatagctactcctattcatggaacacagctactcttattcccatacatactgtctatagctactttcacaccagaaatatcatgacaaaatgtttatgacataatggcaagggataaaaaagaatacagaaagtatgattccactaatttacaagaatgcttaaacaaaaaatactttaattattaataatggattgtagaaacatgagtaatttttttcatctgcatttcccaccttctctgtgatgatcaggtatgccttttgcattaacaaacatcaaccttaaaattaagtaagttggcaaaggatcggttaatttgtcaaagaatagaagggattctaaataacaaaagtaaacagacatttggtgaaagactctaagatcgggagttctaactatcatgtccattttaatgacttttggttgtaaatcattcttgggtacttaaaaatatcaaagatacactgcagacattttagaaggctcccgtataagtatggacttaatatatttttatgtatctttatttcccatatatatccttgttaattctcaaacagggaaaaatgtaaaccttaacttttatttgtcacatcattagtttcttaatgtagatatcctgacatgaaattttgccccatgggctgtactccccttctatgttattactgaagtgtgagatgtctgaaaagtatcttaactaaagatgaaggaatttcactgatatctgggcattataggaaaggggaaaaaagtgagtttaaatgaaatgattttctgagggattttaaaatccttaaattgggtataaggagggccttcttttattagtgtacaaatccagccctctacattgtgctttcacaccctatgccattcattgcagcatggtaacttactgctttctgagctctgaggttcagaaaagttttacttgcccgaagttacatagctgcaaaattctggtctggcattatatctggttctgctgaaactgtacttctcaactctggcttctcaactgcctggcaacatgccaacatgatgacatccagtttagaattccaccctctactgtcccttggttctcactacaaggtgtcactaaggcacagcattcatttccaatgtttttttccatctttctgtggactgattaaatgagaatattcttggaaccgatagagaactgggcagctcattggcagcatggcagtcaataaccgaaggggccataaacaaggttaggtcttatctagttgggccaggcagcagatgtaggttttaatcaagtcaggccacacatgggttggggaagtagctaactctagctaagcctgtgttgggaagctaaatctaggctggtgaaggaagccaatagggcccaaatagctaatggggcttgatccttcataatgagttcctcccagaggtggctcagcaccttggacagttaccaggagagtcacagtttctgaaggagcctgattccctcccaggtcgatttttttggcacaacttctacttctttgaaaaacttcctgttctcccctcttttctcagggttcttatgtgcagaattgggagaatactgatacaactagcaaaatgagctgcttctgaggatatccacacacataagatttccctgattattagacagaaaagtcaccgcttctagccagaagtgtgtctagttccatcagattggcttgtgtcacgaagggaaatatctagttattgtcttcccagaactcttctttcctgggccagcttataagtactaacaacacagactcttctttgcaagttattgagaggaaaaattgtcatttaattcacagagtggattcctaaaatgtgcacactcaaatattctctatttcttatgttgatattgactgttctcactttcccataaagttagattattcaaatcatagatcttcatttacattctatagctgaagttaatgtaccttttcttgattaattctcaaaacaagtttatattttgtataagatctctttaatatgaaagctcatagtgtatctttatagataggtgtatgttttctctgtaaatttgccaacctctgcatctggttcagaaaatggaagttctgaatcagagctacaaaaagatttaatgggcttcatgctgctgttagcggcagtatccaggcaccaatagaccagtatttcccaaactgtgttttgctggacactagtctaacaaaagctctgtgaaaggaaattcttccaaggaagagaagtttggaaaactctgccttactttctacctttttggagaatcgcagtgctcattagcattatgtgtgtaagtaaagaaagctttttcatgctcccagttcagcattttccaaatacattggacaccataacagtttttaaaactagtagtactctgatctactatttaccataaaacccttttctagatgtagtcaattgtcagaatgtcattgaggcaaccaacatatctaatatacaaagttagtgagatttatgtctcctaacctgagaatctatgactttttgttatcctagcttaaatatttacatatgtgacagggtcaatcctagaatcaaaagaaatcatatttatgtctttcttaagtacacactttggaacttggagaaatacttttctaacagagaagcaagtaattaggtgtaattacacattggaaagtggcaggtatgtagatagaggcctcaaacacacggatccttttaaccataattaaagtatataaaattgatagacaataaattttattataaagttctgtgttgaatatggaaaataaccaagccaaaatgtaaaaaaaaaaatccttggactgacatcataatgaccttaaagatgttagcatgctctttgaagagtaaaactcttctgaatatttaaaaagatcatgatatctatttatttttcccaggaaagagtgtaatgatttattttggattcactgaggtatactgctactgaatatttcagaatagcatgccaagtgcaaaaactgtagtactgtttgcagcttcaattttgaaagcacttttccaacccatttattaaagagtatccattttctgagccaaatgatgtaacaaaaaaaattgttctctgtatatacacagcacttttttttcttttggaccttgggtacaaaagattgatttaataatactcctcaattcatagaacataatcatacttgatcctcataaggctttctgatacacgtactcatatatacatttatgtacatctatgtgtacttactttctcttttagagtgtatataagaatatagcaaatatattcatatatatgcatccatattaatatattcccttttatattgtaaatatatacgaatacataaaatatgcatatgtatatatatatcatacatatgcatttatgtgaatacatatgcatattttatttttctgtctcctggagaaacactgtttcatatatattctattatttttatgtgtccttgataaatatgtatagttttctgagcatgttgtcttagtttatcatgtaaacatatttacatatataatgtttcttttttcattcaatactatagttttagaaataacttttgactttgaaaaactgcaaacataaaccaagtatgcaatgagagaagagtacactgaactcccatatgcccatcatgcagtttcgacaattattaactcatgactaatcttatttcatctatgtccccacacacttctctcctacctatactacttgacacaaagcttagatatcatgtcattttatcaagtatttaaatatatatatccaaaacatataatgacactgaaattatcatacccccaaaagacagcaatttcttaatactacgaaatttcctgtccatgttcaattttctcccagtggcctcatggatttgttgttgtttttgtttgggtaaatcagcatccaaataagagctatacatagcaactgattgatatgtctcttgaatctcttttgatttctggaatttaattttctttccatatatttgttgaaaatctatttggtttgttctgtaggtttttatctctggattttatctcatacccatggtgttatttagcatggtcctctcatcctgtattttctgggaattggtggttatatagagagatttaattagtcttctgttaatttttctttctgaggggagaatatttcattggtggtattgagtacttccatttggaagcatagggggtgtctgtgtgtgtaatgttagcagccattgatgctcagtgcttaaacattaagttaccaggtgatgggaaatagtgatatgctaattctatcattccattttcacttagtaactgaaaaactccccctcatcaactctttgttacattgactacagtttgtatgaaaggtagaataaatggttgagtctttccctttattcagtagttttcaaaataatgagttggttccctagcatcccccaaaggtggccaatgatgttttcctacgttattgtgaatttgctttctggtataacaagatattccaggatcatttgtgcatttcctatcccagacccaggatcagtcatttctccaagaaacccgttgcttgtagtagcaaatggtatttaaatccaaaatctgggagctagcagtatttattactactgagttgttcactgttcttcaaggtctttttagtaagcagtgttaggaaatatatactttttacaataaactacattatgatttcatatttccaattcaaattcaggattgtaagatttttatataacctcattgatcttacatctgtatctatttttccaatatctctcagcaccaatataagtattattttgcttccatcccctaaatcatccagtctcaacataatacctcaacaccaataacaacaatatatattgaaaatggttaaatatattttgcagttcttttgtccttagggtatattccactagggatgtttattcaaattgccatgcttcaaattcacttgaaatgtttcctttctttatacttatgttaccagctcaattcacagattcttttcacttagcttttgatttctaaaaatgtgcttcttaaatttaatcttgctctataactatgtaaagtatttacctggttccaaagtgaaatctataaaacgatatttattcagagaagactaacttttatccctgtctcttccccataggtaatattgtatttttaatttttattctgtcatcccattatttttaaacatctatgaatatgtctgtgtatatatcctttttgaaaataagctgagtgcaatgcctcgtgcctgtaatcctagcactttgggaggtggaggcgggaggatcgcctgagcccaggagtttgagatcagcctgggcaacatggagaaaccccatctctccaaaaaatacaagagttagctgggcgtggtggcatgagcctgtaatcccagctacttgggaggctgagaggtgggaggatcacttgagcccagggaggttgaggctgcagtgagccatgattgtgccattgcactccaggctgggcaacagagtgagaccttggaaagtaagtaaagtaagaaagaaagaaagaaagaaagagagagagaaagaaaaagagagaaaaacaaaagaaacaaaagtatacaaaatattctttgctctacgttgcctttcacttcacagtatattctggagatagcttgccaatggtatatagaagtagtcctcactctgttttgcaactgcagagaatagcaatgtacatttgggttgtttctagtcttatgcaactacatatagtgccatgtgccactagttttgtgagatctatccatatgcctatatatatatatatatatatatatatatatatctaatccactaatttatttgcaacaacatacttcatgtagcatttgcctctcctctggccccctccctttaacaaccttcaactcccctgctacttactcaggtccccaggtctttacaccagtcccccaccccagccaaagctgtaggtggcactgtccaaacaaggcgaggtcctgctagatggcataaaacaccagctctgtgaaagctggagtctttgtggggtctgtggttttgccctgattctcatgaagcgaaatcttctcctgaagcaggtacttcagaagaaactatgtaatttcagtatcaaaaatagctgtgcttctcataaatgttgtgagtttattttatacacaatgtgaattatgtaaatggctagaattttctgcattgacttcaagaaagtttggtgcctaatttatgacccactcataacaagtatatgaaattttatggttgtattttttcttgttttcttaaacaatcaacattatggtggacataggttttgtttttgtttttaactgttaaatcaccctagttctacaaagcgcaagtcttgctgcaatgtacccattttgtatccagcctatgtcagcattctagaacatatacaaacattccatgttattccattaaagtgaatatttacaaacatcattgcccttgaaaaatgtttgtctcaataaaaaatacaacctaggaaaatctgcatatgtatagtatagtgttttatatagactattgtttatatataaacataatttcattatctagcaccactaacaaattatatatgatatggaagggagtttttctgggtacctggaactaatatccaaaacataatccactaatgcattcaggagctactgaaatgcagatgatggtggttcatatgcagagagatttccaaacaatgtgccttccaaggctgtctgggtcattgtttgtgaaactgtagccatgacctattattgacttatgaagtcaattcaataagtcacaaccagctttaaaataccacctagattaaaatagaaaatacagtacattgtgtataagtattcttttggaaaacttttgtttcactcttaacaaatatagatgtatatatgcacactggatcagaaaggaaaattcatatctttgttttttttgagatagggtttcactctgttgcctaggctggagtacagtggcacgatcaataactcactgcagcctcaacctcccagggctcaggtgatcgtcccacctcagcctccagagtagctggaactacaggcacatgccaccatacccagctactttttgtactttttgtaaagatgtggtttcaccatgttgcccaggctggtctccaactcctgaggctcaagtgatccaccaatcttgattgccgaaagtgtagggattacaggtgcgagccaccatgcctggtcatgtatgtcttcttgtaggaggcagttaagaatgtcggaagggtcctgctctggggggccgtaggtcccaacccatctcaccccctgaccactccactctgcttcatctccctgtgggctcctttcattctttttggtaccaaaactacattcagaatagccaccttcttcttcccttttctttttgttacttttcctttttctttttaaaattatgtgtgatgactctgcttgtcctcttagtttgggacaaaaaaaaagagttctaaaatagtctcctcttgtcaatggacctctacctcaccttcagctgccatataactggtgagtcatagaatgtcagggtggatttctggcccctgcgtcttttctactgtgtttatctgtccacacagtccaaaggttgtttttctcctgcttttttgtttaagttgggttttatgctcttatagctgtcaagagacttaattattcttttatatatttttttgagattggatatataaattcaataaaatagctatcactctttcttttactgttattaaaaatcaaattgagatacatcacaaaaatatattgtggatagcttaagataaactgatggattcagaagcattcctcttgtctaaaactttgcagtagacaactgaccttttaccaccaaaatccaacaagagagatggaggaaaaagtaggtacttagaggcagacatcgccatatattaactaaatagtccctcaggtcaaatcaagtgcagtcttctacaaaatactcaaaagctgtcggctttacagaggaatttccagaaagcagtaagattctggcatcctattaaaatacctagagtactctgtggatggcttgaaattaagcctagtctaatgtatcattttaactatactgtaattggaaataacaaaattcacatgaaatatgccatgcaaaggtttacccacttttatatcaaattaaacatgccatttttttctttctttttattttttagtgatggggtttcactatgttgcccaggttggagtgcattggttattcaaagatgcgatcatagctaactgcagcttcaaactcttgggctcaagcagtcctcttgcctcagcctcccgagaagatggaactacaggcactgtgcctggcttgaattaaacattctagtttgattagtgtggtgggtagaattctgagaaggcacccaggatccttgatcctggtataaataccctgtataatcccctcctgctgaatatgggcaggaccttgaacatgataggatgtcacttctatgattatgttacttagcatggcaaaggtggaaaaattgtgagatgtaatcaaactcctgatcaactgacattaatttaatcaaaatggagattatcttgggtgggtctgccctaatcagatgtgtccctttaaagagactccaagcagcagagaccctcttgctgacctcaaagaaacaaaaagtaatgttatgcactgcctacggaggggggtggactctaagagctgagggcttcactcctacagtcacaaggaactgaatccttccaaaaagcactgagcttagaaaagaaaccaaactccagataagaatcacagcctggccaaaaacttgattttaatttcatgaaactctgaccagagaacccagttaagccatgcctagactactgacccacagaaactgagataacagatatgccttgttttaaagccctatgtggtcatttgttacagcagcaatagaagactattacaattagaacctcgttaactctcaaagggtcataaatgttagacccaaaggatgcatgtgtaggagccaatggaaaacttccccttcaccctctgaaggttctctgcaaaaacagctcacaaaagacaaattaataagagaaagggtatacaagtttgtttgtttatttgagacagtctcgctgtgtcaaccaggctggagtacagtggcgtgatcatggctccctgcagcctcgacctgctgagactacaggcacacaccaccattcctggctaatttttgtattttcggtagacatgagattgtatcatattatccaggctggtcttgaactcctgagctcaagtgatccgcccacctgggcctcccaaagtgctgggattataggtgtgagccactgcattcagccagggcatataagtttattaatatgcatggggagaaccacagagtgattaccccaaccctccaatggggttcagaagtttatataccatcttgaggttacagaaagaataagggcttggatcttggcgaaacaggttatgggagggagagaagaggtagcaaaggtggtcttgttgtgtagatgaaacctcacaggtagcagctctcagagagaatagatggtgaatatttcctttagacctttgaaagtgtcagactctcaattaatcttccctagatccagacaagggaaggcttcgaagaaagcctggcttcatcaatgaagatttttctctacagatgcaaatctccccaacaaaagacagtttttcagctattcttgtatttccagcttttctgaatagccatcttgaaatatgtcaaaggagtatattttggggtgaaacattttggtttccttctccctcttgggtttcccaaaatactgaactatccccattggaatatgttgaaaatgtagcacttagaaaatctctcccaaagtttaaaatcaactgaacatttccaggaaattctccagtcctatctccatagtgccccatctctctaagcacgtgatttattctaagtgttacatgaatgctggaccccccctccccaggtgggccctgacctttacctggctattgtgcacaatcccttggtggatctcatgaaccagggattttacctgttcagaagggggcaggacttagaaggagaaggcaacaaattggaagccttctagggatctgattctgtgacacagagtgaatttatttcattttaacagcatcttctgagttaggcatcttttgccaattttgggaatgagacaacagattcagagagatgatgaagtcaaccacagcatattgttagtatatggtaaaaacaagatatgcagtaggtctgaaggattccaaaaagcaagtctcttgccaccacatcatgtccaattacaaatgtacagcatgtcaaacttcacacattcttccccaaaatctccaagtaaatcattcacatgtgatagtaaggctaccatttgcacatcccttcatgggctgcagtgaaaactgtacgtgtttcatttgatcctcacaaggttgattgcgcatgcaaaactgtcatatgcttttcccttgagaaacaatgagggtacattatctggaagtgaaaaagtatagggtcatgcctaacaagtcattgataaaaagaaaaagaaaagaaaatggcctacagacatttagatgaccaatgttctttttgtaaatgcaacaaatgcatgcaaaagaaagtaatgcatatattatctgtctctgcaactgtaaggttacaatgaaaaccaggcattttgtgctttttaattcaagacatatccccaggaagtgatctgactttaaaacataaactatatttgctaaatgatatctgttacagcatcatagatgttgactcttttcagaagtcattttgcattcaataggagacagcagggggaatgcatggattttttttttcccctccacatgaaaaggctaagcaaaagcagtatctttcaggagacatcagtgatagttactaaatgagcttattcaaacaaacattaaaataacctccagctgggcaggcctatatttccagctatttgggaggctaaggcagaaggattgtgtgaggtcaggagttcgaggctgtagtacaccatgatcatgcctgtgaatagccactgcactccagcctgggcaatacagtgagatgctgtcccttaaaataagaataaataatctctaagttccaggcatggtactgatttatatgtgttatgcttgaattttatattggtgtccacattttaactaggaggaatcagttaagtgtcagaccttcctattttgaaactgccaaaatttgcctacccattacccaagataattcttgagcacagaaaattgatttgggctctatactgtgtcagatttaggttaataactttcattggctgatttagaattaaatatgccttctagcaaatcaggagtacatttgagaaaacaaaagcacaagagaaatattggaggagtagaaagaattaattgtagaaaggattaggtcaaatggaaagagtgaacaagaatatgggaggtgtggggaagtgacaaaagatttttctagttagggcatgatcatacactatgtagaagtcttcatataactcttactggggccaggcgtggtggctcacgcctgtgattcctgcactttgggtggtcaaggcgggcagatcatttgaggtcaggagtttgagacaagcctggccaacatagtgaaacgccatctctactaaaaatacaaaaattagctgggtgtggtggcaggcacctgtagtcccatccactcgggaggctgaggcaggagaatcgcttgaacctgggaggcggaggttgcagtgagccgagatagtgccattacactccagccgaggtgatagagtgagactccgtctcaaggaaaaaaaaaaacaaaaaaaactcttattggagaaagaatcaaccttccttaaataaatattaacataataaaatatttttatttaataaaacaataaaataaaaattgtgtgacaaggggaacttgtgacttttgcctggttgaacaattattttaaattgtcaatttagggaagagaagaaagttgatgtcttcaaattatattttattctgtgaagaataaaaatgtctactgtattttcaatatgccctctgttttcagtccagaaaactcaatgttttgtttagagatgcaataaaagacttttcttttacaaatgtcttacaattacagactacattcagatagatgatttattgagttcgggaagtgaacagaatctaatggtaattcatgacacttttttcaaaacctactgaaaaaatattggtttagctctcacaataaaatattagacattatatacacagttggaaagtgttctcatttaaatataaaggtttgtgattccataattaatatttttcctttgttcaaacctgtattcaaatacttctgctttctcatctgaagcttttttctttaattttagagttgcccaaactacatgaaacagagttaagaccccagaaacatgcaaaaatgaacagccaggattgatggaggggaaagaaatcagcaagaaaaaatttagaagggaccaaaaaaaaattagttgcctgagggcctttataggtattggctagactttacagccatttgacttcataatgacacttaattttaagaaaaatttaagtaatgcattctttctttaaaaatgaaaaaaaaaaaaaaaaaaaaacccagcaaccagcaatggtgtaacttttggaaaagcctgctagccaaacaagaaaataaaattttggagcttaaagttttattagcttaaaatgtttatttccaacagtccttaataaattattgctgaatctttataaatttggcatgacatgtgtctggacaattggcatgtgtatattttttcatcacttcctagcatctcagagtaagggttctccctagtgtatgcacctcccctcatctttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacgggttttcaccgttttagccgggatggtctcgatctcctgacctcgtgatccgcccgcctcggcctcccaaagtgctgggattacaggcgtgagccaccgcgcccggccccctcatcttttttgacagctctaccaataatttctaggtccagtggaaattttgaatgttatttatctatttttacttttcaccgacattgtggaaatcagtacgtccaaatgtctaaacatctctccagatatttccactttttcaatcaattgaggactgataaaattcaatatattcccaataaaaacaataaaaaaagttaaaacatgttttcccattgaatcccatgttcaccttggatgtgtattccttagaaaaattccttagctataagtcataataaattacaaacttcaaaatcttatatttcaccttaaggaattgtctgcctctatcaagtgatacttagttatatttaattttcctacaaggtgctaaatgaataatcaagtcacctgatttttaacacaaccactttgaacatatttatggacacttattctatgaaaagcactattctaggtcccataaaagatttttaaaactacccttcattctcaaaaagcttaaaacatagttatcataaccataaactaaccgtataaagtagtttgtgatgtgtaccaaatgcagaagattggcaaagtgttgcgtgtgtttgaataagggatcgttacaatagttaatatttatctggtacaggcaccatgttttttccaccctgtcaacaatcttatggcatagttttattagttaggagtctcctggttgcaagtgacagaaactctgactcaaactggcttaagcacagagagggttttgttggctcatattcggggatagcaatagatctaatagctctcactgactctatgacaattagatgttaggcagcaattaagccaaagggcgagcagacatctctaattgtagcaggtgtgtggaaactggggagatttttttctgctagacatcagcctacccaagtctacagatgtcaatcctgcattcactcatcaaatgttacttgggaccaattcagtctcttgaagtaagccaaatttattcaagggattctaatttcatttaccactacagtttaataattatgatttaggcttaaaaacctacatcctgcttagatgaacctgtgtatataagtcagagcctgaggtgggttgggtattccccagagaggtttgaaaataaatcatattctttctgtaacttaaaaatacttttttcttaaagttctatgttcttatgaggatttcctctatttaacaagggtaggtcctaattcacatgatatagtcagcctttgtgaatattctccactgtggtattcaataaatttacctatattgtagctttttggtactggccatagtgaacctgtcatttatggcctatttccctcatccagacaattatgaaaatattggcagtctacctacctgagaggcttccttttcatgatctctgaggaactcagtgtgaagtaattttagctccttgagaggaaaaaatgtgcaaaagaagtacaaagtgctatgattaattctttcattgttttcaaatggtgttagttgaaagcagaaaatgaataaaacacaggaaattgacttgaaaactcacataaacgcacactcagtgaactgcccttgcatgctgagacccagagcgctttctactgaaaacatagatttggctaaaatctgtcatgaggcttgtataggcagagacaaatcttagtctgctttctatttgcatccaataaaataaagacatttaaaaacattttttgttttaataatagagagggcattgtcttgccgtgttgcccaggctggtctcaaactcttgggctcaagcgatcctcctgcctcagcctcccaaagtgctgggattacaggcatgagctaccgtgtccagctggtaaagacattttttcccagtgaaaacttggagctcagtatgtttgatgtttctcattaggggtgatgttaaaaatattttaacaacagttacaatatgggcacagccaagtcaggggagatatctagcaaaaacaaagtaaaccagtggttgcccatggaagcataggcctgatttccttggagcatgggctgtcaatgttgaaactgaaactgtgaagggtctgaaatgttaacctagtttcaagctaacaaattgacctgtcacaattttatgcatgtaagtgtgtacacacacacacacacacacacacacacacacacataccagacctctgaatcagagacagactgctcacagagcttttcccaaagccctggttcctcccagagcaactcagtgagatgtacaggagaggatctctggaattatgaaacccagagcttatataggaactgctggaccatctgtccatcaccctttgtggagaaagagggtgaccgctggtctgaatcataaacacaaattctctctgggaagtagaaggaaagatctctactcaccaccctggaagataaacacaaggctccagggaaaggtaggactttatattactgccaagggctcagtctttagggttgctattcagttgcctattaaccaggtgccagtactgttttcttagaaagtctcaaccttgcagaaacgtgaaaatattcatgatgcattatttctcaacacacaactttacctgcccattggaaacccttggaatttggctttcccctcaatgctgactggtctggaatgcttccagagtatttttaactctaacatgtccttataattgggttgagaaacactgctctaaatttcaaagtaatgttagatatcattagggactgaattggtaataacagcacatctttaagatgattgttggaggacatttgctttatgtcttagttcagactgttataagaaatacacactaaactagggtgacttaaacaatgaacattcacttctcccaactctgggggctaggaagcccaagatcaaggtgtcagcagatccagtgtctggtgagggcctgcctcctggtttgtagttggccatcttctcattgtatcctcacatagcagagagcagagagagaagaagcaagctctcccatgtctcttcttatgtgggcactaatcctatttgtgagggctccatactcatgacctagtcatctccctaaggctccacctccaaattctatcacattgaggattaggcttcaacataccaattttggtggaacacaaacattcaatccatagctctctacatgagatttactttccagactggaataggtatgccgctttaaacatttatgtaaccagagattaatcgacagtttttaaaatctaaatgactcagatttttattttacaataaaataatgacaaatgatgacacataagccagtagaatttattccatttggcaatgaggaattcttcagccacatgttattgtataaggacactattgagctctacacataagtgcaacatttttccccaaaatgactctgatctcagaacctgaagtttcacaatttaatagttaatttcaacaacaggtacttagtataataagtgaactttatactcagtaagtcattggaattgtaatcaataagcaggatcaacttccaggttaaggctcgtgattcctattatagccctgattaaattgtaggagtcattctccaacaaaaggaagcagagatccctggagaaatggctgattatgaggctggaactggaaaaatacaagatgagcctacaacatctcatagtactacaaggtaaggaaatgcttgagagagagagagagagagagagagagaatgtatcagagggacacagaagccaacctgaaaagttctcagtggccaaacttggaaattttgagtaacaaaatagtagcatggccgggcgtggtggcgggtgcctgtaatcccagctactcaggaggctgaggcacgagaatcgcttaaactgggggaggcagaggttgcagtgagcggagatcgtgccactgcactccagcctgggtgacagagagagactcagtctcaaaaaaaaaagtagcatagtattggattataaccaagtgtaaaaattaaatatacatggctccatactgatataaataaatgatttgatataaaaattaataagacagagggagaaacaaatcttgcagaaaaattccaaataatttatgtggctactcctcccctccaggaggtggagcttaggcccactcttgagtgtaagctacactttgttacttgattccaaacagtagagtatagaaaggggtaaaaaatatatatagctttacaactgagaaagctggcaagcactaccttagccagggatcaaagtcaacatcaccagtgataagtcatgttgatagcagacaccactgacataatataacaagaagggcacatcacctctgtgatattctttacaaaaatccataacctagtctaatcatgaagaaaatgtcagcccaacccaatttgagagatagtctatcaaatatctgaccagtactcctcaaaactgtcaaggtcacaaaaaatagggaaagactaagaaattgtcacagaccagaagagactaaggagacatgactactaagtgcaatgtggcacctgaaatgcatcctggaacagaaaaggcacattaatggaaaaactggtgacatctaagtctggaatttagttaatagtaatataacaatgttggtttcttagttgtgacaaatgtaccatgccaacataagacattaacaatgggggaaacggggtaaggggtgaactggaactctctgtgccatctttgcaacttttgtacaaatctaaattttccataataaaaagtttactaaaatgatgaggtgaagctttaactcatttgttctaaagcacaattttcttcatcatattagtcattttagggccgggcactgaacaattagtggtaatgatgatgaattggtggcaggaaggatttctaagaaacagttttaaatataggggacatgaaaagaacaaaatcttctgaacacctagaaggtagaaactgaaaactgtgtgtcctatagtaaggcccagtgtcttctacagaatgtctggctacagaaacgaattatgattaaagagataatgtgaatacaatgggcccttgagaactgaaggaaatggaatgcagcaaaagcggaaaaagaactgtgacaggctccacctcctccatgatcttgctcaggttcaagtttgcttgtcctagaccacccctagactctaacaaaccctagggaagactcaagtcttccagtcaatttttaaattcttgtcaccatgcattttgttttctgtatatcatttctgatgttaccaccatgactgccccctgagtactcaatgttaatatgcttacatttctcttacaaaaaaaagattcacttcatagcatcacaatatcacaatataaataggattttctattgtgtgattattttcatcaggccaacagaaatgaaatgaaggcagaagaaacattgtccccatgtaatttaaagaaaacaaaaagaagatcactgaaatgaactgtcttaaatttctaaaacttgaaaattaaaagagctaagaaattatttatcgaaactatttattttgcttttctctgaggagtgcaagggtgaattttttgcataaaagattacgttaataactgcccactgctttttggttttaaaaccatgactctttggggaacattttttgaggagtttttgggggtcatttagaaagtagcaaaaaatattatttccccaagatcacacaccaaactggccctcacaactcagctctcagcgaagagaaaactacctttcttttctcatttgtactataaggatactctattggatataactcaaagttcagtgatagaaaagagaaattaatgttgttttccttcattccatttcaatataattttcccacaaagataggtaagtcattatacattttcctctttgccctagtgtggggaaaaaaaacactttttttccacactaaattctcctccctcagtttctgccatacacagccatattctgaaccactggtgattttcattgtctaaattaaattattgtaataaatacctgctgtattcctaccattctgtacctaaggctttgggagcaacagatttgcacaatacttattttctaagaacccctccaatgctggttgtcccagagccacttggatttaagataagagttttatttaaagtaacatatctgtgtccctttgtgatgtttctgtgacatggcattcattttccaggaagatctaaaaatctcagctctctgcaagcattcattcatgcatacatgcatttatctatttcttaaacacttaggtgctactttgtggtaggtgattaggattaaaaaatgaataaccaatgagccctatactgaagaggcagatagataagaagataatcacaatcaatgtggccaatgctgaaccagagaaatgagcaggaattgaaatagttgggtagatggggtgatgcctacatggtgagcaggggttcactttctgtagataagccaaggactttggggaaagagggaacagcagggatgaccaggcttctgacaggccttagatgtttcctgcactaggattgatgaccctggatcctagtgaggtgctatgcagaatgatggtagagaggacagtttgaggcaggttctgaagagccctgtatgctaccagaaaaccctgaacttttttcctatatgcattttgagccaacagagatgtttaaccaagaatgttacgtggatagtctcaggttttggtaacatctgcattccattgactgtttcaaggatagcctaattatgtgtattttttaataatatcaacatttctagaaaggtttactgtctaaaaattatctaatgacaatcacaaaatggaaaggtttctttgctgccctctacaggcttccagggctcagtgctttgaaaaaaatcagccttgaatgggcaaacacacatctcattttgtttggcaagaaaacgctaacagtaggaaaagtttaaaatagccaaattaatgtatagcaagtagaatgacaaatacagaaaggtactgtgtgctattggtgatcccttgcatttcaaagtcttttaacttggagttctatagttcaaataattttccagtatatttatctaaggctcataatactttataaatcttaagttgacaataattattgtgattaataattgttacataatttaaacagattaaggtgcaaataacaaatttaaaaggccaattgataaaatattttcattacatatgactaacaaaaggcttgctttatttttgctttgttctattaatctcgaagagctttccatatcaacacacaaagagctcttcctcattctttctcagtgcttcataaaattccattgtatatgatttttaaatgataaactttttatgtcattaaaatatttatttaaggatccaccagaaatggtaagcattgatatcttgtgggcaatgggcctggggtttggggtactgggacaagacccttattttccattttattgtcttctacagtatttgaaattttctcctaaagcatcttttacttccataattatagaaagctgttctaggattataaattagcagtgaaaagtatggaattacttgatttctagtctgtgactcagactattgaatatggttcatctacaaggaagatacgcatttcagagttacatgttctataaaatcacatcagctatggtttgaatgttccttccaaaacatgtggaaatttaactgccattgtgatcgtattaagaggtaggactgttaagaggtgattaggccatgagaactgtgccctcatgagtagattaacgttgtcatttgggagtaggttttttattactagagtaggttgctataaaagtgagttcttccttctcttcctagctcactcttgggccttttatcatggatgactcagcatgatggcccctttcagatgctgacaccacgctcttggacttctcagcctctagaaccatgagtcaaataaatttctgttcattataagttacccagtctgtggtattctgttacagcaacataaagcagacgaagacaacatctaattttcaaatttctaagctattagagagtgaaatttcagaaaacttcaaataaaaattttgataaaatttcagtatagaaaattatgctaatacaaagttgtaattaatattaaaatgcttttaagctgaaagtcaggaaacccagagttcagattttttctctccttaggcattaagatagtttcttctctatggctcaggttatcaatcagtaaaatgggaattattttattcacctatatcaataggagatcaatattttttacccactattcaaagtcagtaaaaaattaacttggaaacttagaaaaaatagttttaaaaaaccacactctgtttctgttttctgttaacttttactaagagtttgtgcttatagactaacacataatttaattcaagtatgctttctttcagtctagttacacagaaatttaatttaaaaacaaaagaggtatcagtggaaacagctgagcgctagtaaaagtgcttaaacctgagaaattttagaaattgctttaagtggttcaatctggaggtaaatgtcttcagttcgggaactagcattttagtgtatctacagcagtacttggtatagcattagtgtgacaggactgccaggttcctaaatctagcacctcctatgtagttctgtggttttgttcctccttccagctgccttgggttcaaatcagaaggtgtcttaaaagagctcaaatgtggaacacactatgcaccaggtaaatttaaatggctttcattaccctctgtttgagtgtttgccttatattcttcattaattgaataactttgtagttggccaagcacttttatgttgatattgtattggagtacatgtaaattacccaacagttgctgggaggtgaagcaacctgcctgaagcaaggctagaattgcagcccaaggcatctcctgtaattcctttgccctttcccctgcattgccagtgcctcagggcagcatccagttcctaatctccctgaaaagacagaactccactctctgaactttacatatatttattttattttattttattttattttatttttctgagatggaatcttgctctgttgcccaggcaatggcacgatctcagctcactgcaacctctgcctcctgggctgaagtgattctcctgcctcagcctcctgagcagctgggactacaggcacccaccaccacacatggctaattttggtatttttagtagagatggggtttcaccatgttgcccaggctggtctcaaactcctgaccttgtgatctacacacctcagcctcccaaagtgctaggactaaaggcataagccaccatgcctggccacatgtatttattttctaacaccacagtatcagagaagtactgttatctcagtacagtagtccccctttattcatagcaagggttatgttgcaagacccctagtggatgcctggaaccgaggatactactgaaccctatggattctgttttttcaatttaataactgagaaggccactaagcgacttaggggcagggagtgtatacagggtggatctgctggacaaaaggatagttctccagagcacggtagagcagaaacattgtgagatatcatcacgctactcagaatggcaagtaattaaaaatttaggaattgtctattttctggaatttcccacttaatattttcagaacttggttaatctcaggtaactgaaacctcagaaagcgaaacagtgcataaaaggggattaccataaataaaaataaatgttatttttgttttaaatgtctctaagtgatctgcatcgaaacctaaactttgaggtaagattctctacccaatctttaagcctgaatggaatttattaaactactgagctcttttctcccacaatgaataatttactcttcagccaggcatgcctgtgaaatacttaagtgaaagctacacaaatgatcacaacaataaaattcttattaactcacatataaaacatattatggtatttgcagctaggtgttgctatggcaacagttaaaaaaatttttttaaacatttgtcacactaaatgaagtatgggatgtacttttttgttaactgtgaatttacatgacctgcaacacgacaatggcttaatgggagctaaacaaagggtgcagtttcccctccctcttcctgcctgtttcccctttctcctaggagccatttcaggctttctatcttgattaactgtgtcttagtaattggagcttacagctcagaacagtaattctgtcccataattgtagatgttaaattttaattctactctgtaattggcaataatcaggccatgttctggcttttctggagtgctcaattagaggcctgtggcctcctctttcttccccttccagcaaagcatctattcttgactcatccccatctgaatgattgtgtctatagttaaaagatatgataaatattcttagatttggaagactttgaaaaggagtatcctaattactattgttcacttgattgaaaatttcccagctctaaagctacattctgttaaacatggggtcactgaagctttcatttgcttcaaaaaaaggtcattttatgtggtcagcagctaacagtataaaataatagtaattttatttctatttcttttaaacaaagagaactttttctaaattaaagaaaacagaaaaggaaaacataagattaattgggttttcacttagcatatttctgaagcaatttgccttcccttaaaaagacagtttctccaagtgtgttattattcaaaatactcctacccaaaggtttccctaagaaaggagcccctgtttttaaaatgccctgcattatataccgctttgggaggtttgcagtatgttctagacatttaagacctctgatgattcctgcaataacaaacgctatttggtttacttttaacttttcaaagcttagattaacccattgcttcccagataactgtaagacactgctttcttgtgacttacattgaactgtgcttataattcactcacccatttttaagtccagagcttctactgtataaacatattaaggtaatcatgttagggttctaaaaattcctgaaaatgcataattaaaggggaaatgattaagttcctttttaagaaagcaaaataaatgctgcctttagaaaaagacatgctaaagcttgtaagattaaaattaaaaataaaatcattttttaatagcagagtttctcagccatggctctattgacatttgaagccagatgctttttgttatgggggtgtctatcttatgcactgtaggatgctaggcagcatttctggcttctacccattacatgcagtaagggagggaaaaatggcttccctccacccttctacattctttgactatactacgaactaaactgacataagacagattaataggagaaaaaaataggtaattatgtacatacgcacaggagtcccacaaaatatgagagtctaagaagagccaggtaattgaagcttatatagcatcctgagctacagaaaggaatagtggcttggggcttctctggggaggtggcatcaagtcatgggcaggtgagaggaagaaatgtgtggtgaatgaagcttgtcttgctgtacaaataaaaagtctctcaggtataaaacttgtctctaagcagccctctttctgacacagatactttgactaatgtagatttcctttatagatgtaattttttacaaaatttttaccaaaggacagtttcatcatagcgactcttatgtctgcagtttttcagaatagccagctctaaatatgctaaagaagtatatttaagggtgacatattctgatctcctatagtcattttttgagttgatgtatcctgagccccaatagttcttaacgtaattgaggggcaagtccaagaaattttcaaagagaacactgatcaagtgctttggctttgtacctttaaagcacaacagagctctgcctgtcttattaaaaaggacttaaaaaggaaatttgacttttattcttaggtcactggttaatagctgctcaaaaactcttctagtttgaaaactctcagaacaaaatgaaggataaaaaagtagaccagacctatgtagaaggaatcttagagtgaagtgggtagaccagcatgccagagacttcctcagagaccaagtccccaaaactgtgattgcttcttaaagactaaattcatttacagtggtaatatggagccatggaggaaaatttcacttttcaagacactttttccctgactccagtcccagtacatattctcttgcgtttataagtttgtcacttaacgggggtccatatagtcttaactccctggttgagagacatactagagcagtgattctcaaagtgtgatctagggacctctgggaatactgaagatccattcaggagatccagaatgtcaaaactattttcacaatacaaagatgttagttgtccttttcactcacattctgtcacaagtacacaatggcgttttttggatgtgtgatctcacaagagactgaatgcagaagcagatatgaaaatccagctatcttctattgagccagacattaaagattttttttttaatgtaaagcagtgccactcttctaaattttgttttggaacatatattttataaatatgttgcttatgttaaaatataatgagtttatttatttttatttatttttttgagacagtctcacgctgtcacccaggctggagtgcagtggcatggtctcagctcactgcaacttctgcctcccagcttcaagtgattctcctgcctcagcctcctgagtagctgggattacaggcatgtgccgccatacccagctaatttttgtattgttagtagagatgggtttcaccatgttggccaggctggtcttgaactcctgacctcaagtgattcacccacctcagccttctaaagtgctgggattacaggcgtgagccaccacacctggcctattattgttattttaatgaattagtaagtatttaaaattttttctcagttttaattcccaacatggtaaatatcaatggatataacccatttataagtgctatgctagagaatgagaatattctgttagacatgtgtggaaagggaaggatcagactaaactccatggaatctttagcatggtggagccttttatttttttattttctattttttgaaacaaagtctcactttgttgcccaggctggagtgcagtggcgtgatctcggcgcactgcaacctccacctcccagactcaagcaatcctcccacttcagcctccccagcagctgggaccacaggcacatgccaccacgcctgaataatttttgtagtttttgtagagacagagtttcgccatgctgcccaggctggtctcgaatttctaagctcaagtgatcatcccacctcggcctcccaaagtgctgggatctgaatgggatcataggcataagcactgtgcccagcccggggtattttaaatacacattgaaaggtagatgtaaatttcagggctgggatttataaacatcttcaacccaataaaatgccacattgaaaattaggcttttcctctgacactctcctaatctcctgaggttgctcattaaataagaacatctatgaagactagtctcccttcctgacagcttttgtatcagtcttccccttccatgaactcgttaaaagaagccctaatttcaggagagagactgccagtcccttggccatctgctggaaatgacagatcagggaggtcccttaagtgatgccattcatagagaacctatttgatgtacatgattatttgaatgctattaataaaagaaataaaaagtgtactttatcctgaacatcataatttattgtcagtcttttcatgaatctataaggtcaactatcctcttgttttcctcatctgttaagtagatcataaaaaaaataagtagtaaattcacatttataagtaaaggtcttttttttttttttccagaaccgtatcttatttcccctatgacctttgctgttgctcggtcctaataaaattgaggcccaggtggatgatgctaacattcttagaatcaagccaagttagagcttcaaggaaccttttagcattgaattcagtggttcttgaattcccctttgagaacctgttgacagctagtagccctttcccccaggaagatgcatattgtaggcagaatgatagccctccaaagatgtctataccctcatgccccaaatctgtgaatatattacattacatgacaaaggacagttcagattgcagatggaattgaggtttcttatcagctgaccttaaaacagggagatcatcttggatcatctacacagattcagtgtaatcacaagggtccttaaatgtgcaagagggaagcagaagagtcagagcgatatgaggtgaaaaagacttgatgggccattgctggctttgaagatgaaaggggcccatgagccaaggaatgtgagcagcctctagaagctggaaaacacaaggaaacagactcccccctagggccttcagaaaggaaccagccctgccaacaccctgattttagcctagaaagacccatttcagacttcggataaatctgtgttattttaagccactaagctcatggtaatttgtcatggcggcaatgggaaactaacacaatgcataaccatgtctacatatccaactttgtatacagttccagggaggactgaccccagggtaagggcttcatgatgtgttccaaaatctcatccgatggatgtcagtagaacccaaaccccttgacttctgatcgccaaagctctttgtatataaaagaaaaaacactcaccttcctacagccaagttcagagttaaaatgggctatcgttagatgctcttctctaataataataaagcctttgacttcaagttggacccaaaacatttttaatgaaactaaaataagaaaaagaggtttaatccagacttgtaattgatcatgctgaagttggagaggaaacatttaaaaaattctgaacagagcccacattaatgcagatccctgagatatgtctgggtctgtgaggacacaggaggcagtcatctgtccagagaaatttatatttataccataccacatcctcatctgcttaaggcctgctggctccatttgtgaaacaagaaacctgccagtcttttctttcaagacagtaccctcaggcactcttctgtgagaattcaagcaaggaaaacaaatcttttctcagggttgcagaaggcaggctaatagtaatggcaagataaagtggatgttattgctcagagggcaccttcctgatgggatcctggggtattcggatggggctctttccacaccccatggtaatccactgctatgagtatcattaaaggcttagaaattatctttagcacattgtttataaacaaaaaaggaaacagagatcattgagggtagagtattcaccattttttagccattttctctctgccgtagggaaaggtgtaggagtgggcattcactctgaggacagtttaatgagctgtgtctgtcacctggactggtcagaggtctttgagggaccaggaattcctgaattccatgatagttgtcaatttaaggctctgattactgttacattgcaaattcatggatctgaattctgaggcccttgagaaaaagaattatgtgtttttcatcatcccacagtagcaaaagcctcatatatagtgggggctcagtaaatgtttattagttactggggagagatgacactttagttttaatccacagctgtttattaattccaaccattgcgttaggtgctctggatttctaaaataaatcaccaaaagaaccttccctcctggagaaggctacggtccagagtagatgagagaagatccttatgcaggcaatggtaattgatcaaaatatgatacatgcaatgggagaagtaggaagaaagtgaggggggattatggagtggggagatgctatttctagagtgaggcttaggaaggcttttgggtagaggcttcatttgaattggtgtgggtggtctgtaggattttttgagatgaagatggtggaagagttatgcctcaagaagagggcagtgtgggcaaggagatgagagtgtgtggggagcctgaagccagcaagcttggctaaatctaaagtgataggaagggtgaggaagagtgggttattagtcatttaaacccagtgcaacctaagagagtagcttggatgggaccaagggctaaggacaagaggccatagctgataaggaatggaggaaggtgcccaagaaggcagggcttgaaagctggggaaccaaaagaaatgtgcctgaacataagctagacctcagatggctggcaaactggagtggatgcaagagtttcagggccattgaaaagaaagttctacatctgtccactttggaggctgcatgcaacactcacatgcctacctattggggtattattggggtcttagtcaacttgggctgccataacaaaataccaacgattgggtggcttaaaagatagacatttattttatcacagttctggaggctagaagtccatgattagtgtgccagcatggtcagttctaggtgaaggcccgctttagggcttgcagatagctgccttcttgctctgtcttcacatggtagacagagacagcaagctctctggtgtctcttcttataagggcactaatctcatcatgagggccttcccctcttgacctcatctaaaccttattatggcccaaaggccccatctccaaatatcatatttggggttagggcttcaacacaggaattttaggggtcacaattcagtccacagcactgggtcagaggattatgcctgggaggtcccaatctagctgcagtggcagcagagagtaggactgctcacccgctggtgttgccagtaagatcagattgcagtgagatctttctaggatgtgccttggtgactagttttatgttttttttatccactgtctacagtgggtcattatcagatctaagttggggcacagttttttgaggtgatcatgatattgaactgacagactcacacgaaaccccaaatggatgtaaatgtagatatagatagaaaatccgtgtctattgtataattataaatgtctacacctaacttgtattctgagatatatatatacatactgtatagtgtgtttgtgtgtttatgttactgttttcgaacccttttttattatctataccaccagcaaaagaagcctttttaagtattttctattaattgcactcgctaacattttaatatcgcaaatatgctgcatataagtttatatactgtatgtgtatctgtgctttacatatagaaagaataaaatttttgccccccaaaaaacaattttcatccttgttggagcaatgctgtccctattgagaatgcatgatatatatatgtagatgtgtatctgtgtctatgtatgcatgtgtgtgtcaccttactgcacaaaagagtttaggatgccaaattagatgttgtttatgcattcacaatggaaaatgtaactttccaaaggaatgaatattcctgtcttctatccaggtatcaggaaagttgaagtagtaaatgggggtgaaaaaaagaaactgcttaaagagcactgagtcaaaagaaaataaattggatagtcatggagaatatttcatccaaggtatagaaatgcctggaataactatctcccaccctaacactaaaacctgactttagtgaaaaaatctatgtagctctgtaatatataaaatgttgctgtttgatagtgctaaatgaattctcaaaatcggttttttccattctactttttctagacactcttcagaccattcttccaattttataatacaactattgtctcagacttcttacaatgcaactgagtagcttatagcccttgagaacatcttagttttcttaattggattagactgcagactctagcctatcttcagggacacatttcaaagccatctactaaggagagttacttcagtagatccattatgtattgttttgagtcatttcagcttccgggacaatcggtttctgaccttgtctctaaatccttgtggtcccccagtggagcccacgtgcagggatcgtgagtcagggaccggactgggcatgctctgttcagcttgctagcagatgtttagctttctagctccattgtaaagtagtaatgcttttcatattttatttttttaaacccatagattttttttagacaaaaatcaatttcttgattcatcagaagctgattattgagttagtaccttttctgaattcttcctggacagaaagttgaatccagtttgcttcatgaatgcttttttacagtccaaaggtattgacaataaacaaaagaaaaccgaaaagactttcttgtcacagctccagaaaatgatgagattgaaggaaagaagacattaaaactaagggataaaatgtctttggaaaataaaactttactccattagaaggaaagctattggaataggttaaaagttcagattacagatttgtttaaaaataaaaatgaatttccacttccagtatggccaaagaagttcctaccagactgatcttgcataaaacaactataaactctggacaaaataaaaaatatttaaataccacaaggcattgaaaaatgaacaaaagcagttagattcaagaggggagttgacacttggaagaaaggaatgacaagaggtaagtttaccagtttttgtggcttttagtctaaggcatgtcacagttggccccatgtccagtggctaaaactctaatagaaaacctatagtttttctggcctgaagaacaaggggccagagtttggggcaaccagtcctgctggaaaataaagagagaaatcccataaaggagaaagccaaagaagatgtacccttcattctctgtacagtagtctccccttatctgcaacataccaacatcccccagttgatgcctgaaaccacagatagtactgaaaccctatatatacaatgtttttcctatacccatgataaagtttaatttataaattaggcacaggaagattaacaacaataactaataatgaatagaccatttataacaacatactataataaaattatgtgaatgtggtctctttcttgctctcaaaatgactcaccccttctcgtgatgatgtgagatgataaaatgcctacgtggtgagatgaattgaggtgagtgatatagacgttgtggcatagctttaggctactattgatctccttatgctacatcaaaaggaggatcacctgcctctgatgctcctggattattgagccatgacactgttgaccctaggatgtcaggagcagacaatgtcaatgactaatgggtgtgtagtatatatagtgtgaatacactggagaaagggatgattcacttcttgggagggatagagcaggatggcatgagatttcattaggctactaagaatggtgtacaggttaaaacctatgcacagttcatttctggaattttacatttaatatttttggactgcagttgaccacagataactgaaactgtggaaagcaaaactgcaaataaacgtggactactgtataaactctgctcaaatctctggctaactcctgaaccacacgtgtgcaagcaagctagaagcagtctagctaaagataagaaaaccaaactgaaattttagctaatgcctaaaagacagtatgcagtttgagtccaaccaaattagttgattgaaattctgttatgtttctctgaaacagtctccacaatataacatcacaatgtccaggatataatccaaaatcacttggcatataaagaaacaggaaaattacatgaaccattcttagagaagataatcaatagagaccaggtgcagatgagcataaccatcctcaatgacctaaaatatatgtgtaataaatgaaaagataggcaatctcagcagagaactagaaattatttttcaaattgaaattttagaactgaaagatatctgaaaagtaagtataacatgattaagattcatataacaatatatactagtgcttgaaaaacagtcaagaagaaattttgcttaaactaatggccaagaatcatttataatctgtttattaattttaagcaaataaattctaccagagtggtatccagtaggtacttgagtgtttgaataaatgtcttaccaggcctcgtgtagcctgtctctctgtcctcatgtcctgctactctccctcggctcgtcctcctcccgcccactgcctgcttgtgattccttgaacatgccaggcaccctgcagcctgaggcctttgcatttgcagttccctctgccaagaatgcccttctctcaggtatccatgattcactccctctcttccttcagattcttgctcaaatgccattttctcatgaggcctttcctgcctccacctcccaccctgccatctgacacttctttattcatttcctatgttattttcctccatacttctcattagcctctgacttggtgtatatttgatctccatattttactatgtctcactagaatgtaagttcccatgagtgcagggatgtgtgtatgcttgtctgctgtctctgcagtgcttagaacaatgcccggcacataataggttatcaaaaatattaaatgcatgcatgcaagaattaatgaattatcttcttacatctaattatacaatatgctataatcatgaattaattgccatgctttcactatatgcccttcacgcagatattaaagtagatccctgaagatggttgctttctctttgtattggttcctttctgagacagaaaatgtaagtaataataactgcctgatgaaaatagtcttccagttttcttcagaccatccatgtcaccagcaaattcattttccaaggcttaaaaactttcatggcttcccctattcagaatgtgcttcacatcctatcttccaaagctccatgatatcgcccttgtctcaggttgcatacctgagacaaggatttctggcaaagtgatttattaggaaatttcgctggcaaactcccctgtgggaggagggaggcaggacagggaagggaaggagactgagcaagggtgcaacatccagaaaatcccatgaagaggacttctgctcagccctgcaggaaagcactatggacagtgaaggtcacacttcataggtgtctccatctctaaggacaagaagctggagtcattccacccccttatcctcctacaggctcctttcttttcattgtaaattttttccagctctctgtgcacacaggcaaagcagcccagtgctgtcagccaaccaagagacacaggtgctggctgttgggagtgaaagccccagaaggcagcatgtagtgaaacagtaaagggattctgggaatacgggcgtgcacaaaacactgacagcatctgctgcctttttaactggattcttactacttcccggttgcaaaagtcactcattgctcttccttctatgcctttgcttgcaactcgcctgccttccctctcccaccatccaactgatcctttaagattgatttcctatgctccctcctcaatcaagcttttcttggatttcaaaaccctgtggcaccctcatttctctgaatcttcattatgtctttgaccctggcatctgccaccacctctattactaatctgctattggtcactatgagaacatatgctcatctgtcaagagtttgcattctgattactcagctcccttccagggcaagaattctgcaattgcatgacttacaatattctaaagtgtattaaaatcatgaatacatttatcaaccctcatcaaattgtaaacttctcaaggataagaatattttgtcttttgggggaaagggatgagagccccaggccggctgagacggccggtccagggaagctccgccagtactgggcacactcaccgaacatggcttccagcagccgcgtctggacctggaacacctctggatctttcaggtcttcgggaactttcacccacggcagaatatttctacgtgccgggagcgttcccatattatgatcctcataaccaaaaccacgctccagcgcaagccaggcctaaccgcaccagctgagcctcagtgctggtaaagcctcgcacctggcggccccgcccccggccctggccaggaccctgagtctgcgcgccccgccgccctgtctgcggtccagctggttgccatctctgccgcttcccgcgacctcaagagagcctcacccgggcccagctgtctgcaggttaactagggtttccacctgcattgacctgtgtctttcgcaccagaatctcctgggcttgggaatggctgggggcggggcgctgttgactcttctagggaacaaccggtggggcctgaacctcagaaagcgggcgtccaggcttgagggtgcgaggaccacccagtagctgccgaatcgagttcctgcctcacacgttccaaaggagggtccgtatcccctcggccctaaggagcaggacccgcggctccactttgctggcaacctgggcaacgtcctgggaactctggaggaactcctgccattgaacaaagaggaaaccgaaattcggaaattgattatcttacatgaagggattagcgttcctcaaagccccttgaacctacccggattttaaagctcacctgtgccctgcctgggcactcgggccaaaaccggtccagccttctggctcgtctctaaataaatttggtttactcgttttttaaacatagtgtttggagcgatgcactggattcactagttgagagtgtgatttcactgttttatggctttacagatggtgatgaagctggcatttccagtcctggtaacatctaatatcccctcagctgtccattattgacggcttcttaaggcggacctcttcacacacacaaaacaactatgggttctattgcaaccaccagtgtagttaatttagaaaacgatcatcactgctaaaactatcagatgaagactgttgaggaactagatagtcacaaggtttggaagccctagcccacatattatgaattacaaaggaggaaaaaaaaagaacgttcctttacaatagagacttggaagaagccaccttaacccaagttagcatcaccaataatgggaaaaatggacttctgcttcgtcaatatctgaaaacaaaaagaggactgttttattacttgactaaagagactaaatgctgtgtgcatggttcaaataattctgaatcaaaggtgaggggttgcatttcaggaaaaggaaggaaattttagtataccctatattgcaaagtagtattagaaacttctagagtggaataagtgtactacaattatgtataaggtcattattctcaggagaaacatgctaaagtatgtggagtgaattgggtttctctatttttatttttttaatttaatttttttgaggcagagtctcactgtgttgctcatgctggagtgcagtggcactatctctgttcactgcaacctccgccttccgagttcaagtggttctgcttcagcctccccagtagctgggattacaggtgccagccaccatacccagctaatttttgtatttttagtagacacggggcttcactatattgaccaggctgatctcgaactcctgacctcaagtgatctgcgcacttcggcctcccaaagtgctgaaattacaggcgtcagcaccgcgcctagccaaataatcaattttttttttcttgaggcggagtcttgctctgtcatccaggctggagtgcagggcgcgatctcagctcactgcaacctctgcctcccaggttcaagcaattctcctgcctcagcctcctgagtagctgggattacaggcccctgccaccacacccagctaatttttgtatttgtagtagagatggggtttcaccatgttggccaggctggtctcgaactcctgacctcctgatccacctgccttggcctcccaaagtgctgagattacaggtatgagccactgtgcccgaccataatcaattttcaatttcccatctcccattccacctgcagcccaagctccatttttcctgtcacccagactcttatgaaaaataaccctcgcttctacttctgtataccttacttattcctaaacacatcattccatggtaccttcctttgcatttcagcaaaagtcactctggacttgctccgtccaatacagaagtcactagtcacatgaggactggaaatgtgtctagtctgatttgagatgtgctgtaagtgtaaactacatgtaagattttgatgacattaataccaaaaaattaaatattaacaattttagattgattatatgtttaaaaaagaataatattttgttctctgaactacagctatgtctgctgaaaattgggaataatatatctaaatctatttcatgaaatcaggaataatatatgtatagtgtctgatacatagaagactcttgaaatagatcgatatattggcatatctttgtacttcaggaagagcctattcagagcctattcagccttgtacattagaagcattcaagaaatatgcattgtagaaacagaaactaaaggccagatgctagttagtggcaaaggcaagcctcttcacactgcatgctgtgacctttctattcctccatgttgccagagccaagagttgattaaatactggacagctggctttggccaaatactaaaagagctaaaacgcacatggaagttatgttcaatcacttaggacctccaccaaccacctggttccaagacagtccacttttagtctcagccactcctaaagcttgttctttgctgtcattaaacacataaagtatggatctaatgccgaggagatagtacccagtggtcctccaaaaagtggcagctttaatatctgatgtttgcatcttgctgttattatttattgcagagtttaacattcatcatggttggttgcccactgcaaggtttgatctggatcagtggctgatcattcttaatttagctattgaaattaataagcggaccatgcagacataagctttagctgtcacttgtttgctcactgctacacaaaagtgtggagaccggaagctaattctacagcaacgattctcctgctcagaatcacaaacacaatttattatacccagaacctgcccaaaacattattataaaaccttcctcaagcaggtgggattaattagatcttcctttctctcaggctcttcctttatagacactcttccttctccttccttttcccactcctttccttggaaaagatcatgtgaataatggtacaggaaatttgatcattgtactttgcaagggagctttcgtttcctttaaggattatccttactcccaggcaatgctccaaagaggcactgaagaaaatgagggagattcagagagaaaattagcccctcaaagggaaatattttaatgctttttttgtttttttttttgagacggaatctcactctgtcgcccaggctggagtgtagcggtgtgatctcagctcagtgcaacctctgcctcgcgggttcaagtgattctcctgcctcagcctcccaagtagctgggagtacaagttcgcgccaccacgcctatctaatttttgtatttttagtagagacagggtttcaccatattggccaggctggtctcgaactcctgacctcgtgatccaccctcctaggcctcccaaagtgctgggattacaggcgtgagccaccgcacctggcctttaatgcattttttattgtggtaaaatatacataacctaaaatttactgctagttacatttaatacattcataatgttttgcaaccatcatcactatctagttccagaacattttcattaccccaaaatgaaactttataatcattaagcatttatttcccatcccccttctccccacccctagcaaccactaatctgctgtctccatggatttgcctcttctggatgtttcatataaatggaatcctgtaagatgtagccttttgcatctggcttctttcacttaataacatattttcaaggatcattcatgttgtagtatgtatcagtacttcattcctttttatggctgaataatattccattatgagtgtgtgtgtgtgtgtgtgtgtgtgtgtgtcactatttgttcatccatttatccattcatgcatatttgggttgtttctacctcttagttctcatgaatagtgttgctgtaaacgatcatgtacaattttttgtttgaacacctgttttaaattcttttgggtatatacagtacctaggagtggaattgctgggtcatatagtaactctatgtttaacttattgaggaattgccaaacttaacacatttttaaaaaccattctggcctggcctgtagaattcttcttatgtctttaatttgagttcagtggtgcataaaagatagcaattaagataattggttttttgtttgtttatttttgacacggagtcttgctcggtctcccaggctggaatgcagtagcatgatctcagctcactgcaacttccacctcctgggttcaaacgattctcctgcctcagcctcctgagtagctgggattacaggcatgtgtcaccatgcccggctaatttttttgtatttttagtagagacgggatttcaccatgttggccaggctggtctcgaaccctgacctccagtgatctacccaccttggcctcccaaagtgctgggattacaggcgtgagccaccacgctcagcctgagaattgttaaatgatgaaggaaacttcatgaagtgcaaaatggcagggcccaggatttcctccctttgggtataaggtaagaatctagcaaataccacataatacacctcatgatgctgttactgatcaggatggctggtccatgtctgtgaagatctgaattgaaaacgaaagttttttatgttcagtatgtaagtcgataaaggtgacattatgacaagaatcttaagagtgggatatataaaatgttttggagtattttacaactatatcataggtttgagcatagcgacagagataatgagcctttccaactatatttcacatttcaatttgctttcttttccacctagaaataatccaaatgattttgcatgatatagacaagccaatatatttccaattcactgtatcccttttgtaatgaaatctcccacgccacaaggaatgccaatttgcttaaaacatcagttgcttatcagtatatttcaaatgcctcttaatttaaaattctttttctgcctatttcaaatgtgtacgtgtataaacacatgcacacacatacatttttttctttttttccagtgaaataaatagaaaaccaaacacatacatacattttaaaggagaatcatatgccacttttaaaacatcctgacaccaattctcttatgaattctgtaagaatgtttggggatcattatttatcttcagtttttatagaataaagggtttcctaagtcgatattatgtaaatatttgattgaagacacattgaaataattcagatgactttctgaatattgtcagattatgttcataatataaacacaggcattttagtgtcactaatatttgatagatttgagtcttagagcctttgaaaacaattttattcaatttgttttaaattaggctaatattgagcttgattttttcctttaggccaaaaccaggtggctcacttgtggcttctattgtctaatgatcatattcaagaaagtggaaataccattatctgaggatcaagctactgttcattcaatcacttactaataaattctcagaattcaaggaaaatgctatggagagagaaactgctcacaagtgggaacaatctcagattttaatatatccgaaactgaatccagaaagctttgcattctatttagcaataatagtcacacacagaaaaggtttatcttttcatgtggcatgggtaagattaaaaatattagcaattatattattatctataaacacctaaatttgatatctacagaggacaagtgcctaaactctgtctatccaacctgcattttcatccactttcaacatattaaacacgttctgagacatgcctatgaaaagtgaattgtggcctttccatgcttaatttgctgcttaattgtgcatgattttataatgcccataaaataatacttataggcataacattccaaggcagcctttttcagaaaaggagagttcgatttatctccagatgtttctaccaaacattttcttttttctttccttcacccttcattcccacttcattgttgtgattaacagcgcaaagctccgtagcagaaattcatcaactgattccttccacctaccaaatccacatttttcaggtctcaatttgagacataatgaaagtctactttgcataattatcatatgagactatctataattaaatgatgaaatgtggttatgctccagtgtgtagacgaggctttatatgaactgaaactgcaaaggtttatttatctgctttaactttcatctggtgtttgtggaagaaaaacaaaaacaagcaatttatttccaaaggagtttaggtccccagtggacaccttcttttttaaaatttcaggagagaaggtgatttcttgaattgaggaataactggagactttaatatgatttcctcctcagcgtcaataaatattgctcacaagctttaaaaaatgctaattatcgacattgcattttgagttttgccttaaaaatattttctaaagattttaggatagctttttaaatacctgtagaaaaacccttcttattatcatgcaaatttaaagcttggaaaaaagcctttcaaaagtttctcaccttcattcatagtcttgattgattgcctttccatttcttctaactagacaaagtaaagttgactataccaagtttaatatgaaaacaatgattctaaaatttattcaaggcagggaatagcatctctgagattctttgtgaaaccccatgaagtattgttgaattgaaccttaaaaacaaaataagtaagcttgtctaaattatatccttatttgcgaagtattctttgcacacaattatatgccatacactgtcagagactgaaaataaagagatgaatattaaacaaccttcaaggagttcagaatccagtagtattccattctaaaagtgccaaggctgcctctatcagtgattcactaggacaaattctggagtaaagctccaatttaggtatgtttcatccactggcctttcccaccctaaatgttgggaaaaggccaccaacatgaagcatttgtgctattgacatgactctgaaaagagagaagcttcctccaagagccaaatgaagaaggaagtttaagtattaatctttaatatttccctaataatattttggaaaatcatgctctatcatttttgcaaatgtgatgatttcacatatacagttgacccttgaacagtgcaggagttcagagggccgacccccaaaacagtcaaatatttgtatataacttttgacttcctccaaaacttaaatactaatagcctactgttgaccagaagcctcatcaataacagcaacagttgattagcacacattttgtatattatatgtgttatatactgtgttcttacaataaagttagctagagaagagaaaatgttattaagaaaattgtaagaaagagaaaatatatttactattaattaattggaaatgagtcatcatagagttcttcatcctcatcatcttcatgctgagcaggctgaggaggaggagaaagaagaggagcggttggctttgcttttcaggagtggcagaggtggaagaaaatccatgtatatgtggacctatgcagttcaaactcatgttgttcaagagtcaactgtacatctatatctgaggtcagcaaactatggctcaaaagccaaatctggccctctgcctgtttttataaataaagttttatgagaacatcagccatgttcattatttatacattatctatgtctgctttgtgctacaatggcagagttaagtcattgtgatcaagaccagatgagctgcaaagtctatctgggccctttacagaagaagtctgccaaacctcgatctaaataacgtgcttaattttgtatttctaggcttaccaattttagaccttatctactgattacttactctgcaagataagggctagctcagctgcaccataccctacctccttcttgcacttgttgaggctcaggacttgatacctcaaagtatggtgccttggcatgctgagtactttgaactaaagaagattggaaggacctcagaagcaaggtctctctgactttatcctgcccttctgtgtcctgcctctctttctgtcccgaagagagtcatagaaaccagatttcctcttctccaagacaggtcgtaggaaccagaacccatctcccacaatgcaagccataaaacctagaaaggtcactgtctcccttctcccttgaagaccttcattttggaggagtcctgccccatactccaaaggaaggaaagctacagagacaggtcaagaagtatctggacagacaggccttggtgggtttttcccttagtctattaccattagatcatacccttttgtctaatcacattgctacatgactctctattcttcgtcgaacctaatcataaaaatagacagtattccctgggtctttgggtcttcattaatgaaggttcccatgtaatataaaatgttgattaaatacatttatgtttttctcttattaacctatctttggttataggaatgtcagccatgacccttatgatgggcgaggaaaggtatcattacctttctgcccctacacacttctctttctccagtgtaattctgtaactgccaattagctttgtaattttaaatgataaattatacatttctttctttttctttctactataaatagcatgtcctgatattagtaattccacttagtgagatgaaaatataattcttgtacccttcttgcttacttccccttatcctttctttttccaccttttgtcttccatagttagtctttaataatacaatggttgaaaacattcacaattgttccataaccattacgatgtctttcatgccttatttataggttgatttaaaatttttaaactcactggagggtttttattcttagtactaaggaaatattattcaccgtatagctaattattgctgattataatgcctctattgaaaagggatttttgttgtttttctagcagtctctgacagtttttcattttctcccttgcatgtcctgtgttaaaaatgctttgtccttcttaaaaatagagtcaaatctctggaaccaccttctttcccaggcacctttctcctcaattcttcctcccactctaacctgggttgatgacttcctaggcctcgttcaagactggcatccttgattttgcttccttctcctcctgtgttggatccattgcttccttaatcccatgtctttctatttcttgattttgttagagcacatcttcagatcacttgcttcaaaaagatgtgtgggaagtaagcgttctaaatttttgtgggtctggaaatgtctttattctgacccctcacttaacctagaaatctagattgaaaatgatttttccacagtagcttcagggcaagctacattgcctttgggtctccaggtcccacagtcaaataatgatctattctcattcatttatcctcaatgtatcttttctctctactgttttaaggataatttatttatctttggtatattaaactttcattgtgatgcttccaggtgtaaagacatttttattgtcaagctctcaggctgagttttcagatcattcagctcagggacttttcagattcttttttaaaaataattcctttctcattattgttctctgttttctgttttagaaattcctatcaattgtttattggatcttctgaattgatcatctataaatgttttcttttctctcgtgttttgatactttgtctttttactcaactttctggaagatttttaaaatttttatccttcaggctttttattgaattgaatatgaaattgtttaatttctaagaatattccctcggtctcatgtttctttttttttccagtgaagtgctgcagtacacaatctaaggcacatggctctatccagttatcttatacaatttaggcctagaaatgagtttgctgagacacataatatatgcattttaattttgaaaacttatgatagcccttcagaaacaggttgcagaaacttacacttctaattctagggaagggaaatgatacatcagaatttttgctttgcatttattaatgagaatgagtgtcattcagaactaccatttgtattatttttatctatgtgcctggtcatgtacttcattttttttttaattgagttgccttttctttttgaattctacaagttctttattgtgtatattatgtatttgtctgtttcatatgttgcaaatattcccttctaatgtgtcatttgctttgtaactttgcttatgcttttgatattttaaattactgtgtaattgaacctgtttgtgttttcctttgtagcttctgggtttcacattatgcttagaaatgtccttcctactcctagactctaaaggtattctttagtagtattttcttctagtgctttcataggttaaatgttttacatctaatacatacaggaaacttggtgtatggtatgtgtgtgaatctagcttattgactttccacatagatactgtatttagttaaccccatttatttatttatttatttatttattttttgagatggagtctcactctgtcacccaggctggagtgcagtggcggggtctcggctcactgcaacctccgcctcccgggttcacaccgttctcctgcctcagcctcccgagtagctgggactacaggtgcccgccaccacgcctggctaattttttgtattcttagtagagatggggtttcaccgcgttagccaggatggtctcgatctcctgacctcgtgatctgcccacctcggcctcccaaagtgctgggattacaagcatgagccaccgtacccggccagttaaccccactttaaacaatagtttattctttccctgggatttgaattgccctcatgctttagtttgtgaccatttctattccattgcactatttactagtttcttttagagaatgtattgttccgtaatgtaatggttcagtggggactcccttcactgatacttactaactgtccaaagtccagttactttaccaatctgttcctcaactgtaaatgactgtaagaataacacccacctcataggttcgttgtgaaaatgaatgtgctaatacatataaataattgagagtagctcttggaaggctcagtaaatgttagcagcagctgctgctgttaaggtaatggttcttttctccagggcctagcacagtgcctgattaaacaaatccaactgaaaggttagataacatgaacgtcaattattgaagagaattgaatgtcttccttgtgaggaagacagaaaggcataaagagctataatgccctttttccaaaagtgaagatggatggggcaaaatctcccagagttttatcctgggtcattgatttgttttccccacggcttgtgtggcccagaaagtaagtcacactaataaaggtcgaaagcagttttcagcctttaaatggaattaaatgaatactattatgacaagttaattagatacccataaaactgctaaacatatgtcattaaaaagtccatgctccaaattttgttaaacatcaattatgatcataagaaatctgcatctagtaaagtggatactgctgacacatgttaattattctggaaaataattgagctctttaaaaattttactatgctattaagcatgtatggcctctgaaaatttgagctattgtgagcttatccaaatgaatctaacaatataaaatgaagtaaaaatgttctttgagttctcttagtatgacaaaaggcaaacacaaattattattttgaagggtccataaaataaacttggtttgaactctaaatgttcaggtaggaaagttgcagagtctcagcaactccagtctgtgttagagtggccacagcaaaatagaataaaacaatgaagagctgttttctttgtccacaagatgacggtacatcacttctcaacagtgcaacagaaggaaggagttttgaaatgcatgcctctaatctatatgcattccaattcttgacagtggtcttgatttatgccaatgtaatgggaaatgttaattcaagtcatcaaattgtttatcataaagaattgctattgctgcccataaattgcttcttatctgggaactcagatgctcaagaaaatcaccagggaattaaaaagatataagaggctggtgagagtgactgcaaattacaggctatatgagggtcggatacctgattcatctcttgagctctttctctgggtgtctctcactgaaccagtgcttttccaagtgtgatcctgaattctgcaccagaatcacttggaatgcctattaaaacagattcctgggtaatgctgggctcactggtggggagaatttcagtacgatttaggtaaactgggcctggaaaatgaaatacttttaagcaaatagcaccaaaattgatgtcagggatgctattaaggaaatagcatcaaaattgttgtgctttctttaattactttcatatttgtattttgaaatgaatataggtaatgggaaattcataatcttggaagacagtgctcattctactctcagtgactattctcttctccctgctgaaatagaaagccttccctgcttgagtgggtctgaacaactaagtcctctggtttcctcccagttcactttctcttgaggttgaccttgcttatcaacacctctagcttctagcgggagtgcactcttgaaatcacaagactacctccaagtgtccaggaaagaccattgacatgatctgaagatccctacccctggatcctacccagtatctcagaagtcagggttgagaatacaaactttagcttactgctacatagttttccaatgtggtcataccatttattctccaggaacagattttgataagggtattcaaagtgtcctatagcatctctagaattcaattcacagtggcttacactcatgtggatagcatactgtttacactgattattataataccaaacagagcatataattcagggtatttattgtctctattacttgtctttttaatttataatcactgataagtctcaatctaagcttcagtgttccttgggagcaatgcctatctggggttgatggtaggagggaaggttgagagctaccagctctgttcagcatctctatcaacccatgggtgtgacttgattattattgcctctgacacattagagtatcattaacataaaagtcatctcttaaacacattaaactgaactcaattaacagaattgattaccagcctaactgtagggattttgcagctttagggaaactgacaaacatcttgcccttttagatcctacaatcacattcacaaagcacggtcaataaacattttgccagctctcaatttatcgtctttaacgaggacaaaaatctctctgggtggatgaactggctgttgataaaagactaattgtggaaatggttttcagtagtggtattgacaaatagaactgagtccttgaaggataaatttgaccatgaattaatggaacctgtcttggatgttaatttgtacaagccctaatagatctttgatttattgcatctcattttctgaagtggaaagcatgactggaaaaatgtatcagtctagatgtataaacctcatggtcctttgaactgtaaccctcaaaatgaataatattctgattcataaataacattaataacgtgtgcattccatttaatgtttaagaactccattaaccttagtttctaagatattccactttttccattgataatctctgtttagaaattatcttctaaaacctgaaggcatttgccaaagtcccatctagctctcaaatttggtgttcttctctctcataaattttactataggtctgttggttttgctatgtggtaatgttgaacaaagataaaagtttactgtgaaaactttgacagagagacaaacaaagagaatgtctcagttgagataaaaagagatctcatttcatttaaattaggcaacatcctcattgtatttcaaggtccgtatgtggaaaatatgtcttatccggaaaggaatgcttatttaataggtatgtgtttttcaggttttgtttttaattttttgagaatgttggtgtatatattagttggtatattataaacaaatcctagttgaataactgatctcagtgctgtttttaatgcaaaagtatttattgttcttggagaagaatcagaaaagaagctgaaatgagatttttcactggaagccaggaagaggggactccccatcagtgccatccaaggggcaggtttgtttcacggcacctactagatttctccatgaaagagtgagatatggtgtgtgagtgactcagagtcctgtcaggaaacaggtggatgtgggcacagataaggaaactagtaagtcacactgaggcaccagggactagcagcagctgggacctgttagcacttcgaggtctcaaaaggaaggagtaagaagaataaataacccatctctctctctctcttcccatcctcattctctcctgccagcacctcccattgttttgcccgagcaggaagccagaacacaaggatcccatgtgatgcaatcataagcgtgaagctctcagggcaccaatgctgctggtggggttgagggcagggagatgagattcagttcacatgtacaaggctcagaacaagagaaacacaagcaaaacccaaaacagaaaagatgtgtaaagttggacagtctaaggaaactgaactctttaggtaagggctagaaataacaatttcaatgcagaaagatcaagagatcacaagttcttaattaaaacaactgttagctcaaacctttgattctgtaatttccttaccagccccttttaacttccatcagaagtttttagttatcaaaaaatgagcctttattatgtaatcacttcttaaaattatttacgtaaagattatagaattatgaaattttcaaagtgtggccaatcaactctccaaaaatatctcttttatcaaaattaattcgtgtttgactcgtgtcttagatcgggatttctgtaacacatattcttgtagtttatatttaccaaaaccatggggttcttttcactttccgagtataaaattataacgtaaattttcaaagaatacatgcggactgggaggacatacaacagccccttaagatggggaggagacctgccgtgtcttcagccctcctcctcaactactgccctaaaatatggatacaatccaatttgatagagacaaactctcaggcctaaaatgattattttaacatgattgataaagactttgctcattgttatcaagcttttgttcaaaaatgtattttcctgcaggtaaaaaaaaaacatatgagtaatcaattaagaagaaaaagcctgcccagccatgcaataattatgttctctgtaaacaatggatgttgacacctgagaaaggtttggggtggttacatttccaatccccaaaggattcaatctatcagagcccaaacaagagcacatgtaagaactatcaaccagtctgtctcttcatcactcaaacctggggctactctgtttcatcccacttgctgtggtaggattaaaccagcaggatggaaatatgccattccccaccagcactctaacttcatttttaggtttctaaaaatgccactgaatatttctgaatgtgagagtggggcttttcaagggctgtggtgagctttgtgatatcaatgactctgtccatcacatttgaatatgtaaaacaccttttgggctcacaccagaagttaggaaccctctggatcatacagaacagaaatccttacattttttttgcttttgtagtcctgtcactaaaaaaagttttgaacatgtactgccccaaatgtgtattaatttattcataatttatatatctgtactactgtaaataatatattatggagaatataaaatatatgttaagaggtgttgaaatgaaggtaaaatatacattttaatcactcaaatattttgctatcactgctgcattaaaaaatcaatattttaaatgataaagtggtcaaggatgctgatttatttttgaacatcttggtttaacatttcattgagtaaaaatgtgaaggtctggttgcaagttcagcttatttctttatttggttttaatcattgtcattggaggaaaaaaagaactgcagaaacatatgaagaggcaaacggacaaagtatggctccaacttgcttactagatcatgaaataccatttttcaatcccatctatgcaagagattttgttgacattcgtctggaaagtttccatctcctttgatgtccgtcagctgttcttacaaaccaaatggaagatattgcctttttattatatttaacaagtgagttcacaatccactgaaatgcttcatttggaagattgttaaacaggttagacaaatccattttcaagttttcaaagactgcagtttttatctatgcatatttgcataattttcaataaaacaatcaaataactgttgttatgtctaaacatctgtttccctacattcagaccacaatccaagtttattttgacaaactaagttgctttctcactctttgctgtatcttctttaccctgaaaagacaactctttcagttcattgtcaccagcaaaccaacaacccctttgtcagacaaaagattttcatagctgctcgactttattttaatcattttgtttcaaaacaaccacactgttgatatctaaagtacttcaattaccctggaagcctcgttttgttctagtcaaagctactactccattgttgtatattttgctatatttcgtgccagtatcataggattctaagaattgtctttttataataagttctggtatcctgtagggctagacaaccatagcatttttcttgtttagagtgttcttttatagcattatgtaaaatttagaattctcattgttgaattttttaaaaaaggactattgaaatatctttattggatggcattaaatttgtaaattaatttggagaaaactaaaattatcacatttattctacccattaaaaagaagcctcatttatttcaaagcctcctaaaattctccaacaagattcttctaaacattttgtgattttaaatttaattgttctggattgtctcggcttttcaagtactatgtaagtttccaagcttgactaaacagttctaaatctttaaatgctcctgacagtgttgtgggaattgactgacagtggcctgtggaattgattagcggaggttaaattcttctgaacccacagtatgcgtatttatgaaggcaaaaagcatgcaattcaccatgttatgtgagctgaaaacacacgatgtgcagttatgtgtgttcatataaaatttaactcatttctagtgaagggatttgatttggctcttttgatcccaaaggacagaggcagtagttccagatgcagagaaggtttaggatcctgattagtgagggttcctggatcttctgtcctgatattgctccacagagtggtctctctccaagtttagtaacttctcttccaactcccatcttcgttccaacaaagatggtttctgttttctcatgtagcacatataaatcttattcctaaactcatgtgtgcgatcgtattatattcctgctggttggcaattcaaatgtaatcatgttgaatattcacaagttctgggaatcttacacagagaagaaatttgagcagggctttatggtttcaacccacattacgtgctcctaagataccctgatccaaatctgtgtgatcccctgaagttcactgactgccgtttcttaggctcagacttaagtcgtggtgccttgccgggcatcccaccaagctgcttctcctgaagttgctgccacctcacaggggtcttctacccttgcttcctcagccaagctgctcagactttcaggaaacaaaagtaggaaagagttataagcagtcaacttttgctttgagccctgataaatacatcacccctaaggcaagagtctgcaaaagacctgtctactttattagacctgggagtggaaaaaacccaatgagaacaaagcgaaaaaatatatattttcaatatattactttaccacacacaatatcatcattttgactcactggaaacctagaactaggttctaaaatgcctcgtgacctctctccgttgtaacctatcaactttaacaatccatactttgctttcttttattcttcctactgaaattcttgctctgaggaactctggtttacatagatgagcacttttggtcaaagctttccatgttaggcccccttccaggccacagcagggattacgaattttgcagccctactgtgcccaagcccaaatccagtcagggatgtgggaagatgctgaagaatagactgtggggttcctgtggctgccatgccaccaaggataataaggggagaagtttcctttggaggtgtctgtggtgtttgtccaatgtaacatacttagtcatgaatgacatggggaatgaagttggtggagaaaatccttttgacatgtggaacttcagggtatttattaataaatactattttaagcactatttacagactagatgcatgagcttttggtacataccaaacatcccccaaattcagtgtcataaaaccatcatcatgtcttatcccttattcaggtagctgatctaggcttgggggctgggcagctctgctatacttagcttctcactgaggtgcaggctctggtcattctagagaacaggctgaaagggcagcagctaccttgagaaggccttcttgtgacgctggtgggcagtaagaacagatgcccaaacaaactagcattttttacttgacacgtctgggctccatcatgggacatgcttagggcaataggatgttagcagagccaaggggcagagaaacatgtactgtgtatagtgggaaggtactggaaaggaatgtggcatctggtggcaaatcatgacctagggagcaaatcaagactaagtcagtctaccacacagaccagtgctaccaagataagagcatatattgatgcttggtcctctcttgtaatcatagctggtcatccctgaaacctaacaccaacgatgacctcaagcataccttaggcacaaaaatgtttatactccataagtagttatacctatctgtgatccagtcttaactacccaggtagcctacctgccattatcttcccagattctttaacctccgcaccaaaggtaacggcttctaaatttggattttccttccagaatccttccactcagcacatattttgaaaaggactttgctggctttaatgagtgcatcaaaaactggaatgacttcaggttttcacacagcatgctttctactagtcaaagcaattatttgtgacacattgggtgtatcagtgttttatttctgctgagaaagaagggctccaagagttcaaggaaagccctttccttttgttatggggagttaggcagcaggatttctgtcattccttttgaaatgaaatctgtcagaaacaggaagattgctcactttatcttgatggacatattttccatttcaattaatatactctgtattttttgggtcacagattcctggcctatctgtgtgttttttagagaaagttggggacagaggatggaggtttgaatagctcatcagttgtatacttctagtctcagcatcagaattcactgacgcacgttcagcaggtaaaaaaaaaatgttgctttttcagctcattaaacaaggactcaagtgtctttattaaaaaaaaatattgcaagtacagggccaaaaactgcttgccttgttacagagggtcaaatgatgtttcatggggaacatgctagtaggcttgcattcttactggaaaagagacgggggttgattatttttaggtaatttattctgaaaacacaacctgttgagagagaagatgagaatgccattggaaggttatcctcaacatgcaagcaaaacaaaaataataaaaaaatcattagcaaagatgacaacactagaccaagcagtgaccacacagtacatatttggttgtgtttcaagccttatttgggtagaggaaaaaaaaaaaaaaccaatgaagaaatataggccaatgtaagactctgttgacacagagaatggcagcatctgaggttgaaaggacgtatgcctgtatcgcccctaattatagaacatcatcagtgcttcttatttccctcaagactcaggcttgcccccggcactatgttcaatggtcacttaatggtctagaaacatggttgagaaaaaacatattaacagcaatccagtcaccagagcacctggattttctcctaccttcttttattctttcgtgttctggtacagtcttgccttgtgtatatcaatgtatgtttgtatttattgtgtcattgcatttgataggatttttcaaattgaaagcctcagagcttacgtaggatttgtgaggcattttactaagaaagttgggctgcaagtattttaaatgttattgagtttattttcaaattttaagactgactgagttcataatgtctgaaacggactcctttctattcattgatctccagagaagaaaataacaatcaatactttgtttttaacttttattttaagttcaagggtacatgtgtaggtttgttacataggaaaacttacgtcatgagggtttgttgcacagattatttcatcacccaggtattaagcctagtacccattagttgtttttcctgatcctctccctcctcccacccttcaccctcaagtaggcccccgtgtgtgtcgttcccctctatgtgtccatgtgttctcatcatttagctcccacttataagtgagaccattccagccaatgctttttgagtgcttactatgtgcttacattttgctgagtgctttatgtttattcattcagttttcacaagtatcttatgaacttgttatgatcattgtcaccattttacagataagaaaactgaaatatagagtgatggagtaatttgtgcaggtcacgtcaataagaagtaggggagccaggacttgaattcaggcagtctggctccaaagtctctcaccaaacgatcatatcagttctcacgttcacactgcacctgggcatttatttgtttcttgtacaaactagaaagtgtcacctacttgaagagacaaatgtctcccataatgtggacacatcaggacacgagaactgcatgctcataggcaacatgctcataggtatctcctcactgggaacgtctgctgtgtgcaggaaaatggttccagagtagaagtcccactcctggtctatcagggtggcctccaaatatattaaaagcacaacaatttctgcggcttctgccactctcaccctggtccaagccaccgccatcaggggttgatgtaatggcccctgaaatgcttctaccagtaccctctcctgtcatcagcagggcagctggatcacatgtctacttgttccactcagaacaaaagacaaagtctttccaagagcctgtgtgatctgtgtccctccttcccatcacttctttactcctcaccaccctgcctgcaaccccacatccttatctgcgccactagccttcagattgttcctgggcaggttcacgtcaggcacgttatgcctcaggacctttgtgcttcatggtccctgtgttggaagtgctccccccgaaacgtttcctgttccctgctgatcattacagcaccttcacccacccactccacccactcagctctctatccttcctccctgccttatttttctccctagtgtttataatgactggctcttccatctattttactaatgtgttagtttcttctttgtcgctgaacactagcgtgaacactttcttttttgtctgctttctttcccagtgcaatcccagaaatgagaatccagtgggcgttttacgaattgactaaatgaacaaatgagtgcattgtggagttgttttggagaattaagtaaactagcatatggaaagcatttggaacaaacaatgcttagcatgaaattaatgtttaataaatgtcaggtatcaataaaagaataacataatagttattgaatgaatgatgcattagatactattacttgttcctgtggtaggaagagggtaatcaagctccagaagttttaagtatgttaacgtacatttacaatggttgctagaggagataatcagggacatcatttgtgtcctcttttcctattgtctggagggcgtactataatccatccttctctaggcaagagagtggctctcaaacttcattggacttgggaatcacctgcagagttttaaaaaattgatcctggttcccatcccagatattctgatatggttagtccggagtgtaactcgggcattaggagttttgaaatgctccctgagtgattctaatgtgcagcaaagtttgggaatcactgccttaagcttttcacagagctaacagcagcagaaggaaaagccttcctcagtccctctctatgcttggaaccgagagttgcaccaacctcggttctaaaacacgtgtgaccattagcaagtcacctagcttcagcaagctttaccttcctcaattttatgtctgctgtggaaaatggtgaaaactcagaattcagggccaggttccaaaaatgtgaattttccttcttccctctctcccttcctttcattcttccttcctccctcccttcttttcttctttctgtcccctctttcatctggaggtaaaaggacagaattgttttcagatgtggctcaaaaatggcttgctctgaaatggtgctttcttacagaggggaccagagaaccaaagtgtccaccatgcctagctggccccattcttccccaggcatacccagccatgcctgtttcagcttcaggagggatcaatgtctgaaggtcaagttcccacccattggggtccactgtgggagtatcagaggtcctactagtgtcctgggttccagccctggcctccccacttcttccctgtgtcttagtgcctcccagcctggggccttgtctgaggctcctaccctggtcactggggctcacactgcattggttttgctggctcactcagggtctggaattctgtcctctgacacccaggcctctccgtctgatctcctgcccacctgagttctgcccacctctcttcatccatcccaagcatataccatatcatggtagctgcgtctaatctctgggtcccgaaaaacacctgcacccaccctatagtgccaccaatctcagcctggacttttctattaatagaatggtggtgagacactggggatagcacaatactggggccagcatcacgggtgtgtgacccattcagtgacacaggaccctgggctgggtttcatgttctgctgtcttgaaattagtcatgtttgaatgagaggctccacattttcattttgcactgtttctgcaaattatctaatgtgccccacacttcaaatcagaagacctggtatggattgcacctggcttacacctgagaaaagcgtgaccttggccaagttatttttcctatcttggcatttgcaaagaaggaatgagtggggtaaaactgtctccatcgtaggggaattttaagaatgaaataaggtaacagatgagtgttagcacatggtgcacaacatgttagttctcaactaacacttctctttttcctactgttccacctcccaagaagctaagtcgaaaagacacttcctttctgtttaaaatggattttaaatgtttgttttcctagatagtgatatatacctaaaggaaagatcttaggagttgtcattgatcttacctcattcttattaattatgcagaaagacaacaggattccttctttgctatctttctttattacattgaacaatatgttgtccagatggcatatagagtagcatcttccaagatatttttaaatgatcttcttttacttattgaagaagattacagggagagaaatttgaattaaacccgtgtcattgaaataatcttagcttacattacattaaggagatttctattattcagactaataacttttccccaaaagaaggctgccttgaacaatgtgcatgagtgaagacttcatcaagagtcatgggagtgagtctttggcccaaccctctggcataccagccatgggcccttagtgacaataaactagtattttgatctcagttttcttattggtaaaatccacaaaataataccagttctgccctctcattctcaatttgtgtatcaaattaggtatttgtggaagtattttgaaaatttttgaatgctatacaaattttgagttgggattattgataagacttctgaagtttaggtgttaatgaaaagattcatttgaaccacttgaaaatctttccggagaacaaatgccaagagttaagttctcaacttctttggaaatggagatgtgtttgacaacaggatagtgtgtcaccaccaaaataatccacttcaattttactgcggccagaagccataggtattaccttctaaatgtctgaaaccctctgaggctgtttctaagcatatcagttataacttaacagcttttcacaaagaaatctctttttctctacttattaattcaagtactaattgagaatgtactatgtgccagatacagttctaggcacctgagataaatcagtgaataaaaccaagttccttgccctcatagagtgtatgttccagtgtatagagcaaaacaacaaaaataaccataaaattaagtatactgttgacccttgaacaacatggggcttggggcgccaaccccacatgcagtcaaaaatccacgtataactttggatgccctcaaaactcaattactgatagcatactgttgaccagaagtcttaccaataacataacagttgattaacatatattttgtatgttatatgcattatactcatatactgtattcttacaataaagttagagaaaacaaaatgttattaagaaagtcatagggaagagaaaatatatttattaatcattaagtagaagtagatcatcataaagttctccatcctcattgtctttacattgagtaagttaagaaggggaaggaacaacaggggatggtcttgctgtctcaggggtggcagaggaggaagaaaatctatgtataagtggacctgtgcagttcaaacctgtgttgttcaagagccaactgcattctacagcacgttagcatgtgattagtgctgtggggaacaaagaagtagaagggcataaaggggatcaggcatgttggggagcagggttgcatttttaaaatgtatggccaggacagtcctcttcaaggtcatatgtgagcacaagcttgagcgaggtgaggctgggccatatgcatatctgcaggataggcattccaggttcgaggaacagccaatgcaaaagcctgaagcaaaactggcccaagtaggccacgaaagaagcatgactatgggtctccccagatctttctcactctctaccaaaaaacaggttttgaaattaaagagaatatgattgccaggccaatgcctaagacatacattgatgccttgtttctcttgtatgtgctttctccacagtcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtaagcacccaatcccagttcttggtttcctgggaatgtctgccacactctgccagaataactactgttcagtttcataagtgtccaggctgtgaaagctggatatgtttttccaaaacctggatagagtcacttcaccagaggaacagaaatgcttcctcaaactaggttttaaactgccaaatccatcattatcaccagactcaggaaaatactgagccatcatctataaccatggaaatgaatcacttcttaacttatgaatgcagacaagaagaggcaggccctgtactgtattacagtaagcccatgatgaattccttagtgaaaaaaaggaggaagtggttacagtaggatttagtcataggggtagttggattatttcacaagtatgcactcccctcccttctcattagaggcaaaataaagggaaaaccatactccattgctgttgggctggatcaggtgattgacaatggccaacggcatattagcaaagatgacataagcaaaggcttgagacgtgcttgtgcaattgagcttgtttcctgagcttctgccatggctataagaagagagtttttggctgggtgcagtggctcacgccataatcccagcactttgagaggccaaggctggtgggtcacttgaagccaggagtttgagaccagcctggccaacatggcaaaaccccatctctactaaaaagacaaaaaattagccaggtgtggtggcgcttgcctgaagtcccagctactcgggagactgaggcatgagaatcgcttgaacccaggagggagaggttgcagtgagctgagattgtgctactgcactccagcctgggcaacagagtgagaccctgtctcaaaaaaaaaaaaaaagagttttccccaggtagctgtgatctcttccatatgagccccataatgaacacacgaggcagcaagcctgcagtggggagccaagtacagcctcatctgcagtttggtacacaactgtccagctaagcctagctgaaatcagccagcctgtggttatcctaaagacccataagcatgagaagaaatgatcattggtcacctgttgagcttgggggtgatttgttatccagcagatgctgactaatacagtatatgtcaaatctttaaaattctacaatatgattagataattaatgtactttccctcaatcttcgtattacagtatacagatgttccgctgtcaacacagctgaatacagtggactatgatgcaatcgcctgaagtgggctgcctttacctttccagaaacaatgtgcttttattatttatttattatatatgtatttatatgcttactgtaatggactcatattggatttattttcagaaaaaaaggggaattatcttccatgccctttcttcataggattttgcaaatcagtaacaggattcagcagtaaagtactacacttaggagcacagactctggcatcagactgcctgaatctgactcctacctctgcccctttttagactttttagcttccatgttaaattccctgcatttcagtttgatgtaacttctctacatcttctgtataatggggatcagagtagtatctaccttgtagggctatggaaaggatgcaataaattagaagagtgccaggcacatcctggtcattccatagatgtttacttttattgttattgttatttaactctaaaatgtttggccagttgagtgtctcaattaagggaaacgaaactcaagtagcgtcctggtatagattttaaaatttggtttcatttttcgtttttcattattttgacataatatgccccagggcaagcaccacaaataattaaccactttagacttgtgctatctgctaaacttttttatttcattaaatgtagatcatattttagttctctgtgtaagattgttgagctcgacacaattgagaattctcaaaacagatctgttgcttcttatgataacatgctttgtaaaaaaaaaaaatagaaacaatgtagatagtatagaggagaaagtaaaaaaaaaaatcacctaaattcctactaccaagatatagccattattgatgtagacagcaataatatgtatagtagatataattccgtgcatacacaaacacacatatgtaatacatatgagatcatatattttacacatacataatacatatatatagatgtatgtatgtatatgcagacacattttttcctaaatggaataatatttggcatgctgttttataatattgggataatctaacatctctgattatgagattctccgaagtatgtgtcttcccaggagctgaatgaagattcaagtcttattttttattttttggtatcatctcactgtttctacaacctctctccttcctggccctcaattctccttagcttcaaagacactaatacctactcttacacaattttgagaagagtagaaaaaaggtaaaaacaaaggtcaaagagtactatttccagttattgttatgagtgaaaacattggtcaaacaagctgtgtctatcataaaaatgactctacagaagtcccaagtgatttcagtgcgtgactagattttctgtagtaggcaatccagacttcaaagtaaaggccatgagacagttctcttgaagtgtgccactgttttgtattttggatgggacagtgtgtctcttctccagaattcttgattaaagttgcttgattagacaagaatagtttcatttgatcaaaaagcatgggtcaaatataagagtatgttaatctgagagtggttttcttattagaatagttaacattcgtccttcagttactttgaaagtttttctgtatttgatcagcgtttgattgctacccatttgtttgactgaatttgagtgattacttgcacataatacttataataagtttcccaagtggtttttctgagttccttatgtgtgcaaacactgaatcccacatctgtaaaatgaatattttgtatcagtaatataaggacatgttaagtttctcctactctcttacttcccggaaggaagacaaatttatgctacagcttgaatgacacatatgcctcgtatctgggtgggtagagaacaactgaattactttcagttccatgttctgggtatgaagtgttcatttcaattactaaatgaagtaatagcaataatatttgaaagatagcgtttcagctgcaactatcacccagagtcagacctgtggaaatatagttaaaattatagtaccatatgctaccgtatcaatatttgggaggtaattgcacatgtctagagcttaattcaggtaattgtttttatatcttacttaaatatagatgtatgcttcactcagatgtggttttaagtttatgtgtcaagaaacctggcagtgactaggttctgaattataggaacaaattcaaaagggacattcaccattctgaacttggaagagtccaagctaagatctagtccgtccttcaagtcaattctttaacctgtgtaagcctcaattatctcattatatggaaggcattatagtattcagtgaagttactaggccaagaatttaacccattgcctggtgcataataaatgctgaacaaatattagtttcctactcccttcttggaaacaacggaaagagaaaagggccaggcacagtggctcaagcctgtaatcccagcattttgggaggctgaggtgggaggattgcttgagcccaggattttgagaccagcctgggcaacacagtgagatcttgtctctacaaaaagtaaacagggccgggtgtaggggctcacgcctgtaatcccagcactttgggaggctgaggcgggtggatcacgaggtcaggagatcgaaaccatcctggctaacacggtgaaaccccgtctctactaaaaatacaaaaaattagctgggcatggtggcgggcgcctgtagtcccagcttctggggaggctgaggcaggagaatggcatcaacccgggaggcagagcttgcagtgagccgagatcgtgccactgcactccagcctgggcgacagagcaagactccatctcaaaataaataaataaacaaacaaacaaacaaaattagccgggtgagtggtgtgtgcccatggtcccagctactcagcaggctgaggtgggagggttgctggagggatgcacatggagctgtgagggaggaaggggacacctgcctagccagccagatcagctgaatcaaccctggcgatcaatggggcaacagatgacacagccagatcaccttcacatccgaacacccttttactgagatatcttacgattccccacagtatgctgtctccctacttgtaataagtacataaatgcacctttgtttgaatccagctgtgccgaattgttgcagctttggccacagggtatcaacacaactgattggctacctgttgagagaatagctccttctaggggcctcaccacacacacacacacacaatatggcctgttgaccagcagcatcagcagcacctgggagcttgtgagaactgcattatctcaccccgcacccccgcatggtaacaagatccccaggtgattcaccataaagtgtgagaagcactgctagactgagtctcgaccttgcttgcaaagttttagaaaaatgtggatgcctgggtcccatcccgaaagattctgatttaactggtcagggtaaagcctgggcctcagaattgtccaaagaacacccaagtgtggttgggtttcggttttgctgatagcaccatttgctcacagtgaatcatgatcaggagaggaggcttgggataggttgctaatggtcttctcacctgtgcttcattctatttgtctccaggtggcccctctgaaggcaagctgatcccgggagatcagattgtaatgattaatgatgaaccggtcagcgctgcacccagagagcgggtcatcgatctggtcaggtgagtgactcattcacctgtgtcctgttctgctttgaaggctgctgcacagctctgaggtctcaattagcagaggaagagcctcctgtgggacaatttaggatggaaatgcaagccaacacatacacatggttgaaaatgctgctgacactgacctgtaatatcaaaacacatactccataaacacaaaactcctaattgtccactctctgttaacattgaaggtacatatgcctcagtttaaaatttttatgactcctatatccaaaggttcattttttccttccagaattactaacacattgatttttcataatcagggagatcaaaacacaatacctgaattcagcacaaagtgatgagtaattttatatacataatcccatggatatacaaacatacagttcactgatacttcatatttgactaagtgcttcattactgaaatttgagattatcaactgtggcaataggataattaggtcaaagctaagagtttacaaaatacaagtggtttattggtttagttttattgtaaatataagtagtttgttatgtgatattcttaatggggcaccagaaaatgtattttatgttatgttaaaaaatattggtcaagaatccctttagaagcccactggagttatacctccttagtgaatttaagggaaaagagttctttagaagttttttaaatgaagaagctgggcctatcatatgaatggatccattcattctatgggagtgttgaggaataaggagacatgacatttgtcttttataaactcatattttcaaccaagattgaagccaaagctgaggttatcagaacacttttcactgaagaggggatttcctaacatttatgctcactcattacggaaagtgttaggttggtgcaacagtaattgctgtttttgccattgaaagtaatggcaaaaacttcaattacttttgcaccaacctaatacatctgtactttgggaaaggcactaagtggagtatttctggggtctttcagagaaagtttctttctcaagcctagttcagcttttgcttcacaaagaggttctggagggtcaagcactcttggaagaactgggagaggagcaaaaagagaaatagaaagagaaggcacttaagagtaagcaaccatcctagttttagcatgtaaaaggcccatgtcccagggaaactctggaatggttggtcactgctatggtctgaatgttagtgccccctcaaaattgttatgttggaacctgatacccagtgtgattgtattaataggtggggcctttagggaagtgattaagtcatgaggtctctgcatcgtgaatgggattagtatccttataaaaagttgaagagaattgccttgctccttctcccatgtaaagacacagtgacaaagtactgtctttgaggaatgtggcctttaccaaacaccaaatctactggaagatcttggacttcactgcctccagaactgtgagaaataaatttcaattattcacaaattacccagtctaaggtactttgttgtagcagctcaaacagactaagacagtcactctacttcagtctgggcttaatggagtcttcccagatggctagaaaagtcatacttgtactcctggggcatccagatctccaaggaatggtcttacacaggagcagacactgagacttgtgtcatattcactatgcatcgggaacaagacctgagaatgtctccaatctttctatggacaaggggagccagaatatagaaagactctgtatgtaagagcccttgggaaggagctgcagtgttcatctggaataacttctctcttgagatgtgtgtgggtgtcagcaggggcataccttatctaggcaggctctgagccttctatcggcttgcatcctggaatgccatgtttgggcttgatggcagaagttgcatggatgttttgttttcccctaggtgcgcacctctgtgattagtcctattgatttttgtgcctggaggatgatagaagaaataaaatatctgtgtttaggttggctgtgacttaattgcctgctgcagggcagtgacagagaaaaacctatctgaaagtgtgatcacttcctagcagttgttccagggacttttagaaagattatttccaagaaagatattttatttctggtttaacgcttgtagaagaaaatggcatatctgtaaaaaaagcgctctctatagaactttacatataacaaaatgaaccagttaaaagagaggatggcaaacagctccaagttcaaatccagcctgccacgtgtttttgtaaagtccatcagctaagaaaggtaggtttttttatacgattttttaaaagttgaaaaaatatattttgtgacacatggaaatcatataaaattcagattttagtatccataaatattttgctgggtatagccatgtttgctcatttgcattttatctatgtctgctttcctgctacaataacagagttgagtagttgcaacagaaactgtctggctcacaaccttttcactcttactaaaccacaatgttaaaataatgtatgtctcactaatgaaaatgatcacacattacaaaatattcctgtgccttcccataagtttagtcatctgtctgccataatgtgtactaacctaaacacttagctcttgtaaaataatcccctttttactgggctcctcagctgatatatgttttaaggtctatatcttacacaagataaattccctttctgtataataaaaaacatcccgttttcttagccactaaggaaatttggaaaaacactcatcattttgataacactgtaaaattctctctttaaaaattggcatccatttgctggctttagtggtgtagtcttgttttgttccttttcccccattgcagcatgtgttcatggatcattttttgttcccagatccatttgtgtttcttggtggattatttttcttatcatttagttactctattatggaaaattatttttttcttgagaaaatgaaagagttttgcagagaccaatttactgctatactaacaacattttggttttttcatgtagtctcaaaaagctataattgctgcactgaaattagatgaattctgttcacttcatagtcttctaagttgttaactctaactcagactgtataatggtgtttgaggactaaaatctttgaagaatccatgccctttacaaattaccatatctttcttctttaaaagtatctaaggataattttcttttcacaattagactaattaactgaaagcagtctccaaaattttatttttaaaaagtaaggagtattattgcccatagaaacattatgaattgtgccttgccttcccactcccacggctagccagcccaattaaattcatttgacttcaacaaagaattattgaggattaacagacatcatataaggcactgagcatgtatagatacgtaggcatgattcttgccctcaaggagaagaattctaattaatttccatatatttatgactggacaatgctgttggcgagggtagtatttggtaggaatgtttggtggagatggatggtgtattaagggatattattgatgctggtaaagagtagccatcaacgcgaagtggaagggcaggtttatgcatgagaagggagttgtaaagtagatctttcctttgaccctagaaaccccagaccttcttgatggacactcactttccaacctgcagatattgaaaaaaaaaccattgcctaggtggctgtcccgaatcacaacctcaaaatttggtccttcaaggcagcaacataaatctactaactcctgttagaatgggtgcactagattttttggattagagatgcaactgggaacctgataaatgccatagacttttccctccatccagagaaacccacgtgtatacaaagttctgcatacaatattagaatggtttttgactccctaaagttagtcccagttttagagccggggcagcagactctaagaatgctgtctctcttcctccccttctcccccttcctcagtaccagatgctaacattgaagagtcaagcttataaacaacttgctcttatccttttctatcaaagcagttgaagtggaaaattgcccatcccataataagaaggtacactggtcaaactggagactaattcccctttctcccaacatctgtaatagggcagctaactatccctccatctgcccttctcccactatttatgttgattattcctactaatctaattgatgagcagtgttatagttatggctatttatctacagagggttgctcacatctgtcagacatgtcaccccttctatactaataccctgggaattggagagctttcctgggtagcggtagtgttctttcaataagaaagtaactgtaataagaaataagaataaatgataggggagtgacattaacaaggtggcaaaatgaggtcccccactggtatcccccatagcaactataatttggcagccacctatggacaaaagtggctttgtgggagttttggaatccaagtaggtcactaaaccctggtggagcccaagactgaggagggccattttgagaaggcagacccacccaggccttggtggcagactcactgactatgatcccaaatacagacccagaaacaaccacatccccccgtggagttggctacagccctgtttggccttagtcctaccactggcattatccatcaagggacccgggaagagtcatacctaccttggccttgggtaacagatctgctgaccttggccccagttgtggaccctagagtggcttgtgaccaagctccagcctctctcagccattgtctgcgagcagtcccacctgtcctgggacctgctgggaaataggccagttcatacccccagaggtaggcctaatgaacttagttccacagattttgaaacagccccataattcagctccagcctctctcagccataatctaggagcagtcgtgcccacccagggacaccctgtgtcccctcaggcaggcctactgacctccatctgaatgtggatcctgaagtggccccataacctggccctagctcctctcagccatggtcagggagacaggcttctctgtgccctagaggcagacttgccaaccttgatccaactgcagatcctgaaacagccctgaaactcaattccagccactctcatctggtattcaggagcagtcctgattccccgactccacctagggacctgttgagtgacatgcccatttgtgccaccacaggcaggcctgctagccttggtccaactacagatcttaaagcaacactgtgatccagctccagccctgcacagccacagtccttcccacccaggaaaccacgaggaagcatgtccatctgtgtccccagaagcaggcctgcggatcttgatcttgactgtggaccctgaagtagccctatgactcatttccagcccctctcaaccacagtccaggaccagttatgcttactcagaaacctacccaatggtccagcaataaccctcccagggatcaggtggaagctacaatgatctgtgtacctagtaacaggccgatgatctgtggaaccttgtcccagcatcagcccaattaatgaagatcctagaagcattccagtccactcaggaatgagataggatccatgctctcccaaggctctggaaataggcctaccccccattgcaagaccccattgcagatctagcagtagtcacatgatctagctctactgtaattgcagaggcaatctcatcagtcaacaagagaaggtctttacctgctgaaaccagtctataaagaccagtctgtaaaaactggaaatctagcagaccccattgcaaatacagcagtagtcacatgatctggctccactacaattgcagaggcaatctcataaatcaacaagataaggtatttactagctgaaaccagtctataaagaccagcctataaagactggaagagggccgggtgcagtgactcaagtttgtaatcccagtactttgggaggccgaggtgggtggatcacttgaggttaggagtttgagatcagcctggtcaacatggtgacatccagtctctactaaaaatacaaaaagaaaaaaaaatagcctgctgtggtggtgtgtgactgtagtcccagctacgccggaggctgagatgggaggatcgcttgaacccaggaggcagaggttgcaatgagccacgatcacaccagtggactccagcctgggcaacagagcaagactctgtctaaaaaaaagaaaacaaaacaaacaaacaaaaaaaacgactgaaagagatgtttgccctctcaaatgcacagataccaactcaaggctacatgaatcacgaagaatcaagcaaacatgacaccacaaaaggaaactattaaggcttcaataagcagcccctaagatatatcatttgagatatataaattacatgaaaaataatacaaaataatcaccttaatgaagctcagtgggatacaagagaacacagaccaccaagaaaaacaaaaagcaatacataaacaaaataaaaagtttaataaagaaatacaggtcaggcgtggtgattcacatttgtaattccagcactttgggaggccaaggcaggcagatggctttgagcccaaaagttcaagactagcctgggcaacatggcaaaaccccatctctacaaaaattagccagatgtggtggcccgaatctgtagtcccagcaacttgggaggctgaggtgggaggatgacttgagcccaggaggcagaggtttcagtgagccaagatcacaccactgcactgtagcctgggcaacatagccagaccctgtttcaaaaaaagaaaagaaaagaaaggaaaaaggaaaggaagtaataaggaaaggaaaaaggaaaggaagggaagggaagtgaagggaagggaagtgaagggaagggaaaggaagggagaaagaaagaaagaaagagagagagagagaaagaaagaaagagaaagaaagaaagaaagaaagaaagaaagaaagaaagaaagaaagaaaggaaggaaggaaggaaggaaggaaggaaggaaggaaggaaggaaagaaggaaagaaagaaggaaagaagaagaaaagaggagaagagaggagaggaaaggagaggagaggagaggagaggtgaactataaaaagaaccaaacagaaatcctggagctaaagaatacaatgacaaaactaaacattttaatagcttcaacagcagactcaattatgcagaagaatcagcaaatgtgaagacaggctatttgaaattacccagttagaggaacagaaagtaaaaagaataaaaaagagtaaaggaagcatacaggtcctatgagataccatcaattgaatgaatatatgcattatgggaatattagaaggagaaaaggaaaaaaggggaaaaagcttatttaaagaaataatggctgaaacgtcctaaatcttggaagggatatggacatccagatttatacaaatcaaagggtctcaagcagaatcaatccaaagactactctaagacacattataaccaaatttttaaaagccaaacacagacatagaatattgcccctaagagatatcatttgagatatataaattacatgaaaaataatacaaaataatcaccttaatgaagctcagtgggatacaagagaacacagaccaccaagaaaaacaaaaagcaatacataaacaaaataaaaagtttaataaagaaatacaggtcaggcgtggtgattcacatttgtaattccagcactttgggaggccaaggcaggcagatggctttgagcccaaaagttcaagactagcctgggcaacatggcaaaaccccatctctacaaaaattagccagatgtggtggcccgaatctgtagtcccagcaacttgggaggctgaggtgggaggatgacttgagcccaggaggcagaggtttcagtgagccaagatcacaccactgcactgtagcctgggcaacatagccagaccctgtttcaaaaaaagaaaagaaaagaaaggaaaaaggaaaggaagtaataaggaaaggaaaaaggaaaggaagggaagggaagtgaagggaagggaagtgaagggaagggaaaggaagggaggaagaaagaaagaaagagagagagagagaaagaaagaaagagaaagaaagaaagaaagaaagaaagaaagaaagaaagaaagaaagaaaggaaggaaggaaggaaggaaggaaggaaggaaggaaggaaagaaggaaagaaagaaggaaagaagaagaaaagaggagaagagaggagaggaaaggagaggagaggagaggagaggtgaactataaaaagaaccaaacagaaatcctggagctaaagaatacaatgacaaaactaaacattttaatagcttcaacagcagactcaattatgcagaagaatcagcaaatgtgaagacaggctatttgaaattacccagttagaggaacagaaagtaaaaagaataaaaaagagtaaaggaagcatacaggtcctatgagataccatcaattgaatgaatatatgcattatgggaatattagaaggagaaaaggaaaaaaggggaaaaagcttatttaaagaaataatggctgaaacgtcctaaatcttggaagggatatggacatccagatttatacaaatcaaagggtctcaagcagaatcaatccaaagactactctaagacacattataaccaaatttttaaaagccaaacacagacatagaatattgaaagcagcaagagaaaagcaacttgtcacatgcaagaaaacccttataaaactatcagtggattgctcatcagaaaccttgcaggccaggaatggatgatatattcaaaatgctaggaagaaccgccaaccaagaatacttagccaggggcagtgacacccacctgtagtctcagctatttgggaggctgaggctagaggatcacttgaacccaggagtttaagaccagcctgggcaacacagtgcgatcccatctcaaaaagagaatactatacacaacaaagctgtccttcagaaatgaaagagacggaaagatattcctagacaaaagctgagggagttcattgccagtatatctgccttagaagaaatgctacagtgagttcttcaggttgaaatgaaaggatgctaagtaactacctgaaaacatgaaagtataaatctcactggtaagggaactacatagttaaattcagagtactctaatactgtaatggtagtgtataaatcacttttaactacagtatgaaagtcgaaagacaaaagtattaaaaaataactacagctacaacttgttaatgaaaatacaacatgtaaagtattacatcaataacatataatttgggggcagggagagttagacgtgtagagttttgtatacaattgaaattaggttgttatcagcttaaaattaactattataactataaggtgttttatgtaggcctcatggtaaccacaaagaaaaaactattagtagatacacaaaagataaggagaaaggaatcaaagtatatcattacaaaatattaacaaatcacagaagaatacagcaagagaggaatgaagtgacaaaggcactacaaaacagcctgaaaacaattaacaaaataataatagtcaaacaatagttagtttgttcaatagttagtttgacaatactccaacctttgtataataggaatcgcagaaggagaagaaagagaaaaggggccagaaagtatatctttaaaaataatggctgacaaatgagattacatcaagctaacatcttctgcacagcaaaggaaacaatcaacaaggtaaaaagacaactcataggatgggagaaaatatttgcaaactattcatctgacaagggattaataataataatatataaggaacacaaacagctcaataggaaaaaaaagaataatccaattaaaagtgggcaaaagatctgaatagacatttatcaaaagaaggcatagaaatgaccaacaggtatataaaaaatgctcaacatcactaatcaccagagaaatacaaatcagaaccacagtgagatgtcatctcaccacagttaaaatggcttttattaaaagacaggcaataacaaatgctggagaggatgttgagaaaggggaaccctcataccatcactgttggtgggaatgtaaattagtacagctactagggaacacaatatggaggttcctcaaaaaactaaaaatagaactaccatattatccagcaatatcactactagatacatattcaaaataaaggaaatcaatctatcaaagagatatctgcactctcgtgtttattgcagcactattcacaatagccaaaatatggaatcaacctaagtgttcatcaatggatgaatggataaagaaaatgaatgtagtatatatacacggtagaatattatccagcaataaaaaaaaatcctttatttgcagcaacatggatgaaactccagttcattatgttaagtgaaataagccagacacagaaaaacaaatattgcatgtttttattaatatgtgggagctaaaaaactggatatcaggaagatggagagtacattgatagttaccagtggctgagaagggtgcagggaagggagggataaagagaagttgattaatgggtacaaaaatacagttagatgaataaataagacctagtgttttatagatcagcagaatgactacagttaacagtaatctattgtatatttcaaaatagctaaaagagaattactcaagtgttcccagtataaagaaaagttaaatgtttaagatgacagatatcccaattaccctgatttgatcattacacattatacgaatatatcaaaatattacatgcacccccaaaatacacacatctcttatgtatcaataaaaaaagtttattaaaaaataataatagtggaaaacttttctaatctggggatagatagcaacacttagatacagggagcgtatggatttccaaatcaaatttaatccaaaggctgggcatggtgactcacacctgtaatcctagcatttttgggaggccaaagtgggaggatcacttgaggccaagagtttaagaccagcctggtcaacatagtgagacctggtctctacaaaaaaattttaaaaattagccaggcatggtggtacacacctgtagttccagctactcgagaggctgaggcaggagaatcacttgagcccaggagttgaggctgcagtgagctatgatggcaccactgcacagcctgggtgacaaagtgagatcctgtctcaaaaaaaaaaaaaaatcaatccaaagaggagtacaccaagacatatattaatcaaactaccaaaaatcaaagacaaagaaaaaattctgaaagcagcaagaaactagaaacacaccatattaaaaggagagccaatacaactatcagcagatttctcagcagaaaccctacaaaccaggacctagtggtccaaagtgggccaagtctaaccatgtggcacattaagtttttcttacttggggggcccagcaaatgacagagctgtaactggcctttagaacctgagtcttatcttgtatgccccatagacacactcccttttttggattatacacaagtagtctgtctcctatcccaggactgctaagcagttgccttgattttagtagggagttgtcaggagtacctgcttattgcagtcgatgggagattggcaagactattcagagcaaaataggccatttagaagggatccatccaaaaattagatcctagcacacctgtcttttcatcagtcccacctcatcagaattataatggaaagtcaaatcagatcatgttccaggggcattctgtctgcagaagagtatattagaaaggtcatcttcctgcctaatgttagatggacttaggtgcaccatgatgctgcttagtaaaataacaaagcagggccgggcatggtggctcacgcctgtaatcccagcactttgggaggccaaggcaggcagatcatctgaggtcaggagttccagaccagcctggccaacatagtgaaaccctttctctactaaaaatacaaaaattagccgggcatggtggcgcatgcctgtagtcccagctactcaggaggctgaggcaggagaatcgcttgaacctgagaggtggaggttttagtgagccgagatcacgccattgcactccagcttgggcgacagagacttcatctcaaaaaataataagaataataataacaacaaagcaaagaacatctgccaagtatctgacacataaaatatgcacaatgatgtgtaatataataaggccttattaagaccagcaagcaactccagtgaaaacacaaaagaaacagctctatggtatgctgacactacaaattgtaatctcacctcatacacacttgcagcatacacgttttctgataattgcaaattacagagcctgaggagaaagaggttggtgattctagaaaatggaaagtgtgggaaaacattataacaaggctgaagtagaaaaagggatttgggagcatagttcataaaagctataatgatatataatgacggaaattaataagaaaaatgacttcacccagattatcttaatgtccttagattttgttaatgaccatgtcccacttacttattaagtctcttcactactctagatgcttttatgcaactcatgtatggaaaatgaatgttaaagattgaagaatcagaataaattttaaattagggcatgttttcaatgatctcatatggttgacactactgaatgtcttaacatcttactttattaagaaaaaaatggaaggagataattattgaaccagtgccatgttctgttcttcctttggaactacaaatttgcaagtgattgcctgccttttctataagtagatgaaaagacaaaaaaaaatcattttggtgaggctgtgtattttccctgtggtcagaacatgcccagaaccaaagtataaaccttattgcctagagagaacggagagctgtaggagcttacagcgaaatctatttttacaggtaacacagtgggtgggtgtggtgggcaagaatctcaggccacacactcagatgtgagagaagtgtaacattatctatatattatctataataatctaatatttatttcaaatccctattccagtgtatgatcagttcatcctgttttccttagagctgagtcgacctgtagagggttgttttaatgagaggaggcattgggagatgtgaagtttacccactcctgggtcacatcatctgtcttaccagaacttgctgagatatatttgtacccatttggtctgtctttgactactcacctagaaaggaagccaacatgtcaccccttgttcaccattgtcaaccctcccttagccacttctctgtcatcttgcatgcacttgccactcctgagccattatgggacatagaatagcctctggggctaatttcctccagaatcttgtcaccttcccagggttctgactagaaaagaaggcacaggttgctgtgctctttaattcttcaaggctatctgggggttcccagttggttcttcctggagaatcagcttctgaaaagacagggagcatgcctgccctttcacaggcaactacaagtctggacccgttgcttgtcctgtagttcaccccattttccccatcctcagactaatccccattctggggaggactaagctttactctggtttatgtaataaccatctgtattagtccgtcttcacactcctaataaagccatacctgagactgggcagtttataaagaaaaagaggtttaatggcctcacagttccacatggctggggaagcctcacaatcatggcagaaggcaaaaggtacgtcttacatagtggcacaagggagaatgagagcaaagcaaaaggggaaacctcttataaaaccactcgatctcatgagacttatttagtaccacaagaaatgtatgggggaaactgccctcatgattcaattattttccagcaggtccctcccacaacacatgggaattatgggagctacagttcaagatgaaatttgggcggggacacagccaaaccatatcagcatcctagcttacagcttttaccctcagtttctaaaacctagatatttctttactttcttctgtaacaatcctttcctgaagtaatgagtgttatatgatctggctgaccaaatgggcaaagaaatagagctgctggaacagagtaaaggaatgaaaggtatgggggtgggagggaaactttggtgactatttcaaaatattgtcctgctgtgtgctacccagtgaaaagacataggggggtagaagtcagaaaaatctgagttcaagttctacctctgtaatgtattagctgtttgtgacttgcacaaggaacttaatttatataatcctcagtttcctcacctataacatgaagacctatcttatacaattgttggaagaattaaataaaacagagtaagtaaagctcttagcggagtaagagcacatagtcagctcttaatacatttgaattatcattgtcctcatcaaggttattaccagcggcatcactatagctgaatgatcatgagcaaattacttaagtctcagggtcttagtctcctagtctataaatgtggctaagaatttgtacttccaagcctttgtctcaggatggaatgagattatgtacatgaagcactttgtggcctgtagcaagttaggtcactgtgtcagatgctgtcattactgctctggaaattgcagggtaggagattggagcacaagcctgggtatccaatcaaaaccaaagagaggaatctgggtggaaattcaagactttcaggatgaagataacttgaaaagcagttaaaaagctctaagactcagggtttgtaaacatacctagactcagccttgcggcactgaaactgagagtttggcagtgaacttgactttggggacacataggtgtgcagcagtgtgacatggtgacaggaaccagagtgacttcactgttctgtcatatatgagtgaaggggatgtgaagaaattcaggggccactggcatgtgccctgcttgggtcgagattaggttaggaatgacccaaatcagggatgaacaaacttttcccttaaaaggcccagatagtaaatattttacgcattgcaggccataagggtctctgtcacaacttaattctgccattgtagtgcaaaagcagccatagatgatattaatacataaacaaattattatggctctattccaataaaatgttatttacagaaatggggatggggagagggcaaatttagcccacaggccttgtttgttgccctttgacctcaaccaatgaagcttaaagagaccaacctgaagataagagtgtatagaggaagagaaatgaagcagaggcttttagctagaaataataatgacaataaagcaaacattatgaactctgtagccacctaaaatccttttcagaaagtggacagataggaaaaataataagcaaacaaacaaatgataaacatcacagacttttgtgatggcttccatgaccctttgtaatccaccccccagggtggcttgcactcatatttttacccactgaaagggatttacaccttgcttataatctatacaacacaatgttgtcactatttgcaaacttgtctttctttgtcacaattctgtgtgtttcctaatgataatggccaatattagggtagctctatcttgtaaaaaacccaaaactatacagagtttccatcacaataggagtttgtcaatcacataaagtccgtaatgggtcctcctgattggtagacagctctccttcagagggtaatccggagaaacagcccagaccttcttcattttatggctcttaaatcttcaacacagagctcccagtttgtccttgtcaaactggcagaaggggaagatgatacaagggtgcatggaagggttttacaaaagaggtgtacagcgcttttcctccccttcctttggcaagaaaccagccatatagatggatctacctgcccaggaagctaagcatggtgtagctgtgcacccaggcagtgcagggagcagtttggctgagcatattgccagtctctgcacacattatgttttattaattatgttagccttcaggcctaccactgtactcagaatagaattggaaagaaagaagtgtttgccgaaagagccataaaagggaatttaatactacccacctttaaaaagattactataatttattattcttgtaaccaaatctaaattaattgatagacttttttatactttaagttctggggtacatgtgcagaatgtgcagctttgttacataggtatacatgtgccatggtggtgtgctacacccatcaacccatcacctgcattaggtatttctcctaatgctatccctcccctagccccccaccccacaacaggccccggtgtgtgatgttcccctccctgtgtccatgtgttctcattgttcaactcccacttatgagtgagaacatgcggtgtttggttttctgttcagcactgtacctgaagcaggttcattgctcatttcacgcttttccatatgcattgattttagccttgacctcatatttttcaaatgtctccatcacttcgtcagtgttgttaactatattatctccatctgcctcacttttactaacctctgggttctcaacctcttcatgtcaccttaggcttcattcatgaaatgaagtatttgctaaattgttcaaattactattctggaattaacctgcatttaaccttcccccatgctgcctaatccagtgtcagatcatatacccagcataatcagagccacatttatgcccaccaacctctaatttcacattaaactcaataacctgtatttcccctggggaaatgcagtgtttattgcccttttgtgtggagttatatttatgcattatgtgcatgatttacatgtgaacttgcagattaacagcctcctgtctcctgactgaaccagcatccaagctatgtagtctccctgcgtccccttcctgtccttaagatgcagagatgtggtagcttgaaagagacatgcatctgggagagacaagatcatggctttacaccagggatttcccaacttgaacctgtgacaccttcagggtcctcatccccgcaaaaggtttgaagggaagactataggcattctgtgagagaccattcttcattgtacaagtctgtccttcaatggaaggacatttaacttctgtgaccccatccactaatcctgatggtgatccccaatcattgagggatgcttccactccattgagaaccatcagagatgatcattataaaagctttacagcttaaatatactattaacagtagaagatgcacctcactgttttctcaagaggatacaattttcaaattcctgtagatgaatggttccccaatggtgggaatgttccaaaatggcagctcatttatgctattgttgagaagagaggaggtggtaatgaggcaagtccttatccctgttcccaagcaatggaacagggagcagggaggtagcaatgatcaagatctactctctccctaccaggaatccagataatgtactagcagagaccatcatgttcagaaatgaaatactaaggcagtagagtttagttataaatgggatcttcaaaagggtcttggcaggatgaggcagaaaaggattccttgaacaagaaagatacaaaaaaaggattttgtactcccttgccacccttttgctagcgtgttttttcatgcagtcagaagctgctgaaagaaacacttgaaccgaattttttctaaaaagagaaaaggaagcagccaccatttattaagccctcctctgggcagcatacaccaaatccttacacatctctgtgaggggcgtaattggactgattcgtagttgaggaaacaggattagacaagtgctgactgtgtacaggattctatactagtgagctctgtaatttgctgaaggtcagttgagcaatacttgatgaagccaggaggtaaacccagtgtctatctgtatatgtactttctcttaaaccatgctgccactctgggtgagaggaagtgaatagagggataacaaggtgagttttaggaaagaaactagtctcatctcttttcccagatgcagctcagggaaagaaaggccctagctatgatgttaaaggtccaagttgactttcaggaacccttaaacccccttccaggaatccttagacaatgtgtgggccagtcttcagtagctggtgtggattaaccaccagaggacccttttgaatggcgagagctgagtagcatcccctaaaaccttgtatgacctgggcgagggggaaaatgtcccaagacataactatgtttcccatcagcctgttgggcaggggctcagagtagagatacattatttagaaaaaataagaaatgagatatttcttacaactagtgttatggataaacattttgtacacacgacatagttttgtttggttttttaatgttagacaaaatacagaagcctggaaagtagtgccctttttcactctgaaatttgttttgattccacctacaaacataggagctcatgtctgtcaaatcagacttattccaataagacttcatttttatttcaacatcttcacttattcacatttgatgtagtttaaatcagtctttattatgtgcaccaagttatttaccaccgtgtagtagacaataaaaagcagtttaaaaaccacttgataacaacttaaagataaaatatagattcatttcttctatgtggtacatatgttagacagaaaggtacaaaaaatttataaatcttgtcattagacagaaacaattgtaatatattattattccaaataagatttcacttttgtatcaacctctttgctctttaaaaaaattttgagtatttcacacttaaacaactaaggcaaaatttcttaccaattctgggtcaaataataaaaagaacctggaaaacaaaagatttgttatttttcccccatgtaagaaattatcaccgttaaacatccttctgtctcttttagctccttgctgttgttctatttatatttttatgaacaaaatagtctatatgtctgtgtctaataaatgggatagctttgtgggctgagcattcttcatttttataagaagcatgtcagagctgaattgatcacatgctctgaaactctcccccagggtgttttcatttatatttaatgttaaatcaacgatattagaggtggaacaggctgtttgccattgaatgcaatcagcagtatcagctcactttgaattccataaatgccatttggaatgttctttttggtagagcacttcagggtatctgggtaacatgcagcttgataatttcaaaactgaataaccaaacacagtaacaaaggaaaccactcttaggatttataataaaaagtaccaaatttggagaaagcttctaaaagtgtgataaaaattttaaaaaccacacatttcttgccccttgaacgctacatgtattatttttcttaagcacagtgagctactggtttccattatttgacaaagtaatacaatatgtgagaggcccttaaaggtagccttcccctatagttttcttttctctatgaagtccatctctctttttttttttttttttttttttttttgagacagagtcttgctctgttgcccaggctggagtgcagtggcacaatctcggctcactgcaacctccacctccagggctcaagcgattcttctgcctcagcctcccgagtagctgggattacaggcacgtgccaccacgcctggctaattttcgtatttttagtagagatgggatttcaccatgttggccaagctggtctcgaactcctgaccttaggcaatcctcccgccctggcctcccaaagttctgggattacaggcgtgagccaccgcacctggccaaagtccatctccttgggctctcagatatacagtatgtcttaaaagtagcatagccgtaactagtaagagcctttcagatgaaagtgaaagaaacacaatgcaaaatggcttaaggaaaaaagtgaatttcctggctggcagaactcaaaagagtgtcgggtggagctggtgaggcacaagggaagtggggtgttgaggcctgatggtatcaggaatcctttgttctctgtctctgcccactttcctgtgttggcttctttttcaggagagctttctccaagtagcattaagaatttacagaagctctaggtttgcgtgctaccagcctaacaactcgaggggctgaaaggccatcatttcccaatgagtccaactggacttcccaaacagagcttatactggcccagtatggtgactgtctacctctaaatgaatcactgctaccccggggggtggaatatgctaggaggggccaggtctgggccgtattcctgcccgtgagaaaaggagatagggtgagccccatgtggattttcagcagctgagagtgggaaaggttggttctgcaaaagaaattgggtagccgttaataaatgaatagactgaagcctaatcaagcagaggaaacaactgccactacagctggtcattcttggctacaggttgttttagagaaatttcattatggaaagttgtgaacagaatcataggttagagaacagtatataaatggtcaacccatgttcccatcacccaacttcagtagtcatcaactcatgaccacacaccatactccacatgccaaggtactttctcacccttagatgacattgaagcacatcccagacatcacattatttcatccatagttcagtatgtgtctctaaaggataagcattctttacaaaaaataaaaacccacaatgccattatcataccttacaaattaacaatattttcttaatagtatcaaatatccaatcagtagtcaaatctcttccatggtctcataaaataatttctcattatagcatatttgaatcgaggtccaaatgaagtccatgtattgtgatttgtggatatgtggatattaaaagactcttttaatctatatttttcctttcatctcttttttattgtctttgaaaaaatttatttatagtttttttaaagttttttgtcctatagcgatttccacagcctggattttgctgattgcatctctgggtgtcatttaacatgatcttctgtccttctgtatttcctatgagagtttgtttcactcccagagtggaggaagctgtgcactttcatcctctagaggtgtacggtatctggttgtttctctttctgtgatataagcagctattgataactttgccaagatttattaattcattaatgattgcaaaagggtgatgctctaattccataatttcctcttcaattattagctgaataacgttataaagaaaaactatttggctacctcaagacacagtttatatgaaagacaacaaataacttgatcctgtctctttatttaccacttttcaaaccaatgagttgtttcactggcattcccactggggaaaaaaatagtatatttttaagtatcattatcataaactcatggatttaagtatattggatatatttatatccattgatgatattattcttattgaagctcaactcatcttatctttggtaatgggagcccattcaagtgagatatcaagtcctctcaacataaacctaatagtctttgttagtttcttggctttctgatatgataagatgctcaaggcttaacttgtatgtttgttgctccaaatctgggatgagtaatttctccaaggagccatgattccttttagtgggaaatgatatgtagtaatctgaatgctagtgtgctcattgataaggacagaactaagaaatatgtgtacatttttaaatgataaaatacatcatgagctcatactgatatgtccaattcaaatgcaggacaaaaggtttctatataacctcatctatcttaaatctttatctcttctttctcaagtcgtaaatcccaatgctcagtgacatcaccataatccctcaactttatcccacagtgcacatgcaacagcctcagaaaaacaacactaccacaaataacatttaaagatatttttattgcagttccatttgtctttatggaatatccaaccaatatattcaaatgactgtgttaaaatcactggaggccaggtgtggtggctcatgcctataatctcaacactttgggaggctgaggtggaaggatcacttgaagccaggagttcaagaccagcctaggcaacaaagtgatatcctgtctccacaaaacatttcttaattttttaaaaaattagccaagtgtgatggtatgcctgtagtcctagctacttgggaggctgaggcaggaggattgcttgagcccaggagttggagaccacagtgagttctgattgcaccactgcactccagcctgggtaacagagtgagactctgtctcttaaaaaaaaaaatcatttgagatagttcccctatgtgacactctgctactaactggatgatcagatgcaattatttcattttatgtataattcttagaaatggctttttaatttaattatgttttaaaattaagttcaactgtaatcatgccatcaactggatacacaggttctgcatttcattttacatgcaatttttagaaattgctttttagaatttagagttttataattatgaatactatttacatgatatctaagtcaaatctacaaaatgtatattcaaagaagtatacacgctttgttctctccatcctatttcctcccccatagataacacttatttttatattctattttatggtccattcttctattgtttaacgtgagcacatactctgatccctctccattcttagaaacagtattacactagacacacttttattcattttgcttttttcacgtaactgtatatcttagcattcattgcatcatgttttctcaaacacacaagtgagaaaaaggtgagtaggcacatgtgtgtaacatttagaaattagatgtatatttttggtttgtttttgtttttattttttgagacaaggtctccactctgtcacccaggctagagtgcagtactgcacctgggctcaagagaccctcccacctcagcctcctgagtagctgggactataggcatgccccatcatgcccagctaattttttttcttttttagagatagggtcttgccatgttgcccaggctggcctcaaactcctggactcaggcagtccgcccacctcagcctcccaaagtactgggcttatagacatgagccactgcacctgacctggaagacatacatttttattctagtggttgtcattagatcaatgcctttgtataatagcttagtccacccacccacccaccacacctgcccaccttttgttccctggctattgtctattggtctccttctatgaacattattgaaattagctaagtaataacctcttagctctctttgctctctccttgaacacttgacttgaactagtttctttctactgccagttagtattaatacctataaggcaagcagctacctaactctgttcttcatacagccagtacgagtgctacctgtctcccagatagcatcagagtcatagttaataccggtaaaaatgtgcttgatcctcaccactctacttcggtggctcccacgctggccattatggctgtccgcagcttgttttcttgtagattcccaggatgaggaatctcccacttcttgtgaggacctgtaggcaattccagggttcttctggtctccaagtcatcagaagccctttttccttgcctccatttccttccacatggatactgttggtatgaatcatattctggcattcatgggaatagctcaccacttatttttgctggtgatgttgtccatggggttttggctttaatatctgagttgctttctctcttttttatgggagaactcaaggagatccaaaaatgattttgccaactttccataatcctccagtggctgcagaatttatcaaaaagttttgactgaagaattatttataaatattcaatatctcttgtggtcatgtagcactttaatttgactaattaaacttgaattaatcctgaagtcctggcagacaaatacaaacaaatggtaattttcacaagcttaggtaaaattctctcttttaatgaagaagaatcaatcatctattatggaaatataaaactttgttgtcctgctgaaagcaaaacttttttccccttgaaagtgaatagcaggccactttttacgatacatatgtaatttgctatatacattgtaaacgttgaaaattttatacttatggacatcaaagaaagcctaatttttaaaaagtacctatttataaggtagtctggatatatttgatctattgaagttattgttttgccagtataattttcacactatgtgttcttccatgattaatatatgtgagtatataatgcttcacaaatagtagactcacaaatacttcagaaaatagtagactcacagaaaaggtcttctttcgagggtgaagaggctcaaagaggtgtagtattttcccagagttacacagccagtagatagcagagcccagagtcaaatacagaagccaagtgggacaatggactgggaaccattgtagtagaccacatgaaaaccataacgcaatattttcaacagaagaagggattctaaccattaccattggagaggaacacttacacttttcatttgtttaaaaggtaggaatgtggccaggcacggtggctcacgcctgtaatcctagcactttgggaggccaaggcgggtggatatcctgagctcaggagttcgagaccagcctgggcaacatggcaaaaccccatctctactaaaaatacagaaattagccaggcattgtggctcacgcctgtaatcccagctactccggaggctgaggcacgagaattgcttgaacccaggaggtggaagttgcagtgagccaagatcacagcactgcactccagcctggacgacaaagtgaggctgtctcaaaaaaaaaaaaaaaaaaaaaaaaaaggtagtaaggagagaagggggaaggaggaagtagtcgaaaggcttatacactctaagcattgcaatttaatatattttaaattttttcttccaagttttataagccataattcacagaggcaccagggtggtatctgcccacctctagattgaaaaagaaatgaggaatcaaggctattttaggcatctgtcaagctgtaattacctctttgctcagagaaacctttatgtaagactaatgtagattggcatttcttctgtttaaaagaacatttccagtcattcttttaatagaaggatccctattatgatggttatttcaatatgttttggtagagggaatatgttcccagtatggccttgacatagaaattacacttttaatctggtctgtttcttatttacttacaagcttcaatacttcttagagtcttctttccctaccctttctagttcagaaattgttgaatggcttttatttaagcttttcaagtaagctgggtttgtttaccaataagtctatgtataccttccactaaaagtttacccaaagtatgaccattaaaaggtgggattgagccaggcatggtggcgtgcacctgtaatcctagctgcttggggaggctgaggtgggaggatcacttgagcccagcaattcaaggccagattgggcaacatagtgagaccctatctctaattttttttaaagaggtgggattgaaatgacaatttatagaaagaaaacaaatttttcatcattaggcacttgttcattgtcttaggttggactcccagaaactgaccctgaaatgaagatccatatgtaagtgacttaatagggagagttctcaggaaagataaatagagggatggggagtgggacctggaagaaaaggagggcaaacatagatgcagtatcaggcaaagccccaggagggtgactttggctcagtgcacagggaagctccagatactttttaagaccacaccttaagttgtcctatcagaggcagagggatagagtgtttatagtcgccagttaagaactgcctcctgggctcacgttccccctcccctccatgctctcaggcagtttagactcagtaggctgagggtatttcaaagagccaagtccaggtgctggatgctgagaatgaaagcacccagcatcaactgttgactgcctctggtggtttacttttcttgcttctatcagcacatcctggagttcccaaggatatcttaagcagacaagggtgtgtaagaagttcaagttctgttgtgttttctagaaacttaccaaatccaaaattggagaccacctatacgtaagtccagtgtttttttctagcccaacattccacatttattaatgattatctctagagaaaggacttggcagtgaattaatttaactagaaaaagatcattgctgtaaaggaaaactatgcttttctaatatttaactcggattataaatatgcaaccaaagtagccagaatgttctgactagggtgatggatcaccagccactgaaatgccatttcaaagaatggatggtgttttaaagaaattatcctattcattaagactgtatctatgcagaggagaaccaagtgcaatgaaaatgtttgcgtcccaggcacttccttgggtgcttggcatatttaatcattacatgagtcctctaaggcaagtaagtattatttttcctgttttagaagtgaagaaactaaagttcatagaggaaaaaaaaaagtatacatttaataagcatttagtaggcatccgctgtgtgttaggcatgatgcaaggcactgattatgggatggcaaacaaaatggacctggtcccttccctccttgagcacacagcctagtgagcaagaggtgaaacaagcaaatacataggttataaatggtggtaagaaaggaaaggaaaagaacaggacactgtaaagcataatgatggcataggagtagaagattcagtagaagattctcattgtctcctcaatgagaaagtgacatttaggttgagacccggacgatgggaaaagctaaccaggcaaagagcgggaggagagaaagagcttagagtgctttggggagtgaaacaagagtgatattgcagttcctggccagccaaggggaaagaggtgtgaaaagactagagatagaagcaggagcaaggtgattgagggtcttctagagtagcagttggcaaattttggcccacaggccaaatctggcctactacctgtttgtgtaaatcaagttttattgaaatatagccaccactgggcatggtggatcatacctgtaatcccaaaactttggaaggccaacgtgggtggattacttgagcccaggaatttgagaccagcctgggtaagatggggaaaccccatctctacaaaaaatacaaaaaattagcagcgtgttgtggtatgtgcctttagtcccagttgcttggtaggctgaagtaggagaatcacctgagctccagaagtctaggctgcattgagctgtggtagtgccatttaactctggcctgagtgacagagtgagaccctgtctcaaaaaaaggaaaaagtaagaaaaaagaaacacacattacctgtggctgcttttgctctatgactatagagtagagtagttgcagccaactatctggtccacaaagcctatttactatctagctctttacagaaaaagtgtgctgactcctggtctacaccatgaaaagaagtctggattttactctaagaaagagaaggagccattggagggttttaggaagtagattcaaataattcagtttttttttttttgagatggaatctcactctgttgcccaggctggagtgcagtggtgtgatcttggctcacagcaaactctgcctcctgggttccagcgatcctcctgcctcagcctcctgagtagctgagatcatacctggctaatttttttgtatttttagtagaaactgggttcactacgttggccagtctggtctcaaactcctgacctcaagtgagccacctgcctcgccctcccaaagtgccaggattacaggcgtgaggcaccgtgcctggcaaataattcaatttatattttaaaaatatcaccctggccgtgctacatggaaaatggaatctaggagacaagagtggcagtaagaagccattagaagtttttgaaagagtccagataggaaataatagctagaggactggacagagcagtggttctggtgttagagaaaagctatgtgtagaggaaggatcagtaggatttagcattgtatttgatgtggagattgaaacagggagaaatgaagtataactcccaaatttgtagcttgagccctgggtggatgacagtgccagtcaatgagatgagtcaactggaagtagcggaaataacgtaggtgagtaaataagtttaagttcctcagagttctccattattaaatcttaggacctgcattggagaccaagtcttcatgcttttccagtaaacagcatggtctcccattggaatcatcacatgagtttactgtcaattgacacaaaaccaccaacactaaattttttcactgccaataagaccacaaagaaatggtcaaagtgatctgttttaggtagatgtgcttgtaattttgtagccttgtctttacattttacagactttatatataatttgtaatatgcataagcatgagctaattttgagctcatcttttttttttcttttttctttgagacagggtctcactccgacatccaggctggagtgcagtgacatgatctcagctcactgcaacctccaactcctgagctgaagtgatcctcccacctcagcctcctgagtaggtgggactacagtcatgtgccaccacacctggctaatttttttttatttttagtggagacagggtttcactgtattgcccaggctaggagctcatctttaaaataaaaaatatttcagaccattgattaaaatctttcacagttaattaaatatgtatctgcattggctatgcagagagcatctttagggacatacaatatagggcttcaaatagttgggctcttgtcaccgtagcattcattttgtctcgggcagctgtgaggcacccactcagcaacatttctgaggtcctaattgaaaatgaggagattctagaactgtgcttaaccctaaacttggaagggagtgtctctgaagcaagacctcacatgtctgtggttcaccttcccatctaggtagctaagagggcagaaaaaggcttctctgaatagccccactactctgcccaggctgaatggaatgtcaagctctaggccaccccaacacaagtctccttaagcagcagacccagcccaggttggaatctggcataacttggaagctgaaagatgacctaactagccacatttcaaattcaagctgaaagtaccactcacatttaatcagtttctggagatctatatggaagccttttatttccacttctttaaatgaacagcagttcatttacctggagaaactgcatgtgaataacagcaaagcaagtcgagagtgagttattaactatgcaaactgactacttaacctgttcttttcagacttcccctaacagttttattgaggatatgcttaaaaacatatttagatgatacattgcatgagtttcaaagagaccattaaggtctcatttgggcagagaaaaatgaatttttaaaggaaccattaatgtgtgtttttataattgtgtcttatggtatttttaatattgctaccatttatcaaatatgaaaaataagactttacaatattatcaaaataatattcatacggtagtagtctcatacccattaaatattatctgctaatcctttaccattgttcctaacatattatgattcattcagatctcattagattttatttcatactgcttttcatgcatagtatctcatactatgcatcaggtagtttttaacactctcactctttttttttttttttttttttttttgagatggagtctcactctcgttgcctaggctggagtgtaatggcacaatctcagctcaccacaaccttcacctcccgggttcaagtgattctcctgcctcagcctcccgagtagctgggattggaggcatgcaccaccacgcccgactaattttgtatttttagtagagacagggtttctccatgttggtcaggctagtctcgagcttccgacctcaggtgatctgcccacctcagcctcccaaagtgctgggattacaggcgtgagccaccgcacctggccaaaactctcactctttaatgcaatttttatttgccttttcttatccccttacctccctataggacatttttcctctcttacctagttgaaaattaatcttcctcggacattaaggaaactcaagaaaaaaatacttagtttaagaaacaaaaatttgctcatatttgtaaatagattttcgcatgcattttggtttgcacccttttcaattctgaaactctgaactctagttttggacatgagattaagcttccatttgatggcaggagtgaaaaatacaggaacattaaaaacggaaatcacgatctccaccaaccctgttcttcatagccttgagagtagaaagagtaaaaggcaaagatagtgttaaactccaatctgttattattttagaggatagataaggaattagtctaagctatgttctcaggttctgtaggaaggaagcttttccactaattctgtttttcttgcttttcctttgtttctaaccccaatggatacatacttttgaaaagtaatctttatataatgtttcatgtagtaattgaatagcttgtatgagtgaaacatttttcttttttatatagccagcccaaatgcagactgtaagtcctattaatataaaacagaaaggtctcaaaattcagttgcagggttagtgtgccccaagttcatcttcaaagcagtatttcccaatagacaggaaaatgagatttctctctgctttgccatggataaagtatcactattgatcaatttataaataatttttctaggttgaggctaaattcaaacatgggaggcacacttcagaaatttagtataaatcccctaacctctttccctcagagaaaattttatcatggttcactgaaaatctgtcaactttcagagaggattggaacattgctaggttttctgagatttgaggtgccatttcaaaatagctgtgtttgaactatgtacctatcgttccttaacctaatttttacctgcagtaagaaggtatattccatcctgtagctgtttataaacagtctctgcaaacattgtcttcgaattgaagcttcttcggggatatcatctctattccttgccaacattaaaaatagtatttctctgtttacatttgtctcctcttcccttctatgtatacgaaagttaccaactggaaaaatagtttatggtctttaccattgccttattgttaatattcaaatacatgttcaatcctggtaaagctctatattgttccaattctgatacatctaaattgggaggtagtggctatgaccactaacccctaggaacaactgggagccccagctccttctggctccaggataacgttatacataggctccccttagttaatttcacctgaatctctcacctttttattcttgaaccgctcaaaatgtgaggcctcaggacacagatttcctctggcacctgcttctctgtgacacctggttcttccttctccatgacttaacacgttccctatgactaattgatcttagttttggttccttcacaagccaactctgacacaaggatttgtgtgtgtatagataatctagggcgtgatcccaggaaacaccagccagagactagagatgtgagaccaaaaaggaagacaaccaataaaatgtaagttatcaaaccaattgccactgtgggcaactggagcttcatcctcttggggagttccaggatcagtgtagaaaacatgccttggagttattcagttgagtggtgagggagtggaggtatttatactctaattcttgtcaggtattgaatgaggactcctctgtggggtcattccccagaacttccagctgattatgtgtggtcagggtggactttagcagccagagagagcccccaggcaggtggaaatgaagaagcctcctcaattgtctgctgtaactcctaactaaccatttctactgcaccccttgaacactcactctattgcaaatgtaatggccttaacaattaacctctttttaccattttctgagcccttgcccttctcttgtgaccacgttgaaaggaggcttagtccttctcgtgccacttaaatcacagggtaaagaggtagtattggcattctcctggcttctcatgattaatttataagtcattattctctcaacctagtgcaaaacttgctcctttttttactagttatgccctccaacaatatgacttcagactttctctgaatttcatgccattccttacatatactgaagactttgacaccttccaagaatcctaccacactctggataaaaatcagcattcaaatatccacatggatgaaattaccttcttagtttttctatctcctcaactccaagtgccttcttgaccattccctttcagccaagcactcctgatctccacatccccaacctttttgacacccataactgaacctcctctgacaccataaattcccaatatcccaactttgtaattattctattactaaagagtgattctcactagaattattctcatcaatgctgtctttcccaactctttccagtcttccttcgtagacttctctcacccaaaagccactcaccactcatcttgtgtcctaattatacttgctggtatacttttctctaagcagaccccatgcatccctgcctgtagtcctcttttcacctacactgcccctggaaactgcattcctttcaagtgcttacccgttcatcaagatccaactcaaacacagctttttcagtggttctccaccactttccctcctatatctcgcatgttggagtcactctcttcttgttctgtatttccaagatatctatctgtagtcgctctgctttgcaactgtcaaattctgccctgccaggtgaagtgggtaaattacttggcctttcaatgcctcagtgtaatcaactaccaaatagagaaagtgatagttacctgtcaacgttattgtggagattaaaagaaacaatatgtgaacatgcttcagaacccaaagatgaacacaacatgtatctttattgggcagctgtaaggaacaaatagagaaaagcaaaacctttttatgggaactttgaatactgataatgactttaccatggatagaaggaaaggacattggtgcacatagcctgggttgtattcctggctccacttcaaatgagctgcatggccttgaacaagatgcttactcgcattggagaaagcccatttcctcatgtaaaaagtggaaataatgaaacctaccttgaagagttactgatgactaatgcatggaagcagacagagctctgataacttgaactgaaatggctcccgatattcccttatcatctctcacccaggccagtaaggttggggcacacaccccaggcaagaggcagtattacgtgacctaacaaggtctgagtgagggagtgactgtcagccccataagacgggattccatcctgggaggctgcactgctgacttggacaagtgtcaagatcctgctttaggaatgataggctcagacagaagctctgagtacatgcagcgtgcgtggggacagagagaggagcagttctttatgtgcccttaaagtgagccaactccatgtctgggctagcctctcctctgtgtcttctagaatgctttccctcatggctctagggacaagaattagtaattactgattactaataatttttaatgattgaataacaacagcagacaccaccatttatgaagatatgattcagggctgtgtatgtcacatctctcatatgctatctgcctactttatccttcccctcctgacccacattctaccccagagttgaacctgcaactcggtctgcagcaaggactatcctaggagtggataaatctggtaaatgagaagatatgaggatttcttctggcacctggattcaaagtattttaatttctggagcctgtgtatcttcatctctaagtgggaataataatacctaagtcctaacatactcggaagagttcttgagaaatattgagtgtgaagtactttacacggtgcttagcatacagtagacgtgaagtaaatgattgcttatactggcgattcttctgacaatgtcctggttgccccccatagatcctgaccatcccttgttcctctctgtattgaaaccttgtgcagagcagtcttctgatgaaaatggcccaagccatgtgaccccaggtacccaagcaacctgtttatctcttctcccaatttgttctctctcttctttaaggaaaggccatcttttcacccatctgcccctgcagagctgtttgtggatgttgaagggttgccatggacaccagtaggcctggaggcacgtgggtgaatctgggaagacttcaaaggggtgatctctggacagtgttctgaggaaagagattgaggtgccatttgttgaagaaaaggtagcaggaagttctagatcaatgacattgcacaaaacacgggaagtgatatacgggactcaacttgaagggtaagcgccttgggtctctagaggaaacccatgtaattttaggtccagttcagtttctacatcttctggatgcaaacagacagcaggagagtgtgaggggctccccacacttacttctagccacctgaggcatcctctgttctgctaccagagtctcaggtcattccatagaatggtggccccagacaggcagggatttttttctgttttcttcatcggtctatccacaaagtctagaacagtcttcgttgcatagtaggcacttgtcaaatatctgtttaatgaattccaacggtctttaaagttgaagtgtaggtgaagataagaggaggtgagtggagagctactggaggtgtttcctactgggggaaaatgattaggaaatcttacttgaatctgagctgcatttggaaatcatcatagtatttggagaagggaagtgatgtgatgaacattaatacctcagtaagatgggtcagctttcttccaaatagaccagaagagaggagacaggaggcacttcacttcttgctaaaaagttattttccccaaatacggttattgaatgaataaatttgaaaaacaatttatatatctgttgtcattgaaagccatatgcttcttatctcatctcacctgacaaagtcgaacataaccatggagtggaagataggaatttaacttctctcactataaattgcagcaagttgacattcagcctggccttctgaaatgctcagtttaaaataacagttgcaggtacccgcctttgcaggctaactcccttagagcatgcagtatcagtgtttgcccttgggaccagacatttgcagttgcctggggaaagtaatctctgtgtgtgctaaaaacacagaacacaatgatggaaatgataccaaaaagtatgccaacaagatggacatgattctcttagcaaaatgcttataaaatctagatgcttcacggacaagggcgcaagcagaaaacatcctcgcaaatgctccacatcctacgtagctgcatgtctaggcagaagtttattgaagcaaatgtaatggccaagaagtactttaaatgagctatttcttgcatccttgaattattttctctccctttcctccctcaatccctgctctcatccacccactaggattttttttttttttttttggcaatcttcaaggaaaaataataaaaagaactggaatttacataataccttccttccaagatactaaaagcagttcacccatctataatttgtccttacaacaatcctttgtacaggcctgttattattattattaacattattattatttcaattttgcagtcacattgcttgctgctgagaattttagctaacacctcatttcttgaacaattttagcccctcagcatatgtataaaaaaggcttcaactgccacctcccatttgtgattgtgccatgtattacattacagtctctggccctctgtttaattttcatttaaaaatatattaaattcctttattgtgagagcactgccggactgctgaacagaaggtgaagtgagcgttgaaagagaacagaatcaaacataaatatcttccaaactaaaagggaaatggaaagtaactgtcaaggcaaattgatttgaattgcataagaatgtgatttttttaaaaattgactcagaatatgaactattctttctaacagcttcaacttggcagatgacactacctgtctcttcctaatctcttgcagtctttcaaattccaaatttgtattgggttcaaaatttttcacatctcaaaaatgttcccagttcactgaattcctttagttatctcacatttcccatatgaacagggcctcccatgggaatgaccctgaaaaggcatgagccatttgccaatggtctttcttaattgccccagcaatcattttcttccatggccctctacctaatttatttttaacataaacaggtttcattcagcagaccagatgttgaatcctccccgtcttcttctcttactcatttacagtgttacatgaaaattccattcttctctctatataatagctgccctgctattagatagggctgtatcagtcagctgttgcttcataacaaataatcaagatctcagtagcttactgaatactttcttttttgcactgtggtaaaatgtatacaacacacaattttccattttaataattttaaatgtataattcagtgccactaattatattcacaatattgtgcaaccatcaccgttatctattttcaaaacttttttagtgctccaaacagaaactctgtacccattaagcaataactccccatttccccttctccaagcccccagtaacctctaatctactttctgactctgtgaatctgccagtcctagatttttcatacaagtagatttaatattttgatatttttccttctgtgtctggaaataagtgtttctttctcatgcatctgcaaactggatggggaagctctggtgatcttggctgggcttgcctggaaactacagattagtttcaaatctatttcgtatgtctctcctcctccttggaccagaaggctgcacaaggcaatacagagcaggagagagcaagcaggaacaggtggcaaggcctctgaaagattaggctctgaactggtacaccgtcactttcacggttcttccattggccaaagcaagtcattgaccaagcccaaagtctaaagtcaggcaagtaaacttcagctctagtgggagaatgcaaagctacatgaaagtgcatggatacagggaaggttaaagagctggggccatatcctacatggttaaaatgtaagttctgcagttgaatggaccctcctctaccacttttcagccacgcagctttatgaaaagggatttaatctttctgagccttgtttcctcatcagtaaaatggggataataatattacctatctcacaggctgctgtgattactattgaaatgctctaaatttgcagtaaaaaaaatgcgagcaatattattgtcattcttaaaacgtaaagaatagaaaaagcaaccaaagccaatagaacctttttatctttgcttttcactgaggaaaggaagttttaggttagaagaggatgctggaaaccatggaagttcagaaagggaattagaattacaaactaagacctattggtacttgaagaaccagtagcaatcattttgtctatttgttttcatattttcttttagtaatgtcactttttttgacataaacctagcctatgatctcagtgcataaagcagtagaggggttctggttgaaaagacaggggtattcagggctctgcccactggcaagagtccctgtctcagaagggttgcatggagcacaatttgaaaaccgctaatcaatcaatcaatcaatcaatcaatctgcaaccttagagactgacttttaaatcagaacctttcaattgttactgtcctctactacatattctgtatctatctgtaatcatataaaataactatgacttactaaaaaaaaaaaaaaaagaaaaccactaatttttgtttgtttgtttgtttttgagacagagtttcgctcttgttgcccaggctggggtgcaatggcacgatctcggctcacagcaacccccacctcccggattcaagcgattcccctgcctcagcctcccaagtagctgggattacaggcatgtgccaccatgcccagctaattttgtatttttagtagagacaggttttcaccatgttggtcaggctggtctcaaactcctcagtcacctcaggtgatttgcccacctcggcctcccaaagtgctggcattacaggcgtgagccaccgtgcccagccaaaaaccattaatttaatccaagcttcctcttcttccagatgaaaaaaaaatgaaacccacttgtgtaatgtgatttgcccccaaaatcacatacctaattgatgccagatctaaaaggagagtaaaacctctctttctaactcccttgcccataccatgctggcttctgtgaactttcaaaggccttgttggtaacagcaacctcttcggcctaattttatctcctctcttctttttcaatttgtccctcattcagatatatcacacttataggtaggtagtgctcatatattagccatgattctgcccatctgaagaatgcaaatgtgttactggtgaaagaaatgcccatctccatcagcaaaaaaggggaagaaggaaatgaaaaagtatatacagtagacatgtgatacaagaaatatgtgaatatgtatattcattctcctataaatgtactgatatatgtatatatatacacactcatacatacacaccattttgtgaatctgacacataatagagagtcatgagatggaagtcaaagttctaccatgtaatagctgtagggctttagacaaattattcagcatccctgagttcggcatcctctaggtaaaatgaggctaagaatcactgcttcccagggatgttacaagcatgaatacgtatgagaaacagaagtttaccaccttgggagtgttaccaggactgccaaaatgccaccctggtactttctaagttctgtgcttctagacccatttctgaattctacagaacaacttataaatacacaggctttggagtcagaaaagcacagatccatgtgctgattctgccagttactgaaatgtgaactgagaacattgaattgatctatttgatctcggttttctcatttccaaataagaatgacattaccttctttactggaatatcaggaagcttgaatcacacaagtaatttgtgtagtacactgtatggcacatggtaaacattcagaacacattaactcttaatcttgttcttatattgtgattgttactgttcttcaaagtttcccctagttttctacccactcaggcacagggaaatacatttggggaaatattgaaatagcagtactttgaatctttagaaatcagattgttttaaaaaatataatattttctttattttagggagaaactattaaaatcttttttcccctagagaatgactgctgtgacgattgttcagtgtggtttcatgtccctgaacaccatctctatccctgtgtgtgtgttccaacaatttaattcagctggcagaactgtccccctttagaataaggtagagattatgctaacattttagacgaggatcctcttgttggtttttggaaaagtacctccacatgagcatctctagatgggcagcattgtccaacatatcatgctgccatgatacagtatggtagcctctagttacatgtggctattaagcacttaaaatgttgctagtgcaactgaaggactggatttaattttattatgtttagtgaacttaaatttaaacagccacaggtctggagacttctctgcatgttctgggccaatgagaatgctgtttgaaattttgatatttaacttatcaaagaacacatccttgaagataaagacaaacaaaaagacaatggaaagaaagctttcatcctggaagcatgtcaaagcagcccaaaatgaatgagatgaaacgaattacccctttcctttcccaaatcttcatgatgattatggactattactaactgctcaccaggactttgggagtcccaataattttcatacagtttgtgctacttagtttgagtgagttgaatgtggcatgcttacaccttcttagtatccctcgctcaactgacaaagctttaactactttttacattactgtaagacattcttctccaactcctcctttgtgaaacataaatggattgcttattcaacatggtgtctttcagtcataatggcatttatctccacatccactcaagaatatgtgtttagatgacagcatgtattgatggactgcaacttattccagttgctgacagagtagaaggaactcagtcagacactaagaagagtaaaaaagtaaggtaaaggaagactaattgagttcatagagttagagatgcacatgtaataggattgtcaatgaatgataaagccaaataaaacagagtcattggttgaacacatgtataccctttgacctaccaattccactcctaagtatacaccaaacagaaatagatacacatttaatatattcaccaaaagacatatgcaagactgttaatacatagcagcactattatttaacagccccaaattggactactcaaatggccatcaatggtagaattgataaatgaatagtggttcagctacacaatggctactacacatcaatgagaataaatgatctacgactacacatcacaatttggatgaatctcaaaaacaattctgagtgaaagaagaaagaaacaaatcattgttactttacaattgtattcatataatgttgcaaatgaggtcatactgttctatggtattaaaaatcggaactgtggttatcctcaggaagtatatttggaaaggagcatgggggcttctgggatattggtaatgttttgatttcttatttggaccctgattacaattatctattggtacataacaaattacctcagccaggcacagtggttcacacctgtaattccagcactttgggaggccgaggcaggcagatcacctgaggctgggagcgagaccagcctgaccaacatggagaaaccccatctctactaaaaatacaaaattagccaggtgtggtggcgtgtgcctgtaatcccagctatttgggaggctgaggcaggagaatcgcttgaactcgggaggcggaggttgtggtgagccaagattgcatcattgcactccagcctgggcaacaagaacaaaactccttctaaaaaaaaaaaaaacaaaaacctcaaaacttaggagcttaaatcaacaacattattatctcacctttcctgtggatcaggaaactgtgtacagcttagctgggtgcctctggctcaaggtgtcccacaggggtgcaatcaagttattgtctggggctgtggtctcatctgaggctcaactgaaaaggaatctgcttccaaggtcactcatgtgtttctttgcaggattcagtttctcacaggctcttggactgagggcctcagtttcttaacaacttttggccgggacctcccttggttctttgctgtgtgggcctctccaaagggcagcttatgtggtatttggtttcctttggagcaagtgagcaagagtgtgagagagagtgagcccacagtatggaagccatagttttggggttttttttaacctaaccttggatatcacattctctcacttctgccatatttcgtttattagaaatgaatcagtaaatccagcccacatgcaaaggaagggaattatacacagtctgagcatcagaaagtgcagatccctggggatcatcttagtggctgcctactgcatgtgtgttcagtgtgtaaatttcaatgagctgtacactcaaggcatgtacttttctgtatattcattatacttaaaaagtgtgattgaataattaattaacagaatctctggatctcacaaaagaggcctttggccttcagatagactttactaaactgcaggttcttaaatttaagtctagcctccggaaacagaagccttttttctaactggtttctgccaaactgggcttactacaacatcactaggtctttgctcttctatcctgtacattatcacagtacacatagctgtagctgccactgcctctgaaaacccatgaaccctgaaagacagaggagttctttccagttggacaagcatggggcctggtgcttcttgtgtcatagaaaggaaaagtggctcggtcatgatgaggtcaagacctgggcttcctgtggcaaaccccacagtcaaattcagtcagagcaggaaaacctctgagatggtgaagaatggtaattgtattatttaaagtcagcctctagtactgacacacatttaaaatggaaaaaaacatgaagattccttgggcaagcatcagaacaattgctgtgggccaaaattcataaatatgctatacactgtccctgattttagggttggcctgtttctagtcactgtttatctttactcttacggaaatgtccccaggactgtggacatgcatagaggcaggaaagaagggaataaatgaaggaagtcttatcctaggtgatgagaataaaatagtgatcctgaaaaggcttgagaaatgttaataaaggagctgccagttaaaacacactctgttatttctcactataaaagaagccgttggcttcttctcaataaccaccctgtcatttgttctaaaccatggctggatggcccatcaacagagcacacaacctggtggcctgcttttgcttaatgtctgttttgttcatccatggcaaagtgtttaagaaaaacatccaccccaacttttttttttttagtactttttgtgctttcagtttactatgtcagttttttccaatggtatttacaagaagcgctcttaagaaccgaagttcatttagagagccattaaaaagtctgctactcaatgagttcatgactattgataacagccacctactgcctgcattgctgccttagcccttaactgggcccacacttccaccttgccctcctgcaatccattctcagcttagtggccggagtgacctttttaaaacatgtattttgtcattcctctgctccaaactcacaggtaaagccagacttttgcaatggcccatcaggccccaaatgatctgggccctggccctctctctgatctttctccctagaatccctccctactctgttgaagggtcgctgagctcctggctctaactcaaacttccctggcaggttccaccttagggcctttgcctgtagccccctgtgcccaggaggttcttccccttgacagcttcatagccaactaccttacttcctactcattgttgctaacttgtcacctcttaatgacatttaacttgtctaccctattcaaaatggcatggtggcctacctcccaacactcacaaatgtccatgtcatcttcagcatgctgcattatacatatggtggtatttgttatttattttttattgaatgtcttccctctttagacggtaagctctgccaggttaggtgttttattgactgttttatttattgatgtagctcaggattcctcaatctcagcactattgacattttgtgctgagtaattctttgttgtgggggctgtcatgtgtgttgtaggatgttttgcagcaactatgggttctacccattagcacttctcctaactgtgacacccataaatgtcttcagacattgccaaatatcccctatggggtaaaatcactctccactgaggatcactgatatatcccaaatgcctggccccaggtagatactcaataaatatttgctgaaggaatgaatgcagggagagctagacagcatcacagaagtgtgcaaaataatttaactattacctcatgaaaagctgctgccttttatacattttaaatagaagcactattttcatccattagtcaaataagcatttcaaaggccagagacaatattcattcagcaaaaaatgaattaaatggacaaaaattaggtcaaaccaaaaccagatacatatgcaaattaactctcttagcagtagtttccaaattcaaagtgccaaacctgaaattttattgcaaaggtttacaaaatacaataaaataaagagtttgaaatgatgcaatttcatcaaaatgttaattctgatcaccactgtatcaatgatgtagattttaaccataatagcctaatattaatcttcttcacaaagaaaatcacagcctaagccttaaatgcattcagtaaaatgtgaattagactttgcaaagatttctgatttctccctaggtttaaaattcaagtcgttggttatatgtaagcgagttaattctaagcctaaaattacaatgtactttaatcctttctctgcaattcaaatatttacttgacaatgccataccaattgtgccctccaaattattccttgtagtgaagcatttttagtccaagacacttgattgggtctgcttctcctctaagtttgtttttttcccctctaccccattctccacaagtccataattaatgttacaattggcaaatcccactctgagcagtaagaaaatctttttccacacttcaacatacgtttgtataagacaatttttttggtttgttttaatggaggtcacaaatacagtatactaagggagtcattggcttggacattttatcttccttgataagggagacatgttgaatttcaaaactgtttgactgttttaaataactgtttctttaaaaacatagttttcaaattctttttgggaagatgatgttctagttatctattgcagcctaacaaacgtaatggcttaatgtaataattaatataaataattggttatctctcatggttctgtaggttgactgaactcatccagatggttctcactggggtctgtcttgtggctgcagttcaatggcagctgcggctggagccatctgaaggcttgattgaggagatatccaagatggcttcttttgtcatatgttgttgcctggacttggacagctgccatagtgaaagctggccaggcatctctccctctctccacactacttctccacatggatggcttctatatgacatggtggtcacagggttgttggacttctaacatggtatccggctttcctcaaagtgagcattccaagatatccatgtggactttataaggcttctaggattattctgaccaaggcccagaagtcatacaaagctatctctatctctacaatattctgttaaaagtgagtcacaagattagtccagattcaaggggaggagactagacagaatgtgaatattagaaggtgtgttacttgaaggtcatctttagatccctagtatcacagacaaaaaaagataagcaatacaattatccagtttttaaggatgaagtctttaatacattgcttaataaggatcttttcttaaattctctttattttccctttggcttaaactggtagtctttttgatcagcagtgtaacgtctcactcaagggtgaaaatggtagtaggagaaacaatatctatagaattggtagaagccaagtccaatgctactgggcaagtggactctttaattcatctcctctatgtttctgttaccctaatgactatggtggcttcattatgcccattttcttccatagcattccctgaacatgacttagaaatgacaaatagtcccattcctcttctttgcaggtaccagggtggaagcaagcttcagcggcaatgagcagagtgtaaatgcttcatatagtccatgacagattacacttaactgtaatatgttgaccttttctgaatgcttggtcatttgctggacatttccactctctccagctaatggcttcagtgcctgttaggaattgattcagtggataattataatctctcttcagagtgttgcaaaggtcaacgagataaagcaataaacccccatttcaagtgcagtcctgtggcgacttttctgaaaatgaagggcaacacttcttccttcatctttgccagcaattgactaggctgacgctacgttatggcttgttatcaaatctgaaaaatctcagtgttcttttcacatctccaggtttaggtgggaagagaaaataaaaagcaagcaagtggcttcatcacaaaataccctaggattggggaaacgcccttctgagcaaagatcatcggagaaacactgttaatcagttcttattttcatgaatagtgactgtccaccagcagcgagtttaagggctgagactcactagcttgcagaaaacaattatttttttttttagttttcttttttaatatttttattatactgtaagttctggagtacatgtgcagaatgtgcaggtttgttacataggtatacacgtgccatggtggtttgctgcacccatcaacccatcgcctatattaggtatttctcctaatgctatccctcccctagccccccaccccccgacagggcccggtgtgtgatgttctcctccctgtgtccatgtgttctcattgttcaactcccacttatgaatgagaacatgaggtgtttggttttctgttcctgtgttagtttgctgagaatgattgtttccagcttcatccatgtccctgcaaaggacctgaactcatccttttttatggctgcatagtattccttggtgtatatgtgccacgttttctttatccagtctatcattgatgggcatttgggttggttccaagcctttgcaattgtgaacagtgccgcaataaacatatgtgtggatgtgtctttatagtagaatgatttataatcctttgggtatacacccagtaatgggatggctgggtcaaatggtatttctggttccatatccttgaggaattgccacactgtcttccacaatggttgaactaatttacactcccaccaacagtgtaaaagcatgcctatttctccacatcctctccagcatctgttatttcctgactctttaatgatcgccattttaactggtgtgagatggtatctcattgtggttttaatttgcatttctctaatgaccagtgatgataaactttttttcatatgtttgttggcggcataaatgtcttcttttgagaagtttctgttcatatccttcgcccattttttgatagggttgtttggttttgtcttgtcaatctgtttaagttccttatagattctggatattagcgctttgtcagatgcatagattgcaagaattttcttccactatgtaggttgcctgttcactctgatgatagtttcttttgctgtgcagaagctctttagtttaatcccatttgtcaattttggcttctgttgccattgctttttgtgttttagccatgcagtctttccccatgcctatgtcctgaatggtgcctggtttgcctctagggtttttatggttttaggtctaacatttaagtctttaatgcatcttgagttaatttttgtataaggtgtaaggaaggggtatagtttcagttttttgcatatggctagccaattttcccaacaccatgtattaaatagggaatcctttccccattgcttgtttttgtccggtttgtcagagatcagatggttgtagatgtgtggcactatttatgaagcatctgttctgttccattggtctatatatccgttttggtaccagtaccatgctgttttgctgttctggttactgtagccttgtagtatagtttgaagtcaggtagcatgacgcctccagctttgctctttttgcttaggattgtcttggctatatgggctcttttttggttccatatgaaatttaaagtagtttgttctaattctgtgaagaaagtcaatggtaacctgatggagatagcatggaatctataaattacttttgacagtatggccattttcatggcattgactcttcctatccatgagcatggaatgtttttccatttgtttgtgccctctcttatttccttgagcagtggtttgtagttctccttgaagaggtccttcacatcccttgtaagttgtattcctaggtattttattctctttgtagcaattgtgaatgggagttcactcatgatttggctctctgtttgtctattattggtgtataggaatgcttgtgatctttgcacattgattttgtttcctgagactttgctgaagttgcttttcagcctaagacgcttttgggctgagacaatggagttttctaaatatacatttatgtcatctgcaatcagagacaatttgacttcctctcttcctatttgaatacccgttatttctttctcttgcctgattgccctggcccagaacttccaacactatgttgaatagcagtggtgagaaaggacatccttgtcttgtgccggtttttaaagggaatgcttcagcttttgcccattcagtatgatactggctgtggttttttcataaatagctcttattattttgagatacattccatcaatacctagtttattgagagtttttagcatgaagaggtgttgagttttattgaaggccttttctgcatgtattgagataatcatgtggtttttgtcattggctatgtttatatgatggattacatttattgatttgcatacgttgaaccagccttgcatcccagggatgaagccgacttgatcatggtggataagctttttgatgtgctgctggatttggtttgctagtattttattgaggattttcgcattgatgttcatcagggatattggcctgaaattctcttcttttgttgtgtctcttccaggttttggtatcaggacgatgctggcctcataaaatgagtcagggaggagtctctctttttctattgtttggaatagtttcagaaggaatggtaccagctcctctttgtaactccgatagaatttggctgtgaatatgtctagtcctgggctttttttggtttgtaggctactaattactgcctcaatttcagaacttgttattggtctattccgagattcgacatcttcctggtttagtcttgggagggtgtatgtgtccaggaatttatccatttcttctagattttctagtttatttgcatagaggtgttgatagtattctctgatggtagtttatattactctgggatcagtggtgatatcccctttataattttttgttgtgtctatttgattcttctctcttttcttctttattagtctggccagcagtctgtctattttgttaatctttaaaaaagaaaaaaaaacgtgctgggtgcagtggctcacgcctgtaatcccagcactttgggaggccgtagcaggtggatcacaaggttaggagattgagaccatcctggctaacacgaagaaaccccatctctactaaaaatacaaaaaaaattagccgggcatggtggtgggcatctgtagtcccagctacttgggaggctgaggcaggagaatggcatgaacctgggaggcagagcttgcagtgagccaagattgcaccactgcactccagactgggcaacagagcgagactccgtctcaaaaaaaaaaaaaatgtgaaccaagatcgtgccactgcactccagcctgggcaacagagcaagactctgtcaaaaaagctagctcctggattcattggtttgtgaagggtttttcatgtctctgtctccttcagttctgctctgaaaccctacaagccagaaaagagtgggggccaatattcaacattcttgaaagaattttcaacccagaatttcatatccagccacactaagcttcataagcgaaggagaaataaaatcctctacagaaaagcaaatgctgagagattttgtcaccaccaagcctgccttacaagagctcctgaagtaagcactaaatatggataggaaaaactgataccagctactgcaaaacataccaaattgtaaaggccattgacaccgtgaagaaactgcatcaactaatgggcaaaataaccagctagcatcataatgacaggatcaaattcacaaataacaatattaactttaaatgtaaatgggctaaatgccccaattaaaagacacagactggcgaattggataaagagtcaagacccatcggtgtgctgtattcaggagacccatctcatgtgcaaagacacacataggctcaaaataaagggatggaggaatatttaccaagcaaatggaaagcaaaaaaaaaaaaagcaggggttgcaattctagttctgataaaaatagactttaaaccaacaaagatcaaaaaagacaaagaagagtattacataatggtaaagggatcaatgcaacaagaagagctaactatcctaaatatatatgcacccaatacaggagcacccagattcatgaagcaggttcttagagacctacaaagagacttagactcccacacaataatagtgggagactttaacaccccactgtcagtagtagacagatcaatgagacagaaaattaacaaggatattcaggacttgaactcagctctggaccaagtggacctaatacacatctacagaaccctccaccccaaatcaacagaatatacatccttcttggtaccacatagcacttattctaaaattgaccacttaattggaagtaaaacactcctaagcaaatgaaaagaacagaaatcattacaaacagtctctcagaccacagtgcaatcaaattagaactcaggattaagaaactcactcaaaaccacacaactacatggaaactgaacaacctgctcctgaatgactactgggaaaataacaaaattaaggcagaaacaagttctttaaaaccaatgagaacaaagacacaagacacaacttaccagaatctctgagacacagctaaagcggtgtttagagggaaatttatagcactaaatgcccacaggagaaagcaggaaagatctaaaattgacaccctaacatcacaattaaaagaactagagaagcaagagcaaacaaattcaaaagctagcagaagacaagaaataactaagaattgttttctaatttctttgaagaacgctgaagtacaggaagaataaagaatcctatgtgtgcatgtgtatacccatgaagtgagagttcaacactatgaagtgagagttcaacactgtttcactgcactttatcgcctttctttctaaataaaaatactgcacatccatctttcaagaagttacattagaatgttatttcactgtttataaaatgctttcatatgtaatcctaaattacctctgttttccttttaaaagcctaacatttcacccttcacagattgattatttacttccatttttgaaatttaaaattgtacagttaacttgtttagacttaatgtttctaaagcaagattctcgaattctgacatgaaatatcttcctacatatctttgttatttgagttttattttgtttggttttcccaatgtctgagcaaatcttgattcccatgatgactgttaaattagtatcagtgtctgggttcatcaagaaatctatttaagttggtctagaaagaaaatatacattagcacatgccaatatgattatatattataatttttaaatggtataaatataaaatgagaaaggcatttaaagaaacatgtcaaactatgctgctctaaaaaacagagaacaccagccttagcttcattgtttagagggattgtaatactggaaactctacctcattggaagctgggcttcttcctcacatagctttgctttctgcatcaaatgacatccaatgaaatcataaaatggtatataatgccaaagcatgctctaaaaccattgatgctggtgtcccaaacatgtttcaagggactctgcatcaaaaaaggataagaataaacctttgtcaaagaaatgaagagagaggaattgaaggcaagtttgacaggagtggtttagggtaggatagactatattcccctgcagagatgagcactgtgattcagggatgaaaatgatgtttttaacaaactcaaccatttaaaaaatattgtcacagcaatttgaaattactcttcaaaagtagaaaatttatgtggaatttagtatgaaataatacttatctaaatgtagttataactggattcttaatggtctctagctgttttaggccatcccagaaagaagttaatttgatggcttaaaagtgtcatcttctattcctgattctaatcattctgttgaggctatttttaaatggtgtagatcattgttttaaatggtgtagatcattgttttgttttgtttttcctcctaggatcgttgggttaggaattttaagggatccaaaacattatagagttaatttttcttgtttggcaggttataattacataattatagacgagaaaaaaagagaagaaaagcatgtccctagtcctggtgataaataacatattggaatattttatttcaattcagacaacttcatttattcattaaatagtaaaattaaagtcaatctagattatgtgtcagataatttacaaagcattactatagctgtaaagactttaaatataatcaacatattttgaaaatagttcccattttcaaattaataaagtgtgctgaggagtccttcttccagaatttcttgaaagaagaaattctgcatgaggttaagtcatgaatggaaactacttttttttttttttttttttttgtgagccagagtttcactcttgtcaccgaggctggagtgcagtggtgcaatcttggctcactgcaacctccacctcctgggttcaagcaattcccttgcttcggcctccagagtagctgggattacaagcatgtgccaccatgcccggctaatttttgtattattagtacagacagggtttcactatgttggccaggctggtctcaaactcctgacctcaggtgatccacccgcctcggcctcccaaagtgctgggattacaggcatgagcaactgcacccggcctgaaactacttttaagatacatatggattactaagctagaagtctctttatgcatgtggcaggcaaaatgtaagatggaccccaatgatctctccacttgtattcttagatttgtgtatttccttcccttttagtttgggtggggcctgtgacttgctttctaaccaataaaatgtggtaaaggtgacgggatgtccatccatcattatgttacatgagattgtagctttcatcatgtcagcagactccctcccttgctggctctgatgaagcaagttgccacgttggtgagatggggagatccacatggcaaggaactgagagtggcctcaagccaactacccacaaggaactgaggcccttggtccaacagcctaaagaggattttcatcatgccaaaaatcactgaagtgagtttggaagtgaatccttcccaaacgagctcccatatgggaccccagccctggccaaaacattgcagcctcaagagagaacatgaaaaagatgaccaagctaagccatgcttatatttctaactcacatgaactgtgagataataagtgggtattgttttaagcaactagctttctgggctttctgggaatttgttatgcaacactaggtaactgataaagctaatgtctatggtcggcagaataatgatcgcctgaaaaatgtcctcatactaatttccagagtctgtgactttctttgcatatatgattaagtcagagatgagatgattatctttgattatccaggtggacccaatataatcactagtccttttaagttaaagaggaagtgaaagtcagggaaagatttgaagatgatactgctggttttgaagatgaaggaagggaccatgagccaaggaatacaggcagcctctagaagttgaaaagtctttagaatgagtgcagcccagctgacaccttgattttagcccagcaaaactcattagagacttctgacttccagaaatataagatagtacatttgcatcatgtttaagccactaagtttgtggtaattcgttatagcagccataggaatctaatacagggtctatgcttattagcatcaaggatgactaacaagagtccttctccagggccttgcctgctcctaacagctactgcactgaagcggtgcatatcagcttccctttccagagtgaacaaataaattcagtgccactgagcattgctctagagaaaattagcatttgtcccacagccttatgggcctattcattctcccacccaacctaccaccttacagttttttgtctgacaattatccctcattctcttgtttactgttttattgtttcatctcaagattctaagcctccctgtcttagtcaaagggtgtttggactcaaataatatgatctaatcaaaccagttcatcatgctaactgacttcaaactatactacaaggctagagtaataaaaacagcatggtactggtaccaaaatggatatatagaccaatgcaacagaacagaggcctcagaaataacaccacacatctacaaccatctgatctttaacaaacctgacaaaaacaagcaatggggaaaggattccctatttaataaatggtgttgggaaaactggctagccacatgcagaaagctcaaactggatcccttccaccttatacaaaaatgaactcaagatggattaaagacttaaacgtaagacctaaaaccataaaaaccctagtagaaaacctaggcaataacattccggacattggaatggggaaaggcttcatgactaaaacaccaaaagcaatggctacgaaagccaaaattgacaaatgggatctgattaaactaaagagcttctgcacagcaaaagaaactaccatcagagtgaacaggcaacctacagaatgagagaaaattcttgcaatctattcacctgacaaagggctaatatccagaatctacaaggaacttaaacagatttacaagaaaaaaacaaacaactccatcaaaaagtgggcgaaggatatgaacaaacacttctcaaaagaagatatttatgcggccaacaaacatgacaaaagctcatcatcactggtcattagagaaatgcaaatcaaaaccacaatgagataccatctcataccagttagaatggcgatcattaaaaagtcaggaaacaacaaatgctggagaggatgtggagaaataggaatgcttttacactgttggtgggagtgtaaattagttcaaccattgtggaagacagtgtggtgattcctcaagggtcagaactagaaataccatttgacccagcaatcccattactgagtatatacccaaaggattataaatcattctactataaagaaacatgcacacgtatgtttattgtggcaccattcacaataccaaagacttggaaccaacccaaatgcccatcaatgatagactggataaagaaaatgtggcacatatacaccatggaatactatgcagccatagaaaaggatgagttcatgtcctttgcagggacatggatgaagctgcaaaccatcattctcagcaaactaacacaagagcagaaaaccaaataccgcatgttatcactcataagtgggagttgaataatgagaacacatggacacagggaggggaacatcacacaccagggcctgttgggtggtggggggctaggggagggatagcattaggagaaatacctaatgtaaatgacagattgatgggtgcagcaaaccaccatggtacgtgtatacctatgtaacaaacctgcatgttctgcacatataccccagaacttaaagtataataaaaaataaataaataaataaatagaagttgggaataagtagagcacgcaggtcttggagggtgcaatcataagacaactatattctttccccgcattgtccacttataacagctccccagggccagttcctccaagccctcaacaaaatctcaggtagttcccataaacatattgaacaggttcagaaagttatccagtcacttgtacacttgtaatcacaattaacacttgattgtcatgtaatagtcaaaacttccaactccacaaaattcctcctttttgcctagttcaggcctaggaagcctgcagtgggttaaggggcattgtcaatgttttctctactgccccagcattcagctccttccagattgaaatgaggccaagatggtgaggtaaaaggcaagaaagttctcacttgattggcaccagtgtaatccagcattactttcttctgtccgtggaaggtgatgttggtggactctttccttgtgtttgctttcatggattcctggaagatttctttgttgagttactcctattgcagcccgcttgtgtcaggcagaaaccaagggcgggctatgctcagtgctccttggattctgtatatttctgcgaaggccctctcatccctcaaagtagctcagttgatcaggaggtcccaggccaatgtttctactgcatcttccaagagtctcatactttgggcctgcctcagtgtaagggtagtaactgcacaaatgtagcctctgctctttgagcatgtgctgcttctgacagcctcttcctgctgccttttttttcagtttgtaatgaagatatgagtcagatcccaagatgagtaaggggtaagggttccaaactctggttttcaacacctttgaaaatcttgcggcacccttctttggcatgtgggaatgattggcatgtattggcatggggcctcagctgattctgtctcagttcatcttagcaccctgtaacatatgaacacatatggcttccatctttttttccacctaggtttggattaggagtcctaagggatctgtagtgctatggagttaattcttctctggaagatgatgattatgtacttaagatgagagaaaacaaaagtaaaagctctttctcagaatgatgatcgatatcctgctgagatcatttatgtgaatgattttatttctagcaaaatggtgaacaaccagccctcaggaatggtggaaaccaggactgttcaggggattactggcatctgtaatgtttactctggtgctcagtcgtgaatgtgacttggctcccaactctcttagtctctgtgtctctaagttctgattctggagaaaggatatctgattggctcattccaacattcaggtccaatgagctgggcccattgcttgctcctgaggactctgggatcagactcagacaggacaagccaggcagggcagatagttccactaacatggctaccacgctcacacattctttggtcaatggggttatagagcatttcttatctgataaacgtttcttgttgcctgtgaacgaggaaaacttgaacaaaaactaagaaacagtgctttgtttctgtttgtgctgctttccacatatttgtctcatatctgttatcctggagatggacacccagtttgcctctgacacttcacccccatgcattctgctgcaagtaacatcctcatccacctccccttaaaggctagcagcagaatttttggggggatataaaaccagagttgactggcttggtcatggtgcttgtgacactgaagttgacctattgaagctagattgcttccccaaactgctacacgtgtgtatattcccaccagcaatgcagatccttcatcttatgcactgaattctcatttgattgcactgttgctctgtccactgcagtcattgggctccctgccagccttggtgactgggaacttgtgggagcagactggccaccatcagcactgtgctaccttcctgcccccaccagcaccatcatcctaagtgttcagagtcttcctggagttttagttctattactcctttccctgccctcttgattcctctcttcccctaccccactccccaactacatggtccagcccagccagagtgagtgggccgagccacaaatcagttagtgctagaagtgtgatttgcagtgacttcttccagggaacagccttgcaaaagatctccttccccttacttatgtgggcaataaatcagaaaagcaggtaattaattacaacctaaagtagaaaaaatcagctcttcttcaacaaaatggcaactgacctttctcctagtcatgatttaaaaaagaacaaagaagggaagaaagaaaaactattataatccataatatgatttttcctcaagggtttgagttacgtggagggaattagataaaccattatattacattgttctgcttttagccatgaagtgcggcctattgtgagtaatatttcccaaccggtgcctgtctgaaatatttatcagcccagggtcctagcattgtgaccagggacttactaagccacacagtatgggaaccgatgtttgctgggatgctatttttttcataagaaacctacaataacatttttgtctctggatgctgatcctgagaggtaatgacgttccatgaactgacagaatttttaaaaatctcttcccctgacagaaaactacagagaaatttttaagcagcaaagaaaaataggctaaaggaaaatcagaaggagagaatcaattctgagagcagcaaaaaatatagagatttgggtgatgcttctaaaactgttcttcccttcctgggttttattttaaggtcctgctgtttgacagcacagataatattgcccaatgtaaacttactaggaagctttcaattgggcagtttgttaaactcaggaaacgcttcattttggcttttgtgtggtctgaaagcctacatctgagctatttggtttactctatcctgggagtccagggagcattcactaacgcatcacacattttgttttgaaagaaaactcttactagttagagtccgggctcagtgcatatcataaatatgtttgtttttctctcttacagaagctgcaaagaatcgatactcctcactgtcattcagccttaccctgtaagtgttctgtgaataaaagtgccacttaatgttctcaggcttcttgtttcttctgcccactccagtaaaaccataatgatgaataacagcagagaaaaataacatgcactcacaatatgggttcaaaaatcttgactatttttgtaatttatactccatgttagcaaagtcattcattgaagagaaaagggagtaatacattttctaaagttcttgaaagacaaccagctattccagtcctatgcaatggtcacatttgtaaatgacactaaattcaagaccttcttatgcttttcagcttaagaaacacaaatctcatgagactatctaattgtaggaggtcgatgcatgattgttattcttatccccatctatttggcagagaactggatattttagcaaagcctgctttaagaatagatgttatatgacatatggtgtcagaattcgatttcagctatcatggttaggagggtggaaagtgatttaaaaactggacagttcttgtgatttaaaaaaaaaaaaaaaaacgactttatcatggtataatctgcgtaccataaaattcatccattttcagtgtacagttctatggtcttcataaaatccactgaggtatgcaacgatcaccccatccagttggaggacatttccatccccccaataagatccctgttcccatttacaattaatccctgttgccacactcagtcctaggcaaccgctaatttcctttctatttgtatagacttgccactgcttgcaaatttcatacgttgtcagttgaactaaaaattaccgaggcaaattcctttagatttttcccaaaatggttcctgtcagtctggccttcgtaaggagtggcagcgattccagcctgcttaagctcctattttcttccccatagagttggagcatttctatatcaattaaagtgctctggtatttgctgatctccatcttctgaccaaactcttcatttcccctgtcccagaatttttcccctaagctctgtgggctaggcattttagacaggaaataataaggatcaggattctgataagaccacaaatagaactaaccaagacaacaaattatgccatcttactatgcatatttatattaaaagctcagtttaatattgactgtcactgttaactccatctctttgacagaacttacacacatacacatacattgggatttgaaaactaaggaggccccaggatgttagagaaccacgacttgagatctagctcacagcagtataacaaacgagtcagcagtgactaccatagctgctcagaaccttggtctccccaactgtctgattccgagattccttccatgtgcttctataaaaaatacagctgggctgtttttagattgttttggttaatcaaattgtcattttcacttacttcacatctatacacatttcttgatttatttgcagtggacaaattcatttgggtaaagccaatgtaaatgtctataataagcatcgaacaactataaattgagattgaacaactataaattcctgatggaacttcacgtttgcattgtcattcctgaattctctttctatattgtataatctattagaaatgcaagatcaggcaggacctttgtgttttgttttttgtttgtttgtttgtttgttttgcaatgtgggatactgttttacctcatgcagtaaacttagaaaaagaaagaagagttttacatgtaagtttatggttgtgtcttgtggctttacttgctgtttgccactggagtccatgtgacttgttattcatttgaatattgattactatcagtgaatcatggcacttccttttaacagataatctggaattttctaggagttccgatggctcttgccgttgtgctacattgaaaggcaacacttagccacaatattcaggaggaagtgtcacatgttcttatagccaacagctgtacctctgctccagagtcactttccccttgcccaatcaccgcagataaattctcatctttgactttcctttgaccactctcctttgagaaatgactccagtcccaccacctcctcggcctcgctaaataaatccttctcacctttcaagtctcaggccaaattataaatgctacctcaaggtttttcaaccttggttttgttgacatttgaactggagagttctctgttatggggacacgtcctgtgcattgtaggatgtttagcagcgtccctggcctgtacctactagatgccagtagcatcctctccccaagttgtgacaaaccaaaatgtctccaaacattaccaaatgtcccttgggagcaaaattactcccagctgagaaccactgtcccacctaaagtcttccctttactgttcaaatcccaaatggcttttctctcctccgaggtgtggaagttgaaattaaagaattaaaaccccaaagtttcttaaatggatatcagacatggagaggagagcagatgggaaaaaacaagactgcaatcttttacttatatttttgggtttggattttactacaagcaagttgctttttgtaaaaaaaaaaaaaaaaaatacttattgagtttcatttatttgttaaacatcttcttggcaatcaagactgacaaacagaaacggatgacccagcagaccaaaagaaagtccataagttctacttttattacagacaataaaaattagcattttaatttcttttgcaacttgctggacagcatttttaatgttgtatttcttctgcataaggtccagtaaagatagagagccaatgtttataccttccggccacattccacatgtgcccagggtacctcaacatgacccaactgcagaaattgatctccaatgagacctaggtcaagggggaatgggggtgagagtcttgggatccctgaaattctttgataagaagtaattcttaataggttgctgcattttttaaaaaaagtattatggtaggctttccccaccaccacgatttttactgtttttcttgggaaaaaaaatactaagtggaagtatagaaagaaatacagatgcagaaaaatgtgttggcaaacttttcccgcagagacaaccagtgtaaacattttgacctatttccttccagtctttttttctatgccttagttgagatcatattgtacatataattttattctgcctcttttactaaatatatcataaacatttcctatgtcatcaaaaactctttataagcatcacttaaatggctgcaaaacattacactgaaccaagatttccttaaccaacccccatcactgggcctttcacatcgtctttattgttttgctattataaataattccgaaaagaaaatctttatgtgtaagtcttaatctgtagttagtatttccccaggatggaattttagaaggggaatttctgggttactcatgggttttatttgtttggctccgatataccgtcttctttccttgtactgttacccttttttattatagatctttcattggccagctccttccttttttcctttgactctgctttctacagtttccaagtctagaattccaaagccaatcttacctgagacagagagtatttaaagagtttctacggctgggcatggtggctcacgcctgtaatcccagcactttgggaggccgaggcgggcagatcacctgaggtcgggagttcgagaccagcctgatcaacatggagaaaccccgtctctactaaaaatacaaaattagccaggtgtggtggcacatgtctgtaatcccagctactagggaggctgaggcaggagaatcacttgaacctgggaggcagaggttgcagtgagccaagattgcaccattgcactccaccctgggcaacaagagtgaaactctgtctcaaaaaacaaaaaagagtttctacaacttcccctcatgcaaccccaactcaatgggacttgagctaagtcattctctcagttctggtgtcccatgagctagcataattcacattcctttaggtttcttctagtccaaagagctgagggacccgctttcctgcctccaacttcctaactacattttactgtgttccacacagctgagagaggctacacacctcctcatggaaaccccagtgtagcacattctatcagagcccagaccatatgtcatgctgagcataccagcccaatttccaatggagaacacctgtgagtctttgcctgtgggctcttcctggccccagtagcatgctcatggagcaggccacaagtgctgaggaattatcattcccagaaaggctgtgttttgtgttctcttacatggtggtcagtcagatgtagccacaagaggggacacaggagacatgcgggaaaaagaagttttttttatactcacaggtcctagagaaactgcatgccaagaggaggggtcatatgagagggagcaccaggggagccgattcaaccaaccaggcggggaccagacagagaggttagagcctgtgggcaaatgcctttatcgggggtcagggtggaacacacaagaaaagtgcgagggaatttcattggtctctttaaatgttactaagtcacagtcaggggagggtgggaaagagtacttgtggcaggagctaactttatcacactggtgcacctggttgcctgggcagggtgctcacaacctgtatgtggggatgttgaggcagcaggaaaatttgaattttgaaaacttacaatacaaggagacactccatcaatgattgacagaaactggtggataaataccccagctccctctctcctcagacagtataactctgaggcatgtggtctaccttgtttcccagaggttcccagcaggagtaagctccagttgcctataatggtgccttagtaacagcgaatgctttactggtttattctcccttcctgcctgccttccccactcacctacctgggattcctgtgagcacctcccaaatcagctacctgtttgtgaatccttgtcttaggtctgcattttggagactccaaactaagccaaccagtgataactgtaggcgagtcttcaccaaatgttcactcaatacctgctatataagtaatactgtacagctctaggaattgcaagttcaagaccttgcccttcaatttcagaaattaatcttatttctgtaattttttcaagctatgttctagtaacttctaagagcattcaaaagcatcaggagcattccacacactattgtggccatcttagcaacagcaaatttggaaaatgtacaggggttgattaggggcctgataatcttaaaattaattaacagtaggagaatctgattattctaaatgataattacttgttatttccaccacaggatatgaagtgcttgtgatcaacacctacaggttgctcagaattaattcagcaggctttcaagtggtacacattgtatattttttgaaagcaaagataaatctgtgttaaaactatagtcatgactggtttacattaccccatataacacaagtaactctagccagtggaataagccagtattttgttgattctcattaagtagccttcagacttggagagcctatgtagttgttatccaaaagtaatttccaaaacatttgtcagttttatgaaatagtcacaaacccagaacaaaaaaagtacttgttatgaattcttagttagaagtttaccccgagtctgttgacttcaaattgtgtataaaataatatttacttaacaaccttggctatttagtttcctttctggtcttcctaaattaccatgtttctcattattgcatcgtaaataaatacaggaatgaagttacataaaatgggcatgctacatatagctagagagaggagatagtacataaggttatttgcccctaaagtaaatagccccacgtttactggcctcagcagggctagtaaatatggggctatttacttcaggggcaagtaaccttacgtattttcgtgatccctgggaacaccatggcactctaaggttatatcaaatgatatgcatccgaaaactctatatttgttattgaagcaaggaattagatggaacactttagaaaaatatggcaaaatataacatttaaaaattgagatgcatagaggaataaacctcagtatctggcacactgaacacacgtgaaacatttcattcccaaacaatgctggagaagtgaggtgtgactgcattaaaacatctcatctcatgagtagtgtctgttctgggtagctttattacagccgcttcacttgtgctcaactcattgtgccaatgtaaataccgcctgcctaaaatcattacgggagaataatgttttcccttcagctaaaaaatgaaatatcaaaagcaaatgcgctcaccgctgtatgatttgctcgttaatcattactaaagttggcctataattacaaagatactgatgagaacaccctgtcacatcacttcagctctgcagcaggacttttaaaagtcacgttgagcatgtttaaagctattctttcggtttcttgctgttgtctgtttgtttgtttgttttttaaagacggcagccattctcttaaaacatcttgcataaatggatgaattcaagctctgggagacaaatcatccatttatccagtcttctaagacactactcacagcaaaggatgggatcggtgtggaggggaactttagaaataacaggattctcctggtattaaagcaaaaactccatccaggatacacacacacacacacacacacgcacgcacacacacgcaccccacacacaccttgtatcatacttttttcaacagcttttttattacagtaaaatacacataacataaaatgtaccattttaaacatttaaaagtgtacaatttcgtggcattaagtacattcaaaatgttttacaaccattgccgctacctagttccacaactttttcatcaccctgaaaggaaaccccgtattcattaagcatcactcctcattccctcattctcctccacccccagcccgtggcaactactaatctactttttgtccctatagattagcctattctggacattgcctgtaagtggaatcatgcaatatgtggccttttgtgcctggtgtccttcacttagcaaaatattttccaggttcatccatgttgtagcatgtgtcagaacttcattcctttttatggttgaataatattttattgtacagatggaccacatttgatttatctatttcatcatattgctttttaaatttaattgatcttaagtatacttgtatttgacaaggatgagagtccttttttaaattcattttacttgaaaaccaaagtataggtcaccctagttggcttttgtatctctagattagtacaataaatagagggttaagcctctgtgttgtttctagagtcaattactagaattctttacgcaacagcctctatgtcttaagactacatagcatggaaaacgttagtttgaaccataggcaattgccaatatttgaccattttcatttataaaataacaattatatgattcaaactatttacctctgtattaggtttcatagagaatgtaattctttttaaaaataaacaaacaatgcctgcaacatagtagatatgtactaggtgtgagttcccttccccttaggcttctttaaaattatgcaacaatggtgattctcagataaagtgactttaccaagatcatgcagcaagggatgccccagtatcacagcacccttctaggcaggttctcccattgtacttccaatttctgaggaagaattgtgccacattgcccctctttctgataaaagaaaggagagaatcataaagcacaaagagcccataagatgaggaagaatatgaagtcaactttcaattgtaatgaaaggtctcgtctctaccctgcccagtaagatcacaggatcacaagttaccaagaagaggctaaaactcaggttgcaggtgcataaggcatgagtgcttgagagagaaagagagagagagggagagacagagtacttgtctgctcacatgcccatatgcccttaatgtgaataacaataggattatgaatcattttaggactatcaatggctcttctccacctcattaaaatagatgattaatgatcaattcatcataaacccaacattagatctgactaccacctcaccttgaacactgtgctcaaagctctctattaaaagcagagtttgtgtgcttttgcagccattgttttaaaacatccctggaaatgtgctcagttaaaacatggaacatagtggtggtagttctgatctggccactaaatcaaacttactaacttatagacatgacagtgttttgactgcatctataatttgcattttgtccttgaatcggacatgcaccaagcattttatttttaagcaaaattattgcatacctaagatggaaaacaactgttacaaggtttgcattatgttaccagtaatcagataaaatgttttcttttcttctagtctcccaaatcagcatttattagtgctgcaaaaaaggcaagattaaagtccaatcctgtcaaagtacgcttctctgaggaggtcatcatcaacggccaagtgtcggtgagtttacagtcacctgctttgtgactcagggagagtcaatgaggcagaagctttgcactcaaaacaaagtcagtagtcccactggaatgactgatctgaaattggttgttggtttttacagaggtgtcaaatctcaaggttgtaaagggcttgagagttcatcaggttgggcctgaatctcctctagcacggtcagaatatgtggtagtccaggatttcctagaatgctttcagtgtcagagacatcactactttgcaaaggagttcatatgatttgggatcactgacactgcctcattcatactcagtaaaatatgcgtctttgaaacttccacctttttcttcccattctgctaaataagcattcttccatatgatagtgctttatgtatttttgagaaaggtattgtgtttctcctttttacttccccagaaaagcctaatctttcaactaatcaggcaaagaacttaaaacgatggaaaaattttatgtaggcaaccagaactgaagaaatactgcccacatctccataaataggtcctgatagaaatcatgattactcaggcaattaactgaacttcagaatgaataatgcaactatcaacaggatgttttgactttttctcccaaaaatatactgaagtgttttcagtttttagaaaactatcatccaaggcactaatattttttggacctttgaaatgccagagcgttggtgttctgttggtattgtttaaataaatccacgaggataaaatctcacctatgatatattcattattgatcacaaactcttctctgaggttggttctggatctgaatctgaatctgaagatgtaggcctatacatcctgggcaaggcactcatgctccaactgtctttgaatcaaaacttactgatctagggctgctccacttggggtccagctattgtgatgcttgtggggaaggctagaggctgtggctgtgctgccctgtgagcatggtctgttctgtgcctctcaatgtgtcccatcactctggatgcacggtcactgtacattattaatttacaacaagactgtcccagctgaagggtggaaggtacagaggaatcaatatgtagcagaaagtcatctgaaacttaccttttctgcccagagctttcgagcgtgtaattgggcaaccaggtagtttatgcatctttagaaagaatatgattctagaagctgctacagcagtgtcagttcatccctggatatagcaggactcctgcaaggcagctgatgtgtaaggacacctctgaggataatcatctcctgaagcctccacagccctgccacaggcttgtggatggcagggatgttcggtcacgtggatgctcctcagacttcatgactgtcttcatttccagtttacccttgctcttctgagtcactgagtgcaatttcttctggactgggatccagatttattcagtgacttgagagcaagactgtgcgggaagtccacaggagcagaaaagagggggaggaaattcaggaaaagaaataggaagtgaaaggcaggaggcctattatggaaatacttagggactgaattctctctgacactggcaaattcctgaatatcttgccttcagttccttcatgtgcaaaacaagggatgtgtgcactcatgactgctgagttctcctcaactcctaggactttatgaccaactacatgtgaataactcagctcactcctgggacttatagaactcattcagtgtgcccccttcctccctctttcttctctctcatctctcactacttccaatgaaagaaaaaatgcaaagaaataacatttctattgtttgctttttgtcatgtttcaagctggcatctttttctgagttatttctagattatgatcttgttcattatagacaatgttttactctcttaacacactaagccattccttatcttttcccttggagttttgttttttgtttttgtttttgtttttgtttttgttttgcagttgcaacatttaatagagttcccttggagtttaagactcattcctaactgggtgaaaatactttcacaaaataactttatacttgaagcttatttatgctggtgactcaccatcatgacactgctaggcaacaacagtacctcatcaaacagcatcattgctggtcttttttctgctcaagacgtcctgccctgcttaggtctgggcttgtagttccaaatgtcaaagcctaatcacaaaagaatcacgtctgcaatcatgtttgccagtggggaatcttgagttaaaaaaacctcatctgattgattttctgatgagcaaatgtatttttctatgagcaacttaactcacatatcaccaaaggaatgccttgttggccttagagagtttgattgttttttaatgccatgcttagaataaagtatagatgtgctgctactgcaaagagaagagttataatttgatcaatttatgccctgcccttttttttgttaaacaggaaactgttaaggacaactcacttctttttatgccaaatgttttgaaagtctatctggaaaatgggcagaccaaatcatttcgttttgactgcagcacttccattaaggtaagatgacctggtaaactctgtccctggacgctttcaggtacaacatgcaggacactgtgagccattgtagcagcatcttctttcagaactatccctttatttctgcagttttgttgattgcctccatataatgtagtctgtgaatacttcaaaccaaaccaaagccaaaagcttaaaccaagaaggctctgctcttttatttctcttggtgttgcaaaacaatataatatgctgtcagtgaagaaacactagagctagtcattttgatgcaactacagattaattaaaatagtgtgactatcaccaagaaggcttggcaccctgcccaaggccagcatgatttctcagcaatatcagctgctcagaagattaagctgttagctgttaattgaatatttgctactttggtgtccagcaaaaaacaaggggtagagtaatgtaaaagtaacatttacttttaatttctgtaaccaatttcatggtaatgatgcataaagaggcagaaatgaggcctgcttcttagaagaagggctggaaaggaagactcacaaagcaatcctattctttcagagccacaggtgagttttagataataggtattatagcaaagcatatggtttttttccccacatgctttcttcctggaaaagaaaagtacagagtctcttccttttattggacaaaagtgtattcagaaattgattgctccctaatgcttcatcagcctaaaataggctttcttcccatggcacagtaaaaaagattttatgaaggtaaaagagtacctagtgattatctgtataataatctatcaagagaatatcaaccctctgttaaaaaatgtctatcaatatccgacctctaattcttgttggtttttttaattaatcagcatagacctcacacatagaagcatttctgcaaagacccattcactgtgtattcttattgtcacgataccagcaagcagctcgttttgaattgctataagtatgtagtggcttaatacgtcatgcagtggaaaatattagattgatgttggagcattaaatcatcctcaaatcattccagatgaaatattaacttccttcatacaagacttctaattttaaatggtgatgactggacaggtcttcttccctttttcctcattcattatcaatttgtggtgagatgttaatataattattgatcaactaacccaagagtaggcaaactttttctggaaagggctagatagtaaacattttaggctttgtgggccatttgatctctgtttcaactactgaactctgtcattgtatcaggaaagcagccatgaacaggtgggtttggttagtccttaagacaatgctcagtcttgataattcactcaaaggacccacagaactcagcaatttgttatactcacaattacagcatattatagcaaaagaatacagaatagaattagcaatgggaaaggctcatagtcagggcacaggagagattgagtggaaagcctccagatgtcctcttccagtggattcatacaggtaatgcttaattctcccagaaatgatgcatgacaatatgcatcaagtactgccaaccagggacgttcacccaagccttggtgtccagagtttttattgggggttttccacgtagacacagctaaccacctgcatggttgaacttagtatccagtctctccagagttagagctgataccatatggcccaatgttctcactataaatcaattgttagcgcagactatctggtatggcccaaggccacccagtaaacaaaaatactcctatcagacaggacagtccaagggcttacaggttacttcctaagagtgggagaaaaagagcaaatttttctttaggcaaggttaatctgttacttcacagtcaatatgtgaacaaatgggcatggccagatataacccgcaggtcatagttggcagacctctgaaataacctacagagctacattattacagccctttctgacaccatggccttgttttgtgttgccaactggtcaactccctgccattggactccctaccccacctgaagaccgaggtaaagacttgaatgcatttcttaacagaaataaatctaaattgaagaaagccctgttgtccattccctccagcctctttattacggaacatatgcaagactaagtttgatttccctgaggattgcagatgacaatgagaagacaggaagaaatgcaaagagttcacatcaaattcaagttatcttatcttatacctaacagcctcattattacaatagacactggctggtaggtgtaaaggagaaatagtatagttatgaaaggaatatgacactgtgtaacaaaaattgccaaaattcttgctgcagaattacaatagggaaaaactcttgctattgattttccaatgtcctccctggtggttcaggaaaatgctttataaagtatttgttgccacacaaaggctggttttgttttctctttcctgggctttaagagaaaattataaagcagggaaatctttttttttttttttcttgaaattcaacatagtcaaggcatttctcttgaatgattttttttcaggagtgggtggatgtggggatctttgatttaatggggcctgaagaaattgaaaaaggaccacagagaaggattaaaacatcagaaaagtcagtaaaagaaaactataagttttcactctaaggtttccggatcttgacactgttgagatattgggccaaatcattctttactgtggggctgtctctgcattgcaagatgttgagcagcatttctggcttctacacactccatggcagtagtgtccccaaccctattgtgacaaccaaaaatgtctccagaaatttccaaatgttgcactggggcaaaacttccctatagaatttttagcatctgagtctaaattatcttcgagggatcatttaccagttttcaagtacatgaaaaaagtataggttgaagagattagttttacattgtagtaaatgtgtgtgtttgtacatggaacacctttctgatcataaatgcttaatcctataaaagattgctgacaaagcttgctcattccaccttccccagagatgtaaaataaatatatgtatattattatggtgccctcactctgtgccaaacaatgttataataaacgctttgtatgtgtgaactcatttaatctttatatccgttctgagataagcattattattatccccagtttacacacagggaaactaagatacttagcgactaaataacttccccaaagctgcacagctaataagtagtagagctgggattagaagcctaactgttttcttagcccctattccttacaaccactacactgctctttcagaaggggaagccagggtcagcaagcagatatttcagtcttcacagtctctgttgcagctactcaactctgctgatgcagcacacaagagcagccatagattttagataaacaaatgggtatgaccacgtcccattaaaactttatttacaaaagctgatggtgagctagttttggcatgcaggccatgttttccaacccttggggcagaccactttcagaactggtttaattgctaccccatttagaaaaaaggagaattgaactggctacactgcacaatctattgacaacctttctatatcaagagcttacatgatattaagcttctcctccagctatttaccttgttaactctctgttgtgaactccataaagattttgaatgatcgaggaggccaggaaaagggcaagagaaggaaggcttcatttctgcatctttttggatatttggagcattaaatttcagaatcaaccaaacgtataaaatttcaagattggcagcctacatgtgtaacacttttcagtcatggtagactccacaagatggcagcttcgattttggtctcatcatgttcatgtttcctctgtaaggatgtcatcttaacccttcaagagaagctctccatcaaaggcattgaacacttctctctcatgctggagcagaggacagaaggggctggaacgaagctgctcttgcttcatgaacaggagactctaactcaggtctgtgaaatctcaccctcaagtgatgaggctgcaggttagagcagaggttgcccagtccaagatttctcccccactctaatcctgtaaatgtattaattgtatccctgggtatcctctgtaaaggaagtgctggcattcttaatgcattttacacctcaaggtcatgtttccctttctgcccatcttttgcagactgtcagtctcacaactagatttgtcattcaaagtctcaccagctgcacattgagaatacagctctgtaaaattatattttatgggattacagtgatctgttcacctgttttggtcaacaatctcttgaaaccattaaaaagaaatggtttctgggattacttaaattaatccaaaatcatatttagttgtctgaaattctgggtgcatacttaagactatttttggaagcctgaaatctctgccccagtcctgcccgctataaatatgtgatctaccaatgtgtcccagttcctgattaccaagatgccacccccatctgttccctggggagacaagcaggctgcttagctgctgaattcagcgcagcaccctgatttttcttgtgacacaagcaaagtctttgttgaacgtataaaagatttcaacaaatttctcttccataggagagatcaatgataacagaactttatggaaaggggtaggaggggacaccaggaggagaagcatcagatgctgccagctggatggagtggcaaaaagtgttgtcatactaaagtgcttcttccttgttgtatataaaagctggtgtcccacacattgggtcctgcaaatatccccgattctcttgattcagtccaactttttgtaatagattagttcaaaagttgccatctgtgatttatattcctctacccaaacttggcttattatttccatcaagttttttggggttttttttgttgttgttgttttgttttgttttgttttgtttttttgagacagagtctcactctgctgcccagagtggagtgcagtggtgcaatcatagcttattgcagtcttgaactcctgggctcaaacgatccttccaccttagcctcccaaagtgctgggattacaggaatgagcccccatgcctggcctctattgagtctaaatctacctatagatattttaaatcacttctaatggttattattttaacctgtgccaaacactcttggaaataaaggacttattttatgcttcattacaggggcacaacccctgatatacagaatctctcatgtgaaaggtcagtgtctggatctgagttcctccagaggcagaacttaaggatttgaatgcatgtagtttatctgggaagagatatctggaaatacccacagaggaatggggaagagagatgagaaaaattgagaggccaataaagaatgtattatcaaaccagtttctactgtgggtaactggagctcagtcctaccggagagcactgggagacagtgtaggacgcacctcagaggtatcccaccgagaggcgagggagctgggacatgtgcctactgacatgctgtctgttattgatagtgggctactctcttgttattggggtttgccttgtgctatcgaatggtcacaggtgtttgctgtaaatatccttcagcttatagcaataaatgccaaggggaaatgggcagacatccagttactacgagtctaatgaaaccccccacaacgttttgatctttctggttatactttctctctaaacttttatctactacatagccattataggaaagcttcatgctgatttagttggacaaaaattctctaaaagtctcttctgatgctaggtaaacacaacttcccgctccagttacatttcttttaaaatgttggaaggaaataaacttctaataatcattctttctttaactttatttttccttatagaatcagaactagaagtgaagtgctaaaaatcaagtgaagtgctaaaaatctctagaaaagaaaacggatttaaatatcctgaaacaaaccagctatatgcctttgaaatcaatgcatatgaaaaaatcgattgctaaaatatttgtaggcatgataaaagtggagagtaagaaattatattttttccaataataaaatcattttaaaacatttaatttctatgaaaacctcccaatggaacttttaagcaactttacctgaatttctagtggtttgatactaaacttctgctagaaaacattatttatatactacttaaagtttccaagaaattgtttctgtttgtttattttagaaagtgttatggactgccatttctaatggcttgaggcaacctttttgcattacgttaattcatttcccaaaaccagtgtaaccttctgatactaaaagtaaactcaagataagatggcttatggaaaattcaagaaagaaaagttgaaccagtaattaaaggagtcagagatatagtgattcctgactttctaacacaccaggacaaaccttctggcaaaatagctcatgaagtcgctgtgaaacacaacagcaaggctggccagcactagtggcctcttagtgtccccaatttctttattcctggtttgctttaccctcagccagtgataagtagcccatagccctcaagtctcaggaatccactcggctctgcaggcctgcccacagccagaaagctggtgtgactactcaggatgcccacatatgtacaagtagggtgtctttttccattggaattcttctgttcaacaaagttagcgaactgtaaatacatacacatgcatgcatacacacaccacgggactcaataaagctattttattttaaattttttaattgcagctcacatttttgtattgccagatctgtcccctgcataagagtattacacacaactgtgttggttcatgctgcatggttttcattttgttttgttgactccttgaagggaaatcgatgagctcttgccttctttcttagagtccaatgtctttcattcattcaagtgtttattaaacacctattattatttattaattgatttccttttgttgcaaaaggaattaagaaacgaacttctagtatgtgacacatattatgctgtataaaatgaaaacaaactgaaatgagccatggtccttaaccctgaagaacctgtggtatattttaagctccattgagcaagtggaacaatatcatcatgatatcagaagtttggagtagtttgaatacttgtagaatctggtgtactacatgggccaaaacttctgtcttcctactttccaatgtgatgtcatctaaggttgacactatcatgttttcattgcaatagtcagtctggagtctaatttggaaaaacaaaacaaaacacagcaatgttatgcaataataaaccatactggacaatctctctgctgtctctttggatcccctttttgtactccccaacatagatttggggtgctatcactaacagccagcatctgcagatcttcttccaaggactgccctcagactaccggagcccatcgtgtccaaacctggaaactcacatcccctgggacagctctaaatgaatgactcatcagtgctcctttggctgaggtctcagcagctctgtggtatagctaccactccatggtctcctgcaggatcaggctatagctactctctgctggggttccctgaggaggcacccttgcttggcttcctcttctttcctgacctgcttcccccactcccttactagcctcccctgggagcactttcttaataagtcccttgcacacaacccctcatctcagggtctgcttctggggaacccaacctaagtggcaaggttatgtgtagttttcagggaatgagtatctataaatactaaaagaatatccgctgattctttccttagtgtccaaaaaaagtcgactgcttcagtgtccctcagccatttctcagtcagcactgaagggttcttgtgtgattggtctactcttccaggtgacacagaggcccagctcccataagatgagatgtcttttccgaattagcttcgtcccaaaagatccaattgaccttttaaggagagatccagttgctttcgagtatctctatgttcaggtatgttaaaattttggcatgttttatatcaatgttgtgatataaactaactctggggctttgccctgaattctttaacttgaaatctttcttttttgtcccccacctcaagctcagtgaatcgtacgataattctatgatgctctttttatttttacgtttgattttgaaataacatcatacttccaaaaaagttgcaagagtagtcatctatacccttcacccagattcaccagttgttaacattttaccacatttacttgctctttagtatatacacgttttctctgcccacacaaatacacatacaaatgtatataatttttttctaaaccatatgaaggtcaattaccaaaataattctggtttactcctaaatacttcagtgtgtgttttctaataacaaagacattttcttatacaattattatacaagtaacaaaatcaggaaagtaaacattgatacatttccattatctcatctacagtttatatccatattatgcctattatcctcaaaatgtcttttatatatacattttttctagaacaagatgcactgcaggatcccattttgcacttagttgtcatgtctctttaatctccttaaatctggaacattcctcagcccttttttgcctttcacgaccttgatagttttgaggagtactagtcagctattttatagaaatctctcaatttgggtttctctgatgttttcttatgattagattgatgtcatacattttgggaagaacaacgcgagtgactttgtgtcctcagtgtaacacatcaagaggcacatgatgtcagtttatccctttaatggcaaaatgaacttcgactcttggttaaggtgatgttctccgaattcacccaaaagctactactattccttttgtaattaaaaagtaatttgtggagagtcactttgtaactcttttttttttatttatttatttattttgagacggaatcttgctcttgtcacccaggctggagtgcaatggcatgaccttggctcactgcaacctctgcctcccgggttcaagtgattctcctgcctcagcctcccaagtagttgggattacaggtgcctgccaccacgcccagctaatttttgtatttttagtagagacggggttttgccatgttggccaggctggtctcaaactcctgacttcatgatccacgcaccttggcctcccaaagtgctgggattacaggcgtgagccaccgtgcccggcctgtaactcttattatcttcttcatcaaactctcacccactagttttagtactgaatgatgatttttttctttttttgagacggagtttcgctcttgttgccttggctcaccgcaacctctgcctcctaggttcaaaagattctactgcctcagcctcccgagtagctgggattacaggcatgcaccactactccaggctaattttgtatttttagtagatatggggtttctccatgttggtcaggttggtctcgaactcccaccctcaggtgatctgcccacctcagtctcccaaagtgctggaattataggcgtgagccaccgcgcccagccctaattgattattcttatctgaatccattattataattgtggttgaaaattatgatttttctaatttcattattgcttctgcatttattaattggtatgatgagagttttcccttctcctttatttacttatttgttcattcatttgatgcttaaattattctgtaaaattgtgatattcattttactgaattgttaatttcaacgtggtaaaacttgaagagaacagtcttttccagactgatatctgattctgagctataattccccaaagatgaaagtttccaggaatgagtatctggtgtagtttgtcccaaagggaatttatccaagttgatatttatgaggtgttcctatattttactataactgcttcctattactctcacttaaatttccaatataatcacattaaacagtaagaaccaactgacctaatccttagacagcttagacatctagcagtagaactaactactcgaagaggttgcaaatctaaacataacctccccctccccactgccagaaagagagaaaaaacaaaaatgaagcaaaaaaaaaaaaaaaaaaaagacacactgtctttgagaatatctgtataaggcaaagattgctggagccatatataaaagatataaagcaaaaatgtaagaaaaatataataaaaagaagcatttgttaactctaggtagttaataacactggtgtttgctttaccatttccaatactttcctgtatatttcaaaacatttgtaatcttcaaaagctgggtagaaaaaaaagtaggcggaagatggaagagagactagacaaggtaggtatcagaggttaagaatggtgacataaattaaagtggcaataagccctgaagatcacaggttaagtcagacaggaaagacacagaacatacaagaatgttctagcagatgggggcactcagggtgaggccagtcaaattttccccacctcagtggtctttggaagactgtggtatttacagctcagtgggatgattaatgttcatgaagataaccctacatcattgggaaaagtcaagtcctgttcaatgaaccctgttgaccaagtaaagaaatgtgtagtgtgctttaaaatattttccaccccgaacaacgaaactgccacgttttgggttttttaaatgttaagctttgatcacctggacccctcacttgtcaacaatatctccttgtccccagcaggcgtgactgcatgaaacagagcctgattctcagctgatctgttactgcatcttccccatgtccctgctgaaaaccaacccagggctttgctactgcagctcagatcatgtgctacattgttagttgcaaataaatagttataggcgctggtcagtagtcgctgtagacagtgagtgcattcagtggtttttctctataattatatactcaccccattcacaagatggtgctttaaaactattttactctgcttccatttaaacatcacgagtccattgcatttataaaagaacaatgtggttgcatttgtcttggggagaggagacctcttaagtagacaaggagtacagctaaacccagttctgtttaaggtgtgtttgcacaaatctaatatagcttagggagatctttcttattcaacagacacatgttttatacatgtgagactgtcctcagaacacgaaaatgtgtctggaaatcttgcccagggactaacagaaaaagactgaggatgtttctgctttcttgccttgggtataaaataggcagtgaattagccacctcttcaaggcatagccagagggggaaaaatagaaaaacaggtatggtaggcaataaagaccaaaataaagcaactgtcatatatcctccgctgaaacaggaaatcagaatgtctttgcctcagaccctcttctttgaaatgccttgtatcacagaatgcgtgctaccataagtctaaaataacatctaatataagtcaacagatctgcaaatggtgtctgggtgcccatgttgatttcaagatactaaaaagatgcaataaaacaagcctagagaacaaaagagtaagcaggagcaacatgtatcactttacaaagataaaatcaatttaacttagtgggctcctaatgaggacagtagccattgactagatgaatcatgaaaacagaagttgcaatagtaatatctattaatctcctagttcttaatggtccatgacatattttacagattttagcatatatattaacaataaatgctaatagtccagattgttcaaatttatcattacaacgggctatactgacatttacctgtccactatctgttaagaaaaagactgttatgtcaattagcaaatgagtaagacctaagaggctccaaaatgttttcaaatactatagtactattggtttcctttttaagatctaacatgttagttataaatgaacattctggaagcctcaagtggagccttttgggacctctatttagcaaaacagatactacccatttgcttgtataactgtattttaagtaatacagttgagagcaataaaagcatgattagtaccaaatatatatatatttggaatatatatatatgttccaaatttcattctccaggatcagtctgaactaattatatcatgtaattaatcaccttgtcaaaaaattcatccagaagcctagttaaatacagggtaaagcagtgatgggaaatatggtcccagctatgactcttaggagaagtaatagtgatggctaatctttatcaagtatcttccatttcatgaaacatatttacaggtatcatggcaaccttgcgagttcattgctaactctcaagttagttgtttttgagacttaacccatttttccgataaggaaactgaggctgaagagagatgaaatgccatgttcgaggtcattttattagaagttgacagaacttagaatcaaacctggggcttttgtctctaaattctatgcccaaatcctctttcaatccattatggcatagcagttgctgaagaaaatgatttatcaaaatgatttctcaaaaaattgattcctcactgtgccaatggttttctcaccccatcctttatgggactgtataaaatgaccctatctaggctctcaaccccttggagctcatgtggacaaccctgagcacttggaaataactggtaaacccaagactagcaaaacaaaatggcagcctgtaattgctctcggaggctgccttaaatcagaccaccctatctcctgtctctggacagacccacttctgacaaggggtgctgtgcaatccaaataggtttaagattttaaggagaagcaaaggtggaagatcacattagggatgaacaggtgagagaatgtgacttcactcttagcagtgaagtgatgggctgagagacatgcacccatggcacgtggatacagagcgtgcacgcacggcacagcaccggtgcagcatgggtgagtgtgcacagtgtaaatattgtatgcagaagccatccaggggtatatgttcctattttagtaaaatcaatataggaagcggttataaatgtgcttctgttggaaaggaggcaagcaaatcttgatatagtttttcatttgaggccaagggcccacagaagtttcactaaaaaatcaagtcaaaaaagacaaatgaattagagaaaaggcatacaaatatatttaacgtatatccatgggagccttcagaatgaaatcccaaagatacaagggaaattgtccatttttatgctaatgttcaacaaagtatggatagccatgtagaaataggattggactaaaagggcctgacctaatgctaacggactgaatgaagaaacctagcaaggcctagattcttcttggcctctctgagcagcgttccttccttctgggtgtggggcaggaccctttctggaatgggagtcttatgacctacaatcaaaccatgttggtcagataatttctttatggccagtctttacacagggcagagggaaaattagagtcatatttttaggttttaaggctggctttggggaaagggggttctagtttctatgacccaccttggggaagagggattctagtttctatggctagcctccagggataacagaaattaaaaaacaggagggcaggagaaggtcaaagaaatacttttgtttctgaggccttcattttgggatattgttttttgagctccaacaaaatattcttggggcaagccaaagaataaagaaaaggaggaaataagaaagaagctaaataccatattttctagcccaggaatccagtttcccataacaaaagtaagtgaacgcacgtgtagaatatgcctaagcaatgcagcgcttcccagcagcacttagctcactgccttgtgtctaagcagtaagtgaggatactactccaaagccaacctctgttcccatgcagcactttacacttgatgacacactctcagccactcttcaatttgatccccacaacaaaccctgtgagataggtgaccttattctacagatgaacaaactaaggctgaaagaggaggaatgactcccagaaagtcaggcacttgaaaaagcagggcagttgccattgaagtgaacagaggagttcaatagctccccttatccaaggtaccaatgtgctgtgataaagcacttgatgtgcacctcatctaatcctccagccactccagtgagatagtatgaatcccgtttgcacagatgagtaaactgaggctgcaagagttaaagtgaatggtctaaaattacttacacaggtagccactgggaaaggcagaacgccagaacaggtggatatgagtcccaagccactgtgctcactcaccgtgctaattctgcctccctgcagctgctgtggctgataaggaggaggaggagaatgatgttagcagtgacagtagtaaacatgtaagagggcttacaccctgccaagtacggttctaagagcttttggggttttgttttggcttctttttttttttttttttttttttttgacaaggtcttgctcttttgccaaggctggaatgcagtggtgtgatcaaggctcactgcagccgcaaactcttggactcaagcgatcctcctgcttcagcctccctagtagctgggactacaggcacacaccaccatgcccagctaatttttgtgttttttgtagagactggatttcgccatgttgcccaggctggtcttgaactccagggctcacgtaatccacccgccttggcctcccaaagtgctgggattctaagaacttttcatggttcactcatttaatggtcaccacaacccagtgaagagggagcagtattatccccaatttacagaagagaaaactgaggcacagacaattaagaaggtgcccaagtttgtgcccctaatgaagtggagaaacaagtttcaagcctaagattccaattccggcagcctaactccagaagccacattatgctatcaatgctgtgtgcattcaactgcggcacctgtgtttggaaatttcatacctaaattcctaattgtttttacaaaaagctaaatatttaaatagcagctcgtcgatgaatgctaaatgttttgtgtggtctctgtgtttgcgcttgcaattcaatactgactcgtttccaagcagcacggtggagatgtttccacatttagcctccttgcctgggaagtgaaggttgaatcactcgggaaatgtatgtcacctgttctgtaagtccacgcgctgcggcctattctttgacaagctgtgccccctgctggtctcttcgcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgagtaagtgttgactctcagcgccatttcggagacagacatgccgcctcccttagcccgggtgtatttttgttatttgtccaaaattgatcttgtttgtgtcaaagcattcattcgccagtggcaaaatgtatgaatatcatgctcatttctggcagaagagatccatttctaatccacctttagagcattgtagttaagatgagggacatatttaaaacgaagcataaatttttgaattcctaaaggggcttgattccaagccaagctttggtcttagcacttttcacacattaatttgtttaattctcacaacacccctatgagattagtaggattttagcttcattttacagacgagcaaaccgagtcatagaataacttgcccaagtcaaatggctattaacgcggggatataggattcaaacccaggcagtgggactccccgttgtgctatagattgtgtgatgggttgaggcacctgtgtttggaaacacatgtaatgctaaagccttggacctccccccacaccctgcttacaatctcacctccaaaagatgtataaactaattaaaatcccactttccaaagaaacttctcatgggctgcctagaaagcctttctaaattccacaatgccaggttcacccaccagggggcaaaatggcttttctcaataaattcatgagcctgtgttgggaaggattaaatctccaacttgctgacttcaacaccactgttctgacaactctcagtcacctgttgacatgtagggacaaatcctcatatgcaatttgagaacctcaggccttcagttcactccttccagatgctttctctctctccccacacataagcgtgactgtagcctgagaaagacttggctcacaaagagatctcgtgctcagctggacacattcacacactcttccactctcctttttaaagttcttggggacaggtgaaactggctgccatttgaaaaggtggcctgcacaaccggagttgattttcagacaattaaaatgcatttcttttcctactttgtgtacccacattttaccaggttgaacattgtatggtcaaaaacgtctcagagatatctggcttgagtaagaatcctgaaaagtctgtaataatgttctcattcataaattcctttgaccaacaaatattcattgagcattttatatagcactcacattaggatagtagaaaatactaatatgtatgaattatattcctggccattgaggaacttgtggtctgattgtaaaaacaagatataaagataggaaaagtaattatttaaaataatgatacaagtaggattacaagaaagcccataagtagtgccaaatgatggataagacaataagtacaagttgagaaggaagaaaacataatgatcatgaaatataccatcttaactagtgaagaatatgaatggtcaagtggtgggggtaggttgtcttcctacccttctttggagaggacctagaacaggagaaataactggaatcctcttgaaggtcttcacataatttagaagacactggttagacacataacctagggtaggatttctactccaggatagatttcctagaattcaaaatatgggaccttcttagaagggggtggtagtcgtttctggtgaaattggctctttgtaaaaatgtattaactcagtcccatttgttgttgttttgttgtacatccacgtccatgaatgagaacagcatctccacatcaatactgggcacacttaagagtcatgaatcacacccaattccacaccaccagcaagaaatgttgatggagggagttagacaggaactggctgggacaaaagaactgtgtgtgcctagagaaatagccatggaggaggggagggacagggaagaatggtttggggacatgaaggacttgcatccattcttctaagagaggaagaatatgagcagacagggagattggagaatagaaatcaacaaagggatggagagaaattggtgttggaaatacaaactcggatacgtgagtgactttgaagagattcagaagttggttggacaaaatgtctcttcactttacattggctccaaatgcctccttagcattgtctctagagaatgaggaacagatttctttttaaatgcaaacatgtgtattaatgatcaagtagtgtgtgtcctgagtgtaaattaaaagttacttcctttggggacttgtctccattctctgcctcaccaagggttcatttgttccaacaaacatcagagcaccattttgtcttagataactcatcatcacagaaatgtgaaattaaagatatgctctttattgcagaaaagaatggggattagagacttttcttccctctgctgtgctgcaaagcatgaaagagaagaacataaagaaagcactttcacaccttgtcaaagcaaatcaaaacttggtaccaccgggtaaaaaggtatcacatttccatcttaaaagaaaattataaagagagaggcttgaatgcattttttaaatgtttaaaattagctcatgaataaaatacttagtaccatattttcagaagcagtaacactgtgtaacttttttctaactattaacatgtttctaacactaatgaaaaataagtattcatatagaaacctatttctttctcacaagttatggactccgtactgtagcagggaggtatgtgttcatgtgcccatccaggaaaagtttgcgtagcctctgagaccttgtggatagaagatagaattgtgaaatcattctatgtttcaatcatgcaattgcttactgctcagaccagcttcaatgcacaacagccagcaagaggccctgcaggccagaggccacattaattaaaccagggatcctcaactgtggcgtaattgacatttgggaacagatcattctttgttagggagttacggggaacatcctgtgtattctgggatgtttagcggcacccctggtctctacccacaagatgccagtagcaccctcccgtgatcgtgacaaacaaaaatgtctccagacattgccaaatgtgctcccgggaacaaaatcacccctattgacaaacaatggattcaatcctacctttggagggaagataaaattattgctgtcattcaccatcattagtgttaaaatctttttatgcttttgtttttgttttcattaagtaagagaaacacaaaggaaattttaaaatatactgttggtcagaaaagagaggtatagtttataggtaataaaaagcaaaggattccaggaaccagaaagagaaggagccttaaaatactggatctataaaattggaagcagtcttataactgaagaacactttccaattgatattagctggagaaatttgtgtgactctaatacaaatcactgtttacgtggagaaccattttgtcttagtatctgatttttttaagtcatttttactgggtaaggtacatttatttctatcccctcctcaccccacgacaatttttttttttaagtataatcagtttcaacacactatcagccacctttaactcacttcccaatttcatgggaaggatgtctttgatcacagtgagcattcagcttacagagatgtagcaagatgatgtgggtcaagttctttttaacttcagttctgatttgctggaagctaatttctataattgacttgtgatttttttttcaagcctggcccactcgtaataatttggataactgctataagatcaatcaacctatccatttatccatcactgtcctttaaaggttgtttttctagccaagagtgaatagtttgctttcaaaacaatttgcaaatgctttgcatttttgaaagaagtaggatggatgaatggtgctaagtaacaattacataaagagcagtgcctttatgtatagttaacaaataagttggcaagccatctgcaagtgaaaatagaattttatggtcattgccacttaatggtggtctacaccttgttggaaaatttcaaccttaataaacatccctggcacattcagtatgaaacatggaccttttttttttttaaatcaaatactctttttagtgatatgggatcctacatttttaagtctttgtaaagataacttttatctggataaaatttcatttataaatcacttgtgaaactcaacagattttccaagttgaattaataaaacagagccttatttagcaagttcaaacatttccacaatgattggctctcagaaagttcatttcccccgaaaacttgcaaggactggaagaaacttgagaggggaagtgtaaagggcctgtttagaaggctttgcctagattgcaggtgcgtattcaaaatgattcccacaaagtctgcattcaggtgagtctcttgtgcaatgggaatataggtagacacctcacctttgtccctaattgcaagtagaaggcccactcacctcttgaaatctcccagtgagcagatgttcaatggaacattttatggtcttgttctcacttgctgagtgccctggcccagcatatctatacccatgagtgccccatacattgaccccctaataaataagatttgaatcttgattttatgttccagtccttcatcaggaaaccaaatatgtagcaattttattcctaatgaatagtctttgtcacatctcaacttttcagccgtaaaatcatccttctatcttacacttgttttctgctagtctccagctgaaatggagtcatacccaatagagttaacacctgaggtttcttttctctcctcagctctctgcactacaagccaaggtccattatctcaagttcctcagtgacctacgattgtatgggggccgtgtgttcaaggcaacattagtggtaatttcttttttttttttttttttgctttctcttggaagccacagcagctcattccgcctctgatgacaaaagcaaatcagctgtgaatcttctccagccttcatttctaaccaacttcacaacagtctgaaaatatcagaagaaatgttaaactagataacaccactgcagaatgccctagaaaaagaaatgtgaagaaccgagagaatcaaaggattctaacaatggccttcttttaaatcattgagccagaagttgctttcacagtgaaaaaaggaaaaccaaaaagaaaaaaacaaacctcatttctaaaaggatcttatgattatgaacatactgtgctataacatttactttctaattactcatgatttatcagagcctcaattcagtcatgtatctggttcttctaattggatgatttagtacagtatgacccagaaacactttctaaagaaaatataatcttataaaaataggatcataggttcaagttggcatagcatttcagaggttcagtatttttatgttgtcaacttctctttctcagcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatgtgaaggcaagtttctcaggtgttgacacatggccttgctgtcaacagctaatttctgataacactgcagatgtttacaaggcaggcaaaagtcaatgtgtgcagagcatcacagatgcaatgtggtgcagaaaataatccaccaactcaggcctgagggctccagtcctcactaaatcgctgtgtgattgggaacaggtcgctataattctctgcgctcaatttttttattcatacgtgagaaagcaagctacataatttctaggtcccttctgactttagaatatgtgatttctaggtatagagtaggggaaacttttctgaactaactttctagaatatatgactcaaatcaagagggagatttttcccaactttctttagaattctcactccctttgcttacgttaggtccatatgtgtttattcttttggaaaagcttgatgttttagttcatctgtcttctcatatggtagcaattggtactgactgaacatctggctcctatgaatgtcatggccattccatttaaaacaaaaatctggccaggtgcggtggctgatgcctgtaatctcagcactttgggaggccgaggcgggcggatcacgaggtcaagagttcaagaccaggctgaccaacatggtgaaaccccatctctactaaaaatacaaaaattagccgggcgtggtggcgtgcacctgtaatcccagctactcaggaggctgaggcaggagaattgcttgaacccagaggtggaggttccagtgagccgagatcgtgccattgaacttcagcctgggtaacagagcgagactccatctcaaaaaaaaaaaaaaaacacaaaaatctgagatggtccacaaagggcaaaactctactcccaaaagagaataggaaatagtccaggttcctggtctccaccttcttttcccagtagagatgagttattggattttggcaatggcagtatttctactgtttctatgaagaaaaggcacgggaacaaatggagatagtgactccacaaaggagacaacaccagcctggagggtgctctgaaaatagccagggaggacccagccctacctgcctccccactagggtgctggtgtgggaggagtggattaacagccattgagaatgtggcaaagcgtttctacaaagcacatcagaatacactagagagctctgcagtgggaacagatgatcacgaaagagagaatgtggagctcagacatgctggctgtgacctgtaggacttcatgggctggatccagagggttttcatggcaagctgaaagtgtgaggatagacttggaatgctaatcctactccatgagcaaagaggctgagagaaatagccccatcacagagaaaggtggatgaaagggtgaactggatgcagttattacagatccgatgacagagataatctgtcctaaacagaaatgagtgtcgtgcccggccgatggcgtcctgcctatataaaataatgatgcggtgccttggaggctgaggggagacctcaactgaagtggaaggaaaggcagttcaacaagtagtacaggggctttggcaggaaagttaaattctacgagctgggggcgctgaatccgcccagtgtcctatacctaggagtgaaagcaagaggcctgctgtcttgctgtctttgtgcctctcttcatatctgctttttcttgcttccttatttctctctcactcactttttctctttcaacaaaaacacatccttcctaactcaatgagaaaaattgcttcatccaacacttttttttccctataagctccaaatctatgtccaattgtataataaccttattgtttcaagagagttttagtgaggccttttctcaactcccatctgttttaccctcctgtaaatttacgatttcatctagaagcaactttttactggatctctggcacttttcattcagtcttagcagtaatttccacttgaattttacctctaacactaatttacaccgtgaacccaaaacttaatcttcctgtaattttcagattgtgagttcactgctggtaactgaggtaactggtaacttaactagttaatgttaatttaccagtttaacatgtttaattgtctttaaatgttaaaaatgttaattatttgggaagaagacaatctcattttttttcatttcaatatgactgggggtccaggtgcggtggctcacaccagcaatcccagcactttgggaggctgaggtgggcggatcatttgagatcaggagttggagaacagcctggccaacatggtgaagccccgtctctactaaaaatacaaaaattagcctggcgcggtggtgcatgcctgtgatcccaactattccggaggctgaggcataagaatcgcttaaacccaggaggtggaggttgcagtgagccaagttcacgccactgcactccagtctcggcgacagagcgagaccctgtctcaaatatagatagacagatagatagatagacagacatatatatatatgacttggaagagattcaaaatgtccaggctttttagagggtgtgtcctgaatgtttttcagtaaggcactttgtgttatccttggctttttctcctgctttgggtttctcccatgaaatgtttgttcaataactcctttttccataagcataaatgcagctgttgacactccagggatgttattaagaatggatggctttaaccaaagtgttctcttttgtgtagcctatcacgcttctgatggaatcctcagatgccatgaacctggcctgcttgacggctggatactaccggctgcttgttgattccaggaggtcgatatttaacatggccaacaagaaaaacacagcgacccaggaaacaggtattctcttcctgaactcatcaagcactgacctccctgcaaacaccccacctgacaacaataataaggatgttttctgaaaagttaaggccaggcgcggtggctcacgcctgtaatcctggcactttgggaggccaaggcaggcggatcacgaggtcaggctttcgagaccagcctgaccaacatggtgaaacaccatctctactaaaaatacaaaaattagctgggcatagtggcacgcacctgtaatctcagctattcgggaggctgaggcaggagaatcacttgaacctgggaggcagaggttgcagtgagccgagatcgcaccactgcactccaatctgggtgacagagtgagactctgtctcaaaataaattaattaattaaaattaaaattaaaaaaagttaaaattgtacccacaaaaaaatcaaatgtccaaattcaatgccaaaagccttcagatacctgtgatgtgggctaattgttaaaaagaaaaatgctgatttctcaccacatttgacacatcactcagaagtgtcagggtgcttgctccaaccttgattttattatcatgaaagtctctatggctgggttttcatggccttactcttacagaggtcagggccagaggactaatgatggaatgcccgaacacgagttgtgagcccctgctttagggctggtctctcctgatggtgtcctaggcccgggtgtctgggagcctcctccctgtagtcagacttatgcccaggattctgggaactttacaaacaggaagacgtggttattgcctagcactcggacttgggaacactagaagaaaattcttccacattggcagccatcttggatccataataggagcaccaagatggcaaagacatcaaataattcagttcacctacttgacagaaaaaaagatccccacaacgaggacagggaaggctgcaaatgttaaattgattattcctttgacagtaggtggttttcattggttttagaacattttttcttcagttacttaagcattttactccatctacagtggatgcttagtaaatgtcactgatggacagatgccaccattctaggcacagccactgagccattaaaaaaaagtataatcagagtttccataattggggtttcttttaaaagaaaggggaattcttaaaaacaaattttactgttgcttctctttttctctcccttccccccaaccctgccccccgccccaagtccccggcatttatcagagaaaatgaggggagaaaaaaagggaaggaagttctgtcactgttaaattgagcataaacatcaatctttattccataaatatactgcaatatgtagacacacttaaacacgcatacagactcacacacagtttattatgatggccaggtgaatggaagcagctcagtcatagaaaaagggaagctagaaacaaggagcaatggataaagcatgttagaaggcaacacctggactttcaagtcaaataaatctgagatttaatccagtcccatcttgaggtatctgattttttttaatttctctgagcttgagtttcttcatttgtaaaatgggatttaaaaactagcttgcaagggttagaaaaataatctaggtacatcatctaaaatgatgctcagcatttctattaataattagcagtgaaaaaaaaaaaaacagaggcagaaagaacccagaatgaaagagatagaagccagatgcagtggttcacgcctataatcccagtgctttgggaggctgaggcaggaggatcacttgagcacaggagtttgagatcagactgggcaacacagggagacatcgtctctacaaaaaatataaaaattagccaggtgtggtggcacacgcctatagtcctagctacacgggaggctgaggtgggaggaaaccttgagcctaggaggtcaacgcggctgtgagctatgactacgccactacactctggcctaggtgacagagcaaaaccctgtctcaaaaataagtaaataaataaattagaacgtgatagaaacacagaaaggagagaaagacagaacatgaggcaaagaaagctcctgagagacacaaatgtttaaaaataaatatagaaaaagaaagaacaaaaaaggaggtgataggcgtgcactgggtttggcagtaaacatttttatgaccacatgttttcattgagctaggagatttagagcaatttaatgctgaccttagaaattccaaagaaggctgggcatggtggctcatgcctgtagtctcagcacttggggagtccgaggcgggtggatcacttgaatccaggagcttgagaccagcctgagcaacaaagtgagacactgtatccacgaaaaaaatttaaaaactagccaggtgtggtggcatacacctgtggtcccagctactttggacattgaggtgggaggatcatgcaagcccgggaggtcaaggctttagtgagccaagcacactattgcactccagcctccaggctggctgacaaagcaagatcctgtgtctaaaagaaaaaaaaaaaagaaaagtaaagaaattccaaagagcagttcagcaatttgacacaattgtttcccactggaaaaccaatttttggctttttattttcaaattttaaagtttatcttgaaaataaatcctttcctcatagactgtaaagattgtagaggtgtatgaagaaaaccaaagctactattctaaacatgcttacagtaataagggtctccactctgtccaattcatagtgacccacaacataaggtttaatagaacttagaggcaaaaacatagttacaaaaagtattattactgtggggaaagaatgggacttcagcctcaccatcatttctcccggtttcaaatacctatccccactctcaaagatacagggcgggaggtaggtggagagagagagagagagagagagacagagagagagaagcgaggataacagagagagagcacactccaaaaagaaactgatagacctaggttgagcagcagtctgggctcagcatactctaagggctgaaagtactctcttctcttcagaaactcccaaaagatctgagagccaagaaatacagagcggaagtcccatcaggccagttcttccccagtccattctctccttccactctgtaggagactgggccacagaatagatcccagcccccaaaccacattcttccttgtctccaaaattattccaggaagccaaatcagtagacccttctggaaggaagccagattgaacacatattttcttctcacctcaaattgatcccagatcttagtcaagatatctaataagaaacagcccccatttcttcttctctatcttgaaaattagccttcaagcactttcaaaatccctggccccacatatgtatgcatctctgggctttaggagggtctcagtaagtatccatcaacttgctttgagcctgctgacctattcagttttcttgttcatctaaatcagagttggcaaaactatggtcaatgggccaaatcatgttcttgcaaataaagttttattggaactcaaccacacacattgttttactttcctaaggctgctggaacaaattcttacaaacttgggagctttaaacaacataagtttatcctcccacagttttggaggccacaagttcaaaaccagaatgttgatagggccatgctcccttcaaaggctttaggggaggatttctcgttaccgcctcctgcttctggtggccgccagcattccttgtggctgcttaactccagtgtctgcctctgtcttcacatggccttcccctcttctctatgtggcccaaatctctctctgccattgaatttagggcccataaagataattaagataatctcatctcaagatccttaacgttgcaagacactttttctaaataaggtcacattcacagagtggacatatcttttgggggccaccattcaactcatacacccatctgtttatgtagcatctatggctactttcatattaaaacagctaagttgagtagttgctcaattgaatggttggcccacaaaaccaaaatatttactatctgggcctccctttacagaaaatgtttgccaagccctaaacccgcgttacaatgcaactttgctgaactagtcttcctcctgcaacaatccacactcacacacacacttccccccacacgcacacccagtcataatccaaattgttgttaataaaataatgctgaacccccacaaggtttatttattgtatggtaagatgcaaatatggccagtgtataattcaatgtcttcaaaattatatctcttattgttcatgaaaatacatgaatttattaaaatgaccctgaacactgttcagcattaagtccattgcatgatttgcggggagcaaaaatctcttaggtaaaactgcacttttttcccatatgtcttgcacatctgatgtcagttatccaaacttgtgctgggggcagtttgagggaacagatgggagaatagtatggccctaaaattttctggaaatgttgcctctggaatctacaaggcaatatcaacagaatgacccagttctctgtcttgttaaatatcagagcaaatctccacatcaaaattccagattgaaagatgcttgaagagcaaacaaaataatagtatttaaattggggttttgtaattttaatccatgaggaacatgaaacaaattttcaggagttcctatgatacaaacaaaaattgaaattaatctaaatattaattatgcttagaaattacagagaaaagtacgttacctgtgaccatgccaccttatgcattttatacacacacacacacatatacacatgggcatgcatgctgacatttatacatgaatattttaacatccactaggatatcaaaagactgaagatagaagttttgtactatcattacaacatttatcttaatttcctaaaaactatggtaaaactctgacgatccttgaccgtctctgaattcaatgaggaaaacactcaatatcttcctccatgaagtagggaatattaaatctcaccttacaaggaaaagaacaattaatgttctggaataacggcctattgaaatctcacctttaagggtaaaagacatgttgtatatttacatttgtagatatgaatgaagccttttaataatagaaccaagggtcagatggaattaagctatacttccctacccccagatggtattacattttatcaaatagcaattacagtttatgcagtatcaattttgttaaggtcggttctcctaacccaaggaattcttacacctgaagcctaaatcaataagtactatatttgggtagttgaaaaactgtatttacataagtgatgctacaagccattaagttaaaaaacagagacgagcctcccacccccgccccacccaaaaccagacagtacagtaatgtgtctttgcgtgattctttctctttaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggttctttcacaattgttacattcattcactgataaccatatcattccatccttccaagccatttgcccctggagtcctgttacgtggtgttctccatttcacacatgtcccatttcataaatgtgctgaaactgccatcatgggtttttttgtgtgtatgtgatttcctttgttatttttttttaaaaacataaggcacatctccccccacccccatttctggaaaaactgcaataaactcagagtccttactgaaaagggaaaaacttggtattttgttttagtaataacgagtcccattttcttacatgtctccaagtgcctctgatgcatccattaatcagttcttgttttttacggcatgcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacaggtacagcaatgatggatttagcactttgtatgacatgccaagagcatgtaaaccatatttacaacaaacttaaaaacgtaatgtctggaagaaaagtaaaaggtagaattttaaaaggccacagaactgtaaagtaccaatcattgatcccctggtatttaataaatactaaagattataaaggtgaaaatggcatttgctctttataatcttactctgtgcttgctttcagaattggatggggcaatatgtttttcctaaattctaaatgcagatgtttagcaatgcccagtgtgacttttagttatatgatagtattgcttagagtcacataacagtttgattttcttcccaagacatctgagttctaattctgccatttcattattgagggacaaggaaggataagagagcagggtatcagggagattggaggggtttggagagatcatttgcctttcggcaatcttactgattcctccctactctgtaagactgctctatatggatgttctgaagtgtcttgcataccccagtgtcaggaagattttgaggctattcctgatgagctgctttattttccccaaaataataaagtgtaaacacacgtagaaaaaagaacacatccaccttctgtatcccaccttcaccactccaccactcaatggcaggcattcccctcaccgatccacttggctggccatcacatggcaaaagcagatactctttcatacttttatgtttcaaattatgtcatcaatagtgtcttttccatacaggtcaatggaagttagtgacatcttatattggtcattttctattcctgttcttttaagattttctactttctcaaaacccaccactggctttacctcctttggaaaagctgtctgtgaatatcacctaactcatcacccaactgcatctttacctctaaactaagtcacactgtttaatccttcatgatttataaagaactttcacctgagttacctcttgcttctcacaaaaattctgtgagatggggattatttgcttcacatgacagcttttcttaaagaaaaaaaaaaatgttgaacaactggcccagtgtttcaacttcagacttttaccaggcaaacctcatgctgacttcttaaaaagattcacttatttaatttgcactaattaaattaggccacttctttaaaagaaagaaaggaaagaaaggaaaggaaaggaaaggaaaggaaaggaaaggaaaggaaaggaaaggaaaggaaagaaagaaagaaagaaagaaagaaagaaagagaaagaaagaaaggaggaagaaagaaagaaaagaaaagaaaagtaacaatgccagatttaacctaattcccttgaaatgaaacttaatatctccaatatatttgaataatctatacacagttgttttctgtgtctaagctttgatgggtagatattgggagtaaggcaattcatgaaatccctgaaaatgtttgggatttctagacaattccaaatgaatcagcagttccagaaataacagattccagtattttcttgatattcattaaaatggaaatttgttatgagatatcaagaggcagtctttggaaagcagggtgaccttagcatcggcagcccttccagactacaaccttgagaaatgacagacatcatgtagagatgtagtaaaaatgacctcccaggagatgcttaatgattctctctgtttttctactacccctagtgtagctttgacagagcctgggaaggagagacgaggaggcatgccttcagcttggtctcaacatcctgaagctgatcccatcctgctaccatcaaacattcactcggaatcaaaggtgccaattccaaatcaagaccctaatgatttctcccaagcaaatcaggcatacggagaggctgtgagctggcggccaccggatctgagaggggggagcctcaggacacctcccagccagaaggctctgagacatagcagcagtatcctctccggatctgtcgatttggagaccttccgagagagaaccaagggtgcagtcagcttaaagtgtccaggcatcacagaagcacaggaggccagttctgaaaggcgagcagaactccccctggggaggaagctcaccaaaagtttttcccaaagctcaatgcacttgagctctgaggggaggtttcacaaaaggtccccagtggctcataaagactcaaagctgtataggacattacccttgcggaagctggagggcagcaattggagatgccggggacccttcagctattgcttcctgaaccgagggcaggatgaagatggtgaggaagaagaggagaggggagaggccaccgtccaggtctcttgcctctatagaccacagatgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcttttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcgtaagcacactgacacgttctctcaagaggcttttaaacaaataaatatggaagtcacgtcataatctacctttgcaaagccatacatgaacttttatttactttgtgtgtatgatgaacagatgtctcctttcttctctctgtatattttgttattttatataaaataggagataaaagtcacattgatgaaatgttgaaatgtactaatcagatgtattctgtttatattatacatatatatacacgtaaaagaaatatccaagaaagtgatgacatttggctatttttcatatagttaaaactccaggtatatgatgtgaaattttaaattctaccatgttagagcaaaacaatgaatcctatcccctttctttccaagtagctacttggaaaccatatcattcatatttagaagtaaaacacaaaacaaaaaagagagagaaaagaaaagaaatcacaatgtatataaaacagtacttatgttttaaaattatgatttttaagcattggaaatagcaaaaagacatttaaaattcaagaagctattatgaattactagagaatatatctgtaataaattaattttttgctcatagtatttggttactggatgctttcttccaagaatcccacatatttaatttgggtttttgctactggggctacaaattggtggggatggattctactgtgtcagcacaaatgctcttcacagtggttctagcatttaaaaaacttcccggggagaagaacagaggggatgatgggcagtttcctaggtaacacctagagttatagaatatctcattacataaaatgtatggaattaataataccaaaattaattatttgatggaaagatctgctttgactaaatgtcaaaaatctgcaaaccaaagacattatcttcccctcatcccaactcaactacgaaacttaaaattccctttagagtgataggacatttagtaaagtatttgcaaacttaaaaaaaggaacatttaatgatcatcaaaattaagtacagattcagtaatgtagaccagaccacacaccagcacctgtgagtctcatctcagatcacagctctcagcatagggcttcatgcatcaccgcctctacagaggctaaggctgccagtcaaatttggaattatagcgtagtactgggacaaaatctcaaatcttggatgttccagaaaatcagggagagatggctactgtaatcatgggagccatgagtaaatagttaagtatttattaaataaatacttaatctggattggctgataaaaatatgaaatctgaaaaaaaaaagaaagaaatggaagtggtatatttgaccagttcaagtgaaaccaatggaatgcaaagaactttccaggactgtcacatctctaaaagtaccctgcagtcataaaataaaatcgatatgtatatatgtatttcctgggtcattcagtgctcaagttacatgcactcctacttagacaggtggctccttaagaacatgatgggagtacaccaggtgcaaatatttctacttttgtagcctgctgagaaggagtcataacacagtccacaattgcaatctctctctagtcagccattccacagggactcaacaacaaaagccgcacgtggttatggatggcagcaaaggaaaggagtttaggtgtgtgttattataaataatgtttaactaaataataaaacattatttcattacaattataattataaatattggtgttttgatattgagagatattagtggtgtttactgtggaaaatcttagtaaatatcattctgtgtactaaaatcctaacctattaataggatgtgtgccctatgtcagacagtgtgctaagcatattaactatattatctcatttaatcatcacaacaatctgctggtttggacactattctctctggaggcaatatggatgagttcttacggatatggggtttggggtcagaaacatcttgattaaaattttgactctgccattttctagcccttttatgttgggaaagctactttttctagtctcaatttcctcataataaaatgaaaatcaattataagatcgatttccatagggttgtcatgagttttgagtaaaaatgtgtatgtaaagttcttaccacaatacctggcagagagtaagtattcaattaatgttagctattattatcatcataatcgttgtgttaaatatattgcccaagataatatgtgggggaatgtttgttttatatgcatattgtatcctgactgtgtgcagaacacattatgtgtattgcatatatgtaaaagaagtgtacaaggaagtggccatccttgttcaagttacgtatctagttagaacaacttcccagtccattggagttctttgagaagcctcagggaagtagctctgggtccttctaatcaacctcccattactgcgccagtaagtttctgtttcttataaataaactctttgctattcagaaaacctcaaggggcccccacattcactaagcatggggctcctaactggggtccaggtccatagagtgtaggaagaacatattagaacaatacttgtgcttatttttatctagcttttttatgtttgtgtatgttttataatggcataatagtacaatggtacatgtacataattttaaataaataaatgaatgaatg

SEQ ID NO: 3046 - DNA, 586057 bp, human
ggaggcagctgcagtgctgcgaggggtgcgtgcgcgtgtgcccagctcgcctgccgtctcccggctccgtctgcgctcctcggtgcgtggggcacgagggtccgagggccgggaagccagagcagcgcctctcgcccaggcctcgctttctctggacgcccggcagtccccggggctagagcgcacggggcggggcgcgagacccgggccgcgctccccgcccccgcctcttgcgccctgcctggctccctctccattgagttttcctgcctcgggtgcctatcaatggtcctgctcggggatgcacacgcagctcgcggccggaggggggtagcagccgccgcctccaggtgcaggttctctccggccgccgccgccacccgctgtcgccgcgactcgagccccgggcgcactgaggtcttggccatggggctgcggaggctgctgttgctggcgtgagaaggggcgacggagttgtcgcgctcgggggtccccagctgcctgcatggatgtcttcagctttgtgaagattgcaaagctttcgaggtaggggctgcgcgggttccgtttgcacccagggccgctgccgcgggcaacttggtgccttatttttcgggaggctgggtagaggcaaaagctggaaagcgcgacggggcttaagacaaacgaagtggccgggggcttccacgttcaacttatttctcactggctgctgaggcttgtgtagcggcgggtgtagaccacacacagagaggtacatacatgccctcaccaacacaccgacattcacgacagtttgttttccctaaggaaaagccccagcggtgtttggggtcccatgtataattcagggctaagagaagatggttgtaattgctactgctagggaaacccagaagtgcttggagcttgggtgcctgccttccaagctgcaaagaccaaaagtgccgccttcccccaactcctaaattacacctccacacctccacaaagtcagctcctagattgaccaggtgctcccaacggtaacctagatggcgaagtcatgtagatagaagagaaagactttcagcctttttttttttggggggggggtaactatattcttaagcctcgaaagatttagaaattttcttctaagtggccatgttgttaaaacagtagctaaaactaaatcatcgattcagacatttttgggtagtactgataaaagaggaacatttccacgcttgggccgcctaggtgttgcctggccagagcactcctccaggtcttctgccctgcttatgcttccaaagtcttcgtttgagccacagagtaaggtttgtgctgcttgctatgtggcattaattgggaagagcccaataggagtggtcttagaaaaccatgcccaaccttctctgcccctggagctctttatagcagctaccaccaggacgtaggaggtagacagttgggtttttccaggatgtagcttaaaaacttacttgcaatatggacagaataatcccaggttttccttcagtcctgagtgtcagagtgagatgtgttgattgcatcaggcagggatgagcagcttccaatagtcagaggtagaaacgtatgttgactttgctttattaaattacattagaccacttcagaaaggttctgtttggatgttgccattctctccgacatctacaggtctttgttctgcctgcccatctccaccttccctttctactaacatgggtcagtcttcatgccactagcagatttccccaggcagaaaggcccagtgcagcttactctaagtagactggagatacgcagttgatgggtaaatacctgtgtcttagagcagctcaggaagaggtgttgtcctgcagatcagaagactgatgtgttaagcagtggatgattgtggtgtggccaattgtttgctttcaagctgatctcatagagggccattgcttcacaccactattctattaacttcctgcatgcttctgcctagggctagtttctaaacagctgtcaaatattgaaccatggttgggaagcagctgtgtgcaagtttagaggctaagtggtaccctccgtgtgatggacagagatactgctaaagggaaagggaagttcaaccaatagtatagttcaaagtaaccaggatactttttggtggcctcagatgctaaaaacagtttaacaaaacatctagagcctcgatttagtccttaaacttaggaactttggagaggacagtgtcatgtgtcagtgaaaagatgtttcatattctttttactaaattctaggatgcctacatgatattcacaaatctgagtttttgcaaaactcaagcaaggctgtggggagagtggtatcttattttaaagagagtttaaaatttagtaaatgagtgtgagtttcactttctatccttaatgtgatccagtagagtgtttattctaaagacagaaggtgcaaatgttctgagctgatgtgccgattaagaaatcttccatccatagaattcttctttttctttagtgtgagcccgaggatggtccccgtgctgagatagaagtacctttagagggtcatcagcatgtaaaaacacatgtttgcagttgcttgtttctgccttgggaggaagaaagtcttgtatgtgttttaaacactgttacagaaagcaagttcttttctcaaaggtgaagtatgaaagtgcttatactgcaggattttcctgatttcagaatggataatcttcctaaaggatttagctttgatcagcatggttacttcagtgcttaaaattctcttggtttagaggcaaacacatgtagttaccctgggtacctggccttacctttggttcctacaaacttgagcttctaaatgttaattcagaaggcatatcttggaagtgatatttgcttagtgtcctatctgtgagtaaagacagtgtaattacagagaattccaagagaatattattcgacactggaataaataaactgcatattttgactttttagagtgtctacatttaactattcgtttccagaatctatacccttttaatcgtgggaaaaatcagaattgacagtgcccctcaataacccagtaccattaaaaaaaaattgctgccaagtgttggaattgctggtaagtagttggcaccctttacatcatcagttagagttatgacccttgattgcatccttcgtgggtggcacagtgtgtcatggttctatctgaagatggtttttcccgttcttctaattttctggttcttaaactgcttgatagtttacatgcagttttacttcactgtttccttggtaacagttctatattattttccatccttgtagatgagagcattacagatgattgccttataaaccagtaatagtataaaaacaggcatatatttttattgttactgctctttgtattgactattttatttgtaaagcagatgcattctttcaaatgtttatagaagaatgcagtccagtagaaaaacatatgattatgccccttttgccagagggagatgatttgagatccaaaactcatagggatgttattaaattgagtgatatgttcatagattaagtccctgatttggcttcttttctttaagcaaaacggtagacttgatgataatgattgagtccccactgttgatatgatgatttcttatagtagtaggtaaatttggggaatgctttactttgcattttcttatagttgcatgggttattttgtggtatatagcagtgactaatatctaatattagaatgctaattttcttacaagtatcttatatttgaggaaaaatacaaaatacatatgtatagtttccttagatttttatgtcaagtccatttagatactactaaacttctgtcttttacctttatcttattcagaattaaatatttcccagggaaaaggggaagttaaagaagtaatgcaaaaggtcagggtttttcccatatcccctatttttactgagtaattgtattaatattgctgataatagtgagctctggaggctagcaatgaaaaaaccccaaagactctggatttgaattttattaaaaatgctacttgctcatcttctgaatcctttctaagttctgctgatttttgtgactgtcaggaggtgaaatgatgaacagtttcataacagaactagattcctgttttaggaatatttaactctagtttcccaagagttgctagtttgaagctgtgaaagtctagtcgctcgcagttctgggaagaaggcgtctaggtcaggctttgtaccatttcaagcatctctctctctctctcttattgtctggggcaagtgagtttcaccttcttgctatcagaatttggtacagactgacagctgcagtgaaacttacttgtactttaaatgcatgacctggaaagtctcactttctgcttatggtccttccagctgttcattctccccctttacatacacatacactgttcaactttagtactttgttatttcatttgaggttaaccgtggaagtttagctgtaagagaatgtacattattggtgaactagaaatgtatctttaaggaatgaacttgaaaccactggtttcacacttggctcaataagaaaactcaagaccgtttaaaatctttgtttaagcataccgtcctgaaatctaccactgttaccatcaaatgatctttaatcttgaaagctaatcatagcaggaaaagaaaattatgaataggctaaaacaggggttggcatactgtggcctatgagccaaatctggcttgctgactgttatggcatagcctgtgagcaaagaatggtttctttatttttaaatggttcaaaaatatcaaaaaaagaataatatgaaattaaaatttcagtgtccataaataaagttttattggaacacatgtccattcatttatgtattatctatggctgcatttgcctgacaacagcaaagttgaatagatgccacagagaccttatggcctacaaagcctaaaatatttactctctggctctttacagaaaaagttaactgacccctgggttaaacaatgcctttttcctgttttctcttctttatcattagcagcacacatgtgggcacacacatgtcaaatcgagcatattataataaatacttgaattcactgacccctgggttaaacaatgccttttcctgttttcgcttctttatcattatcagcacacatgcgggcacacacgtcaaattgagcatattataataaatacttgaattcactaatgcacattaccagttaatatagaccttatctttattgaaacttctgatctcaaattacttcttgaactgttggaaactgaccattagaagtggacataattgtcctactaatttgttgcacttggaaaaattatgcatgcttattctttggtcactaagttgacctgatatttttggggagctggagagttgcttgttaaggtgatgtttgccttccataaatatccagttcaaaatgtatggaaaaagaatgggtgatactacttgtatagcctcaaccaatgtgtgctggtgaactgataatcaagtcaacaggagaatgcctagtatttccttacagtacacttgagccatctggtcctaatggctaatgaccttcactaatctgtttccaaatggaaataaaaccagataagtggatttagttgtagtcagaggaatggaggtaggctgtatcaatttggagttgagtttaatctaactttcctatgatttgactgagagcattataatgagaaatcatagactacctttagttctttacagcaaaaacatatatcaaaagtatgctgccttgcttctgagtaatttaggtcattatgtacttaagctctgaaaattatcttgaagaaatctaagccttagttttagataacaaagttaacattcccatttttttttttttcctggcaaagagatgagaagggttttctgccagaactgttctttcagaaatatattttcaagtatggtttacagaatttggcataagataaatagtctatactaaataattagtgagtgaagtcatatacaattcattctaacatttgttgcaaacaaattgtcatatttgtttagctgaacaattaccatgtcagtacttctttattgaatataacggaatacaatgtacatgttaaaagtaaatagcctgctcttggacttggtctcagagaataaacttttatttctgtttttacatttgaagtatatatatattatatatataaaatataatatatatatttggtgattgatggttaaaaagtcatcaacttgtatttccaaggagtctctgttttactgctttaagctcaataagcaaagttatgatgatattgaaatgggtttttatagatgtcagtaagtttttattttagaaagtcttttttgaaagctaggaaaacacaatcatttctatgaaagaaatgtttccaaagtttgaaaatgaaaagtaatttccctgcaattacaatttactatagggttttaatttttattttggttattttttataggcttcacaagttttatgagatttgcttaattgaaaataagaacatgattacctgacaaagatgaggttcaaagaaagcagtaggcaaaagttcataaaattaatggtaaaattttcctaatgaatgtaggaatgagtgtatttttctattgaactggcacagttatttatctggtcagagactggtgtgggggagaacacgcggccatctggctgattcaaggctgttgtattgattcaacattggataacatactgaccatggtgattttacaatggttcctgtaactggagtcctggatatttgtctcttttgaagttcacgatccaagtcaccggtctttaccctagtacaggagcagttagcagtctcagctatacagtggtggagtctggaattagttttggtgtaaatcccaaacatgcccaactgaattgtggctcagggcgatgtcctgcttcatggcctagggccagggctggcaaacttaacccatctgatgtgtttacttattttagaaagctttatgaccatttttataaataaagttttatttaaacacagccatgcccttttgtttgtatactgtggctgctcttgggagagttggatagctgtgacagaaaccacatggcttgcaaagcctaaaatatttactctctgccctttacatgggtattttactgttcttctttgatctctctgcccagtactcaaatttccctttggggcagtctgggtgtcagccttctttactagcagggggaaggatggatatggttggagattcaccctgaacacagtcacccttgccagccccgctctgggggacttaaactgtcagcacttacaataccacttgtaggttaacttagaagctttgtaaagtgcaaattggatcctccctgtcccctccgtctacatacttttgaggggaaaatccatattctttatccttacccttttgggtttggcctgattcacttggttcctttgagaactgtatttctcgggctgggcgcggtggctcacgcctgtaatcccaacactttgggaggccgaggtgggcggatcacaaggtcaggagatcgagaccatcctggctaacacggtcaaaccccgtctctactaaaaatacaaaaaaattagccgggcgtggtggcgggcgcttgtagtctcagctactcgggaggctgaggcaggagaatagcttgaatctgggaggcgaagcttgcagtgagctgagattgcgccactgtgcttccaacctgggcaacagaacgagactctgtctcaaaaaaaaaaagaaaagaaaaagagaaccatatttctctgaacttgttattcctcctttccagccttaacttcctactcaacaccaaacacacacgtgtatacacacacatacagagacacacacacacacacatctacccctaaccatgttgaattttttagaagtcctaaaaagtgccacaccctgagcctttgcataaactcttcattttgtctggaacaatctttatcttgcctcctttacacctgaaaaattcctatctgtcttttatatttcagcttttaatctaaggttgttccatgtcaccttctccaacctcccaatcctgggttaaatagctcgactgacatcttttattagcgaagataatttcactgctttaacagatcaatccctcaatttttgtggcccatctcttgtttgcttgatacacaaaacaggcattcctgatggtgtgggggagctctgatatgctcagccattctgagaacctgtaagataggactatctcatcttcagtatgctatcgaaggtttcctgcacatcagtgttcagctgacagatgaggggagagaatggtagaagattgggtgacaggtttttaagggctatgcccagaatcaaagtataccattctaccctcattccattaggcagaactctgaccctatgtaactgtgaggcaagctgggaagtttagtgccactgtgtaccctatctgtgctggacatgtcatgccctgctcttttcacaacatttcttcattgtgtggtagattgtaattttgttcccaattcttaaatcttccctgaatccaagccttttccatgtgacattatagttctacttcctagaggtagagggtacctctttgccccattgctgttgggcttggccaagtaacttgctttggccagtggaatatggacagaagtcacagggtatctgttttggtacaagtttttggtaggagaatgcctttaaggtattgtacgtttctaaaaaagaatgtaaaaaagcaaaaagctcttaacattgctatatgaagaactgcctagtttaacctgttggtcctagaagctagattcacatggaccagcaccatcaggcaaacctgtgagcatgaaaacagatgcttattcttgtatgacactgtgttatgcagcattgttgtggcaatggctgactggtatagatggtattataattgagtccagttttgatctgtgtctcatttatgaactcttcaagggcaaatcccctggtattaaacctccttggtttatagtagatttaaggataccttgtttcattgcactctggtttattggtgctttatagatactgcactttctacaaattgaaggtttgtgccaactccacatcaagcaatctgtcagcaccattttttcaacagcatgtgctcatttcgtgtttctgtgtcatatttttcattattattattatatctgttatggtgatgtgtgatcagtaatctttgatgttactattggaattgtttgatgttactattgcaattgttttgggctgtcatgaaccacacatataagatggcaaacttaattgataaatgttgtgtgtgttctgactgctgtaccaactagccattccctcatgtctctccctttcctcaggctcccctgttccttgagacataacaatattgaaatcaggccaattaataaccctacagtagcctgcaagtgttcaagttaaaggaagagttgtacatctctcactttaaattgaaagccagaaataattaagtttggtacggaaggcatgttgaaagctgagataggccaaaaactagacctcttgtgccaaacagttcgccaaactgtgactacaaaggaaaagctcttgaaggaaattaaaagtgctactccaggaaacacacaaacgataagaaagtgaaacagccttattactgatatggagaaagtttgagtggtctggatagaagatcaaaccagccacaacattccgttaagccaaagcctaatccagagcaagactcttaactctcttaaattctgcgaaggctgagaaaagtgaggaagctgcagataaaacgtttgaagctagcagggattagtttgtgaggcttaaggaaagatgctgtctccataacatgaaagtacaaggtaaagcggcaagtgctaatggaaaagctgcagcaaattatccagaagacctagctaagatcactgatgaagatgactacactaaaccgcagattttcagtgtagactaaccttcaattggaagaagatgccatctaggactttcatagctagagaagaaaagtcaatgcctggcttcaaagcttgaaaggacaggctgactctcttttttggagttaatgcagctggcgactttaagttaaggctaatgctcatttgccattccacaacttctagagcccttaagaattatgctaactctactctgcttgtgctctaggaatggaaccacaaagcctggatgacagtacatctgtttacagcatggtttactgaatattttaagcacactgttgagacttatattcaggaaaaatagattcctttcaaaatattactgcccattgacaatgtacctggtcacccaagtgctctgagggagatgtacaaggagactaatattgttttcatgcccgttaacacaaaatttgttctgcagcccagtgatcaatgagtaattttgacttccaagtctcattatttaaggaatttggctgatctgaaggtagtgagttatctcaattgattgttcacagtcagttagagattgaatttcttgttctactcttttccacattctcagtactacacttgactagttttaaaaaaagagatatattttgtatggttatagctgctatagagagtgattcctctgatgaatttgggcaaagtaaatggcaaaccttctggaaaggattcaccattctagatgccattaagaacattgatgacttatgggaggatgtcaaaatgtcattaacaggagtttagaagaagttgattccaaccctcatagatggctttgagaggttcaagacttcagtgcaggaagtaactgcagatgttgtggaaatagcaagagagctagacttagtggagccttaagatgggactgaattgccgcaatctcatcatcaaacttgaatggattaagggttgcttcttatggatgagcaaataaagtggtttcttgagatagattctactcctggtgaaggtgctgtgagcattgttgaaataaaaacaatgaatttagaatatgacacaaacttagttgataaagaagcagcagggtgtgagaggattgactccaattttgaaagaagttctgtgagtaaaatactatcaaacagcatcacatgctacagagaaatctttcatgaaagagtcagtcaacacagcaaacttcattgttgtcttattttgaaacattgccacagccaccccagccttcagcaaccaccaccttgatgagtcagcatccatcaacatggaggcaagaccctccaccagcagaaatatgacgactcactaaaggcttagatgatcattagcatatttttaacaataaagtatttataaactaaggtatgccattgttcttttagacataatgctatttcacacttaataaactacaatatagtataaatgtaacttttatatgcactgggaaaccaaaaaaattatgtgactcattttattgcaatattagctttattgcagtagtctggaaccaaacctgcaatatctctgaggtatgtctgtactgagtaaatatttggcgaattgtgaatgaatcagagtgaaaccatactgtattccacatgatgtccaatactgattatcacaggtatgcctgcttctgtacgtcattcatcagattgcactgctccttccgatttttaggatctgctgtcactgctgatttattgtagccattttacccttggcagtgaactgttccctacctctacagcttgggacccagccctatatctgggcccatatcctctcattctcgtatttcttttctttcctttccttctagtcctgaaagtcctagtcttctctaattatatacattttgtctttagtgccaggagagaattgtagataatattgtaaaatagatataaagtttaaagaaaatagaaggctaagtgatatcattgctgatagaatttcaagtatttatgtatcttttctttatatgctctatattttaaaaactttttacgataaaagcatcctacttttacaatcagaaaaatctttaagtattgtaaaatattactgttcaggaaaaatagattcctttcaaaatattactgcccattgacaatgtacctggtcacccaagtgctctgagggagatgtacaaagagactaatattgttttcatgccagttaagtattgtaaaatacttaaatatttgatcatgggagtttttttatacttaatgtgatattaaagaacctatgatcaggtattttgcatacagtatattgggaaaatgaagttttaaaaaacccaaaagtgaaatactatactaagtgaaaggcattgtcttgctaaaatatatatatttgacccagagttagttttttatcgctcttttgaaatgtcacactgaatgaacaaattttaagaaaagggcctatgagaattttgcttaaaaattaaaatatagcactacctgtgaaaaagcagaaggaaatgctctatggagtgatatagaaagatctctgaatacgtttattgttaagtgaaaatagtaaggttaaaaaaaactttaaaaagatgagggagatggaacatatattttttcttgtatttgcatcacaatggctggaaggatacacaaaaaataacattacttaactctgtaaagtggtagttcagagggttatacgtgagggggtggggtgcacaaggacatgagtggttctccatgtcccatctacactttacatttttattttatttttatttgaaatggtgggtatatattaccaagtaaaaaataaacttgaatttcaaaaatgctaaaagaataaccatataaattcaagagtccaaacaacaatatccacaaattcttcaaatattttttctgattgtaaaagtggatacctttattgtaaaaagttctgaatatatagaatgtatttaaaaagatatataaatgtttgaaattctatcagcaatgagatcgttagccttctattttctttaaattttataactgttttacagttaacataaatacactattctatccttaagtttttacaaaatattttgttcccatatcattaaaccttctttataaatataaaattaacagctacatgtaccacgatttacttaatgatttcctatttattaacattgaggttgtttccagtgttttgctttggataacaatgtgatgaatatgtttacagctaagtctttggatttcatgggcagatttttttcttatggcatcaaaaatagtatactgagtatttcaaaacccataaaagacaggaggtaatctgagatgccattaaaatgatattcaaattttatgctaaaattgtgggcattctagttcctcaaaggtattgaacttgacaagcagcatttgtcacaggagttaacccagtgacaagacttgaagtacttagtgatggggaaagcttgagtaatggtagttggaacttcaggtggatttgagcaagttgggcctctgtcttcttatttgtaaaataggaaaattatgcaatattccctctgaagttaattatatttcaacaattccattgttttaccatataatgggcaaattcaaagaaattcatctatgagaacctagattaaaatagtttgcaacactatgcagctgtaagaataaagaacaaggaaacactttatgcagtgatatataatggtctccaggacatatttattaagtgaaaatagtaagactcacaaaagtaaatatgcttatatttacataaaaatactgaaaggatctataagaaactaataaaaatggtatcagaatgggggggtaatgaagaagaaaatctatttagacaacagaaagaagtttgggtaaatatgatttcctaaaatgtgataaaatgttgaaaaatcaaccccggagaaaatataaattgctaactcagacagttttaacttgaatttcttagttttctctattttgaatgaatgaaacataagagatagtttaatatattaaagatatgtattatacaagtataatagaaatttcagatctataaaattttaatgataacttttactagcaaattaagataaagctggaagatcgtatcattataaaaatgatctgttactttttgcatagaatttagtattctgaagcaattttttttttcatttttaatatcaagataaggttttctctgatggggatataaacagaaaaatatttttatgttcaccacctttcaaccaggaaagcttatacatttttttttttttttttttttgagacggagtctcgctctgttgcccaggccggactgcggactgcagtggcgcaatctcggctcactgcaagctccgcttcccgggttcacgccattctcctgcctcagcctcccgagtagatgggactacaggcacccgccaccgcgcccggctaatttttttttgtatttttagtagagacggggtttcaccttgttagccaggatggtctcgatctcctgacctcatgatccacccgcctcggcctcccaaagtgctgggattacaggcgtgagccaccgcgagcttatacattttataacttaaattttattaattgttgacagcaatcttcaagatcttaccctctgatgatcttctgttcactaaaggggacaacttgatgttttttagagaaccacattccagcgatgtattgatggatgtttcctttaggattgtaatttgattatgatgccattagttcataatttggctttccggttgaggtcatgttgacaggctgaagaatagagtgtttaagtaagctgatgaaacacgcataggaggcaataaagcatctaatccttctctactggttagtgccttactttatctccctttcattccgatgtggtcatgtaaactccataaactttcatttatttagaatatagtcatgtgttaaaaaaggctagctattataggtatatgtgctaacattttttaaagatcatctgaatgcaagaacatatatgcataacactatactggacataattcatagttttattgctggcctacaagtcatttcagatttttttctgtgtcctagagttggcaaaccatagcctgtgggccaaattcagtcggtttcctgtgtttgtgttaagctaagaatggtttttacatttttaaatggttcccaaaaatcaggaagagaataatatttcatgacacatgaaaattatatgaaattcaaatgtcactgtccagaaataaagttgtctttggaacatagccatccccattcatttatgtattgtctacagttaaaacagtagaactgagtggttgctacagagaccatatggcctacaaagcctgaaatatctgccctttgcagaaagttttctggccctggtcctatgtcatcaaatatcatcaagtgattcttgttggagacagagggaattacaaatgaatatgtagatacagatttagatatatacatatttttacctttagataatacaactttgcacttacagatgtttctctgtataaatgttcccactgtaaagacttctttctcttctcaaatagtcattaaacaatttgaataggaattgtgttttaaatatttatattctcctgccatgctcactttctttcccacaaaggagatgtaatagcccacacttgctatgcaggaaatgattaaaagcaaactgataataaattgcgttcccttttgtccactggttgctctgctgagacaagtggatcctttgaagggaagtgtggaaaccacactggaaaagttggcttacttcagaggagagacgaaatagaaggggatgtagcctcctagccctgcccttccaggttatccagctgctacctgcttccgtgggagtggatgtcaacacactactacaacatgggtcatttatttagagacacctatacttagtaggacatgtataccctaaatagctactatgttttacgtgaaaaatgtcatcctcagtatactttcttactttgagtttatcaggacattttagctgcaagtaaatcaatgcttgattaaaggggcttaaacaaaatattcctagatatatgtgattcctggattcggcttcatggactcagtgaagtcaacaacaatccaggtgttttctctcttcctgctccatcagcctcaggctttgtcacctcatgggtgtaatgtggttgccacagcttcaggcatcatgtcatcatatgactgggttcagaggcatgaagcaggggtggccagagcactgtgagcattctctttgtgaggctctttcttttaatcctggagggacatcttttctagaagctagaattttcccttagagaatctcattgctcaaagtgggtcacatggtcacacctagcaaagggcaatgaaatggtcttctctggctcaccttcacagaggcccaaacactcagaatcagggttcagcagcatggaggaagaagggaagaggagttgagaaagtaatcaacctgctgttcttctttaataatttcatttttattcagagatacacttggagaacaacaacaaggctattgattgcagaagaaaaacatccatctgaatatcatacccgtattctggtagaaatatattatccttattgctttatgaccaaattgaaagtatattcactaaaatgctgtcagcagcaagtaatagaaaacacaacaaaaaatacattaaagaggaggacaatgtttttatctcacataagaaatccagagggccactttagggttggtaaactcgattcaaggtgtctgggttttgacatctttttgatgtgccatgtcagcacgttggctgaacctcttatcattgtagaatggctgcaatagttccaggtagcatatcctcacaaaaaaaaaaaaaaaaaaaaaaaaaaaaaggaccaaaggtaaggagacgaaagcaaggtatgttttgtccatgcctctttttttgagagggtggagaattttctcagaaacttcatagcagagttccccaatctttcattgtccagaattgcaccatgttccatgtatttcctaaacctacccagtgagaggaattgacatggctagtttagacttgcagacatcagcaaactgtgatctgcaagcaaatccagcccaccacctgtttttttaaaataaagttttattagaacacagccatccctattcatctacatataaatttatggatttatggctgcttttgcaataaaattactgagttgagtagttgcaagtgagactatatggcacataaagcttaaactatttactatctggccctttacagaaaaagtttgccaacctctgtttaagagtcccagtgattctcagctggaggacagacgttgtgaaatgcccttggggtgttttaattgtttataatgatggggtggaggtcctattggcatatagtgggaaggggccagagattctaaacatcctaacgtgagtaaaacagttttacattatgaaaagttgtccctctcaaaatagtagtggtccctcattgacaaacactggatgctatcaattagggtctatttctagtgtgagagagggctgcagctctccctacctctgttccactgccagcccagcaaatggccatctgatacctctgcaaaattgagactctgggaggaaagaaggaggggaaatgactgttggttaggcaaccaagagcgctggctctggagagcagagaggatttgctgaattgatatctcaaaaggggtggttatatgggtacctaataattacggactgattcatcggctggtgacagtggttgccgtaatggggaacagctcaaaatgctgaagttttacacaagtgggaaatgtgcttctctgtgttccatatactgcagaatttgagttcacaagaactgaaaaggtcttttcatgcttttctgtaatgtacaaattatcttcaacaagcatgtactaatcgtgtgattgaaagtaagtttataaagataatacacaattaagtaattgaaaataattttcttggtgtttatgaggaaaccaattaaattcttagacaactttgttgttcgggtatcatgttgaaatcatgcatttacaatcatgcatttcttcttcctaagcattttctgactgattgattaaggtataatatagttcataataaaaatgtctcagctactgttttttccatatctacagccataaccacaataaatgaaggcatgagaataggtatgagatatatactgaatattcacacaaatgggcaggtatagatgctcacatgttaaatgaatcaaatgtttgatgattgtagtactctgatttatttgaccaaaacccacagtaagaaatttgtcttgcattgttacccagtccacatatataacatgtgtgtgtgcatgcacccacatgcacaattaaaacagaagttccacaaaatattgagtttgataaaacctgattgtttcattttatccttttttatattctgcttattatagcctattgaagtggtttcaggacccacatcccccagtaatttgctgcccatgtttgaaaaacacgagggttgtggatgtgtgatttgttccccttctgggaactcttccctcttcttcctggaacatcacttcttttttttcctttggggacttctccttctccaggtcaaccatacctcatataccccagtggctactgatcatcagacttcaggacccaggctgagccagtgagagcttggccccagcattttatgaacttgagttgacaaagaaaggctttgttcctctatggtgacaagcctttaggaatgtaagtccagagctccccgtaaccacaggtgtcagttccagggacctctgcccaagagctagcatctactgaggcgctgggtgaaaggagcgtttggggttctggatccagccctgtcagaagccagtataccttggtgggtttacttgtacatgctgttttattttttcttaatttattccaagatggtctctgtcctgaaagggctctaagtcatatacattaaccagtacacaaatggttagccctggcgatggccatagattgattccatgataggatttgattggcaaagaatcttctcttgcatctggagtggcctaagctttttgaacgacacagccattgcttggcttagtgagtcaaaaggtgtgagtgtattacaagcttatagaagataaacttactgtgtatgtatttgtgtgtttgtgtgtatacacttgctcatgtgtgtgtagacagagaatggggaaataaaaatcagaagaaaggagggggaaaaaggaaacgtagacagggagagatttgttgacaaaaattgatattatcattacccaaaaattccctttcctcccaaattctgcctgtattctttttagcatctgcagagatttgactcctaagacttgagagtgtattccaattgtaaataaacaatttattgtttgaattggaggttatcagactgggctgcaagatgaggatgtaggtagaggttcccagtagttgtaaacatcctaccagaaaaaaatctttgtctctcacttgcctaaatgagtacaattgacactgtagacacattggatctttgagtctctaaagtaccttgtccaaacttctgtccttacaccagtaacacttcttattttttaagactgttcggtgatgcataatattcatgtaaaaaatcatagatgtagactcaatggatttccacaaactgaatatatctgtgacacaactaccaagttcaagaactagaatacaacttgaactccagtggtccttcttggagctcttcctgaagttaatcactatcctcttgatttctatcctctgtctttgaacataatatcaatggaatcatatagatgtgtctttttttcacttaagtcatgtttattagacacatctttgtgtgtagttgtatttcatttattctcattgctgtatagtattctactgtatgaagatccccaatctattcatccattctactgcttatgttaaaccgagttgctctgatcattctcatgcctgttttttggtgatcgtatttgtttctactgagcatattcctaggagtagaattgttagctctgtaattgtctttgatagtcactcctatttttctctcccctcactggtttgtaaattcactgttatctaacccctacatttggcagagaagctgttgcataggaagtacacgccttcttgaacagtcctgaaaaggtttttgtgctagacctataatatttaagctggagcaggatacaagtgctcaggcaggctattggccagcccatttgatttaacaagttaaggtaaagctgctgtaccaaaaccactccaaaatgtgtaatgtctgcaataccaaaatcccttatgtcctgctcttgtaaggtctcctccaaggagtggcacagggacctaaatttagtcttcagcatgcagcttcaaagacatgcatacagcaggctgagtttgaaaggcagtgtggagtggatgagaaggctcacatgtcacttctgctcacatcccttagtgagaacctgttctgaggctagatctgaccgcaagaggctaggaattgtaattatgggtgccgtgaataagagaaactggtctggtgactagctcatcagtctctgccacagagatctccttggagttccaagagctttctttaaatgctcctttgagaacttgtaccttctcagtgttgtgagctcccctgggggtgggtaaagtctggatcttaaggactattgccgttttactatgacagttgctctaggcttctgcaatatgtctccatgttctatattcttttatagaagtctggcagtagaatatatctcttttatgttggagaagatttggaagatagatatagtgagttctgatagaatgtgacatatgcattcttaaaattatggcgctatgcaaaatcatgcaatgaaaatccaggcttacagggacaatgggtgagagacacaacacttaaattactcaaaaactttgtcagtgacacatgtttaaaagataagaagctaataaaaatgagagcacacttcttcacaaattgaatggttaagaaatatggtaagtactacaatacctatggtgctttcccttgaaaagccctgaggtttgcttgtggaagtgggtgtggaaagatttgcagcttgtgactgggaagggctagaaagagggttatctaaacctccgaggggaagttgtaacaccagatgggaacaggcgtggctcctaacacatgctgtgaactgaggtagctgtagatgttgaggggtgtgtgtgtgtgtgtgtgtgtgtgtgtgtatgtgcctgtgtgtgcgtgcgtgtattcctatgcagttctgttctggtgagtatggttttctgagttcatagtgcttctcccagaggaaattgttcataagcaaacacaaactttgcatcgtattcaaactgttccctaatgtattaattcaattgaaataaattcacatttataaaacaagtgttatagcagaactacccatacctggatagtgcaagtggttacaggtagacacactgtggcatctctttgttgcaataaagttctgattagtccatacctgcttatatgtggatatgttagaaccatggttttgaccactattattctcaaaccaggtaatctacttctaggtaattaagaactgaccgtagtttggaatctactgttgctggagtaatgtgttgattttgttctgtttcaggggagttcctttgtattttccgtgtaacattttctcctcattggtaatcaacacaactcataactaacccttaattcagtggttcttctgtggcttttactcctttaatatatatgaagattgctctgttttcctaatactgccccaagatataattatcttctttcagaggaaggcagaagggtatcacattctttagaatatccctgtgtcaaaataagtcataatttctggtacaaaatagatcagttttatatttcattatttggattgactgtgcaatgatgttcagggcttagaatattagtgttattatgagtactggtaatagcaatgctctttgtattagtaatcaccaatgatattagaaatgttagtataataagggtattactaatatggttattaatattaatattagcattaatattgttacttaattctacaattttactaacactacttcatgctatttatattagttattactttgctagtttcagaacgtataatattaccgctaatcactacctccttctgttgctgctgctgctgctactactactattactgctgctgctgctgtttccactaccatgagtacctcaactgtattaagggcttattgtgtcccaagaactttttttttttttgagacagtgtcttgctctgttaccgaggctagagtgcagtggcacgatcttagctcactgcaacctccacctcccaggctcaagccattctcccgcctcagccttccatgtagctgggaccacaggtgagcaccaccacactgggctaatttttgtatttttagtagagatggggttttaccatgttggccaggctagtctccaatgccgggccttaagtgatctgcctgccttggcctccaaatgtgctgggattacaggcatgagccactgcacccagcctgtcccaagaactcgatgagcattttataaacaatagctcagatatttaatcagcataacaacccagtgggataggttctattgttattccggttttatagaggtagaggacactgagggtcagaaaagataagtaactaacttatccaaggaagaagcagagttaggatttgaccattgctccgaagtccctacttgtaaccactttctatactgtagaaattaacgccactaggatatgctgtaattatctgcctcctatgatcactgggatctgcattttaaaataataatgccatctctcttacgataagaataatttgttttgtttttttatatatatttctagagctatagaattaaattcaaatagtctcatttccgataatgtgagtattaatggaagtggtttatctcctctcttaaaacagagatttttatcactactatcaaaggaaatagatcaataggtatttcaaaagtcccaagtagccctgtttttctacattgccatcctattacatatcgctttccttcatttggacccatacggcctttgtacattttgtttctgcattaaatgagtgtgatctactaaaaaataaaaaagaaaagaaaaaacagtggctgccatgagatgtcagagaatgtaaaaaagtctgcatcgtggaagttaatattgaattgcaggtaaaactagatattttccttctggaataattgttggagggtctgattaataattttcagtggtgtgtataattaactctagggtgggaacaggtttctcatatttaacaatgttttccagttggtaacaatgtaccactcaattaattgagatggagtgtgtgttccactttgtaccacacaatagcaagcttaagaaagttggtgatggtttctaagaataaagtaaagagccttataagaatagaggctttaatattactgcagcaccttcttcttggaacagctgtggttgcatgaggtgtattagttgggagaccagattgcccactcagaatgcaatagtaaattggatccagattgttctataagcagatgcatttttttattggtaacttgcttcctgtttatcattttcagtgacatttacaattagtgcccttgaaactgaggaccacaagtgccagggagtgttagtttatgtagcggtgagtcacagtggtgataacatatgctttcagatttacgcagcatctggggtttagtcccaggcaaatcaaggaagaacatctgggaagactcttctgtttctacccctagcaggtggcatgtcccctttcctgtggtgaacatggcattttcaggtcagggagattctttaatggccaaacatacactctgcttatgttgcaaaatggtgaaatttgacatgtttcttttccctctgatttcaaatgttatgggccctagaactcatccagctgttacagtcttcacctttgtgaatctctccactactaaaatatccagattgactgtattaaataagaagtttccttcatcttgtaaatatctcactagtaacatctcttgagtcctcctccttatgtcacctcattaaaaaaaaggaggaaggagagaaaagagggcacaatttttatgtacaggtgaaaatgaaatagatggttgccagaagatggtttccaaatgataaatggagccattaggttccaattagggacttgaaacctccccagtacgtgggtagcctgcaacagagatatccagggtctaatgatatttgttggtgagatttttccaggagtttgagcaagataaactattccaattatttattctccttttctggagctgtgtttcttctcatgtttcccattctttgggcctgctttgggggttttgtttgtttctttgtttgtttttatttttttgcttataagcccagttttttttatcattcttgatagtcataatttttcctgactgattttttttattccaatgaccctttgtaaaaaaaaaaaaaaaaaaaaaaaaaatagagtggctcttgagaccttgaggttttgaagtttggttttgatagcagtcttcattctaagttcccttacctaggtgaactgcagccattagggttttcattcagtgccaggcagtgtttacacttgccaacgtgctattccttttgccattaaggatagcactatccaatgaatgacttcatggggctcagcatgtgctgattgttggaaaaatacaatcaatattaattatgctactctttcctaagcaaccactaaatgttgatcaaaacatacaaaaggcacaggcccgcctttgattactttatagcagcttaatatcatcaagaatgagaggtagccatgtttcaagggaattaagatcatagaggtaagtaattatcaggggtcccaacgtttggctgataagaaccattttttaccatctcatgggatttggtctcacttgcagaagcagttttgtgcatacactattgtttccgtttaagagaaattggtaggatggtgggattttatttatttattttattttttatttttttgccccttagttttttttttattattattatacttttaagttttagaatatatgtgcacaacgtgcaggtttctaacatatgtatacatgtgccatgttggtgtgctgcactcattaactcatcatttacattaggtatatctcctaatgctatccctccccactcccccaaccccacaacagtccctggtgtgtgaggttccccttcctgtgtccatgtgttctcattgttcaattcccacctatgagtgagaacatgcggtgtttgttttttttgtccttgcgatagtttgctgagaatcatggtttccagcttcatccatgtccctacaaaggacatgaactcatccttttttatggctgcatagtattccatggcatatatgtgtcacattttcttaatccagtctatcgttgttggacatttgggttggttccaagtctttgctattgtgaatagtgccacaataaacatgcatgtgcatgtgtctttatagcagcatgatttataatcctttgggtatatacccagtaatggggtggctgggtcaaatggtatttctagttgtagatccctgaggaatcgccacactgacttccacaagggttgaactggcttacagtcccaccaacagtgtaaaagtgttcctatttctccacatcctctccagcacctgttgtttcctgacttttcaatgattgccattctaactggtgtgagatggtatctcattgtggtttttgatttgcatttctctgatggccagtgatgacaagcattttttcatgtgttttttggctgcataaatgtcttcttttgagaagtgtctgttcatatccttcgcccactttttgatggggttgtttgtttttttcttgtaaatttgtttaagttctttgtagattctggatattagccctttgtcagatgagtaggttgcaaaaattttctcccattctgtaggttgtctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccattttcagctttctacatatggccagccagttttcccagcaccatttattaaatagggaatcctttccccattgcttgtttttgtcaggtttgtcaaaaatcagatagttgtagacatgcggcattatttctgagggctctgttctgttctattggtctatatctctattttggtaccagtaccatgctgttttggttactgtagccttgtagtatagtttgaagtcaggtagtgtgatgcctccagctttgttcttttggcttaggattgacttggcaatgtaggctcttttttggttccatacgaactttaaggtggctttttccaattctgtgaagaaagtcattggtagcttgatggggatggcactgaatctataaattaccttgggcagtatggccattttcacgatattgattcttcctacctatgagcatggaatgttcttccatttctttgtatcctcttttatttccttgagcagtggtttgtagttctccttgaagaggtccttcacatcccttgtaagttggattcctaggtattttattctctttgaagcatttgtgaatgggagttcactcatgatttggctctctgtttgtctgttattggtgtataagaatgcttgtgatttttgcacattgattttgtatcctgagactttgctgaagttgcttatcagcttaaggagattttgggctgagacaatggggttttctagatatacaatcatgttatctgcaaacagggacaatttgacttcctcttttcctaattgaatgcccttgatgtccttctcctgcctaattgccctggccagtacttccaacactatgttgaataggagtggtgagagagggcatccctgtcttgtgccagttttcaaagggaatgcttccagtttttgtccattcagtatgatattggctgtgggtttgtcatagatagctctttttattttgagatacattccatcaattcctaatttattgagagtttttagcatgaagggctgttgaattttgtcaaaggccttttctgcatctattgagataatcatgtggtttttgtttttggttctgtttatatgctggattgtgtttattgattttcatatgttgaaccagccttgcatcccagggatgaagcccacttgatcatggtggataagctttttgatgtgttgctggattcggtttgccagtattttattgaggatttttgcatcaatgttcatcaaggatattggtctaaaattctctttttttgttgtgtctctgccaggctttggtatcaggatgatgctggcctcataaaatgaattagggaggattccatctttttctattgattggaatagtttcagaaggaatggtaccagctcctccttgtacctctggtagaattcggctgtgaatccatctggtcctggactttttttggttggtaggctattaattattgcctcaatttcagagcctgttattggtctattaagagattcaacttcttcttggtttagccttgggagggtgtatgtgtccaggaatttatccatttcttctagattttctagtttatttgcgtagaggtgtttatagtattccctgatggtagtttgtatttctgtgggatcagtggtgatatcccctttatcattttttattgcgtctatttgattcttctctctttttttctttattagtcttgctagtggtctatcaattttgttgatcttttcaatgaaaccagctcctggattcattggttttttgaagggttttttgtgtctctatttccttcagttctgctctgaccttagttatttcttgccttttgctagcttttgaatgtgtttgctcttgcttctctagttcttttaattgtgatgttagggtcttgattttagatctttcctgctttctctcgtgggcatttagtgctataaatttccctctacacactgctttaaatgtgtcccagagattctggtatgttgtgtctttgttctggttggtttcaaagaacatctttgtttctgccttcattttgttatgtacccagtagtcattcaggagcaggttgttcagttttcatgtagttgagcagttttgagtgagtttcttaatcctgagttctagtttgattgcactgtggtctgagagacagtttgttataatttctaagaatatggggaaaattgtaaggttgaaacattagctttggctccagtaatctagttttctcggatggtgggattttaattgggggaaatgaatatcaagtggtagccacttagatctggaaaacctctcaagggaatccgttttcctcaggcttttaatgacttcttatgcaattcagtcatggaagttgtgcctgtggcccatggaatagttctgaaatgcttgggaaataatccaaggcacagaggcagggcacttgtattttatgggaagacgatataatggactttccggctacaacattttgtttccaacagctattgggatcatgtgccatgtgtacgacataaacaatgataacttgatttgatatatatattaagaaaaccctttaaagtaaacaaattatttgtcttccaggaataaaaagaattctatctgggatgggtgataatactgtttttgagtaagtcgcttgttctcagtgaaggagtaggggttggggtaaggacaattgtgcccctaggggccgtttgaaaatgtctggtgacatcatttttggctgtcacaactgggagaggggctgctactggtatctagtggctagaggttagggatgctgttatgcaccttacaatgtgcggggcagcccccacacaacaaaaaatgatctgactcaaaaagtcagcactgccaatattgaaaaacctggtctaaaggtttagaggaggcagagcccatagatgaaaggtgtctaggactcggaacaactgtgcagaacaaaacacactctccttcctttgcccataatttcactggactgggctaatgaaaaataaacttcaactgagttaagtcactaatactttggagttgttttgttatgtcagatggcttatcctgctaatagggattcaaagccagattgggaaaaaaaaaaaaaaacaactctccaacttgcagtgtgatcggaatgccatctgcatgcaacttaaatgaatggcacaaactttgttgtgatgcaatcaaacacaaaaccgcaagaaaatataatttaggaagatttttagatgctcctgtttgaatcaggggaaacattttattagataataagttagtttaagtttctgaaaattatttttgtacccttttgagatttttagagggtcttaaagacactgaccctttttttttttttttttttttgagacagagtctcactctgtcacccaggctggagtgcagtggtgtgatctccgctcactgccagctccgcctcctgggttcacgccattctccttcctcagcctcctgagtagctgggactacaggcgcccaccaccacgcctggctaattttttgtatttttagtagagacggggtttcaccaggttagccaggatggtctccatttcctgacctcgtgatctgcccgcctcggcctcccagagtgctgggattacaggcgtgagccaccgtgcctggcaagacactgactctttattaggtcttatttcacttcacagagtttctttcatcttcttcaacatagcacatccctaatacaactattaaacttataattcacgatgaggcttgtattttgactcatatgtaaatgtggtgttctaatgccattatacaaacatgttaggagagaataataaataggctagacatatgtatatgtgagaagaagattgttcaaaatagatgtaagtaaacagtgattagtggaatctagaggaaacaggaaacatatatatatgcatgatccccctaaatacaaaggaaaggggtagtgggaaataaaggtttttgtttagttttctggactggaggaaaactaaagaggagcctagcaagaaaggtgttggtttagttttctggactggccaataatcattgtcattgggatatataccaaatttcattgacttgaagaggccatcaattgcaagacatctaaatgcagtatacctttttgtgtatattgctaataaattaagacatgtgtttttatcacttagatcataggttgacaaattgtcctgcaggtcaaatctggcccactgcctgtttttataaataaagttttattggaacacaaccacacccatccatttgtgtatttccatggctgctttcctactacaatggtgaagcttaatagttgtaaaggagattgtatgttctattaggtctaaactattaatatttaccatatggctcattatagtaaaagtttaccaaactcatagacttttatacttcttgagttaactttttgactaaggcatacattttaatcatataacacttttgtgcatacaaaagaagtgaaatataagcaaacaaattagttaagctgtttgtaagattttaaaacacatgacatatagaacttgacccatatgaatcacttttcagtggatgcaaacacaaatgggtgggagtggttgtgttctaataaaagtttacttataaaaacaggcagtgggccagatttggcctgcaggccaatttgtcaacctgtgatctaagtgataaaccatttcagatttaaatctgaaatcagaaccataattttccgcaaaatattttcctcagtgccatgaaaagtatagatacagcattgcttgaatgagtattccattattgcctccaagattttcttccaagctactgaagcccattctgcttgctttgatttagacactcttatctttccagaaattttccacagagttttttttttttttcagtgacaacaaggtctcctattctttcttcaaatggtcttgaaatagttggttgcttgaaacggggaggaattatggttgtcaatcatgaaccgagaaataaccaaccaattgtgctacctccaggtagacagacatttgaaattgccatttattataagatgaacctggaatctttaaaatccagtagatatgtgcatgttagcatccgtgaaatactgtagcttgtttgttgccctgcagatgaggaatggtttggatgctggttaattgaggggagagaagaaaataaaactcctgtcacatgttatgttccagcaggtcttacttgtatacttgaaattttctgttttctctttgctttactttatcaagctgaataggtgactttttaccacagctcaaaataaaaacttcatggaaacattcttcataagcctctagattttaagctgctccattcttctgggagccccagtaattcagactgattgcagtgctgcttggtggcaactcccgcgactccagcagcttggctctggggcctgagtaaagctctcactctagcagccacaggatctaatgtgaactctggagcttaactcatctctctcctctttcctgtacataacataaatggcctgtgaacatctagaaaccccttgttgggttaatatgatgagatcattctttgggtggctttccattcactggtgtggttcaaaagaggtatgcctaatgagcaggtgtttccacttgttctcagattcctagatgatagcgcactgcgcttaagagaagtttccttcaggggattgtttttagaaagcatctgagggtctgttaagtgaagatattctttcctgtctcagggtactctgccttttggagtctagaaaccactttttatttccctggtcataagaatctgtaaccttaaatacagttgacgagaggctgctaatttccagtactctgtggatgggaccctacacagtgaaaaggcaaaggactcaagcaagtggaggagcctagcaagaacagccagctttgaaatgcatcaggcaaggatcaggacttgatggtagggccttctactgtttgtgcatccccgtttggcatgcaagttctatttatttttattttttgctatatgacagatatggttatataagcagctttcaaaatgaggcataaagcttttgattttctcatcctttgcttttctgagatcctggaggccttttttaaagagttgaggctgtttgacacagcaaaaacaacagagaaatcagtcggttgcactttagagtagagcttggggtatgtgcttctaacttgttcaagttggagggctaccttacaacttggcaagatactggagataaaagccagagttgtagtggttacagattcagtttttcagagtcaaaatcaaacaagcaaagcctgttgttgacccagaagccaaaacctggttgagctgttctttgatgcaagccgatgagcgtgggacttcatatctggtcaccatgacttaaaggaaactcagaggtttcttggattcattagcttatagaaacaaggaaagtcatatcaacggctaccagagacttggggatgaaagaagagactgacaatagctaaacacaatctggctatcaggtacagccattctcaggtattaagaggctggaccccagaggtccctctctgcttggctcctggtcataccacaaatcctgatgctggttaccctcctcccatcagcccttaacacacacttacactggttatgccctttagtgaagctctcttcccttgaatttctgctggcacagagaactaccatgtcaggtcaccaatgcctgatagtggtacactgttgatgctttagggttagttatatcttaaccaatgcataggatgtctgtagaatagtctatcaagcttgtccaacctgccttattttgctgttgttgttgttgttctgtttggttttcttttaggagtttagcagcctgaagccatgatttttagtttctgtctctagtgataaggaaaaaaaaaaaaagggataaggaaagggctttagaaactaagaactcatgactgtattctctcccttggacacccctggttgatgctgacctagcaggctccagtttctttgttaaagtcttttctgcagcatgaaatgaagttcagatctcaagtccttccctaagtaccttatatcttgctctcttgtaaactgcttaaacaagaccttttcctgtgttcatatcagaatcaccttgcaggacttgttaaaacactgactgctgggcccactcctagggtttctgattcagcaggtctggggtgggtcctgagaatttgcatttttaagaggttctcatgaaatgctgctgctgctgttccaaggaccacactttgaaaaccaaaaaagaagagagagaaacagcaggaggagtagaagggagaaaagtcagagatttgaaggtgagagagacctactatggctggttttgaaaggggccatgagccaggaatacaaatggcctcctctctagaagctagatctaagctgtaaacaaaggacagccaaatccatcatagaaaagaaacctttctttaaagcaaatgttatctgcagggatgtgattctgtctataactgctttctcatttgccactatagcagttttagcatttcaaacatccccttgctaattatagtctccgctttacatttgcataactaaatagtccattcaagcagcttttgccaaataaagtaattctctgtccaaaatgtgtattcagtttctacccagaagaaccccaaattgctgcagctcttggtttcaaagatataaaattcatacttcgggccaagcccaagctcaaggtctctatgtcttttttctttgaccagagaagtctctggaaatcagaaggttttctatgatgaggaagccttaagtgacttctgcttaaaatagctatggttgtatgaggcaggtaattggaagatattaacagatcttgcacccagattgtagtagtaaattaaatccaggctgttctccagcagatacatttggggcatggcatcacagcctccttgtaaccagcctcagtggagtgtggcactgaggtggagcccacaggtgtgcctgtacatcttgctccagggatcaccagcttttccctgtggctgtatgtcagtgaggccaaaaataaaaatagcttaaatgttcaaattcaaggagagccaactgcagacaaggtcatctgaagtatgaacagagtgttgggaaatgaaggtgtataagaaaatgtcacatttctctctcttactaaaccacattcaacctggctttgctaccacctgcctgacaggtagaatatgcaggggagggggctcctgctcctatatttaggatcatttaggaattctgaggattaaatagggcaggaacattaaagtggggcctctggtcttgattttgtcctgactgctgctgagatgctcatggcccaaggtggctttggaagtaggtggccttgctgacagcctgctctccttcctgataagcttggcctctcgatgtcctctgcagcacacaagtccacagatcgtggtggcccttctctaagctgtcactaggatggccccggaagatagctgctacctctggggctgagagcaggcatccagggctccactgtacatgaaacccaccagcttactgtcccaggctgggacactcttccaggggctcttccaggggctgcctccctcccttctccctcaacctttagagacttctccagctttagaccttcataggcttaggctttagaaagggggtcagccaacatcttctgccaagggccacatagtacacattttcagctttttgggccatatggtctctttcacaactattcaactctgcccatgtagtgtgaaagcagccacaatttgtaaatgaatgagtatggggctgtgttccagtaaaactttttttacagacactgaaatttgaattactttcatgtgtcatgaaatattattattttttcaaccaattaaaagtgtaaaaaccatccttagcttgtgaatggtatcaaaacaggtgataggccagatttggctcatagactacagtttgctgaccccttctctagaaaaccaaagctgctgcttgttaacactcctcaggggcagtggaggcctagatggctaggagaagacataaacagttccttaattgtttgttttgtttgtctgtggtttttaaacatattttcaaatcattccttgcggtctggccctggcttcctctctactccgtccccttcttccactctgggaccctttgtgctactctagcaaaccacatctggtcaagtatctgtgagtcagtggttctcaaactttgatgtatatcagaatcaactggagagccaataacaaacacagagaccccagagagggcctgaaactttatacttttacaagtgattctgatgtccaccagaatttgagacccattgatatcaataccttgtttcatgccttcctacccttaaacaagctattctgtttgcctgaaatggtttagctccttccttcttctggtccacttaacctgcctcttatcttttaaaaatgtaagtcaactgatagtacttttgggcagagtcactgatccctgttttattttgagttcttaaagcaagctgcatgtacctttatgatggcacagttacacgaccttgccttgattttgatagttgcatgtcttcccaaataggatgtaagcttctagactggactttgtctgctttgaactttcatttctaacatagtatctttaacaggtatataacatagactcaataaaagatggtggtatgtgttacagctctggtaggatttgtttaaagttttctgatgaaaaaacaagatggtggtagaagtgaataacaaatacacccagagaatggagggcaaggaataaagaatgggcaggagatgagagacatcaataaataaaaatctctagtatttaggtcttgggagctaaatttctagtattgtgaacagtgatctctctggacttattttgcctcctctcaatttccagttctaagtggtccatttgttagttgacattcattaaatgccctgaactggtgtttctcaaaatgtggtccctggacctgtttcatctgcatcacctgttagagatgcaagttcttgagctccaccccagatgcactgaatcaaaaattcagtacgtatttttgttgttgtcgttgttgagatggagtttcgctctttcgcccaggctggagtgaagtggcgtgatctctgctcattgcaacctccacagttcaagcgattctgctgcctcagcctcccgagtagctgggattataggcgcctgccatcatgcctggctaatttttgtatttttagtaaagacggggttttgccatgtcgaccaggctggtctcaaactcttgaccttgggtgatcaacctgccttggcctcccaaagtgctaggattacaggcatgagccacagcgcccggcctcaatatgtgttttaacaagtccttcaagtgattctgttgagccctcaagtttaagaaccactgtgtctagatgactggttctcaaacttagtttcacattgaaaccatctgaggagtatttaagaatacagatgcctttgtcccacctggtgatgtgctggtaatggttaatagttgactccctagaaaataaagagccctgacttacagtatttgtccattcctgttatgtaaatactccgtcaccaatttcaagctactaatattgatgtcacagaacagagttgggaagacatgtggactatcagctcttgtaaactggtaggagccaagcaagcttcagcgcatattagttccatccccagagattcagattaattggtccaggctgtaaactgggcatcaggattttcaaaagaagtcccttaggtgattgcaatgtggagcaaaggtgaaataaatttgttagtattaataaatataatttctctcactcagccataggcaaaatacttcgtattccttttatttaatcctctctgtattctggcaatcacagaacatgttctgtagggaagtcactcaccttccaatcaagacaaaaaaaagccatataagaattttattgtggccgtatttccccaaattttattttcaaaaaatgtttgcgtaaatataagactaaatgtgatgttaaaatctgtataattaaaatcaaatctagtatacattcagtaattaagtcaaatttttagatcataaaatatgtttgcaataattttctctcactatacaagtttattttaggacaatgattaatattgtgtatgttttaaaattggtttcaaatattctaaacaattaatgtgttatctaaacttgagcaaaacaacagtgttttgtattctgaacatgagaacaaactacatttgggatgtatagtttggccaaaggcaaagataatataaggaaatgtggcactttgaaaagtctagtattagtggaaaaggtaaaccattagatgagtttcttttgcctggcctgccatagtcatgtctggaaaatacaatttctcagatcctcggggagaaaaatggcttaataagagcaacaaatataaaattgattaaaacaaaaatgaataatttattctagtgtgacatttcgttttctgtggaataaaaataaaaagccattatgagtgggttatttttcatatacttacctgaaattatcacttaatgaaaagatgctattagttagtgctcattaaatacaaatatatctggaaatgtcacccactagattataggtgatagtgattatgtggaacttaaaaccaattattcattctaaaatattaattttgtgtgggatcaaaggaagtggatgtgctttttgtggaacaaggttgaccaagaatggatgatcactgaagcagggtggtagccacgtgaagattcattcagttattctatttttatgtatgtttgaaaatttccatgaaaaagtttaaaaatattcattacagttttattgtttacaggtatggtatactaggcagagtggaaaatatagaaaaatgcaagagataattctagttttcaggatgcaaggaaaaaaataagacatttctaaatcacttatctggcagttcatattcataaatttttcagatgaatgaaggttactgcttatatatgtacaaactttgaaaagcaattttagtagaagtctttcaaaaatgttatctcctgccctgtgttgttggtgtaatgaacgtatttaaccttttcctgatagtcaagttctttctcaatttaggcatcaatctcatctgtgctgtctatggtgattgccttcaaagttgttcatccaatcaacaaatgtttacggaacttattgagtgctgacaatgggccagtcactggaggtatagcagtgaacaaaagagataagaatcctggcccttgtagcacttatattctactggctgttgagatgcttagagtggcttaggtgagcactttgagtgagaagagacaccgaataattcaggggtctatactttttctgtccctcctatctgttctttgtagttgatttcattcatctttccgtttctgcactgtcacttttgttacctcttggcttgcctactgctgtgttctcagtgtgtgtgtccttcacaaattcatttgctgaaacctaacctccaaggagatagtattaaaaggtggggcctttgggaggtgattaggtcatgagggctctgttctcatgaatggaattagtacttttataaaagaggcctaagggagcttgtttgccccttctgccatttgaggatacagcaagaaggcaccatctttgaagcagagagcaagccctcactagacatcaaatcagctggcaccttgattctaggacttcccagccttcataaccgtgagcaatacatttctgttgtttataaattacccagtttaaagtattttgttatagcagcctatacaaactaagacacctaccatgagtgattttttaaaaaattaattgatttaggtgttcttgcccagcattcaggtcattgctactctagtctgcatgatatgatcacaaagttttttataaatgtgtctaaaataagatatactaggctttgagtaaattcttgagttgcgattgggtggctcttgctttgcttttttctccccctaattacttttgtgtttttgtgtttctcaatagcttaagtctctagatgaatgattcattcatttagcatttaacaaactgttattaagcccctgctgtgtgccaagtactgttctaggagttgtggatgcaaggtataaaaaacaaataaggtgtatgtcgtgagagctaggagaaggcataagagttcgtaatattgtgtgctggttggagaagcatttgcaagggcaactcctgcaggctggagatgggggtggggatcaaggaaagcctgtggaatcccaaaggggatgtggatgcatttaattgtggagtaaagtttgacatgcttctgagatgtgccagtggagataatctggagagaggtggattttccattgtctcctgttgcacatcaaaccaccctaaaacttagtggcttagaataatagcaacttattatttctcatgattcagtgggttttctggactatttgaatgctggttttgcttgagctcactcatctgtctgcattcatctggggcatggctgggctggaaggtccaaggaaatctcacagacttgtttggcaatggctctgactattggttcttttccacatcatctctgatcctccaggatgatagatttgcttccttccttacattggtggtctctgggcagcataccaaggtagtggagacagaagtggcttagtctcttaagacctagctttggaaggtatataatgtcattccagccacattctattgaccgagcaattcagatgaccagcccaggtctcggggtggggaaatggacttaccctcttaatgggaggagaaacaaaatcaccttgcaaagggtcttcatacacagaatgggaagaatccacagccatattttataatctatcatagttggatagatgcatctgaatcacaagagagtaatttggatgatagagatttgaaagttatcaacgtatagattaaaggcttgtaaatcttggctgcatatcaggacatggaaaatgggaggttttccatatgttctacatataaaaatgacaagtatgcaagaaatatatgccccaaaatgttgggtgggagaactgggcttcatggcaagctgaggcttgacaccaacgcgtgcagaatgcaatctcacgttttgaagtgaagtcaaagaaactaggttaacaaatcagctttcacccctagtcttaaccacaaagtttagtgccccatggagggattttattatgtttaataaggaatttataataaaattaaaacttaatgaattcccacatagcctctgttgtgttctagtttgcatgctatcttgctaacctagcctttttttttttttaaagtatatttgtttctttcccagaattctttcaaacatgaactggggttcaaagccctcatttgccattaactgtcatggataatacggacttcagcctaccagttatctgttggtattgggtatgggagaaatgagggaattctcttgaggcagttatagcagagccttgaaagagtcttgaacaagaaaatattgcttagagagaatggagacttcactattccttagtggtctgaatcctctaatgctgtactgtccaatatggtagccactagccacatgtacataattatatttaatttaaaatgtagtgacttaaataaaattaaaaatgcagttcgtcagttgaactagtgctcaatagctacacatgccagtagttatcatcttggacactgcagatgtggaacatttccattaacataaaaagttatatcagggacaactcttttgacatttcttgtctaattaagaataaaacaggtaatgctagttttagatcctcatgctgaggattgaattaagagttaggggtaatttcctctgtgatccaaaatacccatcgcaatacatcatggatcaatttaaacaaattttagtaagagactggggataaggaatatgattacgtttaagagaccatttgtgaattagatgtaggttacatattgataaaattaaagaagattgtaccaagctggaataaagagcctgtctaacaaagttaaatctaacaagataaatgtaatgcttatattgttggtttaaatcagaggttgataaacttttctggaagatccatgtaacaaatatttttgactttgcaggcaagatagcttctgttgtaattacccaaacctgacattgtagcatgaaagcagccatagacagtatggaatgaaaacgggtgtgtgtatgttccaataaaactttatttaccagaacagaagatggtggtctggatttggttcactggctatagtttggtaatccctggtttaaagagtcagttattcaagtttaaattgaggaagcttggccagggcctgacattggcctgggagtcttctgctggctggttgggttgagccagttgccttagggtaatgccattttaatctgctttaatagacatattccttccaaagtcagagaaggaagaatttcattgtagttcacagtgggggtttgcattcaatctggatgttgacaagctggatcctgcatggcatgttcaagatttggaaactgaataaaaggagaatggaaggaactggggtctaacttaacagtggagagctgttggaggatgttaatttagctgtcttcaagtatgtgaagacctgtcatgtggcaggaggtataatttatctgaataattctagatattagaaatacaactaagaggtacaagtttataaaaggagaattttcaaaacaacagttgtttcaaaatagactcccttatgaagtagtgttttccacaactgaagggttttagaaaaaagatggataatcatctatgagctggttgaagaatttgttctagaattgggtgagaggttgcaagcatagtcatctaagttgttgttatactttgagattagaactggttgcatgtagagaaatcccaaccaaaattagcttaaacaaaaaagggaatttgttgggtcccactactgaaaggttccaggataggtctaattttaggcatggctggatccagaggtcttataaaagtctttaggcaggactggctacataagttgtgggctctagtgcaaaatgaaaatgtgaggtcccttgttcaaaaattatcaagattttccagacagtggcagcacagtattaaaccgagtgtgggtccttccaagtgcagggccccatgaaacttcagaggctgcatgccaatgaagctagctctgtcttcaggtcatggtctctatctctgcctctcagcctcctttttctctgggttggtttcattttccggcagcctttttttccctcccattagcagctttaaggcttttgtttttaaatctgcaaaagggtgttcctctcccctggtgacaccagcaaatgataccagataatttctgatagacttttctcacctctgaacccaattacatggtgacattccctttgcccaggcctgagtgatgtgttcaccctggagctgaaagtagtcagctctactgaaaccataaggaccaagaggtcaagagatgagcaggtagttccaaaataaaaacagagtggagttacctgaagaagagaaaatggatgcagggtagtccaatgtctactctttttagcaaacaattgaacagtagtgaagaagtgactaaaggtaagaaaaagtcttaattcagagatcttgccaatcagtaagggttcctttccccctgaagagtttgctaaattttttaactctattttttcaggtatgcaagcaagatttttgctgtgtcgtgtttatttactgtcatatttatattcttaacatgagcacgtttaaaatgatctgtcaagattctgagatctaacatttactgccctgcctggaaattattttaatgcactgaggaatgttgcctggaacctagttacatttctcagtcccaccttctatctaaaactttgttcagtctcttaggagggggaaaataaataaataaataaatatatatatatatgtcatcactttctgtcttagttggccctgctttggaaccagcacattgtttaataagctctgctcaaaagctgacttttttttcagattatgggtcaaatgcctggaaaggtgaggagaactaggtagcccaaggaccatgtagaatttgtaatggacttatcacctacacaaatcagttcagccaagattttcattcgaatccagtgagatatggccttgtttttaccgacaaatctgacactttcgtggaaatgaattaactaacaattttattctggacagtttatcaggagaggtggggacaattgattacagtcaatgtctgccatggttcatgcagcttatggagaaccttgtcctgaagtctgctataccaaggcaggagttaaacacaaggtctctggagccagacttctgggatttgaagtctcgtcctgctgctcctgacctatgtttccttgggctagtttgcctttttgagatttcctttttctcatctataaaatgtcattgttgctatctatctatctatatatatatatgtcagcacaactgaaacaatagaaagtgcttgcctccctagttccaccacacctgccgagattcacagggtgctttttctgggtcattcaaccaagacactagaatagaaaatgggatgggtatgtcttgacttcctcttaatataaacaagttatcaatgcataatatgcttggctaagcagccattggcatacgtttatattggttgacttccaccccaaatctgtccttcacaagcacggcttatcctccacaaatccacaaagcatacatttacattcattgaacatgcaagatggtagtctttttgcctcctttttcctatgtcaaataacggtcctcactagaaaaaagaagttttgaagcttttggaaaaatagctatttcaaggaaggaagaatctttattttctgatcttttacccagagattgaagtctgatctaataattacaccaaagaatttccctaccccacaaacatggattttgtcagtttacagatttgtgcttagctttggttacttttgaagattttatatatagcgagcgtaatggcttgatctcccttgctgtcttctgtggagacagctttaacatgtcttcccactgatagacactcacaatccatggctttttaagacatacacaccagtctcgtgttctttagaatatataaatagaagcattgaacatacacttggagctttctaaattgacttccctgaaccaacttagcaattaaagttgagctgaggtgcctgtcttttgcttgttaagtcttgcagtgttttctctgaaatggcaggtctcctgtgacaaatcaaagacatgttctctttaaattccctgaaaatcagaagggcacatttttccaatgatttttaattattctttactggaactgcatattgaaagtggagcatatcacctgggtagataaaggaaacagatgaaagaaaaaaccatatttatgattgtattcaccagtagtctgcaacactgattttttttaaagtcccaagttaatttcccatcattactaacagaaatacactgatttaaaatttcctactgctttagagaatagaaataaaaaatcctgaacgccaaacaaatgcatgcatggaggaagccttttgagaaatatttggctgcctagatattacagagatggcattgagccacctgagaattcctggacatacctacaatacatggtagacaaccgttgagtttgatttcaaagttcagtctctggtggccagtcacacacatgctgaaagggataaataccctcactacatgctcagccttaagacaaattgcaatctaagctaccactaagaacgataaaaaatgacaatgagatttctgccaatgcattcttttccacatgagccaaagagtgcaccagtattacacatttactccagtaagtgctcatgtaaaaactaagttcattaaaaagaaaatgtggtacatatacacagtggagcactatacagccataaaaaagaatgagatcctgtcatttgcaaaaacatggatggaactggaggtcatcatgctacgtgaaataagccagacacagaaacacaaacattgcatgttctcatttatttgtgggatctaaaaatcaaaacattgaactcgtggagatagagagtagaaggatggttaccagaggctgcagaggctgggaagggtagtggggggtgatgtaggggcgacgtagggatggttaatgggtacaaaaaatagttagaaggaatgaataagacctagtattttatagcatgacaggatggctatagtcaataataatttaattgtacatttaaaaataactaaaagagtaaaattggactgtttgtaacacaaaggataaaagcttaaagggagggatactccattttctatgatgtgatttttatggactgcatgcctgtatcaaaacatctcatgcacaccataagtatagatacctactgtgtaccacaaaaattaaaaagaaaaaagtgaagtttatttagttaataaactaataaggtctccattatataagactagttcataaccaaatatacgtgaagaaaaacacaactcctcagctccgactttaaaaggattcattcacgtcttaaaataaatagtgtgcatgttcaccatggaagtggttattgaccacgggtgaacaaatgactcacttggggagattctatagactatagatgcctcaccccgcacccacagaatcagaatcctggggagggtgttatagcatgggtacaaagataacacctcccaagtgaatatcattaagaattactggagcaaaatgagacctagaaacttctcttccactattagacttaatgtcagggctaactcttccaagggtccctctacgacccaaatcactcattttcccccactcctatctttctctttccattgccttactcccacaattgctggaatgggaaacacctcaaagggaaaaaactgttcatggagtcatttttgaaatgtcagtgcaaatgtaagcaattttggcctcacataagtaacaaaggaaaaaatggagtgctaatagtggtgatggtttaaggaatccaatttattcccaggggctccattcatcaaatatcattgtaactttattgcatattcaccggaaatcattacattttggtagtttgtgaattccactacttggggtcataaaattccctctattataagaaatcactgctgtcaagtccagtctgattaaagtgaaggacagatgatctgcagtcttgtagatgatgtttttggctgccaattacttacatatgaaagacaattaagtgattataaaaggaaatccataggtacagttacacatcataaataattttaaagatgggtaatctgctttcatgtcttttattgtttgcatgcagttccttgaattgcctccactccaaggcatttcaactctattttttgcacaataactttaaaaaaatctcactggctatgcacaacaccatgaccataaaactcatgtgtcagatgcctccctgctaataagctagaatactcacctgtcgtgaagtgcagcatacttatcaaacaaagaaacagtgaaggttaattctttctactgtctgacctttgtagtatatgggagttgctgaaatattttgtttcaaataatgtttaaataaaataagtaatgcttaaataattattattaaataaataattatttaattgctttttaagcataattatttaattgtttttaatggaatctcccaaaatactcattggtgttgtttctattttacttatcatatgtcacgtaataatacaatagtatcccaaagagaggatttaaataattttttatgacgacaacatcaatatatttcgacaccttgcctattgaagattggcaacagtgacttcctgacaagaaaatattaaataataccaaggttcaaatgtgcctttggtgtgtggcttgacgatgaatacagaatatttcattaaaaggaaatatttcattgaaaggaaaataactaataatgctcccattcatatggtgagaactgggttgtgaatcctggaaaggaaatagaagtatgtgatgactgtctttctgtgggttcccctttgtctccacttgcaccattgtatatttttctctctgacttttggaagacaagtatatctgcaaatgtgtctcatcttcttgtatttcctataacctttctcttatgtctcggcaaaagccatgcacagtaggggttacagggagttacactgaggcatattttgaggacatctggaaaatctgaatttatcttacctgtatagaaaatgtgacataattttttctcctctgatcattgaaagaaaacacattagagtggaaaaggtggcagtaatgcaaataaatatgattttttgagagactactttagaagatactaaccacgtaataataaacaagaaatatacccaggtccttattccttgaatgcacttgctcatccacccctattcctatgggtacttctcagtgggattccagtgtcacctgtttttgatggtgccttctccaactcttgcctactcccatgtatttcccaatagcctttcataaatgctgctttacattatcaaccataatgcattatattttagttgcttccaagactatcttttctacatgagtgtgagtttttttccatcagaactgtatcaaatttacctcgttgccacagtgacttgataatactggtcagcagtgtttgttgaatggctatccaattttaagaatgaatttgtttttaaaactaaaatatccttgaaaatatttagctgatattcttgggcagtttttttcaaaatgcaggtcctggtttgttagtgagttatgaggtcaacttaagtgggttgcaaccagtattttatagtgaaatagaatagaaaaatattagaatgtgtcagaatctattacacatagtaggaatattgtgtaagtattgttctgtataagaatttggtgaaattctcatttctatttatatatgtctatgtacctacataaatatacatgtatgtatgctgggatgtttctgtgtgtgtttgtatagatacacatacatttgtgtgtatacactaggtataaatttaaaatttattcctttttgtgagtcacagccaaagaacgacactgttctagatcataaggacccaagcaccttcagactgcaaacaggcaaatgctttcaaacatacaatgattattgatatcccttagtgtgaacaccccaaaccagcattctggcatatcaaggagtgccaatcagttgtgagaaatggctcaggttacattcctgtattcagtcggtatcatccaagccatggtcacatagcactgtggcacagtggcactggagtcagctgacctagactggaatcccagccctacaacctatcagcaccatgggttttggcaagttaataaatctgagtcttgtttctttgtctctaaaagcagcatgtctcctagttctccacagagattaaatgagtacatatgtagcatctagcattatcacacagtacatgtcagttgttatgtatctctacaccttggatggtgtattttccctcttgcactgtaactttttcatctgtaaaatgaagacagtaatagcacctaatgcatagtattgtttaaagaggattaaaagaatcagcagaagtatttggaggtgtacttggcacacagcactgtatatgtcattgctattgttgttattgtgtatgtttgggtctaaagaacatcttgtcagtatcctgtaaggatttcagggattctagtctatgttcaaagatatttacaaggaatatggcattgaactaacgttttaactgagcacagaatgacaagaatttcgatacgaaacctagatttaaaatataaatgagcatataaaccacagtttatttcagcaaaatccttgctagactctcaccaaataaaaacactgccatccctttttgtccagcttatgttttgccagctgtctctttcctggtgtgtagacataaccctaacaaacaatagcaaaatcatcatgaacaagtaacattggtaggtggtgcatcaaattatagcattcaagaaaataattttcttacatgcagtcttatataaagagtccagcattttcacctttgttcttctttagctgaaatgaaatgattaaacaaaagaaaataaataattacaattagagcagataccagtgaaattgaaaacaggaaatcaataaagaaatttcttttaaaagcccagaagcttgttctttgaaaagatcaataaaattgataagtctctaagccagactaagaacgaaagagagaagacatgaattactagtatcagaaattaaagaggtgaccttactacagctcccataaagattaaaagcatattaaaggaacattatgaacaaatttggaaacctagatgaaatgcaacaattccttgaaacacaatctgccaaaactcatacaagaaaaaatagacaaactgaatacgcctatatctattatagacattgaatcagtaattaataacctccccaaacataaagcaccaggcccagatgggttcactggtgaattctaccaaacatttaaggaagaaattataccagtcctctacaacctcttccagaagatagaggcaaaaggaatacttaactcatcttatgaggccggcagtactctaataccaaaagcacacagacattagaaaaaaactacagaccattatctgtcatgaacatagattcaaaaatccccaatgaaatattagcaaattgaatcaaaaaatgtgttaaaagaattttacaccacaaccaagtaggatttatcccagatatgcaagtctggttcaacatttgaaaattaattaatgaaatccattacatcaaaagggtacagaggaaaagtcacatgatcatatcaataaatgcatgaaaagcatttggcaaaatccaactagaaatagaggcaaatgtcctcaactcaggacagaatgcacataaaaaacgtacagctaacatacttagtggagaaaaactcaaaactttcttactaagatcaggaatgatgcaaagatgtgtcctctcaccactgctttttaacattgtacaggaaagtcctagatatggcaataagagaaagaaaaggtatacaaattgggaaggaagaaataactgtcttttattcacagatgacataatcatctatatagaaaatctgaaataatcaacaaaaaaattcctggaattaataaatgactattgcatggttacaaagttaatatacaaaagttaattgctttcctatataccagcaatgaataagtggcatttgagatgaaaaacacaataccatttatatcagcaccaaagaaataaacacttatatataaatctagtaaaatttatacaagatctgtatgaggaaactacagaactttcatgaaagaaattaaagaatggaataaatgaagagatatcccatgttcttggataggaagacttaatattgtcaagatatcagttctttcagatttaatctatgggttcaatacaatcccagtcaaaatcccaggaagttattttgtggatgttgacattttgattctaatgtttatatggagaggcagaagacccacacaaagaacaaagccagaggactgacactacctaacttcaagaattactatagagaccaaagccagatgactgacactacccaaccttaagacttactataaaactacagtaatcaagacattgtggtgttggcaaaagaatagacaaatcagagatcaggggatcaaaatagaatccagaagtagactcacattaatattattagtcacctgatctttgacaaaggagcaaagacaatacagtggaacaaaaatagtcttttcaacaaatgttgattgaacaactaacgggacatccacattaaaaaaaaaaaaaaagaatctacacacaaacttgatgcctgtcacaaaaataactcaaaatggatcacagacctagaagtaaaatgcaaaaaagttataaaactcttagaaaataactttggagaatacctacatgacctcaggtgtagtgaagactttttagattcaacaccaagggcacaatccatgaaggaaaaaaattgataagctggatttcattgaaattaaaaacttctcttctgcaaaagacactgttcagagaatgagaagacaagccacagactaaaagaaaatatttgcaattgacatatttgataaagaactgttatccaaaatatacaaagaactcttagaattcaacaagaacacaacacaaattttaaaatgagccaaagacattaacagacacgtcatcaaagaagagagatggcaaataagcttatggaaagatgctcttagcatatatcatcagggaaacgcaaattaaaacaacaatgagataccactatacatctattagaatggccaagatccagaacactgacaacaccaagtattgatgaggatgtggagcaacaggaactttcgttcactacttgtgggaatgcagaatgatacagccactttagaagacattttggcattttcttacaaaactaaacattctcttaccatacgatccagcaattgcacaccttggtatttatccaaaagagttgaaaacatgtgtccaaacaaaagcccgcacacgaatgtttatagaaacattatttataattgccaaaacttggaagcaaccaagttgttcttcattagatgaatgaataaattgtgttatatccagacagtggaatattattcagagctaaaaggaaatgagctgtcaaaccatgaatagacatggaagaatcttacaatgtattactaaatgaaataagccaatgtgagaaggctataatactgtgtgatttcaactgtatgccattctggaaaaggcaaaactattgggagagtaagaggatcagtggttgcccggggttgtagagagggagagatgaataggtggaacccagagggtttttagggcagtgaaactactctgtattatactacagtggtggatacttgttatcctacatttgtccaagcccgtaggatgtacaacaccaagtgaaccctttgggtgataatgatgtgtcactgtaggtatattgattgtaataaatgtaccactgtgatatgggattttgatagttggggagtctgtgtatacattgtagcagggaatatatgggaaatctctataccttctgcttaattttgctgtgaagctaacacttctctaaaaaaacaaagtccattaaaagttaaactaaaacaattaaatgagtatgtattaactctttccttactagagatctttcccctcaagcactagcttgctttgggtttggtttccatttgaatgagctgtgtctcttgtctgctggttgaagcaactgtgtcacatttccaaatataaccaacatttctgggcatattcctcaaactggggctcagagtcctgtagtggcactgctgtgacaagcctctaagccactggatactatatggcacggccatccttgatgatttaattaactcacctatgctattcctgtagtggtatttaggagatgtggcattctttagttaccaagaggtattttgacactttgcctggagaaagctatagaatggcagctgataacttgagagcatttgttaagatggcagctgcattgacattggagtgagctctgatggggtggtaggaagggttttgtgagctttgcatgctcacttctctttcaccttgccagtcaagcatgacagaaggattaacctccttgccatctgcttccctacctctacagatgacagcttgggtacatctgtagtcagtgtttccaaatttaactaagtgtgtgccaaatattgaagaacagtgattcccaaatggtagtgtccatcagaatcacttggaaggcttgttataatcaaattagtgagccccaccccagagcctctgattccttaggtctgggatggtgcctgagatttgtatttgtaataagttttcacatgatgctgatgctgctgatccagggaccacactttgagaatccctgctgtaggagaaagtccatgtagacaacaggaagaattagtggaaggtgttatacaaccagaaagtatcacgtacttatccaactgctgttgttgctgctgttttaatggatagattgctttaaaaattttgttgggcaaaaatatagtgagtgttccagatgaaaaaaatagagtgcgcaacttccttttaaggcatcggcaaaaattgtataaaatgagagcaaagagcaggcaggtgtggaaagcaaggccaaatcagaaaaatgggaactttttctgcctggttccaaatcagctcttcttgtttttcacctatttgtccatctcagggttttctagatggctttctaaattgtgctatataccagacatgtatgcaacacatcataagccgctaaaataaatctgttgactttggaagctttgttatttttttgtacacagcttgatgggcatcttaaattgttggtaattacatctcattcctccaaaatattataaaatattcatttaatgtaaaagcatctagatgttaaataattcaattatttaaacagacatttatgccttttggagaacatagggccccaggtcagtgtgaagtgacaggaggacagaagagtagtcacaaaggaatatatggtaattggatactttcgagattgagtgcttctttggcaaatatctgacaagtaaaggtaggtgaaatccctatcttcttctgcataagttggcaagtgttataatgaaagcaagcctcagatcaaagtttgtataaataattagtgagctgaccgaaaaaagaaagagaaagagaaaaagaaaaagatgaaggaacagatctactacttagtcttatgaggtctgtgaattatccgaaagaaacagaaagaaagaaagaaagaaaggaaggaaggaaggaaggaaggaaggaaggaaggaaggaaggaaggaaggaaggagggaaggaagaaagaaaagaaagaaaaaggaaggaaggaagagagagagaaagagaaagcgagaaagcaagcaaggcaagagattgaaaaactagatgtactacttagtcttttgaggtccgtgaattacttgtacagtacctgcctgaagagttctctttgaaacagacatggtctcaggcatctatttggatcaggcatttagtcctctgttaagtgggtaggggtgaggggttatgcacaagaccaaacggaatgctagaatttagagtattactcttgggtatttggctgctgtttttgcccaattcttatatttttcctacgcaagttcaggagggcctgtgtagtctttctagctaccacatttctggaacactactcatttcatcaatgaaaaataatttctcatacccttatgctaattaataaccctctggtgcagatttagataacacgtttgaagtacttcctttggctgcacctgaagtgtggattcctgattagggggctttaagtgtggcctaattttctctaggatatgagtgaaaattcgcttttgtacccatatacacatcactgttttgttctagttattaaaaaaaaaaaaggtagcagaggtgaagtataaaatctttcatgttaatcacagtggcacttaaaaaaatttggggtgctgccccgttatgaagtgtgttacaggcgttggggatgaaggaggaagtttgagagctattattgtttactaaactactgttatagaaaatttgggtgttttgtgtatgatttaggttagcatttaagaaaatgtaatacaaattgttatagcatttttctgattccatcttgaagacccaggattttagaatctgcaaagcaaaaaatgctaacaacaacaaaggcatgctgaaaagcctggatagatctttttcaggggggaatactgtttctcttcacacttctctattcctagctgatagcaagccctgcatttaattattgaaaacaatgccaacatgaaatggaacttcccagtgctggctttcccctttaatctaagatcatttaatttgccaaataacttgagtgaaggattgaggctgaaaggttaatacaaaccatgttgcccttggcttaattctatcctttctttttatgtcatttgatgtttagctcaaactttaaaattcaaagacatgacactagtgtgtgtgcacgtgtgtgttacatgttaaatactgtatagaatttctggtttttaaaaataccgactatacagacagatgcctcaaaattacaatgaacttgacagtttatttcactgaatttgaaatgtttaaccgcacctctcgccaacccccaactgtcaaattcactaactggaacgtcactaatgtttaagtaccaatccaaatggctgttgagacaatgggactgttttgggatcacaaagaccacccacatgtttggtgattttttagaaggacccatgggactcagcatacaatggtgcatacagttctatttatttaatacagctacacggcaaggatacacagttgtatcaataagggaaaaagatacggaccaagtctggaggaatccatgcacaggcttgccgtgtttgtccctggatgaggccacataagcactcttgcccccaacagggaaaaggaagcaacctgtgtacagtttttctgcctgcggaagcccatcttagttagactcagagcccagagttgttattgttgtctggtcacgaagttacagtgactagccacaattactgaaattccagactcccagaaggaaagcaggtgtttagtgtcccaggtgggaaaaacaaccgattgtgtagggaacttttcagaagctgagttcccaggagccagccaaggaccaaccctgcaagccgatccttctgaagataatagctcagtcctgctaggttaacacttttctgcagagatgtagacttttctagtactactcagtatctttcacatcataatctgtaaatgtatatctgcttctggctccatgagggcagaagtcataggccattcatccatgtttttctggcacctggaatgacaggtggacctaaagggaaacccgatgaatgtttatggaatgacggaatggatgtgtcaatgggatgtggattttagtcttgtgtgtaaattagaagttgcatatttgttagattataatttatctgtgggtataatttgtagatggtaaaattctcatcatctgagcaagaattttggcatgctatccacaataatcttgaaatgacctcatttctagactgtccaagctagctgctaaatactatcttgtataatttccaacttccaagccagttgtggggcaatgatcataaacatctccaaggatagcaatggctgaggtggtttggcagtgctgacatagccaccctgtatcctcattggtcattggcagagcccagattgcttcagtccctactgccatcacattctcctttgggcttaggatggagccagtgagtatcatgagaaagatcttacgtttagggcaaaatatcacagtaatcacattagggatgaaaaatgaaatgagagaatatgactgtttacccaccacacctgggccagttgaagtttggaactatttgtgggagcctgaatgaggtttaatagagacttcccatctagttaacctcagtgtacatcttaaaagagccagttaagtggtgattgatactgttgaacatacctaaagtagagaacatttgttgttgcaaaaagaaagtttatatatatataaaaaatatatttataatctatatattatatataatttatatacacatgtgtgtatataaagttgaaatatatgtttcaaatatgtatatatttatatagatttctaataggaagcatggaagtacatgtagccaggtaaggatagaggacaaagtgtttatgaaacagagccttgaacagaaaatcagcagacatttgactgcgtgtttctttcactttttaaatttgattacctagaatgtgaatatataagaaacacacaattaaattgaataattatgaatgttaggagcctctttaattttcaatgaaccttttacatatgtgtaggaaatactattattaagccccatcagaaaatggaatattctagttttatcacatagtacagtttaacaaaaattagcctctccatctcatatgtatcatctgttttcaaatataaatatatgtatttatgtgttttttaagttaaaaattagtattgaggaggtattctctgaatgtagggaacacatctctataactttgccgagataggccttgggaaacagcaaaatgagcatgtgtggactttggaattccaggagtgaccccagtgtgagccaagccatgacacactttaaatcttgcttccataactgtgaaatggggctatacagaccctatgagacagcgacccatttaccacctatgaaatattgatacagtgtaagagattactgctattgtcatagcactagcacttagatatttggaagcctccagaaatatgtctgctcctggccttctgctgggtttccactgattgatttcttaatagaaactggaaagttgggaaaagtgggagaagagaagtgggcacatgctgtgaccggaagatgaaacaaggcactgataagtttgaacgtggatgatggcacttctagtttctctcaaagaccttgtaatatctggctgtaaaggtgactttcttgagtgtgtgttgaaggtgacttttgtacacagaaaagattatttaagggcagttttgtggacaaacttgatatccaatgtattcaagttacacatttaaaatcatatttcttccttattttttaacaatttgtaaatctagcaaaattttatagtcatttttatgaggacttgtgacaacataattaaatgcccttcaacatttaaatggtatttctgtatttcttttaaagcccttcagttatctgacaaacgcttccaagtattgaataacttttataaagctgttttaaacatatagatgtgttttgttcttgtaaatgtctcagtcccatttataaactgtcttttaacatataaacccaaatctaaatcaattactcagcacacattttaaattagaattccaagtcttattcttgccatattctcttaaataatgtaaagcactcataatataaaacatatacagattaattctaaatttaatgtgaatatattaatactatgggattgatttactccatcatttctgtacttaattctaaacctttctgggattaaaacacacccaataagaaaatcgttctcagccagtaaagttcgggtttccatcttgattcactgtttttaattcaggcagagagacataagtctggtctttattcatacttgtgaccctaatgagaaataccagttgctgttaatatcccgatgattgcttgaccagtgcttcttaatctttagtgtgcacacgaatcagcacaagactcgccttggtgtcttgttaaaataaaggtttggatttggttgtgagttctcacaaccccaccccgacttaccaaatcccaggtgagtcttgtgcacatctgtgtgcacattaatgattgtacccagctcccaggtaatacctgtgtcgctggggcagcaactacacttgagtgagtagtgacgccttagattcaagtgccattttacatcattcttcatctactcatagatgacttcatcccccattgaggtagttcacttccttcacagtttgattggttttgcatttctttgactctcttaaggcattcaaatgtcatttccattagacttcgcagacttttccaggctttgtgtcactgtggtcagacaactgaacccttgaagattaaaattaatcatttatagtgaaaaaatagattgttttgaaataaatgcatagaaatattttgatagaaaaagaacgtagaaaggacaagtttgccagactgacagtttgaactctgttgaatgaacacgaggttttataaatgtaagatacaacattttaaaaagttggttcctgtatctaaatgaatttttagattgtctctagatactttgtattgatcaaacatattaatacagatgcaagttttttttaacataatggctgtgcctccctccctatcaatccttatagtcagaaaatacagcttgctggatgatttttcccgtcaaatatctgagaagcaagggacctcatagagtatgtgtgccttttggttgaactagcttattccaagccaagtttttcactaacatttctttattctataaaagtagacaatttaaatgttagaaaggaaaatgtgtgtgtgtgtgtgtgtgtgtgtgtgtgtgtatgtgtgtgtgtgtgtgtttccttctttgaatgtttttgatgttgacagcctggaagcaagcagtgagcattgagcctctgctcctttccattctgagaccctttgtcaccctatgatcttacaaaaggcctgaataaaacatctcgtttacttgcctggccctataggcagttaagttcactaccttactagaaatgggtcctctcatacagtgttcataggaatgtacctgtgtacagcctgtgcaggtattttgaccaagcagctctacttctagaaatctgtccaaatagttaatgggacaggtatgcaattttgttcaagaactttctttgtggcattgttcacaacagcaagatattagaaaccaactgaatatccatccatatgtaatcacccaatggcttctccatgtctgctgcctagcagagccaatttatcaagacaagggaattgcaatagagaaagagtttaatttattcagagctcgctgtgcaagggccagagttttattattactcaaatcagtctccctgaaaactcagggattggggtttttaaggataatttggtgggtagaaggtcagaaagtggggagtgctgattggtccagtcagagatgaaatcataagttgctgaagctgtcctcttgcactgagtcagttcctgggtggagaccacaagaccaaatgagcaagtttatcgatctgggtggtgccagctgatccctctagtacaggatctgcaaaatatctcaagcagtgatcttaggtttcacaatagtgatgttgtcaccaggagcaatttgaggaggttcagtaatcttgtaatctccagctccacgattcctaaaccataatttctaatcttatggctaatttgtgagtcctgcaaagacagtccagtcctcaggcagaaagggagtttgttttgggaaagggtgattatcatctttgtttcaaagttaaactataaactaatttcctcccaaagttagttcagcctatgcccaggaatgaacaagaacagtttggaggttggaagcaagatggagtcagttaggtcagacctctttcactgtaataattgtctcagttataatttttgcaaaggtggtttcaagtatggatcattcacacaattggaatcctttacagtcattacaaatctgtattaatcatcatggaaaagagctatgtcatgtatttttattttttaaaattttaaaatttttattatttttgcagaggtggggtctcaccatattgcccaggctggtctccaacccctgggttcaagccatcctcccaccttagtctcccaaagtgttgggattacaggtgtgagccaccacaccttgccttgatgtatttttaaaagaataaagcaggctacaaataatgagttatggtgaaactctgttattgtaaataaaattaatgttttaaaaattatcaaacaaggtagactcatgattcatacaactgtaaaatgaacacgttaaagatttttatttaactcattattaatgagggaactggtgagatgttaaaacagttcaaaggagaatccaaagaatgaacatatttagggatcaggaatatttaaatgaatttacaaatgattgcaaaaacagcttcttccacagtgggaaagggagtcaattgtacctccatcttatggaatgtagacaagtattattttgcgttgttgtcagttatctaacacttacagagttgcaacatagttcaaaggcaatgcaaggcacagagcccccctacagtcagaatcagatcacttggaaggatgggttctcaagtggagagcctaaacaaggcatagttttctcttaaatcacatatttccctcatatatgtttaaaagtgtggaatgaacagaaagaatgacaagttgttttctatggatggtaagattttgtgttattatttctatcttttctgtttttctgtactttcacagcatttctaaaagaacatataattttttataatcaggaggaaaaacacacttctgtattgaaaagcatttacaaatcaccttctcatgtttttagtaaatccttcaacaatgacaacaataaaggaaattgctatgtatctgctgcctgtagggtattgtgattactagggtgagaataggggccagagaatgtgggcggtcaacatcagctgtgctaacctgctatttctggtgggtcctccaattgattgcttggtgttcaggcctaaattatttccacttataagagatatgatggaaccaaagtgcattagcacgtcagaggtgcttttagctttaacactcaataaatgaagtgccaggaagttgctaatattttctgtaccttcttaagatgagtccagaaaaagcctgtttactaatgagcagttcctgggtgggagaagggagaaggacagtgtctgtgcatggtctgtcagaagggaagatgcttcccataactgtgtgtgatgacagttactaatgaatagatgtttcagagttcatgctacccccctctagttaatgttcttacttatagaactgatttgaaaattaaacagagatgtttctttcttcaattttatggctgtaaagagataataaacaaactgatggcttgtattcttccagaattgtttgcctaggtatcagttattgcctagagatttgttgtctttctgtcctctgggtgctttttcttcttttttttttttaacctctcatgccattgtatttctggtataatccttattttcttacatcttgccaaactgcagttccttttggatgccagatttttcttgtaatcttcatcctgactgatgagagatttacagagcagttggcccacacatacaatatagctaagaatcttattgacagtgtacacggactattttggataatcctagaggcttatatttatagcttgttgtatcaaaatgattaagatagcatcaataatttaacagcagtctcttgctcttctttagctcagagctgttgtgcatgttgatgtcaaaatgtttttgttgaatgaatgaactgaactatgtttatttgtagcaaactatgtgtcacctttatggagtactggtgtgagtggttatgtaagcattctgccctcggaataacatcacctataaaaaatatttggggtgctcgtatccacattttatttgaaggtttagttctaagaatacttatctccaacaatgctgagtatccttcccattatgctcagggcactgatctttaggggaagactggccatgggagaaaggaagtaggaggcaaattttgtttttgatgcctatactaaattaatttgtgttaccccaaactccatgttcacctggtacctgtgaatgtaaccttattaggaaatagggtctttgtggatgtaatcaaattaagatgaggtcatactggattaaggtagaccctaaatcgatgtctggtgtcctaataagaaggctatgtgaagacacaggcacagagacacagagagaaggatgccatgtaacaacagaggctgagatagaagtgatgcaactccaagaaaaggaatgccaaggattgctggccaccaccagaagctattaatgggaagaggcaaggaaggattattgatctaggattcttctctagaaccttcagaggaagcatggccctgctgacaccttggtttcagacttctggcttccatactgtgagagaataaatttctgttgttttaagtcacttagtttagggtaatttgttatggcatccatgggaaactaatgcaatgtctcccacttgatgttcccctttcttccttagtgtttctcattcccctggtatcctgtgcccttatcttgtagctttattcatgtgttagtcaagatcgagtgaagtaagaataaaacactctagataaattgaacaggaaaggatcgaatatagggaattacctgcttacacactgttcgagaaatttgggagtcaaagtcaaggatacttttgttggtatcaagaactcagaaagtgcagcaaaggcaagaaatgactacctaatatcttagcaacctagaacacttaatggggtcattctcaggaagatgcttggaagacaccaacaaaacactacatatatattaatgcccaaacgtccgactccagctgctgccagtgaataatgtcttctctttctcttcccctaccaggtttctgtcagtgatggtcattggcagaatatgaatgcaaaccctactgctaaagagagctgggaaatgtttccagactttcagccctagtgatactggggagagttttgaagggcaaggacagaactgaatacaagagatgctgtcctgcttactcagcttaattcctttccttcaaaacaaaaacaaaagcacttgcttctcagaaggattctgttaatctatttatttacaccaaggtattatggaccaacaataccttcaaatgcatttttttcccccaggacaatttgtactttcacaagaacaaagatttgatttaaagaagcgaatccatctaattgacaactggttggaacagggactcactgacaacactgtttcctgaggggtcctcagagatacaaagacattttagacagaaatctactcttcaggattttaatctatttagccttttctttgtatgtgcaaagatatttggttttgttgatcttttgttcttatacaaaaacataaatgagagatttccttctggttaaatgaggcatattcttctcaattctctgtcgctagtggttttcaatggggcagtttggattcccacgttgtgctctcaggagacatcttgtaatgtctggagacatacttggttgtcacaactgaggttgggggagtactactggcttagcttgtgttgaggtcagagatgctacgctacatcgtgcaatgcacagggcagcccccacaacaaagaattacccagcccaaaatgtcaatagtgccacagttaagaaattctgctcttttgctatatgtggttggagcaaaaaggtgagatagagtctctgtcttgattctaggctgtggtgggactgcctgccctcaggtacccttggatactgttgtcgccctttgatgctgctgccttaacttcttcgctgtcctctgaggtacgctgccgaaaagtgaggccagagctctctcccccagcttcccaattcagaaccaaggtgcgggcgctgcatgccctcccttttaacaactctttgggtttgttccattctgagatccctttgattttcgaagcctccttcccatatcctgagagcagcctgtctgtcagcttcttcactgcagctccttttccagagtctcatctcctgcctagaacgccttttcccttctcttctcttcatcactgtcttcttcacccctgccccttgccaaattgctctgtatcttgacattttaaacattctcctctttctctacatcacctgcctagattcactggagcaaagctgatggcataagaaatctgctattctccccagatccctcccctgatcatttatagacacttgccatctcccgcattcccagaatgcttatcttgaatttacacctgttgtaaattgccccattcatgaattaggctaatgattgtctttctttgttcaattgcttcatgccgaaggagtcacctctctgggttctcacatgctgtaaattattagagggcgaaaagcaaggtcccagtagtgctcttcaaccaagctggacacaaaatcagagctaatcaaatgctaaaaaaaaaaaaaaaaaaggctttttaatgatgaaggcgatgataacccaagctggaagggacttttgaagcccatgaagcctgttcccagtgcacctaggcagactaaatcatccaagatagatgaggatttatccaattttcaatgatttccagagagagaaatttcacagcctgttccagttattaactaccctgttatgaaatgctttctctaacctaaatcgactgtctcttaaggaatcaacattgtataaaaatatatactaaaaaattttgaaatatgagttaagattttatttatatacaatacatttatatagtaccatttcccttcaaggtaagaggattcttatttttatctgaagaaattgctaagccagggcttttggcaaggggattggaattgaggacaaatgagtagcttgaaaagacgatagatggtatgaagtaagaaaaatagtttgattctttctgtatactctcagagtgttactgcacagcttacttagaatgccaaaagctcttttaagatgacttatatattggggtgtttggggaatcacctctccctctatattaaaacggtgcattgcattgtttcctttataacttcctacagggaagctgttaaattatgcaactttacagggcagttctgtctacctcagcattacccctttcattgcaggaatgaattttcaagatttgtgtaatgtattcagcaaataaggattgaacctctttggtgtgcgccggcaccatgtgggctaattatagattcaaagaagaagacactgtcttgaacctgcaaggggctttggagttgagaagggaatttggacatgtaaataaggaagtcccagaaagggctataggctctgtgatagcagcctgtgaaacgtacaatgggaaacatttggtacataactttctaataagtgtgtttttctgccttcttcaagaacacatgactttaaaccaagataaacctggtgacaaatctggtctttatcactgtgtgatctttctgagtctcagaatctaaccttgcaaatagaaagaaaccccatctgccttaaagattattgtggtgattaaattaaactaaattgaattaaattcagtaatgtggtttaaaaacactaagcaaagggcctagtattgcataggtatttaataaatgttgtttttgtcttatctctttgatgattcaaagatattgtaagagacctctatatttattcttttttggggaggagggggcttctaacttcaaaataaccttcttacatttggagactctcccaagtcatgaggcagagccaaccctactgtagaatctaaagatgacacagacccatctttccaaacttccttgcagctagcagtggggcatatgggcaatcagacatactaacacctgtccttgaattagtagctcatggtttggagaagcaggggctacccagaatccattcttatgatgagtcacattggcagcagccaccacgcctagtcttagaggtctcagatgcagcagtgctaacagaggcagttcaggttcagcactggtggtatctgtggtacaagtttcagtgtctgtcctcagtggtagcagctgtgatatccttactatcctgatctgtgatgtgattttaaatgttgaccctgggtgcattgactccaaccctgattcttatgatgtttatgaacaacaaattatcctttaattaatcccttttgagcttgtgttatccacattctgtttgttttgctcacaactagaacttttgactgataaaaatattgttataaatatcataatcttgttttgttatacagtaatgttttatatgctatcaaataaggaaagactgttgtttccttccatatgaaatagactcttataatgatcccttttcaattggtttgcatttttttggttgttttttaaaccttactgcatcttcctttactgtcatatgtcatttctcattagaaaaattacagcataccagagtttccattttcttgaagctacatctacatgatagggagagagctataccttgtaggattgccaaaacctataatgccatatgcagagataaaacaattcagactttttgtttttggcaagaaaaaaatgcctcacaattttttttatgaatattctattttaaaacctattaagccccaatgctcttttctttagatagaaatttctcaatattttaactaaagctgtgaaatagaaaaagggagaactcttttaattttttaaaaagaaacgttgaatcagaaacaaatctctaaggttctcattccaatattggcagcatagcttgtattgtgctaactattggactattttgctgataataactgtacattaaaaattataaactgtaaaaatcgttgtttgaaagctacttggaaagtagtaaaagcaagccagaactataagggatatggctcttgaaagaagaggagcacatcaggcaggatccacacttaactggtttttctgctgagcgtgcttcccagtttgttgtggcacactgagatagagctcaagcagaaggtggcattcttattaagtgaagaagtcagaggttagagctcagggctaccaaaaacttctggaaatcgggagggggaatcctggaaatggagaatcctaaaatctacatacaaatccctagttgactcctaaactatgcacatgcaggtatgatttcaaggaacacaaaaggaagcagtagttggaaagttaatgatctgagcagaggtgataccagcttcctggttctaggaagacagagattggagttcaaatcctgccaagttataaagatttggcaaacaattcaagattttctttggaacccagagtagctatgcattagaagcagggaccatgtcccaggaatgataactatatccttgaaataatggcaaaactaaaatagacccattgtaagaaaacctgaaaaccaagcctccacaaaattaaggtgacccacttgtaatataatggtctgacatgacaaaattcaacactcttcagaggaacagagcagaattcacagtctatacaacgtattatcaataatatccagcatataatcataaattgctagacaggcaacaggcaggcaaatataacctataatcaagtagaaaatcaagaccttgtctccataaaaaaggaaaaaaaaaagtcaatagctgaagaccacatgtcatccagattttggtattagcagataaagactactataatgtgtttgaaggtttctaggaaaaaatggatatagtgggtgaaaatatggggaataaggggagagagaagaaaccactgcaccctgaaaaaaaaaaatcccaattagaaatcctacaaaagaaaaataaagatgatatctttggtatcctattcacttttgtatcctttgcaatgtctttatgccaaatagaattgtttttgcatagctgattgttaattactgttaaaaggtaaatttatttaaatccataaacttggacttcctcctttaaatcatataaaaataggcatataataccttactatactataataaaatgtttacagtaaattaaagtagtaatgaaccttagtaattttttaatatatttgaacaaattatttcagttaagctattctgccctccaattaaatacaatcatgcattacatttactgtctatatctaaagcgtaaagagtaaaattatggaataattcaattggagatatctttggcaaaattatgcatcaattggaagaaactacaacaacaattataaattattctggtagggtggttttccttatttagaatcagctaactgaagtaagctagctttcaataaggtgattaatttgtttattttaattattgaacataaaaactgtttgtgagattaacgatcacattatccaacataattaacctgtaatggaattttgtcttcttaaattgaagtatcatttttttcagtcctcttataaattagtcctgtccgtcttgaatcaatatataaattaagtattgttaatcataaaatatttttaaaatagctacaatatagtacaagtggttttaatttaggtctcataaaactaaaagcagatatccctacatttttgtatttcatagaatagtaatatatttaaaagtatgtttttgagattaacactaatttgtttgccaactttatgttgcatatttgaaagaacagaaccaaaaaccagtatatgtactatctttacttcataaaagaaatgactttacagaaccaaaaattaatttaggtaaccgcaatatcaagagaaactggaatcctctatgagcaagcactgtagatatttaaagccacatctatttatatatccgttacatagacttatcttttttcactgcaaagtgttggacacctcctcactgaaatctacagattatcatttaaaagccctgcagtagtatgtgaagggcttcagtgcagcagatgggcttggttcatgggagtggttgggtcctgtgtgtctctttaaagtgtttggatacatttatctatcagcacacgttagtacttttctgggaagaagtttcctaactttcacatagttatcaattgtgttcttaattccaaggataaaaatccttgctagtagcccttttcatttatggcaagtggtgtatctcttccattttctcattgctctcaactgttaataattgacaagagaacccagtttaaagggatattcatttggtcatttcttagaatcatttcacttacaagaaatgaagtgagccttctcggtatcagatgttgctgttgtaaaatatgaaagccattgccgtttttcataggttccactgaagtgatagttgcttggttttctttctgtggtggtacatttgtgagtaattatttgccctgtgactttgtgtataccctacttcactcaagaaaaagattgaaaattgttcctaaatccatgcacaaaacaataagacaacatgtaaagtaagtaataaaagttagtcaacaagaaatgcagaccaaaaagaaagatgatctgaagccaagtgttaatacatcaaacatgtgtctcaagctgcttctgcatgatacacagttcagaattggaaccaatcttcctagtagtcagtacaaaggggaaaatcagttgaattagagtgggaaagaacacaggtctgacaaactagcttgagccagcagaagccagcttgaatgagcacaggcccatgtggcccagcacaagccaatatgaaccaattagaagcggcctgagtcacacatcttccctcagatggtggtgtggttctgccttccttttcctgggaacctgccttcagcagcatctcccctgatgaggagggtgagatgtggacttagaggggctggccagacagaaaggatgaacaagggtgtcttcatcttgtacaaaacacaaagggggagtagcttcttaacttacatttgaaagtagcttggcggtgctcccagtgagtgagtctgatgttccagagactccacagacagtcatcatgtgttaatactggaaactgccccgcctcccccaccgacaacacacactaaaaaaggggaaaagaaaaccagacaacctgcagtttgaatttagatgtatgagacaaagtgacagccttaacattcaccaaatttaaagaggcaacattgaatggtaagttatattttaaaatatcaaacaccgaaatgttaaactttcagaaatatgaaggttttaaaatgtcaaaactaggcattttttaaaaatcccacagatctaatttcaaagtgacaaaactaaatagaatgtctctctgaaaggtacttttgttaaaatgaaacagtgtttgaattcagtgggtgattattcattgctctggcatttattttacgatctcagtaaaaactcaggagacaacaactccatgtaatatgacagagttggactgactggcatttttgcagttctcactaacgggattgaatccatcaagacttggatagtggtggttgcttgagcctctcaatacctgaattttccttcataagcaactccatgtggagctctggcaagaaatggtggtatgtaaggttgggcaaagcagcttgcatcttcttcagacttggatgtgtctcctgattccccggatttagttgccaaattctctcctcctttttactcctcttggcttatagatctgtttactagccaatgagctgtttgatgtctgagggaaacctctgcagatggaaaggattctttagagtaagttggcttctatctgcatgtttagtttagtagagttatctttgcaaaaatcctagtttttcatgtgttttgaagttcagtatggaaatcttattattctatttttaagtgtagttaaataagtacaattaccttcatgttttctttggctaatatttaattaattcaagtcaaacaaattctacttaaataatcatacccattttcaaaggtagttaaacacccttaaatattttatactgcaattatgcatttaatatagtatattttcctttgaagtgcttccagtgacctgatagggcaaatcagtatgcaaacaatcaaagctttccaagcatttaaaagtactcttataaatataataaacttacaaagcaaataagcttttaaaaatgttccaattatatttaaaaatacaatcaattttcttattcctttcagcttaaaatggcaaaactaatgtatagtttcttaaatcacctatataacatatattcttcataaaattaactcaaaagtactaattctgtgagttgatgttatttccattgttggcttaattctaaacattccgggtgttgagatgtttattactgtggcagaaacttccagttcctccccacagccatccttcccttcctctataataggcactggcagactttttctgtaaaaggccaaacagtaaatattttaggctttgcaagccacatatgctctctgttgcatatttgtcctttataaaagaaaacaaccatttaaaaatgtaaaaaaaaaaattttaaccctctggccatacaaaaaagatcagtgggctgattttggcctgtcaattgtagtttattgacccctgttctagaattttaaaatcattcgatttttttttttcttttaggtgggcacatttcccagactctcttgtaggtaggtggccatatgactaatttctgtcctctttccctccgaatgcaatgcggacctaatggtgcagcatcttggctctgtagttaggaacagcaccatggggatggcagagcaacaagctagaaggagactgggctccagggcactgcaggaactttatgcctctctgagaactgagcggtgttgacaaccagcctagacttctaggtgagacaagaatacatttctaacttgttcaaattcctgtaacctgcagccaaatctgtatagctaatctactttcttaggggacagatttcaaacctcaggggaactcaagttaatgagtcaaaaattcatacccaccatatggctgtcaattatttgataattgctttcaacttctctttatttttgtgatgaaatcctgcacctttcacccaggcctaaagaagttctaatgctattccattgaattttaaaattctcttcataatttggtagaaagcccagtgacatgtttttggtgccttgttttgtgcatcagttctttggttggtttcttctgagaagtctggactgtttgtgggtaagaacaaaggacccttgatttctttcatgtaaattgtacccccaaagcataaataactctgagactccactcctaaggctctggatcaagtctccctcattaatttctttctgagacccagtacccatctggtcctgggacagccatgcattgctatagctgcgtttcttctttggccctgtgtttctgagcctcagttttgataacatgctctgacttctcgggttctagagctctggcttatgtttgccagtcttcttccagaatggaatatactgccaaatctctgtttcatgataaggtccccttaaagatgcaagtgcttgacacatagtagagatttaataaaaacaaattatcttatcgttaatgcttttgaaaactagaataaagccataactttaggtgacacttcttactggccttaaaaataaaattatacaatataaatgttttctgccagattaaattggtctctttgcacatgaaagttgggtgggtgggtggaaaacatctaaaatttatggaaaatattttcttatgaagaagctgagacatactttccccaaaagcagcattaatatcctgagagcactttacttgagtggctcaatttttgtttgtaggttcctaatgactgatggacatttaatcatttttgcctgatgtatgtttttcagttgaggttcttgatgcatgagaagtaacctactgaatttcttgaaaaatagcttgcctctcaatgttaagagtgtggacttgacatatttagagaagctttcatatactgtcttttacatgcaatctttggatgctttctttactttgatctgtgtaaatgagaaaggataaaaatgtatggtttaaccaaattctggtgaggtgacttcttgattatttatgaagctggaaatgtttaagtgtttcatttattcttaaaattctgtcttactattagatgtatattgaagattacatttatcttggcacatatatttgacttacctttgggccacatcttttctaaatttacttgaaagtggagttggaaatatttcttaagtatctgcagctattttattcaggaatattgaaatgtaagggaatattagaacacatttaaattttccaatgatgtcatgttatatgaacttaatgatttattaatttgtcatcaagttggaagttaattaaaaatcaaagttctttagcaacatgaatcactgaagctttttccctgaattttttttcttggtgactggcattgttgaaggagttcattcctgattactggcctttaaaaataccaactaaacttgcttacaaattgcaagcataatgacgtaagatattctcttgccgttgaataagcataatattctcctcttaaaattttctcacttagctttaccagaacccaactttccagactagggagagttggtacttcatttgtcataggaactctatctgtacattttaaaaaatctgttatgatttataccctgttgtagatcatcttaacacttaccaatgagtcattgctaaaagcacaatatcaaatttattgtttgtttgtaagaaacctaaataaagagtgaaaagagacctcaaggcaaagagaaatttttgaaaaacatagaactctataacacaaatgacagagaattctttctccaccttttagtagagcattgtgtcatggtagatatctctcttaaactcttgatgtttccatgaaccgatagctgcatgtttatgtggatgccattgggctgtgtacagcaataagcatctcctataataatgaggtgatagaatattaatcatcttcaaaaagtccttataaaaacaattatatgagaaaatgcttaatagatcatgttttgattaaaaaatggataaatatataaatgtgacatatataattttgttacattttacattttcagccttctttttacatagcaattatataaatataaaatatgaaacatgtaattggtaattatacataaattaatattttataggtaaatattttcccttctgatatatatgcatatatgtgtgcgtgtatatatgcgtgtaccttataccagaagggaaatactatagcaccccgttgagttgaacaatataaaattgtgttgacattcaaccttttattaactcacaaaaatggtcgttttctgggtagtgagtcggtgtgagacttttctcgaagtaggtatgtttcctttactttatgatccaaggtttttttgagaggcatttatttataacctttattatcaggaagaaacctccaagaaacttgttcaatgaagcctcaaaggcagcccctcctcctctctctcactctgatcttgccatctttccatcctggttgtctgcagtagcctctttccaggtagcagtgctaatgttctccccaaacacaccccaacttcttcttcttaacctcctgccccttgtgtccagctggttgcagactctcttcttccatcataactgtcttcttctctttctgttgttactcctctagttaaacacagtagaaagcagcaatcattttaatagtgattactatgtgccagccattgttctaagccttatacatgttatttaatcctcatagtgacctaagaagtagataatattattatccttcattttaagatggatgaggaaactgggggacagacaggtcaagtgacttacctgatacataatccatatccacagatcatacgcttaagtagcaagccatacttctctctaggtaccttattttgcctcttcagtggtttctatcatttctaaaatgagcagccacatttctgcctcaaggcctaacatcatggttcttcctttgcctagaatatgggccaccaaactacatcctgtgggccaaacctatcctgtccctactcccacctgtttctgtaatagttttattggaacacagccattcattttcatatcatctgtggctactttcttggtataacaacagagttgagtagttgtgaccaagaccacatggcttgcaaagcctcagatatttattatccagccctttaaagaaaaagtttgccaactcctggcctagaatacagtttctgtgtccaaccattccagttactatagctgtgtattcaattaccccaaatcttagtagtgcaaacaaccatttatcatgctcagggaatttatgggtcaggaattccaactggacatggcatttcttctccatgacatctggtacctggactgagaagactcagccagctcaggactggagcagccggggcttttcaggcatcgcttcactccctagctctgggtggacttcgcacatgctcttttcagcctagtagcatccagacttctaacatagggtctgggttcccagtgtacatgtcccaagaaagagagccaagcataagctgttgcatcttttttgactagccccagaaatcacgcaccaactacttctgtattatcttgatcaaggcagtcacaaagatcttcccaggttcaagctgaaggaacacaggccatacctatcaccaatgacacattataagaagagtatggtagaatggaatatctattggtgtgactatctttggaatataaaatccaccatccacatccacccacctgtctttaactctagacatcttcatatctcctcaaaccataaccaggaactcactgtcctgggctaaaaaaaatttctgccatgttccacctcatctctgaaactgttgcttatcctcatatctgggaggcacattcatcttactgttttctcattctgttagtagaaaacttcaaacttttaatctaagccctgaggattactcccagcctgaagctctgttccttaggtgtgtcttattgtaaatgtgtttgtttgcttgcttgttcttctgagccagagtcaaaccttaaaatctgcaagtggctttctttcctccctgtgtctaagcaaggtttctgctctgccctaggtttaaaaatcttcattaccgctttctgccgtctgcagaaattctatgtgaaggggacacaggtggcacctgggtcaatgtgaaaagtgtttgtgaaaggagggaaccagggtacttgtcttaaagctagatttattacaatatttcacacacaactaaaaatgtcagtggacattatttgaaaattgcaagcagtggggttgatgcctttatgttatcccctggttctgccactgtctttcttggttttggactctccccttcacctggtataatttttgttgttttagggaagtaagctgcttcagggtagctttaggatttatcaaaggaaagagaaggttgaaaagaagggaagtagatcataaacatgatttgtcttcaatccaagcctgccaataatagtgggtaaaagaaaaagaatccttccttagaaatttaaatgcattcagaggctctcttagtgcagtgggcagcgcgtcagtctcataatctgaaggtcctaagaaatttaaatgcattcatgtctgtaaagaacagtaaaaaagcaggaacacatttttgatgattcaccacataggtacttgataagcttgatactcttaattggcaaactggattttcattacagttcatctcagaaaataatattttggttatgtctttcccactcttataaaattttccacccaggtcagaggtcagtaaaccgtgccctgctggctaaatccagcccttcatctgtttttgtaaataaagttttattggaacgcagtcatgcccattcatttacatgttgtgcatgattactttagcactaccgtaagactgagtagctgtaagagagatcacatggtctgcaagggaaacatttactatctggagttttacagaaaagtttgctgacctaaagtgtatgttgccatttaaactaatttttagatttttttccatttaaatgtcagataatacagtgaatcacatggtgaattttagtagggttatattcaactttacactgaattatgtagctagtcagtataaaggtgtcaggagaaaccaagctacctcttaatttaggtacctgtatgattggacttgagaaataaactttctaaaaaagaattttggtcattagtgttcattaacatccttatttttttaacatctcaaaagaattaatgaaaaaaataagagatcaagacaagaatttatgaatctatgagatgaactctttggaagaaaaagtaagattaatatcctattaatgtataatgataattgatttaaaagaaatttatgaaaagatttccagtgactttcaaaaatggttacagtagtgaaactccttggctataacaacgaaatattagggattgttgagacctgcaggctgtgacaataggagtctcagcatgggcttgggggtggtaggagtgagcaatcatcacttatgacctattgtgcaaagtaggggtgaatgttcctcaaagaaaggtagaaatttgtctggtcaaggaatacaaagttgtctgagaatttagttattgtagtttatatcatccataatcaaaatttatagatctttattgaatttatttttctctacttctagcataacccactctctcccctaaatgggaggagaggaaatagattcactctaaaaatagcaaaatagtagagttgactttaattaaagcctttcaagggtgataatcatgactgtcaaaatttaaagaaagtataagaacctaagagatcaactagaccagagttttaaactatgccccaggttctgaaagttctgtggggcacccttaggggccattgcagttgggggcctgtgaattagttcagtgtatgatccctccctactttcaaacataacagctatgcttttgttttctatgactgccttacatataacatttggtttatgatgggtttttagtaaaatgttttgaaaccataggttctaggccaactcttcaaattttgtagatgaggaaactgaagctaccataatttggaaggcttaacttgggtcatacattgaattacagtagagctagaattagaatctaagtctcctgtgtctcaatcaagagcttttaaaaatgatttgggctgggcaccgtggctcaggcctataatcccaacactttgggaggccaagatgggaggttcacccgatctcaggagttcaagatcagcctgagcaacacgacgaaatctcgtctctacaaaaaatataaaaattagctgggcacagtggtatgcacctgtattcccagttactcaggaggctgaggtaggaggatcgcttaagcctaggaggccaaggctacagtgagccatgttcacaccgtcgcacccctgggtgacaaactaagaccctgtcccaaaaaaaaagacaaagaaaagattatataaaaaggaagagcaggctctgatgccttagtctactgagagaaaagggtaaacttttgtatatttaatgcaataagagtaggagtttagtatttgtgaggtactttgacttttgtcatcacattctactaatagtgctcaaattttagtgtgcataagaattgcctgggaaactattaataatgttttaaaagtcagcttcccagttatcctttctagaaattctgatgtggaatatctgcattttagtcaaacatcccaggtgcttccatacaatgttttatgtaccatacttagaaaaatactgtcttaaagccttatagttgtatcaggaaggctagcagtacagacattataagagattccttggtaccaggccctctattgaggcaaactactacaaagtagatacgtttaatatataaggcaagttaggttaggctatgctgcagtaacaaagcaaccctgcaccaggtgccatgtctcaagcctgttatcccagcactttgggaggccaaggcgggtggatcacctgaggtcaggagttagagaccagcccgaccaacatggagaaaccctgtctctaccaaaaatacaaaattagcctggcgtggtggcacatgcctgtaatcccagctactcgggaggctgaggcaggagaattgtttgaacccaggaggcggaggttgtggtgagcggagatcgcaccattgcattccagcctgggcaacaagagtgaaactttgtctcaacaacaacagcaacaacaacaacaacaacaacaacaacacaaaaaaacaaaaacagaaaaacaagaaaacaaagcaaccccatttttggcatactacagggactgttcccatatcatacttctgtcattagaagcatgtggtgcccaaagtggctatggaaaggaaagagagctataaagtcatgcttgataaacttactgaaataacaaatacagatatatgtacaaccgtgagtgtgcaacttaatgaatttttacaactgggcatactcttgtaatcagcacccagatcaagaaacagatcatataaaaaaaccttttgtgtcccttcccagtatttacccatatccatccgcagtaagcataactaccaagcaggattgatttaagtttaggttgagaagcggcttatatttcttcctaccacattccattggtcagcacacagacatacgaaccctgatgtaactgtaaggggtactgagaaatgtagttttcctgtgttcccaggaaatgaaatgctgtggttaacatataatattttctttgttacaagttactaaattataacctagaatatactctcatggtccaaataatgatactttctgtgcttttctatggtgtggcagattaaataaaaatttgcatactttctaacttaatctttttctgtagaaattaactttattcccaaaagcctatatattcatattgccaattacttgaatattattatatggacttgtagatggcagataatttagagcaagatggaaggcagtgtgaacctctagggacaattcatttctcaaacatgccctgagcaacatatcaatttcatgggaataagcattaattcccgtaggttctgggttcctgaaaaagtccatgtatgccctagatgtaccttccttcaaatcacaagactaatttctccagtttactttctttcttcactatagccctttgacatttgagattggtacttgtctttctaatttttgcaaaacacttaagtttacttattaaacacttctctgttgatatttcattggaagcaagactatacatttacatatgcttctgactttaaggttgttaccatcatctttactcaattcagtgattaaacaacaacaaccaccaccactaccacccttgttacctagcattaactaatgcaatactgcttagcaaacatagaaggaaatacaaaaatatagaagaactgaaatacatggttcttgtctaccacgggcttaccatttagttgttctcaagatgtagacaaaggaaaatacaatgcacagaaccttgtcagatataactagatatccatatgaataaagtactaatggaatttggaagaggtgattactgtgagctgaaacagaggaaggatggttagaggaagttagacttgctggaatcctgaacgatgggtagactgtccgactggagtcaacggataagaatgttccaagtacaggtagggaaggaacatgtgcaaaggcttcttgttaggaaagagcacacccaatttggagaaaagtgaatcaactggccttcatgaagaggaaatatgaaataggagcacattagggggttaacttagatgtagcttcaatttggtggaccctgaatgctgggtggagatgcctgtgcttaatgctgtaaaaaggtagaaatgatataatagcgacatcaggaaatggttaagggaattgtgacacatccacaggatggaatataaagtgtcattaagatgatgtttatgaagattttataatgtaaagtttagctcataagtgaaaataaagatatgtacatatttacatggcataaccacaacagtatgaaaaaatatgctatgaatataaaacagaatgaaaataaatatattaaggccaggtgtggtgacacatgcctttaatcccgatactttgggaggccaaagagggacgattgcttgagcttcggagttcgagaccagtcttggcaacataacaagactctgtccctacaaaaaataaaaaaggaaagaaaataaatatactaaaatatttaaaatcatgttcttaagattcataaattttgaatgactgctttcttttttccattttacttttccagtccttcatgatcagcatacattgcgttttatattaaaaactaaataataattaaaagtatttgtttattgtgaacaaggaactgcatggacagtaaaacaaatataattcaggctatttatatgctagtgggaagaaaaccaggcatcccatgaacagttaaataacaatatagtaattgaattatagctctccaaaatattttgacatcgtttttgagatatattgttgcatgccatgaagtttaccattttaagtgcagagtttgatgagttttagtcaatttgtatggctgtacgattgtcacaagcatctagttttagaataagtttcatcatgtcagaaagttcgtatgtgcttgcttgcagtcaatatccactcccacacccagatccaaccaaccattgatctgctttctgtctttataattttgttttgtctagaaatttcttataaatggaataagataaatgtagtcctttctgtttggcttcttagtgtattgttcttgatgttcagttatgttgtttcaactctcagtagtttattcctttttattgcttagtagtattctgttgtagagatgtaccatgttttgtttatccattcaccagatattggacatttggattgtttccaaggattatgaatattatcaataaagttgttatgtacatgtgcatagaaatctttgtgtgggcatacatttttatatctcttgggtaaataactagaaatggaattgctgaatcatataggaatgatatgtttaatgttttaagaaactgacagaaataccattcaacccagcaattccatcagtgggtatataaccaaaggaatataaattgttctaccataaagacacatatacacatatattcattgcagcactattcacaatagcaaagacatggaatcaatctagatgcccataaacagactggataaagaaaacatggtacagatgaaccatggaataccatgcagccatacaaatgaatgaaatcatgtcatttgcagcaacatgggtgcagctggaggctgttatcctaagcaaattaatgcaggaacagaaaaccaaatatctcatgttcttgcttatgagcaggagctaaacattgagtacacatggacacaaataagggaacagtagacaccggggcctccttgagggtaaagggtgggaagggagagaggattgaaaaactatcacgtactgtgctcactacctaggtgatgaaataatgtgtacaccaaacccctgcaacacacaatttacccatgtaacaaacctatacatgtaccacctgaacctaaaataaaagttggaaggaaaaaaaggaactggcgaactgttttccacagtggctataccattttacatattcaccagctgtgtatgtgagttctagtttctccatattcttgagaacatttgttattatctgtctttattatagccattctagtgggtattaagtggcatttctttgtggtttagtttgcatttccctgatgactaacgatgatgagcatcttttcttgtgcttacttaccattcaggtatcttctttggttaagtgtcttttgaaatcttttgctcatttctatttatttgttttgcagaatactttaaagcattacataattgtatcgtttagcgtcgagtttatcagcctcagcactattgacattttgaacattcttggctgtgagggctacccctgcatattgtataatatttagcactatccctggcctctatctagtagatgccagtagcacagctcctgtcgtgacaaccaaagatgcctctagatatttccaggtgtcacctaggggacaaaattgcacctacttgagaaccaatgatgtaacaaattgatatacattcaaaggactttaagagcaaagatgtgtagtaagagtagaaattaacttggatattttgttttgttttattttatttattttatcttattttttgagacaaggtctcacactgttgcccaggctggagggcaatggcgtgataatggctcactgcaacctcaacctccccaggctcaggtgatcctcccacttgagcctcctgaatagctgggactataatcgcacgccaccacacccagctaatttttgtgttttttgtagagatggagttttgccatgttgcccagcctggataacttggatattttaaatgaacagaatttagaaagggggaattcacattatgaagaatttagagggggaatttcaggtaaagcattttctttttataataagttttgctgctaaaacagttttccaatgctagaaacttgagatgagattagatgctgtttgcctaccatcctaacagcactattttcctttcttgtctttatccacaagtctctctcagtaagcagaagaatggcacatgtcttttgtgagacatgaagataggctctgattttgtgctctcaagcctaatctttcagtgtgctcctgttggtacagtttttatttttctttgaattattttcctataatgaatatatatgaataatattactgggataaaggattaactttttaaaatgggtttttaatatgtatcacctcttagttttccaaacttgtgccagttaggaaatgtccatttccaatttctacaggccctgttgtaccaaagatagtctttgaataaaccatttttctctatgtattgagaagcagctgcaccagattctaagcctctaccagtaatagtctaacatttcttatttcttaaagatcctatatatgaaataaacaatatgctaagtcaaaattcctccacaatataaaatccctatgacagactaagtttggaagtatagaatgataggaaatgagtttaaaaacataaatctacttgtgtgtcaagtaagaatggtgctttatgcaataaaacctccttaagtaaacatttgatggaaggaataaaatgttacttgcacgtaaatcttttttattaacagtaaggttgtgtgtataagtgaacactaatgtccccaagggaagaggaaacagaaggagagattatagcaaataagatgagggcagaactgtttcaccatttatcataaattgatccaaagttgcttaaccaaacctgaaggaagatagatgcccatctggatgggggtttacataactgagtgaagctaatacttaatagcaactttcttcaagggttctgtgtgccttaaaaacctaatgtaattcagacatgaatagacagtgtttcctgccctcctccttttttatttccctagcttaaccgaaaatggaacaaagaaaaaaaatacacagattagatggagctagccagggattgggttttgtggttacagctctacttcttttatacagagctagcaacattgtaatgggtagaattttctggagtagtgtgacctgaaggcaattggccaaggaagtatctcactctcccttgaaatgagttttctagcaatttatagaatttcacaaatgtgttcccttttacaagtgtcaataatgagggataatataattaaataagtgaaaggaataacaaatgaagaattaaacatgcttgagcccaggtgctgtacactgctggagttcagaacatgtagggtggaggtatatgacgtcagcctgcctggggtcagatgatagtagctacctcctgggactggcatgcgcataaaatgaaaacggtgcctggcacaagaacccaagaagttttagccatttattattgttgtggtagtgttttctttgtttctgtttttgctgtattttgttttgtttattttatttttttgaagacagtgtctcattctgttgtctagactggagtccagtggcacaaacatggctcactgcagccttgacctcctgggctcaagcgatcctcctacctcagcctcccaagtagctgggacgacagttgagtgccaccatgcccagctaatgttctgttttaaatcacagaaagcttaggacttctaggaggatagaatggggaggggagaatcattctaaagacaaacttggctcaatgtcaaaatctcagtcatcctgaggaggggcacttaagagaaaagtggtgactatcacttgaatttttttctagtttaacttcataatctgcatttaggtctcaattccagatagccagtccctaaatataaaaatcaagatcggtgacgggtccgaggttttttttccccttaacttgtaagctaacaaggtagcttgccacagtttcatggatgttggcagaagacacgatacctgtgttagagacaaaggacagtttattatccatagcaaaacagtagccagagtatcagaatttgtgtcaatttcttgagcccccatttccacagggcaacatgaagaggcccagatggatgccagacatgcagtggtttccactacaggaaaggaaccctgagcctaaaaaactcaagtcttctataatgggcagtaatcacatctaccctttgctccaaagggaggcactatctctatcttcccaggctgtaagcaaacctgccctctgcttgggaaggaggcactatattttagaattttattccctatatcaatatttttaaaaaattggtccagaacaaagtcagtcagggcctctgctcagaggatgtgttgaaatacaagagacccatggagaattacctcccaacataacatttgaaaactatgtttacattagaagatagagaagtatgcaaataaacattgctttgatattttaaatttttttattttttatttttgatgtgacaaaatataacacaaaagggaaagcgagtggctatggcacactgaagactccagagcacacgtagcattttaaggatgttgacagctgggtctggtggtgattctggaggttatggcactggtggcagcatcaggatgcctggtagtgtatcgccagaacttagtggaaacagctcttgcatggccgatggaggcactgaagaagtgcttccatgtatatgtgcagacctgagagggataaatgacagatactgtggagaggctaacaggaactagttgagagctttaggagacacttgctgtagactcctagaagtaaccagtaacagctctataaaaaacggtgggcctctaataattggaggaattgagatccaacagaatacaggttagattgagaatggcttttgtggccaggtgtggtggctcacctcagtaattccagcactttgggaggccaaagcagaaggatggctcaagcctaggaattagaggccagcctgggcaacatagtgagaccctatctctacaaaaaataaaaatattagccaagtgtgatggcatgtgcctgtggtcccagctactccagaggctgaggtggaaggattgcttgaacccagagggtcgaggctgcagtgagctatgattacactactgcactccagcctggatgacagagtgagaccctgtcttaaagaaaaaaaagagaaagagagggagagagagagagagagagagagagagagaatggcttctgctactcctgatttaaaagactatttctgtggagtgtaggggtgtgtatgtgtgtgtgtgtgtacatggaaatttggtaagaaaaaataagcaaatgaagtggtgagacccaaccccaacaaaattgattcatctatgtctataaattttctgtttctgattcagattttgtcagtgatctgtgattatcaattacccattgcagtgctcccaaagtgtgttttggggagcccccaggatgtacttccagatactctaccaaagaggaaacctttggccaaatacattttgaaaatgctgattattataccgtccctttggggatttacacttcacaatagcctatgaaatacttttagggtttccttgcctttaggatgctcatgaacttggtttaaacttgtctttcctaaacgcacctgaatatagaatcctacttttgtatgacattcataaaaatctaaaaaacactaatgttttagagagcacattgtggaaaatgttttatggaaattttataatatgactgtaacaattcaagtgctaataaataataaaggaaaatttcagactctttaagagcttttcagtgatacccattgctttacttcttgcttatattcaaggtcagttagaaactcagcattttttaaccctggcactgcattgtattcatcactagtgaaagggtctagtccaccagacatgatttagaatttctgatattgacactggtagtcaatgtgatattttaataagccacagttgtcatattgagtggttacaattctggtgaaaggcaaacttacttggcatttcttagttcttgaacagcccttattgagaataaatttccaattttcaacatgtttatggaatattaaaacttgcttacaaacagctgtttgtgaattcgttgagcattcaggacacaaggtaggtgaccattggataagaatgtctttttcttgggcccatgtggagtttttattactttgtcattgttgccaggtaaaatattaagaatgtggttaagaattggataacagccttggtttccagctttagaagcctgtgtcagttgataggaagatttattggtgtttttcattatgttaagtggaagataaattagttttttatctcttgttttcacaaatcatatatcaaaatttatacgtgaaagcttctccttttgcagttatctctttagaaaaacaagaagcgtgataagaccaaattgttggaattggttggaggtattctggcaggaattatcatatattcacgctgattttgacataaatttcacagtggctaaaattgtgatgtgagcaaaggttgtttgcttttttttcccgagtcatgtcatctctttgtgtttcattatgcattcaagtcagggagatcaggaacatttgtgtttcaattctggatccactgtgggaattcacttaattattatgagccacagtttcttcttttgcagagaggaatatacttatgtcataggatgttagatgtgttaaatgaaatgccaactatgaaggacccagtacagttcctggtacataatgcatgctcttgacatgttcacttcttacccttcctacccttgcatctcttcccttctgcacatttgaaattcttaccgtgttaccctttgactgagctccacgtaggtctcccccagttccatactcctgcatatttctttattccccttatccttaattgaatggtttctgtcttttccattactcttttccttgggttcatctttgctctctccttctccactggcctttctcccaggcgtccatcataagttggtctcacccatcttgaaaagatcttagttccattatcttcctcccttgagctatggacattggtctctccttcacttcttcactaaaatcctggaacatgtctatgccagctgcttccatttctttgtttgttaatccttgtttaatcctcagcatctgccctacaacctgctgtttcactgtagcacgtctcctgaaggttaccaagaaaccattttgcagtatgtattgacctccttgtcatttttctagacctttctgctgcatttgaatcttttgaccccaccttggatgtgtcctctaccatccactggcaattcatcatctaagtccttttgttcactttatgactactgttgttctataggctcttccatgccttcttcttcttgctgctgcctgttttacccacagactgtccctggcctgttggctctcacccatgcactgcaattcagtagaattaaattatgtctgcagatgaatctgaccagctgttttcctctacattcacatcattatcacttgaggagtggcgcataggggaagtgatcctttctaaccagattggctgtgagtaaagttttggcgctactattgccctcttgacattcaagttttcaaacatgaccatgccagtaatcatgtacataagtgtataaggagctggacactggcaaactgagaccaaattgatagagactgcctttgggcacataagcaggaggcatggcaatattgtcacagtgtctccatcatgtttttgagccaaatcaaaaataatgagtcttggaagtcagatgtagccatcccatcgcccacccattgtatgtcacacatagcaaattgaacctttctcagtcaaggtttggagggcctcaatgtctgaaaaagaggactagcatgtatagtgataccaggtggtaggaggtatggttccaaaggggctggctggccccagggagaggcctgcatggtgagtgattgaactcaggacataaaccaaagagtttttcttccctatttgcatttgttatttaaatgaaatttctagttacttctagtctgcatagagctagagctattgattcaaagaactttaccaacacatcaccctcccgtctatttttttctagacctaactacaaagcactattaaaaatacatatatattatatataataatatatactatatatatactatatatactatatatattactatattactatatatactatatatagtaatatagtatatatagtaaatatatagtaatatatatagtatatatagtatatataatatatagtatatatagtatatatatagtatatatatatatatataaaatatatatatatatatatatatatagtctcattctgttgcccaggctggagtgcagtggtatggtcacggctcactgcagactcgacctgccgggcccaagcaatcctcctgcctcagcctccaaaaatgctaggattatgggcatgagccaccacacccaggccccaaataaatattttgtatacagagagtatagtgggtaaattccggccctgaagtcagcttgagtctcaatctgagcacttttacttgatgtagagctttgagcaagttgattaatttagtgtcagcctcctcattgtaaaaggattaaatgaagcaatacttataaagcagttaacacatggcttggctagtcccccagtagtaggtttcctcttagcttagtagttcctttattccaacaaagcattgatgaacagcctgccaggatcaagcttacacataaggcccccatgtggcccacttctaaacatctaagcccttacaaccaaaagttaaatgattagtagttgccagacactcacttgcacggaagactcacttcgaggaactttacaaaaaatacagatttcctggccctacccagatttgctggataagaactttctgggagaagggggcatggagggaatactgcgattctgtgtgttattgaagcctccaagggcctaggtgattattttgtgcagctggtattttcaccacaaatatgaaccaatagatgagatttaaaaactccattacttcccacttcatgagtcctattctagtttcttattcttgaatagagaagagaagcacgtttaactggggtgaatgtctttataatggccattctaagtgcaaacatttgtgtattctgttgggtgtttccataccagctccctatttaaaattaatgcttgagcactgtatgagtgctccaaatcagggcactgttaagagtgaaaaggaggctattaataattactctggaagagaagacataaatgagggccgtcccaagcaaaacggactgtatggtcacctgtaagaacctggcctaagtcaaagtaggagagagagaaaagtgggagaggtcacatgggagtagaaggtttgccacgttttgtcttctgtttctctctcctccttctccccgatgctttacttagtacttgtattagtctgttctcatgctgctgtaaggatatacccaagactgggtaatttatataggaaagaggtttaattgactcacagttccacagggctggggaggcctcaggaaacttacaatcatagcagaaggggaagcgaacacgtccttcacaaggtggcaggagagagaagaatgagagctgagtgaagggggaagcccttgtaaaaccattagatctcgtgagaacttactatctcgagaacagcatgggggaagctgcccccatgattcaattacctccactgggtccctcccacaacacgtggaaattatgggaactacaattcaagatgagatttgggtggggacacagacaaaccatgtcagtcctcagtagaacatactggtctcacctagagagattagattggcaaaaccagtattgggtggggttggagtagggaggggtcaatttttcaatgatctgagaactaaattgtgctgtatgtgcagcctttcaattaaatctggacacaacaatttattaaacgaccagaggtagcagtatttatacttacgcaccatataatcagcgatgagctgggctctgagacacaaggacaaataagagattccttgccttcagggagctaacagtatagtaggagttataggcaagtgcacaggccattcaaacactgagtgaggagaagtaagtacaggattctttcaggaagaagtaatccaaaaacctatgttgtacaacttttggtggcccatttttacttttcaaatatagtttatagtcctaaattctatgttgccttacccagtactaaagacataaatgctttaatccccaaattctaaatcctcccactctacgctcttgttccttgctcacaaatccaattttccaaagccattaatgctgggtgaagatcgttttaaacaattgacatgaggatgtgaccctcccagggtgtattttaaattcaaatatgaggtaccttacccaaaagaatgtcaaaatagtatatttgtaaggtcagatttatcaaataaaaatatagaatgccaagttaaatttggacttcagttaaacaatgaatattttgcttttagtataagtatgtcccatgcaatattggggacatacttatactgaaaattattcattgtttatctgaaatttaaatgtttaagtagaagtcctacattttatctggcaaccctatatgtttgggggagctcagtttgaatcaatatctttctggaactcttttattaggtcttattttttataaccttagcctgaaccatgttacaccatgagattacttccttttgttctttcaaaaagcattgactaaacctgctgtatatcaaggatatacagaggtcactgtgactagagtgcatagtaaagttgctgagtggtcattgcaggcccaaatgtgtgcagtgggtaggaagtcactataagctgtgtggtttcactgaagcttcggtggaagacagtcagtggctggagagttgggtggagtgagctggggatcagagggacatttggaaatggaggcagacaaccatgggccatgtaaacaaggcagggaagcttggtgaaggcaggacttggctttcttccttttgtgttcccagggatcttacaatagtctttgtacatgggagctgttcaaatatttggtgaattaagttgcctcctccaaggggatatcttctgccatttccttctgcgtcatctgccagagaatgaatgaattatttatttatttatttatttatttataatttatttcctctctggctgctgcacacgaagtgctttccttcttcagtttgcaagtggcctatggggtttggcaagataaccagcacgagcaaaaatggactggtaagctgtgtggccagccaagctaggcagagggcttccttttcactttagggcagagtgcaaggggaggtgtgtgtgtgtgcatgcgcacaaccagtcaagctctacagaggatgttctttcaatgttatattttaatgtaatgttaatggtctaatgttatggcagagagagaaagagagagagagtgtgtgtatgtgtgtgtgttgtgagagtgataaagaagggagtgggagcactgtgctaaggatagattgttttgttggcactttacagcataaatcttttattagaacctccaaagtacagattaatttaaaaatgagccagagtcaaccctggaggtaagaaatgagccaagaccagtgatgcagcaggtcgttgaacatttgccatggcttgagcagagaggtgcactaataccacataaagatgattatactgagcagcactcttgggtttctcctactgcactttgtgacaactttgatttgcagcctccaggaatgatgccaaccacctccaggggtgttgagaaatatctaaaacaaaattaaaaataaattcactttcatttaaaatgcaattatattctatataacacttttaggagcagtgggactgggtgttagaagatcagggaaagcaatggggcagcaatgttatgaattgcaaaattggaaaagaagaaaacatgctaacaacttgtgaaggattggacactgctggggagaagacagagatcaggagtgaaaacagcctctaaatttagctttaaaacttttggggattcatcttttttcttgtactgtcagcagcagaatgatctgcccttgtggtatctcattttgagcgtttgtttatttgtttgcttaggattcattcattcatttactcagtgtttattttgtgtgctaactctgtgctaagcaccaggcttattaacacacaggatgggctttcaatggattcttttaatgtgttcgtattgccatcctatcaacatatgctatcctggcctgccctgggagctagaaagaaagagggtgctgtgtcagcaggtggaattgagtgagctcatcaaatggcagccattgaaagctgcgcgtcccttctgggggagatgtggctggtaacagctttgaggatgaaataatgtgtgccgacctcaaggacaaattagggtaaagcaaggagaagagagaggatgaaatagtctctcctcttacaaacctaaatttaattgtagctaatggtagttcatgcctttcttgtgagaagacaggtcttccaagctgcataagggggccagttactggaaatttggtgtaattttattcattcgtataatacaacttgagttttaagatacttttttttaggcatgaaaattcatgctttttcaacatcagaagaacatgaaaaagttagtttgtttacatgcatagctgatagtgtaatcagtactattaagctgctttacaaagttaaccattggcaattatgaaaataagtgaaaattaaagggcagtacttagatttcagtacagcattttatatccactattcagtattagactttttatgcagtatcgtacctttatccagagccatcgctcaatgcatatctttgaaagtccaattagagtctcagaaagaacatggctttttgtcagaaagacacccaaatgccaattttatcactgctgctaattcacttggacaagttactttcctctctgagcctcagtattttcacctgtaaatgaggataatagtgccaacatcgtagggatgctgtgaagttcagtgatgtacatgtagctcttggcacatggcaagagtttaacaaatgtcagccacttcccaaccacctgcccctccggcctatctccctccacctgttcctgtgccaagagttcaggtgcttttcaagaaggacacagacactaaaccagtgccatcagattctctctgtggtttttgaattatttatgttgtttgtaatagaaagagagcttaactaggactgagacatcttctgtttaaaacaacttaacatttacaaactatttaatcttgaataagtcacttggccactctgaatttccatttccatatctgtaaaatcagcattatcaaaccatacagtgttatctgagactcagataacgttgtatgtggaaaaactttgaaaaccctcaagcattataaaaggccaagtttgctcaacagttttattgagcacctactatatgtcagttactgttctcatgtgctcatggaattgacattctagttgggagagttcgggatcaaattaaaagctctttaaaagtagggattcagtcctatttatctttgaatcattactactttcacagtaaattgtcatatagggtttcataaatgtttagtgcaatggaaagataatttatataaaggaaaaataaaggaatttatataattttaatgattatgttgtcaaatgttgtgggagattcgtatgacaataataacctctaaattcaatctgtatccaagaatctgattagaaaaaaaaatacctgataaaacaagataggtataaattagaaagctgaaggccaattcttatcttgttcgtgacttaggaaatactgggttctgtaagcctgcagttcctagcatattgcagtgttgatggatattaatttcttttggatattagaacatgaattgctgtacatcagctgttttatttaatcagaggtgattttgctcccaggagaaatttggccagttctggagatacttttggattgtcacaactgacaagggggttgctagtgacatctaaagggtaaaggataaggatgcagctaaacatcctacaatgcacaggacagtccccacagcaaagtattagcctgtccaaatgtcaatactgctgaagttgagaagccctgatctacgcaatagaagaacaagagtctacatttattattttctaacattaatatatattaggacatttttatgcatagttgataataatagactgggtttaattgaataaaaaataatgttgaatgtatgactttacatttaagaaatatatttttgcattcttttcatattgtatacatctaagtacagaaattttttttttggtatttgttttgtagctgcattagaaatagatgagttagcatgttcagacatgctccattcatcctgaacatgaatgaaatgtctgccagagaaggatcatttcctgccatatttcatgctggcaatcagacttggtctgttttagtagtgctgttagcattttgaacaaatatcttccatattcacagggaggaagatttattaaaatattttcaattaaactcatttcaattcttggtgccaacatattctatttgctcttgtattatatgactctcatacttgactacaccttcagaaagagaggctatgtttagatattaatcctgaggatttctggaaagttggtcattcaaatattttttactactcctttctctttgatatttgatccaaagatttttatccacccagagctagttcattttcaagaagctttatgttatttatctttttgaaagtccagttttgaagaggggtaaggagttggcacaacatttccagaagctgatcagaaaactaaaatgtatcattatgtgttttctataagtataatccttggaattgttttcctaaatacatttttaaaaatggtttaagaagcgaagcaacaatgtgttaaataaactcttttaggttgccattcagaagcagttcaacaggaattgacaaatttgagtcagagcagtgacctgtttttataaataaagttttattggttcacagctacaggcactcatgtatgcattgcctgtggctgcttttgtgatactacaacagggttgagtggttgcaacagagacttcttggcctccaaagccaaaaatgtttactggccctttatttttatttatttacttatttatttatttattgttgagatgcagtttcgctcttgttgcccaggctggagggcaatggtgccatctcagctcaccacaacctccgcttcccgggttcaagcaattctcctgcctcagcctccagagtagctgggattacatgcatgcaccaccacacctggctaattttgtatttttagtagagatggggtttctccgtgttggtcaggctggtctcgaactctcgacctcaggtgatccacaccacccctctccgccccgaccagcctcccaaagtgctgggattacagacatgagccaccgcgtccagccctgtctggccctttaaaaacaattttgctatcaccagcagtataagagtaaatctttaaaaatgtgatctataatcttctatggtgttgataaaacttttctttaaacgttgtgtcagtattatctgtcataatgtataattaaaatgtatactcattatttaatcattgcatatttgtacttgaacatcctaaagttagtttcatatctctttatatctgaaatataaaatatttacaaattgataattctgtataatacaaagtcattaaaattttttaaaattactcttgtgaaaaccgtgccttctctcagataatatagtctaataaacttcaaattcactataaatatttattagttaatcctttttacacagttctactttccttaaatactccttttaaaattagcaatgcagttacaaaatctataaaatcaggaatgttgaagggcttaattacagtgtctgtttgaagcgttctttagatagtggaataatcatgctttagaaacagtatttgctcaattacatgaaatggactcttttgtggttccatctgcagatggaaatgacttatttgtacatgtcatcgtatatgaattatttgtttatgctatcaattcatcacattaaatcagaatcaaggctatttcccagaatgaaattgtaccttctttctttaagacaagtaccacttttgttctcaggtatccatcatttagaaattggtccctggcaagatttgtctcagaaacacttaggaagttatgccatcagattatccttggcaaatgtttaaaagggttgggggaaaacaagagaagaataaagaaactctgcctgcctaaaaattgtaaataaatctttaacttcagggaaatctggatgctgaagcttgtcacaaaaactcagatgggagcattagtgtttctccaaggaaactcttcatttctgaagcagtttgtatggtatctgttcttttcatgatggtcaagattatgcaattgcttttgtattagtgagagtattcaacttatgtaacaaatgttgagacttaacacagtaaaaattatttcttactcatgccattatctagagaagggagaggggaagattttcttctccacacagtcatgcagcaactcaggatctttcagtctaggaagcagctaagtgtggcctgtgggttaagcatggtgttttagttagttccagctgctataatagaatcccacagattgagtggcttgtaaacaacaaacagttatttctcacagttttggaggctagaagtctgaaatcagggtgccagcatggttggattctggtgagagccgaattcctggctcacagataagcatcttctcgctgtgtcctcacaggaagaaatgagggtgatagagctctccggagtctccttcataaggaaacaaatcccattcatgaaagctgaacactcatgacctcatcgcctttcaaaggcctcacctcctaacaccatcacatttgggattaggattcaacatatgacttttgggtggagagataaaccttcagttcatacataacacgtggttttgacttttataatgtttacaataaccaacaaacatttttgaccatgaaaattatatgcaattcagattgctgagtttaccattgaaaattgtactggaatacagtcatgctcatttgtgtacttattgtctatggctgcatttgtgctacagtggtagagttgagtggttgtgacagagacaatgtgacccacaaagtctaaattttttctgtcttgccctttacagaaaaagtttggcaacctctattctagaggcttgaacttcgtggaactctcaggcggttttaagggcaaggctaataatatgtggctctgccttcacagttggctggaactcaagcatgtatccccagtgtctataagggaggccggtaaatgcagtctagtaaagtgatgcagatgagagaccacagatatagtgaacaagagtcaatgtcagacattttataggaggaatttattgtgtggactcacctttgagtcctgccttcaactatgacttcgtcttattttaagttcagtaaatgcatgagctcttttattccctctccccaagctgtcattatttcagctcatcacactttatttccttaatgtgcatagtcacaaaatgaaagacaactggtttgttttttggtttttatggggctttttatagatcaagataagcaatgtgattaaaacagcaggggtgtccaataattgagttgggtttgccaggctcatttgtgtatttactgaactagtcatgcaataggtgttagaaatattgatcaaggcagtgttttatttttatggatcctgttgtcctttttggtctgattgcacctgccaatgtttgtgagttattttcaaatgggcaccttccaaaagggtaatgtttcattggtgtagtaaatttcatgtgagtgtagttgctcctataaattcaaaggttgtgatcagccagatttttccttcaagacagaagaaagagacaaataacaggaatatggcaataagagatttttatattactaaagggaggcccttcataataaaaaccaataggatccttgagttttgttgggttcctgggaatttctcaatatcagtaataactttttaaaagctggcaacaatagaaattacaaacatttatcagcccaccaaaagcagtgtataaaactgatgtttgactcattacattccaaagatttatctgttttggcttaaaatcaggacaagactgactcagaccttgtccaagtgggtcactttcatgccatcaactttgggtgtatgagagttcttcgaggactttggaagagtcacagttgcatggaaaatggaaggtagagaagtggcaaagtgtacattctttgtaatttccagctttttaacttacgtatatcaaaatactactgccaaaccccaatattcgagatttcgtggtgaaagcacacttccaactttcatgtagagttattatctctctattgccatcaaggcagcctgacccctgactggggcggctactctggtgagtgtcagacatcttggggtagacttggaattgctcaacagtggctagcagatatagagaaaggaaaataaggcctggcacactggctcacgcctgtaaacccagcactttgggaggccgaggtaggatgatcacttgagctcaggagtttgagaccagcctgggcaacatagtgagaaactatctctataaaaagtttaaaaaatttgcctggcatggtggcatgtgcctgtggtcccagctactcaggaggcttaaatggaaggatctcttgagcccagaaggtcaaggctgcagtgagctatgatcgcaccactgcactccagcctgggcaacagggtgagaccctgtctctaaaaaaaataagaagaagaaggagaaggagaaggaggggaaggggaaggggaggaggaggaggaggaggaagaggaagaggaagaagaagaagaagaaaagtaagacattgctaggacttttctggcactccatggcatcctcacacatcacttcctttcctctaaactttccagtaggtcctccatatactttaaggttgttgcctgactttggaattgtaactgaggctaaatgtgactatatctatattttaaaaattattttcagcttgtaattaagaagattcagtgtatgggcccacatgactaaccaatccactgttctccaaatgactatgcatttctattagatgatcctctcatttctaataaaattaatggtcatctctgttcaacaaccttgtactctcattcacagcatcctttccaaactgacctgttctaaaaaaaaaatgcattgaatggtgagtttacatgcaaggagtctctattactttattttaaacaggaagaacaataatgtacttccaacccatctaaaactctaaacagtttcccccaaatatcaataaactaatctataacattctataatggatttctgcataacacaaagcatttagaacaaaaattgccaaactatttaacatttaacaaatgcatttgtgggcttgggtgcagtatataatgctactgtgcaatgttaagtgcaaattacatcttcctcctctactgcaacaaacacactactgccaataaacattggattgacctgtatgcaaagtatatagagacctgaaaatgactcagttatctcttccttgtgtttacctgtttctttttttctttctcgagacagaatgttgctctgtcatccaggctgtaatgcagtaccacagtcatagttcactatagccttgatctcctgggctcaagccatcctccttcctcagcctcctgaatagctaggaatacaggcccatgccaccatgcccagctaatttttaaaaattttttgtaggcacaggatcttgctatgtttcccaggttggtttcagactcctgggctcaagcaatcctccttccttggcctcccaaagtgttagaattataggcatgagccaccacacctggccccagctaattaaaaaaaatcttttgtagaaatgggatctctctatgttacccaggatgatttcaaacttcagggctctagtgatcctccagccttggtctctcagagtgttgggattacaggtgtgagccactggacctggcctgttcacctgtttctgtatgcttcgtcattcccacctcgtgttttaacatgagattttatagctttcctatctttcctactttgttcatggaattttccatcttcttaaagggcattttcaattgataatatggaaaagactatcatgcttatgcacaagatatttaaacaactcaagcacaggatgtgttccaatccaataactgcagtgcaatccacatcctctcttctagcctgaagagcacattgaacattttcactggcatacatgtgcaaattaatcatggcaggttttcattttagttagcgaattgagtgtacaaatgtcttatatgttgttatagcagatatttggaaggtgagagtaaagtttcggggcatctctataagattgcttttattcacaaaactgaagatgctcttgtcattatatagcatactaaaggttctaggtggaggaaacaaacctagtttttttttttccatggaagtttttgtctatgacatgtgggaaggtgaagcatgataagcatttattccaggcactgtgcagcatcctgggcccacattcctcacactggagcagaaacagttgtccatctaaagggcttttttttttttttttttttttttttttttttttgaggcaaagcccagttctgtcgcccaggctggactagagtacagaagtgagatcttgacctcctgggctcaagcgattctcccacctcagcttcctgagtagctgggactacaggcatacaccatgttgcccagctaattttttaattttttgtagagatggtatcttgctatattgcccagtctggtcttgaactcctgggctcaaatgatcctgttaagttgccctaccagagtgatgggattacaagtgtgagccactgcacctggcgtttttgttttgttttgttttgttttgttttgttttttattttttttaaatgaagctgcatttcttcttccaaagaggaggtatgcccagaaactgcatgagattgggtgggctggctatcagttggagtccagcccagcctagaggattctgcctttggctcagctaaatttctcttgttcactcccctctagttgggatgaagttacttccacctcccctcagggctggaagagacaaacatatgccccttcagacttggtcactctaagcacttagtggatggggagatggtttttcttttttccacatgggatctcccttctcttgaggcagtagaagaaatgttattttttccagttaaggaagaggttcactgtggactgctaagttgactggcgccctagttctgctttattggagagatttcagtcaaagccccttttgtattgctacacatattgttgccaggccagggagggagtgaggtatgagtggtggttgaaatccagaaatagtgtagcctgtaaagtctaaaatatttactaaaaaattggctctttggaggaaaagtttaccagctcctgttctagtccatgtgctgtggacctgggatcctgaaattctgcttccagggctccgaaggataggtcacactgaagaatgttccagtgggtctgtttgcagaggcaaggtggacagttccagtgggtctgtttgcagaggcaaggtggacagagctgagatgcctggactgcacatccacatggagctctggagtggccctgagtgtgagttggggagaggagaggggtggcataggcagggtcctgaggcagtctccttctgccacaccgtggtggcactgtgaggggcgtaaagtttttaaatttgaaactaccttgcaagtccttatgaaagaacgtttgtcagattacgagggtagaacacatgtttgatttaacagattagtagttgatttggaacttttacataattggatgtatagtgtgtggccctctatttgcgttctttcccaaacctgcatatgttgagggtgggcctgcaggaagagggatgactgactcatttacataaaggcactctgtatgcagagagaggtagttgcctggttgaatcgcccttaatctgggctttccttttaaagcgctcttgcccagaaatgataagaaaaaggggaaaacagtgggttgggatttttttctcacaaaggaactatatttgcggccagctctgaggctcataagcttcttagcaagacaaagagaacccaagtgttgagaagtgccagcaagtcctttgtcagacactaaatattttctgccagagcagtaatgataattgacgtcacccacttggtctctttttttcaatctcttctcctctcttatgtcctctttttttttttttttttttttcaaggagttcttggcttcctctcatagaggatgtctgctctggtttgaatgccacctccaaagctcatgttgaaattcaattgctattgtgatggtattaagagatgagaccatcaagagatggttaggctatcagtgctctgccctcatgaatggattaatgctgttatcatgggtgtggctagttatcatgggagtgggttatcttaggagtgggatcctgataagaaggatgagttcagcctattcctctctttcactgtctcttgtgctcctttgcccttctgccttccaccatggagtgactcagcaggaagcccattgccagatatgggcccctggaccttggacttcctagcctctaaaactgtaaaaaataaattccttttcaatataaattacccagtctgtggcatttctgttacagcaacacaaaatggactaagacaatgtccaaatgtaatcaccatggatggattgactcagagttgcctgtacttaaattatggttccagtatcttctgcttcaaccagggatgccagtggtattcttcccctttagggttttgcaaacagatgttttgacaactaaccactgcttcttgtgattcacttccttggaattactgaaccccaaaccccacggggtttctgaaaagcctgcttctcagttggattgctgctgtgttaaaaaatcaaagaagttttggttcacattgcatcaaaatgagatccgtccttccatttctaagagctgactcttcattcacttcactgaaatgaagagcttcgattttccaccatattctgatatgtaaaggttacctttgcgtgctcttagcagacaaaaatgctagagtggtagaagaatacttacaggattattcagcccttagaatcattgcttcatcgatagtccagggtacagtggcctgctatgaaaccactgtggattctaggatgagcccattaattttcttgagctttatggtgttcattccttgaaattggagtaagactgagattatttttaaggatatattttcacattatctgataatgctgttgaaccacttagagtcataggaaaaatacatatttttttctttgcataattcttatggcaatttctgttcttttttttttctactgatgagaaatagtacagacaaaaggagatacatattgcatgagattcctgaaccagtgtagcattttttagcacattttagtataatctttcctggacaccttaaaattaaggactcactttccattaacgtgatggtcatagagtatcatcatatctgccaagataagattcttataatttgaaaagaaggtggtgaaaaattcagaaaccagatttctggccacctaagtttgtgatttaaacccagaagtgttgccagctaataagcctaggataagatattttggtctaataaaccagcaattggtgccagttggactcttaaggggattcagagtaggtgagatttttcttggattttcttgtcttactctttcttttgccacttccttatttctagagcaaggattctcaacatcagtactattgacattttgggctgaagaattctttgttgtgcagggctatcctgtgcattgtagggtgtctggcagcatccctggtttctacccactggatatccatagcatcccctcccctagttgtgattatcaaaaatatctccagatattgtcaaatggcccctggaagagaggagcaaaatcactcctagttgagaacctctgctcccttctgccagttgctgggtgctccacgttattgtctagagttctgaactaatcacaccagtaacccatccccaagttccatcctcgggagtgcccgagctccaaaatcattgctctctccactaaggcatggccctcaccaaggatggatatgatatattacttgtttaaagtggttcacactggtgcatgtatgtctcaggggataaactcagaccagcatatgtgcattttatttttttgttttttaaattagaaatggggtctcattgtgttgcccaggctggtcgtgaactcctggactcaagtgaaccacccactttggcctccaaaagtgctgggattacaggcatgagccactatacctggcaatatgtgcattttaaaagaaatttgttaaacaaaattgatgtctaatcagtaaaaaataagagactgtctgtaggtttactaatagtcacttggtgttttttgagacttgtggcaattttatcagataggtaaggttataaaagcggatattgagactcagggagattaaataatttgaacaagttcaggcagtttggtataacaaagcaggactaccattcaggtctcttgaatcttaacctggtgatcaaagtgttttgaaatgtcaagagagtccttctaggtgttcttctaattgtcccaagcaatcactcatattcctttctttatctcctacctgtcatggattgctatcttcttttataccatgtattgttccttgtaactcacaaaaagagtattccagaggtgaaattccaagaaactgaaatgtgtcttttgagagttaccacagtttaagggagcttttacacaaagtataacaattccagctgctgacagtaattttctacataggcatccctttccactctcaagtctcacttattgtgaacaaaagcaaaaacaagactcttcttcatactcgacttataggagatgacaacatattcattctcttgtctcactctttctttggccacttccttatttctagagcaaggattctcaacagcagtactattgacatttaaggcaagatatgctcttgccttagcaaatttcacaagagataattctggtagtccttgtagagtccaagcaactaacatgctaattgatttcttagtttcttagggaaatgttaagggattctgtaacatgttagcaaacttccaaatactaggagaagttgttaagggtcatgtatagtctatgtttaataagtatgaattttttttattttctcttttcataattatactataacaaatttggaaacaatgcaaaaaccacaaagaataaagcaaattatccataattctaatgctcggtcataaccccgatgacattttgatgtctgttcttttagcctttttttcctagtcatatacatatattaagaaaacaaggcctggtgcagtggcttacacctgtaatcccagcactttgggaggccgaggcaggtggatcacctgaggtcaggagttccagaccagcctggccaacatggcgaaaccccgtctctactaaaaatacaaaaattagctgggtgtggtggcacatgcctgtaatcccagctactccggagactgaggcaggagaatcacttgaacccaggaggcggagattgcagtgaaccgagattgtgccactgcactccagcctgggcgatagaatgagactccgtctcaaaaaacaaacaaacaaaacaaatatactggaattatagtagtcaggacttttaagcgtacaagattatggacattttctagtatcattatgtatttgattttgatgactgcatatgctctgttttatgttgtatcatatgctgtgtgtgtttgaatgtattcttctattcaaagttttgaatataataggcacacaaggcatttttcagtgtgctgtaggtcacttgtggtattaaattgtggagggagagggaaggatggatgcctgacctttggtttttgtgaaagccacaggtctgagcagattccatagagaaaaggtggtgttaatgtcaccaaccatatttaatagggcagcatagacagagtgggaagagtgtggacaaagctagctaacactgaaggaacccaaaccagatgagctgctgtttcctggggtcattgctgggaatggttgctctggggcagctggatggaggtacctgagatgaaggataaagaggagagaggtttgcttcctacttaatcatgctttctgggggctagaaacaccatcattatcatccctaacacatttattgactattttccctattcagaggacctctaagaaaagcgggatgcctttgaaagtgtgtgcttaataaccagaagtatactgagagagaaagaagaccatttgggcagttttcagagacttaagccatcaaaatcattccctcaaaaatgattctaaattgtcagacaggaaaaatgttaatgagctattgaatattggttataactgatatattatttctaggaccaaaaaaatcccaacctagtctggttgtattttgcagtcatgtgtgtagtggttggcaatattcaaagctcctctgtgtactcactttgtaggacttactttagaatataatttttattggacagactatacatatttaagcttattttgtattgggtttaattattaattatggtattctctctctctctctctctctctctctgtgtgtgtgtgtgtttgtgtgtttgtgtgtgtgtgtgtgtgtgtgtgtgtgtgtgtcctgcttaaaaccttgaattatgctaggcacaaaaggcatgaagggaattttttggtgtgctgaaggttctttgtggtattagtctgcaagggaagtttacttagtgacttaatttctggaaacacactgcagtttcaactggaaactgtttgtggagcaagttataactgggcatttaacaatgtcctctgccatacctaaatgcagtttgagagttgctttttaaactttgtaatttgacaatgattattttcatggcaaaatagacagatgcgatcatcaaatgtatctacacttctgttcagtaggttataacatcttatgaattcttaagttacttttcttgagaataccatatgcaaatactctactataaaaccataattttcagatttgactagatatttctttgctaaaattcaccgctgatgcacattataaaaggaatatacctttggggagattggtgcatattatagaattaattttatagaatgatgaataatatagacatttcttaaatggacagtttctttatctccgtcaaattggctactctagggaaataaaaatttcactaaagtacaggccaagattggatgcgagcagtgccctttattacagcaattgtggaattgcagatcaggaatccaggaagtgcatgctgtctctagttgatgcttcaggtcaaatacccccacttagagctcccttggccaagagacccttgacctccaccgctctgctcccttgctccagttggccgttgctgggagaggcctttgcttgtaaagattccagccaggctcagggcctgtctttccatcattttctgaccagggcaccaaagcgcccagctgagttttgttgttcccctgcttaaaactaactttactatgagcacctatccgccaggaaaggaataataattccagacattacaaatggaatgtaaaaatgtggtaaatttgcctgacgttcagaaatgtgcttttctgagttacagtctcagccagttgccttgaagaccgaggagatccaattgatcaaagagcaaggagcaggtgtcttccacagggaagccaggcaaaaggttggtgctttccaggtagggcggacaatgtcagggtctggcctggatcccttcatatgctttttactgtttctttaccttccctctccattcaattttatgttgctcttttgtcctcttttcttggtgattccccttgactgctagaacctactttgaacccactttgttgaacgaatagaaagctggaagtagctggcaggctatgcccccagcccgtacacacaaacacatagattttggctcatgactgtctagtgctggaacatggaggccgaaatcctttgcctcgggtcaaagcaacttggaggtgtaactcacacttaagtctcctgtgggctcaggccgaagctacccctatgagacatttccagggttctgttcttcttggcttcctctccctcctgggctgcttcccttcctccctcaccaggtgttccttagagagtactgcctttatgatttcttgcacacaaaccctcctttcagtgtctgcttctagagatcctggactaagacaacagatcagcacatatatttaggccaggcaggggctctaatgagcactgacaccaacacagcaagttgcatgtggctgtgttgcctactgtctaaaagcagaaggtctagactcagagaaacctcagttccactctcacctcctcctttggtagctgtggaacattaggcaaagtggccgaccactctgagcttcattttccttgtgaagtagaggaaaaatggaaccaaactcataagattgtgaaccttaaaagaaatattgcacgaaaagagctgctcatgacacatagtaaatcctcaataaatgttagctttatagaaaatcttaagttttaaaggagccttatgtttagataattctcagtagcacaactcaaaaaggccttgtgagatggagcagctataggtgtccccatttgacagtgaagaaaataggctcagaaaggttaaacgactttgtattaagtcatatggcttgttgtggtctgtgatgaggaccccaggctctggaatagcagggtactgcattatctagggtatgcacagcttctcagcatctagcaatctgacatttgggggctatatttgcctgaaccagtgagcacattgaactccaagtataaaaatagacctgagatttctaaagatcagaaatattaatagtatattactaaagaaacatgtaagataaagaaaagaaggagaacacagagtatgtcctcaaccattctttgaatgctacaaacaataatagttcatgaaaagtgcatttttgcttcatttcgaatgattccaattgctggtattgattcttctaccttatctagaggaaatgaaagagattttagatgatgatgttctcacaagctcttgaatctgtgaatctgaaaatatcacaatgaaaaatgtgaaggtcatgtgcataaatctacatatgataacattcatgtatgtgttaattacttccaaataaattaagatcagacatatggaaaaccatatgtacgaggaggaaaaaaactcaggtgtgttcaatatatcaaagtgcaggaaatctaacctggtttgactgttgtgggagggcatgtgtgagtcaagtctttaatttgtaacagaatgaaagtgactgtatttcactactttagacagcaaggtcaaggggaggaaatacacttagaaataggactttgattaatatataaaggaattcaaattatatttgagttacctggagggcttgggaccaccaggtcttagagatttcagctatgtatgagaacatccagaggacagaacagatgcagtggaaaagacacaaaaaaatgtcatgtaggtgaggagtctttaatattttgtttgaggcaaggagcaaatacaagcaagacatgcagaagtgcagaaatgttttttgaatactgggcgggttgtgctctagatgaagacatagacttactgccagtccttcttaaaggtagaaccaacataggaggaggaaagttacgaagcaaatcagaggatgcacctcttccagctcagctggaaacagcgagtgagttgtccatcactagaggtgttttccacttatcaaagatgttacagaaagcttcagatatcttactctcccccagcattatgaatatttcatttttattttcataataatttgtggtacttatcatttaaacataatctatgtccttaataagatctttttaatgtgtcatgagttttatactcttgtggttttgtgaatctagttaagaagctttatctgtcttaaagtcaaatataccacagctaatgtcattaccctctactcaaagtaatgggtattatttattgatgctagttctcatataaaaatgaagattgtattttttcaaatggatagaattattccaagtgtatttttagttaaaataattggataatgtgtgtgtagtgtaataatatcttcagagtgctgggggagagagagagaagggaggtacaggtttcaggaaggagtgaatgaaggaggaactccacaccaataattatatatccagaaaaataatttcaaagaatgggttgaaataaatgatattttctaataaactgcaagagattttctactaagaggagcagtaaagagtgtactccatgaacaagggaatattatcaggagaacatgagatgtaaataatgtttgttgggttttttttttcctttttcctctctctagaaagggaggatcaccaggaagaaataagtccagattccccatcagttcagtggtatggagtccagagtcagaatataattttttaatagaaaatgtgttgtaatatttcttgaaaaacaaaatagattggacaggggcaaaagtggctgtagttagccattttgtaggctacttcagtgattttgacattggagggagggaggttgaatatgtagagaaacaattaagtgttagaatttataggatttgttgattaatgacatgtgaggagttaaggctagccagaatgcaggaagagcacctgagtggatgttgtttccttttagcaagataagcaacagacagacttgggaataagaccattagtctagtcctgaggctggtggttacaaaatgtatgtgagagatccaggtgaagacgtcaagtggacaattgaatatattggtataacctggtaggcagctgaaacagcttgctttgggattcaaagaaattatgttgaaccctgatcaaccctaatcaacatgaagagggcctacagccctcctagtctctagagattcttgatggcagggctggtggcagaaaggcaggcatgtattaacagttttctgctcatctcagtcaaaatttctgctttcattgaatttgttcactagactgtctccttgtcctcatgtgctgtctgtctgttcttctacattgtcacaagtgtagaaaagaacctcactttattgataatatcaccaacaattatttacgcaaggcttttatttagccaatctgaagttctgggggattggaggggctaacactgtagcagtagttttccaacatccttggttttcagccttgccaacatattgatcagccatcttcttcttcaagaccctttcttttactatttttttggatcactcctggagggtcttctgggaaagtctgtacccctcactccatacagcacagaatttgacattttcataatccccacttcacttcatgctcactcttacctttccccaatttcattaagatcctgccctgcactgagatccaggatttgcccttccgcaatccagaactttcagaggcagtgacatgtcagcctcttccttcctgcaatggagtagaaaaagcacttaattttcccgtaaataaaatatggtggaagtagcaacaattttactctcaaggaacttttactccatccaatgttgggtcttgagctcagaaaagagatccagtttggggatcagttttgagttatcaggatgcagatcacaaaagagggagtagctggaatgggtgataatgctgcacacacaaggtagaaaaaggaaggggaatggtcagtgttttctgctcaacttgcaagaggggaaaaattaagcttttttggtcccaaaccacacttcccaagagaatcctgaagcgtatagggtggagggtgataggagaagggttgaagggcagttccatagtcagcatttcagggaagaaatgttggcaatttaaaggtagtgaattatcaactgctttattgctgtttctttagagtggaaaaatattttatgaagcattgtgtttctgaatatgaattcaattcaattctgttatcgggccttccttaaaatgattcaaacattcaacaaatacaacattattctacttctgtttgtttttaagtactttatatgtttcaaaaaacaaatttaaatattttgggcattcaaaattatcattctccagtgtaattaaaggaataatttggccatgcaatccaatgtctgttcatcaaggcaataggtttgtagatgaaggaaacctctctcttactttgggattcatcaaagtggccatactataaatgggtgttgtacagtttctagtttcttcattttgtgaagacagatacagagggctggaaacagggcaaacccatgaactgatcatgaacatgatggtagtaatggtctggtcattctctgtgttttggaacttgattcttgaagttgaaagccaagggcaatcttctgcatgccatattagcaacctaacattatcaggtgcacaggctaggatctagaggttggatgtcagcaccaagggtaagtggccagttacgtatacatgtgcttgaccatccccctattgggaggcccatatagggtagaatataggcatgcaataagtgagatttctgaggtggttgacctctttggatttctaacccaaacctgtagtgtgcccctgacaagttccattggggtgttggcaacacaaatttcagatgctttcatgtttcatccagagatgcccctgtcctatccagtgaccttccccacaaacaggagaagacagtagattaaaaaatgatagactagggctatatgtcaccaggcagatgcagctggaacctatgccccaagaatctagccaggacttcttaaaaactagttaggtctatgagccaataatcaagacttatgttaaccatcctcttgagaggcttaaccacccgttgaatttggtcaagtgtgagtgagtgactgtaagccttggagcctcattgcagggcattcttaattaaccttgaagttgggataatctcaaaagactatgaccaggaaacagtaatagtcaggcctgttcataaagtgctcttgatttacagttggaacatctctatttgtgtgtacctcggtgcttcccagccttttcaagtcatggcaaatgcaaaatccagtaaatgggtgaggttatttgtggaagaaggtaaaaatccagaggacccaactgttcaaggtcaccccctctgattaaatatctggctgagagtctttagttaaatatctctggataaatatctctacacacttgtaactcattcatggcacaccagtgtacttaggcattgtacattattccacaattcttcctaatcccttaaatgtttgttctactactgttgataaaaatcaacttattatctcagtgttctaatttatttaatgaccaaggtgtggttactctgtaaaaatattttccagaaaagatgttcactgccaaacattagaaataccatccagcttctcatttaaattttaattatcatactagttgaaatgacacttcagagttaatgtttcttatttggctttactagtatagtgtctcttaacaacattttcactttctttgtgctataaatgtttcatgcctacaagtcattatgtttcaccaatatttggctgtatgatctttccttgcaaagcccaaagtccaatgtgcctgggtgaggacactctcttgattgaaaacattatcttaggttcatcacacctatggtttctgtgggttttttttcccttttctaccaccttacaaattgtaatatgtgctttacccgttgctctgccttctagcatacacacacacaaacatacaggtgtactttgattcttgactcattttccatatattgatgcttgaggacagtgttatttgattatcttgtcatttccagtttcatagaagtcagaataaatctttgacttgttttgactttttttttctcttctgattttgcccattgaactatgagagtattgtggtaaacaagattaggcaagaaactcctgtaatctggtgggcatattggaaagaacatgggaatattttttggttaaataaacctgggtttcagtcttgactttattaattatatggctttggaaaataatttatgttctgagccttttcctcaactgaaaaaatgaaaatcccaacgcttgttttaggtaccctgaaaaactattttaagtagtacatgagaaagttttctacttagaaaaacatctatatatgctttctccagtttcagaggatgaagtgtcccttctttttttgaagttacccctccatctgtattcctgatcccattgcctctcaccttcttcgcggtgtcgtgcctactcttattcctcttttgcagctttaccttatccttcctgatcaactgccctcagcctttaatactagtctagattccctctcatcctgaaggtactcttcctttcattttttattctttgttctacctcccactcctccccaccaagaaaatcctccctatctttggccttcaaaggtgaaatacttttaatccaatatgtatatattccgaatttgctttatcttttaaactgtcattctatcttcagtccacctgctatggtttgaatgtgtcacccaaagctcttgtcttggaaatttaactcccagtgcaacagtgttgagaggtaggacctttaagaggtgattaggtcatgagggctctgccttcatgactggattaacgccattattgtggaagtgggttagttattgcaggaatgggttcttgataaaaatttgagtttggcgcccccacttccctgtcttgcatgctcactttctcttaccatgtgatgccttccaccatgttatgacacagcaagaagtccctcaccaaatgtggccccctcaatcttagatttcccaacctccagaactgtaagaaattaatctctattctgtgtaagttacccagtctcaggtattctgttagagcagatcaaagtgaactaagacaacgccactatttggactttactcaaatgagaaattctagtgtaaatgtcaccatagatctcctgtatttttttctaatttattttattattattactttttatcgatatgtaatagttgtacatattttggggatacatgtgatattttaatacatgtatacaatgtgtaatgatcaaatcagtgtaattgggatatctaccacctcaagcatgtatcttttctttttgcagggaacattccaattcttctcttctagctatttttaactatacaataaattattaactctagtctccctactgtactatcaaatactagaactcattccttctatctaagtgtatttttatacctatcaaccaacctctcttcatttctccctctttcctatcctctggtaatcaccattccactctctacttccattagatcttccatgttctttagaagtaaatgttgaaagagatacaaccttcaagttcaatggcttaaccaaatactagtgtattttttactcatcaaatagtaagtgtttgatcctggtcaggaggttcttcttcagtaaatgatatagggacccaaactctttccatcttggagtcctgccttcttcaacacctggctcccaagcggggggtgcgtccattctagccatccagaagtggaaaggaacagggaagatcatgtgtaggaagtttttatggtttttagggtggggcctaaacccaatatgactgatgtctttatgagaagagggaaatttggacaaagagaaacacacacacagggaaaatatcatgtggcaatgaaggtagagaatggagtgatgcagctgcaagccaaggaatgccaaggattgccagcaagcactagaagctaggaagatgtaaggagggatcttccccaggagccttcaaagagcatggtcctgctgatatttaggttttggacttcctgcctccagaactgtgagacaataaatttctgttgttttgggctatccgttagtgggtactttgttacacagttctaggaaacgaatacacggttaagcctaaaaggggatacattactcctgctcatcctccgttggtcagaactcagacctattggcacgctgaacagcaaagaaaccagggaaatatagtctagccctgtgtctaggaagaagagaagaatgtgggtttagagatcatccagcattttcttccacccctccacatgaccacatactatgaacatttttagtcatcttctgctgaatttgaccctgtgggctatacagttcttgatgttgttgataaaatagaggcactagatgtacttgatgcctattatcttaaaccttcacaaaagccctgcaaagtaaggattgttatttcatttctcagttgacattttcctggcagctcagttcattttattttccccacataactttcttagattttcatatctttgattattgctttttttgtcactcttgtaggttcttctctttggcacatcttggatttaggtattccctggttgtcaccttggccttttttccttcttagtcaacatgcattcccttagtgacctcatccttttgtggttttacctgcacctatatgttgatgactccaaaatttaagtctccatacctaatctcttacctgaatttcagaatatgtccaaatacctattgcatatagcctgcagatacctaaaactcaacttcccctaaaagatatgtctccaaatttatcctatgttcttccttgtttattctcacagtcagtgacactacctggtcaggtcacccaaaccagaaaactagtaataattatcaattcttctggctcttgaccaatattaccttctaggtataactttgaaccagcttccccagctgctaaccataaattgcctagttctgtctcattattcctcactggatttcatgccagttccctttgatggcctcatttattaattttgcatccttcacatccattatctacactcatcccagaattttctatctgaaatgctagctgtgtgcagttccccgttcacttatcagtgacttcctgttatgtaccgatccaagctctttagcatggcatgtaaggccatgaataacctttctcttcatgcctcttcttcagcctcatcttctcttccactctgtactgtaatttatgttatagtaataacaaatttagttctcccaataaagcatgctgtttcaatcctccacgcgtttgcttaatctgatgcctctccctagatgaacttctcttttttctgcatatggctaacttctcttattttttaaggtgacctaagtatctcttcttaagatgcccaaacagccctcccctgggctgtactcacaccctgtggttttctttatctttacacttacaatggatgcagaaatccttatttctgtgtcttctcccaagagtgggttccctgagggcagagaagcttgtcccagtaccgacctaacatagcagtttctgaagcatagtagatgctaagtaaacatttgctaaaagaagctgagcttcttacagaggatattatcacctggatagagattttgagtctggatataatcatagatgatagctcatcacctttaaatcccaaaaggaaaagacatatcctagtttataaaaatctgtgaaaattatatttcagaatcattatagctgataaaaatagaatgtaaaatatacaaagccctaaattttgcctgattctctgggctatattgatttaagaaaaaaagaagcaacaatgttttgatgcttcctggaacctctaacttcaaaagctggtgatttgcatttatcctcttaaaatgttctcagtgtatctaacctacccaaatgcataccactaggacttgacacataagaagagactactggaagctaaaggactgccaaacattattttggtgataaaagactgaacaacttagtccagcaagagttcagaagaaaaacagaattagagcccaccaaagaacttatggcatgatgtgcatttattcaacaataagtgaggcattcatgttttaaactttattataaaaattttaaatataataactgaaagtaaattgaatagtaaaacaaccctgtacatcatccagcttcaacaattatcaatatgctgtcatttatgagtcgcctatatgcctagacattcccattattttttctgtcaaagttttcattttgcatattcaaaagcacaaatgtcaatatacctatgttaaaaatattcctaccataaataaaaatattagatttttattatttgctttgtattgcttgaaatgtaaaataactttttaaatctagtttacttaataaaatgtggcagaaaaaatcaacaaaaataatcggttgttactcatatgaatgacattatttccacttctgaattgtttccagaagcatcttaatgtagcagtttggggcagaagctagcacactctagcccactgaccaaatcttgtcccctgcctgtttttgaaagtaaagttttattggaacacagccatacccattgatttgtataatgtctgtggctgctcttgggctacagtggcagagtcgagtagctacaatagcctgtttggcctgcatagcataaaacatattttttttattttaaaatattattttattttttacttctatatttttagagacagagtctcactatgttgcccaggcttgaactcctggcctaaagtgatcctcctgcctcggtctcccaatgtgctgggattatgggcatgaaccaccatgtatctggccctatacagataaagtttgccaatccctggtttagcacatgaggttccccttgtcatccttgtggctttagacgaggcacttaatttctctgatattatttaatcatctgtaaataggaatgaaggtcaaatctaactcacagggttgttttgaagctcaaaaaagttaatatgtgaataacatgtagaacagtatttggaccataataagcactcatgttacctttatcatcataattatcactctcaatattattgttgatggtaccgatagaaaccagtgggcttcaaattgcagctatgtcacttagggtcttgaggaagtgagttattctggccgggcccatttgtgtatctctaaaaaggagatagttgtctcttccttgtgagattgtataaggaatgaaggtgacaaatccttgggacatggaaacatttcatgaaatggggattgctatggttagtgtggttgtgcaggtattctacacttggaagtcactgggcatgtgggtccttgtagatatctggctaacaggtactgaaggggcctcgtgaggttaatttgctgcagttcagagtctgggcttcagctttgaagacctaggagccttattttgttatttctacaagagggagtttcttcctcttaagctaacttcaagtcataagactgacatgcacacatttactattaaaactacaacagtaatgagcaaacaacctaagggagaaaggatgtcaatgaaggtacttggggggatgagtgttactggcacagggagaaatagggtgaccaacttgccatggtttgcctatcacatactgtgtttttacattgaagatcttgcatcccaggaaactccttagtccccctggtaaaccaggatggttggtcaccttaggagaggtgagagtatgcctgacatgcaagagcatttgcaagcagacaaatgtggctggactggagtgagtgttagaggaagtgacaaatgatgaagtcatcagtgaggtagggacatcagatatacaggaccttgtcaggcattttgaggactagctttgacttggaatgaaagccagtagagagttggcattggtgtgacatgagctaatgtctcttactaaaggcctatgctggcttctgttttaagaatagagaagggaagcggcagggaaactacttggaagctaccacaatgacccaggcaccagataatagtagcttaggccaaagcctgggtagctatagaggtgagaagtggagggatcctggatatatgttgagggtgcaaccaacaactccctgacagtttggatatggagtgtgtcttagtctgttttgtgttgctataacagaataccacagactgcataacttgaaaaaaaaaaaaatttttcacagctctaaaggctgggaagtccaatagcaagatgcagacatctgccaagtgcttcttgctatgtcatcccatggcagaagggcaaagagagggtaagagagtgagaaagagatagaacccacagccgcaagcccttttataatcaactttaatccattaacgagggtggagcattaatacctcccattatgccccattgctcaacactgttgcattggggattaagttgccaacacgtgcttttgggggggacacattcaagccatagtagagtgaaagaatgagaagagtcagtggtgactcttgagcctttgttctgagtcactgataggaaaatattgccatttcctgagactgagaagaacaactttgcagtaaagtaagccagttttcagtagaggaaaactaaggcctaatgatgtgcattaccattgctaatgtagaatagtagaagaacaatttcttctcagtctcaggacatcaggagttgaggaaggagaacaggaattgactgggagatacctattagatatgcaagtggcaaagttccataggtagttggatttagaagtttggggttcagagacaggagacagttgggtgttgtcttaggggctcaagaccctcttcacttttttcagttcattgtgggtcagtatttcacattacagctgctttctgcaaacattttattataattttgccctatattaatatgtctaaaaatactgtatgataataattcaatttcttcataacaggtgttgattggaattaagtgagatgtaagtgtaggctaccgtatgtttgttttcccacaagactttgatgagtttgtctattagtctaacataacaaacttttgaataccagttgttgtttgattatgccatagtatgttcttgaagattgcctacagctactgtttggttgatttaaaagagttcctttactaattttcaaatgacaaagttattttaagatattctgaattgttttttgcctttcaagatgggaatttatggggttgggttgtattaagcctagtgaaatatacttagaaaaatgctagtgaaattggatgttcttctccttccatctcctaagtaggctcagggttaagagctgtagtataaagtaggccagttttcagtagaggaaaattaaggcctaatgctgtacattaccactggtaatatatagcagtagaagaaaaagttgtcttcactttgccttaatgtaaaaacaagagttacctgtgtttcggtttcagcctgtaatcaaagacaaagtaattctcaatcttggctgcaccttggagtcatctgggaacctctaaaaatatcgaagtcccagcctgaaagattctgatgtaattgatctgcagtttgacctgagcaccaggattttaaaaatctctcgaggtgattttaacgtgcagataaatctgagaagccctggtatagaacagattttgatgctgcggtttgctggttcattcaacagtgaagatttttatggtaaattaatcgacttctaaaactgaaaaagaagcccagtaactgtaataagagtcttctgtgttatatgggttctgattccttagagggatttttctggggaatgtgctgactgtcacctacacttgggctctgtgctagatgatgacagtgagccttttctaggctgttatcagccatatacgtgtttaaagggcattttgatttgtagacactaccccttggggaaattttctcagctttacttttctgaattccctttatttcatgagtttctgccacattatttttcttttttttttctctgactcatataagcaatataaacaaatatgtcatgtggatagatgttccaataatactgtagccctttatgattacaatacagttttaaacttgggtgattagatctcagttaagaacccccccccaaaactgcacatgaattagatgttaatagtctatccaggaagataattgaattctgaaatagaaaatctatttaaaacaaacaaaagccgggcgcggtggctcaagcctgtaatcccagcactttgggaggccgaggtgggcggatcacgaggtcaggagatcgagaccatcctggctaacacggtgaaacaccatctctactaaaaaaaatacaaaaaaaattagccgggcgcggtggcaggcgcctgtagtcccagctattcgggagcctgaggcaggagaatggcgtgaacccgggaggcggagcttgcagtgagccgagatcaagccactgcactccagcctgggcgacacagcgagactccgtctcaaaaaaaaaaaaaaaaaaaaaaaaaaaaagagaaaacaaaaaatgaacaggccatagtaggagaaaacattattattatagatggcaaaatatgtaactgactagttgtatcagttagcattggttgtgtaattaaaccaccccaatctcaatggcatacaatagtaaacatttcccatgggtctgcaagggtcactgatctaggatagcatccattgggtttacttttctgaattccccgtaagctggctcttttccttatgattcttatccttctgctgggaccagtgggtcagtgtagacatgcccttcctctttagatggcagaagtgcaagagagcaaatgaaaatacgcaaggccccttgaagtctgggcttggaagtgacatagtagcatttctgcctcattctattggtgaaagcagtaactgaaccaagttcagaatcaaggggtgggttgagtcctaccttcacagtgggacagcacagcaaagttaccttactcggaccattattggaatctaccataccagttaatcactgcccttccttatatttaatttatgtattaaaaactttgaaacagaggaggtatggtacatgcatgcttttgtgtttgcattctttcccctggaaataatatgagagatgtacctcctacgattgtatattcagagtagcctatagtggatttgggagactgaattagatgtggttacagatgctcctcgagttatgatgggattaccttccaataaacctatctgaagttgaaaatatcataaatagaaagtatatttaatacacctaatttgctgaacatcatagcttagcctagcttaccttgaatatgctcagaacacttccattagcctacaattggtcaaaatcatatccaaaaatgctggcaacacagcatattgtacagtgttaattgtttacccagcctgggaaaatatcagaattccaaatgcaaggtttctgctgaatgtatatcactcttgcatcatcatcaagtcggaaaatcgtaagtcaaaccattgtaagtcaaggacccgctatataatcaagagggagaaagaaatgccctttttctccacattgtaggtatatgtatttagagggaaaaatacattttaagcatgacttcaaaagcaccttgtcattttcccaaatttcttctataatgctaaataatggttgtttgattaaacttgattgacagccaattttcccccttttataatataaaaaatatacagtgctccaaatagcgccttcttttttctaagacagatgggatgcttgaaaatgaaatcttgaagcatggttgttagtattagtcttgataaatttagtaacaaattactagttcacttttgggttactgactgttggcagaatgacgttaagctgttatttgtcttgttggtttatacatattcgtctacatggaaaatatttaggaggaatggttcgcttgaatattttggagtctaccatagctttttgagaagaatctggtgttcatttgctttaagcagctgtcactaggaattttgctgtaggcagggatagaagcaaagtctgtggaaagtgaacactgagcagagggggaaaggttgatgcagaccagcctgctgggtttcctcacacaagctgaaggctctccttaggaatctaccaggaatatctgtaactcccttctataggttgagtccccagaagttccctgacaaacaactagtctttcccttccttaaatgtgttgctgtcttagtcatttttggcaaaagcagtggtggttgttaaggtaatttatactccaagactcagtggtttaatacaataaaagtttaattttcactcacatcccttacttacgcaatttggacagggtggtctaactctgcacagtcattcagggatgcaagctcctttcatctgatagatccaccctcctctacatctgtagcgtcatctccctttagctagaagtttggggaaaacagtgaggacctcaagtgggagatttttaattgaccaggcttggaagcagcatactcacttctcacattgcattggcaagagttcatcacacacccatggccaattataaggaaggctgaaaaacacagcctaccttcctgtttgcccagcaagaggaggagaacatagatactcatgagtggtagcagtctgctccataatcataggcagaaaaagatagggagtgcaaatattgtaaacatccaatggataggagccttgtactttaccttgagaggcagctgagatacagagcaaagttccagtctcaactctgtactcatgaattgttccaggtcatcccaccaacagaaatgagggtattaacctcttaggatgattttgaggatcaactgggctaatggttgggaaattactttggaggggtcatcttttgtattctaccatctcctacacagtgataggcatagcctataatggcctctctgagattcttttcccaaataaaagtattccatctcattgacaagagcaggacatcattagttccatagggtgcacagccttctgcaaagagttatgtttctaattttggaggctctaactgtaatgctaagagagttttgatataaatgtcacttcaagctttaccctcttagtgaaaatagtcttaaagattcctacgtttcttttaaaaataaaatatctgcggttgtttccctctgctggaagtttggccatatcctgtatttcgatcacatgctttccactagtcatagaatgatcattgaaaatgaattaaataacattatgaaaagattctaaatgtcttcaactgtgaatatttgaaatatctggttggtttgtctcatttcaatacatttatttctagaaaatggagagtgagaggtaaaatttgactgttctttttggttctgttgccatttccatatttttttattcttctgttgtttaccagtgtgaaaaggctgaggttgtagctttatataacatcactaggtaatccacagtctatcaataaaatgctaacatattgaattatgtgaataagagtttggggagaagcccaggaggcaacccagcataataggtggagcactgcactagaaaccacaccgcttggctcattgggtgattttggaacaatacttacctcctcagatggcctcagattcttcattaataaaataaaaaaaaaaatcttcctggaagctcttttagaagccttccaatgataggctctgttctatacattgatccactggcaagtccgggaatcagttttttgaaactgggattttaaacttatgacacatttagggtccactcacgtcattgatagatactatttctggccatggtttattgttaaaaggaccaagttttgtttgaaactatgtctaagtaatgctattatagtggtggtgattttgcatgcttgtccccagtggacattttgcaatgtctagagacaattttgggtttcacaactgaagtgggaggagcactactggcatctagtgggtggagatgagggatgctgataacacatcccacggtgccaagggcatcctcttccactccacacacacacagccaggagttatctggctccaaatgtcaatacctaatgctgctgaagctgagaaactctgcattagagacagaaggtggagtctcagattctccaactttgtgccattggcatgagagaatgcatttcaggaagaaataggtatttgaaccatgtttaacttagaggttggcataggtgaggggagtgagaaatatggagaataatgagaaagtggccctaaaaatcatatacttgaatctggtgatatttaatttccaaaattctaatgcactggtagaaaattctctctgaaattactgattcctggatccttcagaaagaatttccagttgcaaaaatattgatgtgttcactgtatgtaatgtcatctactggctatgggccacatgtagaatttctttttttggctttagttttattagttgtttttcttttcctgatcaattctctataatgctaatctaatgaggaatattagcatgccaaataccattgtcttttttgaaaaaaaaatgcttttaaaaatgttttctttaatttatcttggatgaactgtgtaattgagccatgtgtcagatcattttctattctcttaaaactatctgtccatctggttgattcatatctcttgaaaactgaaatcagtttgttaatttcccttagggaattgcaagaggggagaaaatacagagcagtcttgatattgcaattaagtaactggtaggactaaatatcatgatcaagttatgtgactgtgtcaagaatagaagtttacataatgattgttttactcttcaatttcagaaatatacatatatgtatatagagatagatatatacatatatgtgtgtatctacatatgcatatgtgtatatatccacatatatacttatatgtaatatatatagaaaaaataatgtgtaacagttacaaactagtcaacacatttctatcgtattcacttacccatcgtttcttccgcaaatctatgaagaaggccacaaggtatgaaactggagctaagatagaatattcttatgggtgagatctcagtggagtctatagtttagttaatagtattgcagcagtgtcaattttctggttttgacactatactatggttatggaaggctgagttattcagagaagctgagtgaagagtacatgggaactttctgtattatttttgcaatttcttgtatgtctaaaataaaatgtttaaaaaatcaaaacaaccaggatgctcttcctgcttcaaatagtagtatcagtgtaaatagtcttcccataggagagtataccgtatgttttggttggaacacgtagtaatattcccatatacactaggtaattcccgccactcagctatgtaaactactaatattctctttcatctctgttaatcagtgagactatgttctagaaattgtaattccttttatgtaaacttttatcacctgtaacatatatgcagaataatgtcacaagtctacagctagcggatattcacaaattaaacatactcatgtaaccaacacccagatcaggaacagaatatgactaacacacagagatatcttccccaccccacagtggtgccctttccaatccttaactgggccctgcctctactaagggtaacaatatcatggcttctggtaccagagattagctttgactgtttcgaactttggcatagtgaaattgcagatgtctcacattttctgcgtaggtgtgggatcagcacctactgtccacgaagattgtgtgctgtaccattcgagaggttttcattctcacacagtgtgccaaaaagctgcctttaagctcttctctttgctgctcacctgtgccacgtgagctaaactaaagcagagcagattttctttaattttatagctgaattttgtgactttggcttctcattacaaggtaaaagtaaagcttttattcagagaacagtgagagcttttttgcctggtgatcaaaaagtcagtattataccttttgtcattaatgagttccttagacaattgcatcccaaactttgtgagcatcagactcccctgagaatccatttaaaatgcagattctcatgcattaggtctgcagttgagtcacagattgtgcatttcttccaatctcccactgatatagatgttattggttcaaggaccacattttgagtggcactgatgcagacattttcttattagaggcagcactgtatggtgattaacaacagggattatggagccagattgcccagattcaaatcctggctctgccatatagatgtggactttgaatacgtttcctaaactttctcatctgtaaaatggggaaaataatagtagagttttgtggggattaaatgatgtagtacatgtaaagtgctttgaacagagcctggcacataataagcactctatagatgtcttcctcatcattattcaatgattgggcatttgggaatagtctctattaatcatgggcattgaacttgcaaccacatggccttctagataggaatgtatttaattctgggagaagtattgaggataaagtgttggtattcgcatttgtatgggaatcctaaagtcattgacagtggaggctagctgctgcagaactggcagtcaagtcaatgaagtggagggtgaccagggagaggacgggaggctgagagtgaagattggaatcatttaaatgacgaaagagtagaggttgttgatacctgagcagcatctgatgaaatgattatggtggttgggcctaggatgaattgtagaagggacagtttctacaaccttttattaattcaacttttctttacttataaagtgatctcaaaagtataaagtatgaacattggcctatttgaaatctgtaacagttcttaattagtaatcattagctagcttgtagggaaataagtcaaggtggaaaataaataccatacccaagttattaaaaataaatatatataaaattcttgcatgaaacaaaagcttaatgaaagaaaaggctgcgtgtggtggctcacacctgtaatcctaacactttggagggcgaggtggtcagatcacttgaggtaaggagtttgagaccagcctggtcaacattgtgaaaccctgtctctactaaaaaagatacaataattaaattagccaggcatggtggtgcatgcctataatcccagctacttgggagactgaggcacaagaatcacttgaacccaggaggcagaggctacagtgagccaagattgcaccactgtactctagcctgggtgacagagcaagacttggtttcaaaaaaaaaaaaagaaaaaaaaataactgtcactttagttgccagtgctaaaggaactccagctcctaccctttaccaattttagtcttgttattctagacaaagaggactttataggatagtaagtactttttggtttgtttttgttttacaaaatgaacgccttaaaaagcattaggaaagtgcccataaacatggaattttgaaagtgttaacaagtaaatgtctaaaattgttaaataagaaggttgctgtccattttagtcaatttgcttatgtgttatattttctgccaaatacagtatgacttttttaagcacttacggtaatttggctttcaaatcagacacattcaaagacaccagaaattttgcaagcataaaagttgacacagattattttccaaatacagattgtttcagaaataaaataatgaaaatggcataaataatattttatatgaatgcagtatataatcatatgatatgctaagatgatagtgccctcttaatttctagaagcttctggttccttgcagtgtcaatctcattagtggcggtgatattttagtagaagcacactagaatatatactgccagttattaaggatatttttcatgttttgcttttaagtgcccatcccctgctaagagcatgaaaatctgtatgtggctcttttatgcttcatgcacagagttactttggaaagatttttctcattgtactgagttttcatctctgggtatcaaaactgcatgcaatttattttgcctttttgaccgaaatgtttttttattgtgtggtcactttcactttgttttcttccacaggggtgacattatttccatgctgttacgtgatttttgtaaaagtaccagtttcgtcagtatggaatactatgatatcataaaatttcactcatgtagtcattcacagattcattcattcaatacatttcatgggtctttcatgtgcagaagagggcacctacgaagaatgtaaaatgtggagtcaacacattcctatgggttcggggggcccctaaatggcctctaggattttttttttttaagattgaagaaatagacttaggtatctactctttctaattaaaaattaaaagagaaataaaatcaggcacaaatccaggttttatggagccagaaacttttgcattacaagaaaccctcttagggaagaatacaaaatcatggctacaaatcgccagaactccacccagagtttctgaagtagccttgcaactggggtccttacactgaaacgtcattagcctcacagtcaattcactgtggaataaaaataggctattttactctgaacaaatgcatgttcattcttaacttctgtgaaaaagagatagtgcttatggaacaataaagcaaagaaacaacatgttgactttcgtagtttcggtaagcagctaaataatccattgaatgaagcttttgtttcatattttcctgcattaggatttgtttctcaagagatgttaggagggagcaaggagggaaaggggcccagtctgtgatccttctgcttccagtatggagcaatgtactcattccatttgggaagtaaagatgggttgggatttttaggagcatgttcgggagataaaacatgtacagaaggcggggcgcggtggcccacgcctgtaatcccagcactttgggaggccgaggcgggcggatcacgaggtcaggagatcgagaccatcctggctaacatggtgaaaccccgtctctactaaaaatacaaaaaattagccagacgcggtggtgggcacctgtagtcccagctactcgggaggctgaggcaggagaatggcgtgaacccgggaggcggagcttgcagtgagcggtgatcgcgccactgcactccagcccgggcaacagagcgagactccatctcaaaaaaataaaccacatgtacagaaataactgtagccccagatagaatgtgatattgtttagctatttgtccccacccaaatttcatgttgaattgcaatccctaatgctggaggtggggcctggtgggaggtgtttggatcatgggggtgaatccctcatggcttggtgctgtctttgagatagtgagtgagttctcacaaaatctggtcatttagaagtgtgtggcaggcccctccccctctcttttccacctgcttctgccacatgacatgcctgctcctgcttcaccttctgccatgagtgaaagctccctgaaggcctccccagaaactgagcagatgctagtgccatgtttgtacagcctacagaaccatgaaccaattaaacctttgttaaaaaataaattaccgagtctcaggtatttatttatagcaacacaagaacaacctaatacagaatgcatttcctttttaggaggcagtgaggctgccagctgaggaaataggagctttcatgggaaagataacatttccatgtgactttcattgatgggtgacattcgaaggtgtgtggatgcagtaagatggaatttcaagcagaggacttgatgcaaactgtgaaagggggaagggcatcaggacagctctatgtgtcagatgcaggacagagggtggaagtgagaagggaggatcctccatggagagttggcaggtgaggtggattttgcccttctgttgagtgggtaatggagattccatgaagaattttgagttgggagtgaccggacctttgaggaagctcaatggacaatgttagggtgatctggagatcagttccacttaacctgtcactttacagttgaataagctttggcccagaagacgcagcagcttgtcaagaccacaatgcaggttagggagtcaacttaggtctctagataggcagttttcctttcttgccatcaaaacaatcatagttcaggatccatgtcttgtcctgtaacttagttcacaaaaaccttgctccttcctgtaataaggaggtggaaaggggcaagataaagactatttgatggttaactaaaatattggatatttatttgaccacaaacaaattttcaagtccatttttatataaagcagaactgtctgatagaaatgtgtaagacatatattaaacttaacttttcttgtagctgtccatgaaaagagtcaaactctgtaaaatattttgaagagatttattctgagccaaatacgagtgaccaaaggacgatgacacagtcctcaggagatcctgagaacatgtgcccgaggtagtcaggccataacttggttttatacattttggggaaacataaggcatcaatcaatacatgtaagatgtacattggttcagtctggaaaggcagggcaatcggaagtgggggcttccaggttatatgtagattcaaagattttccgattggcaattggttgaaatagttattatcaatagaatggaatgtctgggttacaataaggggttgtagagaccaaggtttgatcatgcagttggagcctccaggtatcctgcttcagagaaaatagattataaaatttcttatcagacttaagagtctgctctatcagtaactccaaaagggaggagggtaaaatgaggcatgtccagttccccattcccatcatggcctgaagtagtttttcaggttaagtttggaatgcccttggctgagaggaggggtccattcagatgattgtggggggaccttagaattttaattttggtttacatagctacatttaaaaagtttcaaaaatgttaattttggccgggcgcggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaagtttcaaaaatgttaattttaataacatattttttatttaactcagtagatacaaaacattatcattcaacatgtaattatagggtaagaaaaaatacttttccttttacccttaaaagttctcagctggggcctttgtagcaaaagacagattaacaagaaaaaaacatgcacatttatttaatacaagttttacttgatatgggagccctcataggaaatgaagacccaaagaagaagttggaattgaatgcttctatactgaactggacaaagaatattaagttataaaaatgtgacaagacaaacaggcttgggctaggcggcccatggtggaaaagtaattaggaagataagggttagtttaacaaggtttgtttgtacagatttgtttcagccttcacttccagtctctggtgataagactgttacttttcttctgacacagggaagacatctctcataagggggttttatctccttttgggaagaaaaaggggtcaccagagtacccttctaggacctgctgttttcgagtgcctttaccttaaaataatatttatgccaatgtcatatattttgggtagcatattttgtcaccttgcacaatatcaatagaggtatcattatgatattttacttttactgtcttcattattttgtaattatggcacatctctatttggactggtttcattacaagagctcaatacccatgtgcaggaggtggctatcgtgttggacagcacaggtatgaaacttttgactaaggtttaaaagggggtgatttctgaatttctagtatgtcatttcatgttttagttgccctcacctatgtcccatccagcaggtattacgaattgtaagaaaaactgaatagctattcccaaattcagacctctgtgtgaaacacagatcctcattttttattctctagttagatagtgagggctctgcatagatttcaagtccacggctattcttttctttggctcactagtctcagaaatctccattcttccagaagttcataccttttctcaataaatttttttccatctaaaagtcagtgtttaatatcaacaaaaaagtcagaagaagtaccaagcctgttccttgacaggaagtgccggggaatgatttttttcccccagaccctggttgatattcacccatttcagctgctgctttttgtcacagatgctcccagccacctgttctctgaatatattcttttcccaactggcttctccatttgttttgatattgggcaaagcagattccacctatcactcattctgtgcactcatttattaagcccattcagtctgaaagcttttttctcatccagccagcaaaacaaagtcacagacatctttttcaaatctaattctaatacctaaaaaaactcctcagtgggtctagctagcaagtgagagggaagggcaagataggggaggactttaagatgtcttgggttttctattactcagatgacttggtgtagcagatacttttgaggagccttcattgcaaggacctgagactcccagtgaacacagcttctttggttctgctttcccacagggctggccggaagtggtggggagttggtgtccctggtagcagccctcagctaatgacccagggagttggagagtacataccccagctccctcacccctcaagtggaacaactctgtggaacgttctatagcctcccagaggtccccagctagactaagttcaggttgcctacagcagtcacatattttatttttttaattttattttgtaatctgggagcatagattccaattgccccgtatatatgctgctaagcagtcacttgtttataaacctttctcctattaccttccttctcctgtctcattcttccactctgcctatcaaagctccctgtttgatctgttaaataaactgttttcactcaaatctttgccttagggcctgcttttggggaacccatcctaagatctttgccctttctagcattgcttagaagccagcggtgtttatgacccttgtaacggtgatgatgtagtcttgggctgtagtgcacccaccgtaacattcagagtccacaggcttttctctccaaattccttctgttcccaacagtacccagggatgggcctagtgttcttcttggtggacccaactctcttctctatcatcactcatgcagcctccactctgctgccatctctgtcacctctggcttgtgccatcacaacatttgtgaccttgccactgaactagatgctctgccctgctcatgctgccctcttttatggatagaaggctgcctgctttcaggtagtacagtgacttttaggctttcagagaaagtgaccttggtctctgtttcttaaagaccagctagtactgggctcttgttagccatggctaacaggttcctttcaagtcaattaaggcaggttctcttgggactggggcaggggacactttgcctggaatctctcctgacattcaggctgtgttctatatgtctcttttctttcacatgaggtcctgggtcagcccaggcctggtccaccatgccaggggattacattgttccagtctcaatgtcctggcgagccacacatcctcattacccattgctccaaaagattcccaggtacagaagtgtcatgctactctgggaagtcttgcagagtctggagaggagcaccatggccatgaacactgactctggaaagaaccagatggcctgggctcgattccaactctgactcctaccagcagatgatccaggacctctctgtgcctcagttcttctctttacaaaataggactcataatatgacttacttcataaggttgctggcaagattaaatggctttacaaatggaaaatatgcagtacattgggcacactgcttatttagcgcacatgcacacacgtgtatacatgcacacacacacaccccacacacacgtccactctccaatctcagatatactaccacacaacctagttgtcaaaaatagccttaactgatcaggtttctagtctaaccatttactccaagtgctacatatttagtaaggctgctttaaaataataataataataataataataataataaaaccaagtttatgagcaaagaacaagactatcctagggaacacatctctaatgtaaatgttgaatcagaggtggctcctggttggagacccaggttctttattagtgggagtgttcaggaaagggagagatttggggttcaggttccttggcctggaaccccctctagaacctgaaaaaacccatctgccattcctgggcagcccaggcctccccttcctggtaaacactcatggcctactatttaatgaacagggttaatccacagaaaaactcaacttactttattgaaaccatgataggcatgaggatgggatctctgcccacagcccatgaagtccccactgtcttaggggaaggagtaccattggcctctgagaggaaaaattctgctcatcctcggatctatggattttgacaccctcattgggggtcctttcccacttactactctatgacttcagacaaactacacatctctctgtttcagcctagccacctgcaagatggagatgccagtaccacacttatagggctgctgataccaccatcaccatagtcactgtcagtgctgttgtcctctcattcttgttggcccactgtatctctgttggtgcatccatctgcttccttgatgctggctccttcccagagtcatacaaggtcctgatactgctccctgggtatcttctctctcagactgtaccaatattttctattttcctaaccttctctcttccattacatgtaaaaatgaaaacgaaaacaaaaccccaagcattactgtgggaaaagtaaacaaaacaaagcaaaacaataaaaccagcaccaagctcgtccttactttcagtcgtgagtgttcatcacccattcctggtggcagggaagtttgggtgatgggaggctggctttctattctctacagaaagctccacataaaattagggtgaaataccaccttctttcttttggaatttcacttcccaaaccaaggaactatacaaaagaatagagcatctaccataatcaccataagttatattttttaagtgaataattccaagccagttaagtcttcattttttaaaaaagtctttttttttttttcttttttgagacagagactgactctgttacccaggctggagtacagtggtatgatctctgttcactgcaacctccacctcccagattcaagcgattcttgtgcctcagcctcctgagtagctgggtttacaggtgtgtgccaccatgcctggctaatttttgtgtttttagtaaatgcagggttttgccacgttactcaggctggtctcaaacttctggcctcaagtgatctgcctaccttggcctcccaaagtgctgagattccaggtgtgagccactgtgccttggccttaaaaaatatatatattttccagcctagcaaacttttgttgttgttagttttaatattagtaatgggatttcctctgtgaaagacactgtgctctgtagacatcttatttaattatcattcctattgggtaaggtagatattgatgtattttagttatttctttgaaaattggggttcagagatgatcagtaacattcctagggtcacagagtttgttagtggtagaactaagatttgaatctaagttaatgagatcccaaagcccatgatctctataacctgtcttgtatgtatctgcaaattctgaagtttgattaatatgcatcttgttacctaggaagcaggtattaatagactattgatacaaatttaatcataaattaagaggtctgaaggatctactctacactatcccttcatagtgattctgagtcttgtaaaccaatctaaaatgtattctccaagctaagtatatctttactgaatttttctcccattgtgaagcccctcaccttttccttgacccatggaccctccaggctgcctgctgaagggcccgcaggcagtcacggatcttagtaaactgcaggcctgggcccaggtgggtgggtcagggcagggagccagccccagcttctccatcaggcacagggctgaaggcccaaaatacttttaattcttttaaatacagaagaaaaactggaacttttggtgaaagttttaatgtataatattaataagtttctcatctttataccaagtagttgtaaaatataattttaatttcttttatggatgaaggggcacacagaggcaaaagtgccttgggcccacagaaggtatcctgtggcacgtggcagctgcagccaaagtctgaagtaaaaactagattcaaacaaatctagttttattatttgaatgcttaggggcatttaaactactctgcggctaggcctggagaagttcaagagaacaccatgcggtgataggaaaatagcaccaagttgccatctacaaacccaaaggaaattagactcatctcttggggcacgggtgcgctcatgttggagcttcttccaaggtttccatcagcttgccttggccagtcagccacacaaactttatgtttaattacctcaggtcaaatggatgtcccatgtcaagataagtctgcaatgaggaggtccagaaatttccagaaaggtcaatgtctatacctgcactgttcaattcataaccatcagctgtaggtggatattgcatttacatttaacttaattaaaatggaatgcaattaaaagcccatttcctcacccatactagccacatttcaagtgctcagtagctatcactgcagaaagttccaatggacagcgctgatctagactgtattaaaagcttgtttcagatcattggctttgtggtttcccagaagaaaaatcttaagttacagaccccttggagaagaatccttgggcttccagaccttgtttttggcagtgtcaaagctgcccttgcaaagttccatctggtgctgtgaggaccgaatgtttagggtgaaggccaagtggagaacaaagtaggcatacatgctttaatggaaatatgagaattatttgcaattagttacattgttatttctaagtgagtgtttttcaagttcttgagatcaagttgttctagtaagcaaattaagtatgtcttcagaaatcttatttgtgccaataaactgatgagtatactcttcatagtgcagagataaattttagcttagacaaggtcagatggtggcacatgctaaattggtgcactcttaattaatgatgttttagtctaactatcattttctctaacaaacatttcgttttagctgtgttttcagagtttgaattgcctaagtgactaattaaaatataagacacattggatttctctgtaacaatgtgaaccattttcctttttttttttttcctttgctagtatttgttatctcactaatttatcagactggtgtaaagaaatgatgaatagcaccctagccaggcccaaaggcacacatagagcatttgtgtgtttttacacttttgtgcttgatattttcttaacataaatttaagaaactctgaaaaatctccatttgaatgaagacaaattattagtaacctttattgcatcaggaagtatctcttgaagttcattatagcagcatagatttttccaaattgtattctgagctaccctccctagggatccatgaactatgataataggtgttaagagaaaaaaaattccatggccaactagtgtagtaaaaactacacatgaacctaataaaggttctgataaatatttcagtaaattaatctgtggaagatagttttatttagcacttctctcatttatttttgtttcagatgacccctctttaaagctttttgtttgttttggtgaacagctattatcgttgaacagtatgttggtattatttctggaaactttggggaagtataatatgggcctcaaatagaaactaataaactcccctcctctgtttactggctcctgtaatttggaatgtttgtttcgtaaaagcattccttctgcaatgtaccctagatgatggacagatttgacatactgtcccaccttcctgtgcctcctcccccaacttctgccctctcaagcttcccaacttccctgagtagtgactctttgagttgttccttgtgacaaaagggactcattctgtcacttgactacagcaggggagagatgtgtttgcggaagtgtaagaccaagattgcagacaagaacatgccttcccaaattgtcataggcaggggttaggaaagctgaaatagccatacactgtgttccctagatagtgaagcttccagggcagggccgagatttacagcaatatgaccctatcaattcatgtcaccttgatagtgaaagcacgtctcccatcttcccatttccataccaaccccctcgcaaaagcatgtgaagatgtcgtcctgtatttgagtgcaagatgttgcatgcatctgtcagtgttacattttgtctcgctgaatttcacctatccttcctagcttccagaatccttaaatgcaactcagggaaggacctcactagacagcctgttttctaattctgcctctgcctctcataatctgcatttaacatttctctatgcctcagttttctcatctgcgaaatggggaaaataagacaatctgtatcatgggagtattgggaggactacgtgagctaatttatgtaaagcattgaggaacatacttggcatagaataagtgaacagtaagggcacccactattattatttcaagtttgacctttcatgaatgtattattcaactcttccagctttggaccctctagaaatttgatcaggtttctacctccatccccattcaaatcattaatagaaatattgaagggaagagaacagtttggtgtgccactggtgagtccttcctaggtgatggagacctattcattgtacaacacttttttgtgcaaggccattcatgaagttagaaatcatgtcaccatactccttcaaacacccatggttccatcctgttcccagaaaggattttttaaatgtaatatttgctaacaaagaccaacatcaactctacaaatttctgaccagtgttacttaatggtggggcagggttgggtatcagaatcatctggggagattctgggactgttatttgattttttttcattttgtgttgtgagatgttgtggaagtgactaagagtcagaaaggatgagatgagcaaacacatagaaatattcgtgatatgctggggaaactcaggcaggtaatttgatgtgcgtgtgttcatgtaacttaggtgtttcttgtaggcagggatataaaggccaggtctagaggatataagcaggctttttaggctgttgctgacccaaatcttttaagcaaggaatcctctaatcaaattctggagaaagattatgggaaagcatttgaatacttgcttgctttttatttctcttttctgaagcattttcctctgacatgcttcttacaggagtccagcattcagcagccccaatgccgggtgtatctgaggattaaatgtacatcggttgcacatatcaaatgataatcctcacaaaagccctcatatgtacttgtatttaggacaattctgtggacaaacaagtctgacactgatttcctgtcttggcctttatacttaatagtggtgtaaatagataagcacatagggaatttccctgttagtcaagcacgttgtgaggcatcccacttctactcagctgaccttcgcaggcaacaataaccccacttcttccatgatggttcttttcttttcttttctttaaatgagcagaatgcattttatatacatttagatgcttactaaagaagactagctaaatgtgaaaataaagaaacatacacacatgcacacacacacaaacatctgtatattcagacatccaactgtccttgacagatgtattttgagatgattatttgcattttagaagaatcctgttttttttttcttgtgagataatcttgctgtcattttcttcttaatcacagccatcctgtcatatataaaaatactcattgtaaatgcagcccaattttctcatctataatatgaggagaaccccctttatgatgtgaatggttttggccagtgtacagtttgcctcagaaatgaggcactgaattaaatgatatgaataagatccctttgaattctatgatttctgtgatgctataatgaaattcatgaaacacacacttatgcttttgagtaagccccatgtactgccattttgtgattagcagaatgttgggatatgcacaagaacccctctgctttttttgtgccttatgaaggatttcatgttgttatagctttgataaaattggtcatagactgagtatgaattatatcttatgatagactttttggaaattcatgtgtcactgtgtagatgttgcctcaaatgagttgatcaaaagctaaagaatgtggggatttaagaaagtcaagtgcatgacattttggtgtcctctaaagaatgaaaaaaaaatggtccattgatttttttcattatagtaaatgcagaaatgaaagtgataacgctctttggcatattacacagcttgagtatacctgaccttcaggaaccttgagcctgcacagcaaacactctctctggaggcatcaatcctgacttggcctaagtcaagaactcttgggagaatgggtcagttccaagtgctgtctcttttgagtcatagctggggcaagatgcaagagaaggtccatcttttcattcaacattgttcattcactgaatgtctgatatgttctgtgcactatctagatgttaggaatgcattgatgaacaaggcaagaccaaatgtttacttagggagatgattgtgttggaggtagatggtttgggagaagacaagtaaacaggcaattttaaagttcaaggaagaacagtgtgatatgggagcccttaagagagatagctaaccaggtccttgtgagtctcaaagcccaagaaaaggttgttctccctccctgataggatcagcctcccaggtgaagaaaagacttgccaaaagatgccaagaattggagacaatggtgatcatagagcaattgggagccttgtcagaatttgcagattgacagcagcaggaggcatggttggaggccattaggggcagccacagaggactttgtatgcgtataaaggagtttggctattacctggatagcagtggggaactagtggggatggagtgggctttaagaaagaaaatactataatcaggtttggaatctaggcttgtaagcagcagactaagtgctgagttattgagttgagaccaagaacaagtgttgagttgagaccaagtgtcaagttattgtagtcatctaggagagaggaatcaattatctgagttttgttggagatcagatcagaaaggtaggatcaagaacttctaaagatttggatgaagactcaaaggtaacattttactactcaataatgataaatattgcattatttaggatagtttgaacactaatgaagtacagtacccaattaacagtggctaaatgttaaaggcctttattagctcacatattgagacatttgggtgttggcagcagtgctgctcagtgatgtcatggctctgtttctcagtagtcagctttatttctgtctcaggggtataaggtggctgccacccatctgacaaacatgccctcctctggcgacatccaaagtcagacagaaggggtgggtttctcctcacttagctcttctgagagtttaatcttccctttacttctcttaagacttcttctggcatctgattggctaccatgaagtcacatattcatggcagaagggatgatattactgtgactgctttagaccaattgtgatacatgccttgggtataatgccattcaaatcctgaacaaaatccaaatccagttaacacagaaaaaagggaacctggctgtgactaggcaatcctactgttaaacgattctataactattcatgactctcaaccagagaagtgggagtggcttaaaatgggtttgttactagaaactaagggagataatattttgccttttcttttctaaagcaacaaatatcccccctcaaacatccttaattataacactaatgcttgggtgctatgccttagttttggtgtgtctatcttatatgaccgtgatgttatagagaagtgcaattcattttcctggcacccaaaggaagaaatgagaaagcttcaccctcctgaaaaagactatacttcctattttccaaattcatcttatcatttcaattgtgtacagaatttccctgccttttttctttataatttttctctgccaagatgtagcatctccagttttttgcagaccagtcgtctcttggtgatgaatgagatacaatcctaggtaaaatacgttatactttatcatttgacttggaaaagcgttagtttctaacaggattgagtaatggacactatttgtccctccttttaaaaagagtgctttgataatttgttgtatgattttttcaataatttcattcagccaatttattggaatttggctaactctgaatcttggggaaggcatgggcacacaggtgtgttaggagatgagctgattcagcacagtgctaggaggagcttaggaaatgatgaatatttttacattgttagccatttatttcccttgttttctgagtaaattagctcagtgggtgagtcagtggtttatactttagtgtcttcttcctttttttctggatctttcttcccttctgtgcctcatgtcatggggtttctagtgcttggggagatttgtcttcccttcacctcacctcatttcctctactttcaatctgatttttaaatgccagccttgccaggaaaggtttaaaatatgatagtgttgttattttccctgtggtttctgactttttctccttcaccttgcatttcttctcctatctatcattggaactgaatcttttaaagtttacttgtattctaatctctagacctgtgttgtccaattcagtagacactagcccatatacagctattgaaattgtaattaacaacacgaagtgagatttaaaaatccagttgctctgttgcactaggggcatctcaatgttcaagatgcacagatagctagtggtcatcatattggacaatgcagatagaacatttccctcctcgctgaaagttctgttgagaagtgctacactagatgcttgccagtcttgcctttttttaattcttatggaatgttcagggtgtacagagtacaaggcagtgagatgggtctatgtctctttagatgaggaattgaagaggtaaggggctgtttctgacccggcccaccatagtttccaaggctacagttcatgggattgaatattgatgcggaagagaagaaaaccctgagcacatgagaaggcccaagttaacattgagaaaggccagtgccttcttgcaggtgttggagccttaggccaagacccagccatggaatccagataaatacagtatttcctgagaggggtttaaaagcaatctgcacacccagaccttggtaaggaagtaatgtcattagcttgggtagtgcagaatgaggagggcagagtaaatgctaggacacatttttgggaaattctattttgaaatagagaaggaactttccccagagccaactatattgcatagccattgtcctgcagtttcagggttctgctcccacatagtagccaggcaagtacggagacatggaggttgactgtgatagtcaacaaacagcacttcctcccccagggaaaacaagtggatttctgtgttaggattagcaagacagggctatcaaatactagcttcatgctgtacggagcagaggtgatgaagaatttactactgactgatttagtctgagcctcagtccaaaaacgattcaggtaatgattcaagacttaattttctttatactgcccaaaggtaaaataaataagtcagattaaaaaaccatgtgctcaattcctggctttgatacttcacaagccttaccattgattaaactcactgagcctcagttttctcctctgtcacttgggatttaaacttaaaactgttttaaaaatggctaactatctaaagtgcctagtgcagtttgatgatggtgtgttactttgccattgcttttcaaattaacagaaaagccacttccacatattgatgagttttctttttaggagcagtaaaacatttcacatatctggtacttttggaaaatgcaataatgagagacacacatgtattttctttaatattgtgtagtactcatatttatatttctattctttctattgataaaaggctatttgaagatgtatttaagcgacagaagcagcaagatgtatgtgtatcttgtatcactttattaatgtaatctgttcttgacactccccattgtaatttctaccaccccctacacatgtgcatacatataggtgaccttatattttacagaaacatggaggtaatcggaaaaaaaaaaatcccttaaatacattaagatggactgcttacattgttatggcttgttttggaagaagatggggtttctttgttacagtgctaaccatcccaaagccttggattccctccccttcatcttgtgactttaatgttcacttctcttgcaaatcttcgatcttcctagctccctggctgcatctgcatggttaattagcatgctcaaatccctggttgggtaaaaaaataaataaaagggcttttcctctcacccacttcccttgctgcctctctcctgaatggttttcctaggaagcttccctgtcaagtccaaaggccagtttttgatcttcatcttccttgaactgcacggtaacatttgtcagtaccacttgtactacctgaacttttctctccttttggtttctagttcttcactttatcttaattcttctatacttctttgactcttcttattctttgctggatgttccatttccatcaaatgttatggtttccagaggattgtcctcggctccctttaaggcctcatagtacattctatcccaggatgatcttatctgtcctcatggcttcaaatgtcatttatatgctaattactcttaaatcattggcactggattctctccccatctccttatctatacttccaaatacaggacattttctacatgggtatcctacagcagtatcaactttatcattgccaaattttatgaatgatcttttctcctaaacctcttcttgtttctcctaatcctgaaaccagtcagtggtagcagagttcacccagtttcctcactagggatcacattgcaaagcctctcccctctccctcagtctccgatcatttcttagttctaccttggatgtgtatcccaaatctggtctcctttccttttgatggcacttgtggtcttagtcttaccctcatcctttctgctgggggttgttgtatcctactcgggctccatcctgccagcttcttcctaattcagtttgttaccacattactgtaagagttattttcctacaaaagaaacagcacttgttatttcacttctctgcttgaaaactctgctgtctgtggcctagggaataaaaattcataggcctgtgcttggcaaatacgtgtttttcagtgctttccagacagtgacttagaacacacctgaagctgaacaagttggatttactgcccattgcagtgagagagaacacacatcctggggaaccatggggagtctcagttaaaagattattagaaaacacttcttatagaatttgagctagtgttaagtgatttgggggaaaggaagcaggacttcgctttggattggatactttaggaagtagcagcaattctgattatagatagtatagtatgtagtatacaataatagtacgaactgaaaagtgttgttgtgggcgttaatgtatgctaagtgcttagaacatttcctgagacacagtaaatagcaaataagtattatctattattgtttttggtggtgttgcctattattattgttgccttatttctaaagtatcaacaatgaattcagtgcctcacccttattctaccaccattttataatggtggtagaatagatgttttgtgcttgtgtattccatgtcaatcgagatgtatttatgtgttcattatttaacttagatttaggacaatgatatgaggtaattcttttcatctttagcttgtaattgaggaaacaagtgtggagtcactagctggcctgctcagggtcacataacgaacaaattgaggtcagatacttcaggatcctcatccagtatttttcaaactggttatgccagtttaaatggcaactttttcatatgcattattataaacaaaccatgcttccttggttgtgaagtctcttgacacgcattaggtaaaatattgaatgatctgtcatttgagtatataggaatataactgagataactgggccaaatgttgaatctctcagtgaatccaatccaaagataaagggttttggtgtgtatgtacctacacaaaggcatgtacatatacatcttaatattcttccagggaatatagaatatggatttttttttttttaatgagagctggatagtaactgtgactgcattttttttctattcatcacctatcaggttgttaatgctgactgactatggtgtgttgttacaaaaatttcaactatatttttggctatttcaagtatgtgcttccacaactttgcagctagaaggctaaacacgcagctcgcagtaataataatataggaatgtggaaagcgaggctgggtgaaagaatgctaagaattatgtggcagaaatagttctggcaagtagatttacttcacggagtccacttgctgtgttgcaattggtatccaatgtaaattattgccgggagaaggggaacaatttgaaatccaacttgtcttatacagtggagaataaatatgcaaattgttctattctttgaaatagccagaaagaattgtaccttaattcacttgtagtgtcactgtccattttaatactcacagaaacactggattctttctacatttaatttattctttgcttttctttaaattgttcttgtaatgggcggccactgttgtacaacaagaaagaataataaattaagattgacttgtattgcgtaagccaaggctgctgactctggaactaatattaggtaattttgcttgaatttggtgcaagtcagcctgtgctttttaagtattttcactttcagaactcatatagcagtgctttttaaattttatgtaccattttagtattaattgtggtatgaattaaagatttctactttattgtctttaagttgcatgctgttgtatcataattacaaaacacggggattgttttacaagcctagttttttgttctatatgtaaagttgattattatgtatttgtcagtaaacatcgttttcattaaagctatctttgactaagaataatagcgtagcccttaaagcaatgctgtctacttatggaaagaatagactaataaatgaggaaatatttattaggcattcactgatctgaagtggtgattaagtgctaaaacacagcataagacatggtcttttgaaccacataagcttgtgctctacatcagtgttttgtaaatctcctccctcactttcttcttcccttcatgtcctggtgtctattattcaaaaaagctagctattacccaactgctctgctgcaaggaggcgtcgtttgggggttgtgggaggcactcaatttgccaggtgtccctggagggtgtccctagaactccagtgttccttagaataaggaatgtgtaaagactattgctccatatgatgaaataaaatgcccttttgaaaagctaatgacagtttatggcaacaaaagatacacaccaaacagggacatagatattgagcccaacaagtcttagaaaataaactatgagatctaagtaattaaatctgttcctcaaagaaagtgtttgaaacattgtatgaatatcaaacacttgagaaaaacttggctataaactcataactgtacacacacacacacacacagagagagagagagagagagttttataatgggtttttcttatgattggtatgtagcagttaaagagattgtatttgaccaagatgttaccccacatatgatgtatgtatgtcacagagatttcactagatggtgaattctctttctggacatgtctttgatctaacctgggaagggtcagtggtaagattgatggctcccacactacagagtgtacctccaccagtgaaaggactgtgtcaccctagtcattgctatatccccactccctagtgtagtcctggtaaatatctttttaatgaataaatgaatacagaaggctgggcgatagcgctgatcaaggaactggtcttcaaggaatgctgtgagaatgagatttcattcttagactgagcataaatttgcctcccaaggatggaatcctatttctcaagttcataggattcaagtataaaaaaatgtgtatctcatagttatttatgtaaacacacagagattatttacataggtttctattgaaatgtctgtgtatgaatctaccatgagaaatggagtcctcaaacagactggaatgttcactttcttatatcaatacctcctttccctataggcaatctatgagacaagccaaataataatcatgcttccagcttataaaggaatcatgagacctctcaagtcatctggaggttcatgttagcttgacctgctcactgtatccctgcagagaatctataggagaaaccaaattatcaaaaggctgctttgatgagactggaatcagaataaggggtgttagtaatatcagctgactgttgaattgcatcaggtttttatagttctggatatacccatcagaatagggatatttgatttgtctggagggagcccatgtcttcttgcaagtgtatgcatggactctgctgtggtctgccttctagaaagagctgtttattataatagtaacaacttcatagaatttttgtgaagaccaaatgacataacctctgtaaggtacttagaatttagtaaatatttattgtttaaatatcgtgtatttattattccttctccttaccttcctccttttagttttttcttagtttaccattttacttgcatccccacattggatgactaactcctcttctaaaagacacccacttgctctgtaggtgttgacattgcttaactgtttctattcagtttaagagtctttttgcctctttaaggagagtttgcatttctgtattctaattcattatttacatattttaaagtttagttctcaaatatgaacgttccttatttccaagtttttgaggattgtggggaaccttgctttagtatctggatggatagcaattttgttatttagtggagagggctggcagtacacaatggctgatgtgtgtctggcacataatagacgctcaataaatataggttgaattaactgtggcagttaaaaaccctttcctttagagcaagccctatttacttttcaggttggataattttttcttggagtggggggtgatgtagggtccctgatctctatccctgatctctatccactagatgcctgtagtgtgcccccgcttccagtcgtgacaatcagaaatatttctagacattgtcaaatgtcccctggggaacgtgaccatccctgattgtgaaccactgctttagagcaaaacattgctcataagtggtgttcacatctgcattttctccttggatttctcaaaatttcccagaaaaaaatcacagaaggcaaggacattgtcattaatattaataaatttccactaacctaagggcagtagtatttaatgctgaatgccacaagaatcacagccaccagcaatgtttctgttattcaggttcttctcttacagctgtgggacaggacataaatgaaaaaggccagaagaaggaattgaggagtgaaggtagctgtgtccacgtaacacaagtgtgatattgatcccatgccccagggttggctgtgactttgtctacagtccctggtatactggaaatgggagtgggggttgggtagatcagcaatacagacctgagtcacttccagcttgctgagccttggcttcaggaactgcaacctcaggttcatagccctttgccttcatctctacttcacagcaggttggacttgcctgagttatttagattcaactaaccctggccataacttctcccagggaacttcccttcggctcctgatcccccagcgtccctggggtagatgttctcccttcaagtgcacaaaaccctaatgaggtatagtcacctggtgatctccatgctggtggaagaaggctgggatggggaaagggacatatatagctgggcacaccccagtcctctggggcatcccaccaggacctggccatgctcatggaagaaacagctgccccttggcaggacaggtgggcatggggtagttcctgtccctccccatgttggctgtgtgcttcgacaggtactcacacttatctgagtgtttctcccagattgtgaagctcactgctcactcctgggaaatgcattgaatcctttatcccttcagtgtctgcttactgactgcttcattgactgtccatttacacaccaggaactaagctaagtgataaaggatagcgctacacaaatgctaccagtttaacctgagctaagaagctcctactgtaatgtaaaactactgcagcactaagcacaatgtttgagatggctttttaaaaatggcaaaactgtcttggtccattttctgttgctgtaatagaatatcacagactatgtaatttataaagaagagatatatttttcatagttctggaggttgggaagtctaaggttgaggggctgcctctggttatggccttcttgctgcatcataacagaatcatgggaaggatagaattatgagagaaacagaattatggtaaaaaacagaattgtgagtatgacagggaattgtgggaaagaacggaattgtgggaaaaaacagaattgtggggagtgatacggaattgtgggagagacagggaactgtgaaaaatacagggaattgtgggaaatataagaaattgtgggagacgagagaactataggagagaaggcagaattgtgggagagacagggatttgtagaagagaacagaattgtgggtgacagggaatcatgggaaagaactgagaattgtgagagagaacgaagcattgtaggagatagatgattgtaaatagaaacaaagaatggctggagtgattaaatactgttgggaagaaaaagaattagccccccctggagtctatttcttggcagggatacatccctcacttttgatcatgccatatatcttacctccctccatgaatgatttctggcagcctaccaaaatacaggcaacactgggtcaaagaaagaaatagtcaaagaaactggggaaagggtagcttaatgaaaggaaaatgatgcagctaataatcatattaataattaagtatgtaggccataggatcctgaactttctccttttgagaagagaggaaagtgcctctgttaaaggtaggccagagatttgactgtaagattttcccatgttgataagattaaaagtaaccaggttttttgctgtttatgtttgtttgtttttaagaacacaggttttcttgatttttagtcctgagagaaatcccgattgttcataaagatgatgttgtgagctaagggtgctaataagtgtgctgtggagctacacacagatcccctcaatgtaaactgttgtcacagtcacaaagcacaattcattaaaccaattttatgaatcatcaagacttctgttcaactgaatatacaagctctcaatgttctaccttaatccatttagatcactgttcctagtttggcaagcaagtttcaactggcatatcagctctgattcccttatagtagctgttctaataactatgttgggaagtttcatagctaagttcagactcagaaggaaatgctctgttattgagtagcagtatctatcatgggtgcaggaagggtttagagaaatggaggtcttatatgtagatattctaggcagtcctccaaaaaccattctcgttgcagggcttttgataaatattagacagtagaggggtcaaggtcattgctgttggccaaaacctaaggggagaaactctgagatgtttattaagttatctgatttgaatataaattgggcaggggttagtgtaaaattctgttataaaaacgagagcatccaacctaaaaggtgcatggccaatggcccctccacctctctctgtgtatagttagaagtacttacatatagagagagctaagcacatctgggtgaccatcaactcaaagccagatgggcgatagaggactgaaaatctatccatagagcatggctgcaagaattttagcctagaaaaataagcatgaccttccaggaccatgagaaaactctcaaaacaacacccaagcaacagtggaaataaacatctaagaataaatgtcagaagactcagtacagtcttgcttttactatatgggactcataacgtatttgtcttcattcacagcatgagacacacagagcacatgcattcagtttaagaaactgtcttcaaatttgtactttagaaatataagtttggcaaaattgcatcacctagcttatctaagttagtttttctttccaagcagtagtgattaactttctctgaagtaaagaagaggaagagaagtaggaggaggaggtaaaggaggaggaggaggaggaggaagaggaagaagaagaagaagacgaagaagaagaagaatgaaaagttatcccatgaataaataagtcaaatttctgatgtttatggctattagttaacctataaaatttgatgggcctttcgaataccctagtttcataagaatttctcatcttaaaaaggacataaggaataagcgccaagacaaaaatactcccaaaaccagagttccttgtttctgataaattctggaagttatttttctctagaaatgacaaaaaaaaaaaaaagtaaagcaccccaagacacttctctatctcaacagggttatggaacttcctagtactccagtttatgattaggattagtcatttcagtaatattcaacaatcaagtatccataggttatgagaaatgcacaaatgaaccaaacatagtccctgccctctgggaacttttagttttgtaggacacaaaagtaagtcatgctgacaatagatgcgtggaagaatgtgaataaaataccgtgggaacacaggagaagaagaggatagaaggttagtggatttcacaagtcaattctaaaactctccaacaaaagcaaaagaaaggaaaggtttcttaaagtaggggataatcaagatagacctggaacaatggccaaattgtttaaaggtgaaacataaaagcttacaaaattcaagttaaggaaatcacgtgaaaacagacacaaaggacagaagtgggacacagtgattctgactcgcagggacttgctgttggtagagtggctcagaggagggtcggggagggagcttcagtgtagatgcatctgaaaagccaaagtggggttagaccttagaggacagagagtttggattctctgacactggcccagaggggctaatgaagatttcaatgtgggaataacttcagtgtaaatgacaaggagaaggacaatggaaggtgggaagggcattctctgactgagttttcagtgtcccagtccttactgatcaagggctgttggatgggcagtccatatggcctatgaacaaccaggggagggccagtaaggctctggaggcaggatggaaaggggacagggaattcgaaagaggaatgaatgaaagggggaagcaggagaatggggtctgaaaataaaagtcaggtgatgtggacttcatgccactctttctggccttcagatgtttccacttggaaagtgacatgctggagtaaaggacatgttagatttctttcaggatttctaatcatgcactactctgtggtgttccatattatgaacaaatgtgagaaaagaatgcaaggggtttgagataggtgcaaggtaatctgaaaagtagttcctgaactaacagatgccagagagctgcaagaaaaaaagaaaatctcaagaaagagatgacttaaaaagctctgagaaggaaaactgccttgggatgtgattagaaccaggtggtggtggaggtggcccaatgttagatccacagggtcttaatccaggagactctggaacaagctttgacttggaatagatgattggatccaaggaccatgaggaaaaggtgagagcagttcagttgcctccttccaccttgccatcctacaggtctctcaaccttaacacatctccagctgacctcagcgcactcccttgtgtcctgccccttcttctgtatttcaccaaagagcagaagtgtttcctccactcagttgccctgggctggaaacctccgtggtctataactgctttctctttctcactttccacagtcaaggggtggggagccctgtggcttctgccttctcaaggtgtctcaagtttgtcctcacttctccacataccaaggcatcactgtctcctccctgactcactacagctggttacagctggcatcgtagcaccagtctctcccatacccttgcactgtcctggtccaacaagcaaatcagatcgtgtctttctttatttcaaaacctgaactggcctggcatcggtctacggatgaagtctattatctttagcagagcttgtaaaagtctttatcatctggccccaacctacttctgcagcttctcccaatccatccactctgattgcagcagtggccacccccaaacaatatacagatgctctgctccttgtctcacacaggttcttctttcagttctctttttcctcctctcccatgttagtctgtcttgcgagacccagtctgaacatcacttcctctagaaactctcaccagtcctccaaaaatcagtgtagtcattgcattttctatgttcctttgacatttcacagatttttacaaatacagcatagtattatacttacttaaataaaatcatacatcctacttctgaaggacacttgtacccctggctaaaagtgatgaccatatagtaaacactcaatggctatttgtttaagttcaaattcagctaacttgtgaaatatccctagtaagtgccagataccatgttggagaatgaggctcaatatcaactctgtagccttggagtaaaacctaaagtagtagatgcttaaggatacaatgagtcaccttcatcatggcagtttaaataaggagaagcctgtccggtactcactgtatgtagcttgtatccccaggcttttactgtctccacacagcagagtacttcttgctttatggataagctccctacccttatggaagaaaccaaaatggaagcagctggaaagaaggaaataggaaacagcccaagatagcccatacctcagtcccaagataaccacttcagaaaagtaggctgcagtttttggcttctggcgggagaaggtcacctgtggcaaaataacaggagtctgctatttgcgaggggtcaccctgccctgggctggtttccttacatgtatccatatcttttggcaatcttgctctgtcatgatagtttatatgcagattgggaattttcacttgactgttttgcctgtgaagtctaccactcaccaacatttgctttatttttttcaaactaaacaatttattaattattagatgttgcgtaatttattttattattattatagttagtatttattgactgcttactatgtgtcaggtactgcttaagcatatagcatacaatatctcaatactcacaatcttagaggaattactgttattagcatcttattagaggtaaggaaatactaagtgagatgtgcaaggctagtcctgagctcacttggatggggtcatgatgaacagttctgtgcccagatgctaataacacttccttgaggttatcatgacagctcttagatagcaagtctattccttatacttgggtcatgtgttgcctaccttctgataagcttaagaaatgtggctattgctcaaagagcttattcattataaaatcttagtttgaaaaaagtgtttaagaagaccccaactctcatatcattaagaatatttaaaaatttataaccagttattcttattttccaggtaggctttttggaataatgcaatacatataatgcaataaagctacacaaactcaaattttccatcacaacttataatttaatattatcacatacagccattggacacttatgtgcaaagaccaagcattcagtatggttgcaagatggtcattgccagtgatactggcaatgaacatgcattttggttaaaggtcttcaaatagccccaatacaataaactggaggatgttagggaaggggagaggttacaggacctctgtgtgggagagatgcaactttctccacaaacagcatttgttggaatcagcccactgccaaggactaaggtaccacaaacatgtcaactctatgtaaagaatttcagcattgttactcaatgctaacagttaaatgtttattcagaaagaatctttaaaggggataaaatctgaatgtactatttatattaaaaattgaagtaagatcttttcccacaagccttaaataaagaaataagatgaaattttgattttagtcacatcagataacatagatggagagtaaaattaatcagttataataatgatgaccttaattgagatttaattggaaataaaaatgataggtttggtttattctttttcattagtctttttaattaggagataaatgtgcttattgtaatagtaaattcagaatatggagcaattgataaattataagtttatagtatatttgatgactatgaaagtgtgggtctatatgtactaaactgatatctcattttaactagtattccatgggtgtattaaattataatcactagagaaacattatttaggcctttaattggtattttcttcctctttattacttgggtgaatagaaataacccaaaataagaagagtttaaaaagggaaaacaaaagagaagaaatttgtaaattgtaagttaggctgatagtggcaatatgaaaggaaaccaaaaagatcgatccttggataggccaaaatgctgtgctaactatagaggaaaacagatatttagaaagagaaaaaactcaagtcaaagtaaaactttattttgcacaagcagtggaaaaggttacaagctaaatctgtattatgttcaacataagatggacgtgtccaagttgagaactcttcaaggtagactgtacagtcctgagctgagaagctgctacacagcagtcaagactgaacttgatcactgtcatctaggcaattagagagaaaactcacttcacctccaactaggaggttttcctcggaatatgacatgattgatttatttatatatttatttttattgtaaacaataaaagtaatgatgccaacttaccaaggtgtcagtactaaatattatctctaatatactaagtcccaagtggctatttctgatactgagaaactaagaaggaatttgtgttctattaccaaaaagccttagacaattaaagtggcaacatgagagtaaaataaggtctctcagtatcagcactattgacattagaggcttgataattctctttttgctggagactgtgtgtcctgtacattgcaggatgtttagcagcatctctggcctctacacactagatgctagtttcctccccattccatagctgtgacagtcagaaacgtctacagacattgcctaatgtcccctgggagcaaaatcactcatggttgaaaaccactgctttatagtaagcctgtaatatacaacccacaccctccttttggtcccaagatattataagtaagaaaataagccagggacaaggaggtgtagatttcctgtcactgttccttatcaacagagaaagagcagcctcctcgcctgcttcagcccagtggagccatttaaggcagcccttcccgtcactcattcactcacttgaggcaaaatccaccctggaaagatttttattttacaatcatatataaaatatagatgcctggtgcatgattttgaattttgacttgatgcatgtcttatgaaatgaatcattcatgatgaagacatgatacaatctgttgtagaacaatatgccatagagaacctcattaatagggtggctattgtaaaatatgaacattgcagatcagatcttactctgccattttaccagttagttgcagcccgccgcaagattaggggtagtgaagattggaaatttggaagcatggttgatagaaaaaattctttgtacattctgacttaaatagaactcctcaatagggaaacagttcttatgaggatttttctttgactttatgcagagaagtagcctcagatgcacatttaacttacctaaattcaattctcttcagtgaagggtcaggtagatagaggacaggggagaggtgaggatttacatagtcccaggaatcctgctgcccaggtttccacagagttagcctgtgcccacaggcagggaggtaggcgaattggaaacatttctacaagctgctataaagctctggtaagaaaagatgaatgaccctcaagcttcccccaccactgacagagagaagagaagcacattctcaggtgacaggcaagtggctccagagacatactgaccagggaagcattagagggaatcctaaaattgtccctagatggcaaaggtggtgacagccaaaagtcagatgtggaaatcttcataaatgtgctgaagtgtcctaggcagcaaagcacttaaatgatttgatgattaaattctttccataatccttttttttttttttcagacagagtctcactttgtcacccaggctggagtgcagtagcacaatcagagctctctgcagcctctaatcactgagctgaggcgatcctctttcttcagcctccttagtagctgggactacaggcatgtaccaccacagctggctaagttttttttttttttttttttttacagagacagggtctcactatgttgcctagtctggtctcaaactcttggtctcaagcagtcttcccaccttggcttcccaaagtgctgggattataggtttgagtcaccatgcccagcttccataattgtttttagattaatgtatataaattcctgcacagggttggctactctaaaaaactttgacagccgtgtctcatggataatttcaagagagtccaagagtgactagatgcaaacttaagaccctaaccaccaccttggctacatcttcactttatactttcacaggagattttggtcgttaattttaaaaacttatgctgtgcttcaaaaaaaaaaaaaaaaacaaaaccccccaaaagactgacccagtagacgttagctaataatgtgtcactatggtttctaaattgacagaggctatttttacagaaattatttccacaatcagaagtactgtactgattgcatttctttgtctcaaaaagttttccttatgtttctcaaagcagtatttacactaattattcaattcttatctttctttcagttttctccaatagactgtgagatctttgagggccaggttgacatgtctctgatacctacaccctatgcagctcctagtgcaggaccttgcagtgacgagcatttaggaaaggaacaaagagtgaatattcattatgagaacacaggccaaatgtaaccagtgatcctttcctattaattattttctttctcttattaaactcacaaaattcaatgtcttttaaagcactgttttattaaaattaaccaaaaactgaacttcatccagctaatttacttccttgtgatttgccagattctcccactgcttaagtgattaagcaatttggaaagtgagtgtttacttcccaaatggaattccagtaacctaaaaaaggcatgtccttaagaacatggcacaagtaacattggaagtttgagtgagaacagcagttgaccctttgttccattcagttttccaggtaattattatgaagtcactgggattagcactactgtgccactggaaatagtggcagaatcttccaatgcaacagacttcaaagatgggagatatgatgctttctcaagacttcctggaggatctggcatttttagatgagtgtagatggtggatgttttccataggcccaaatgagaatgtattcagaagaaggcgttcagggcccaagccatggcaaaaacaaaggccaccaagtgggaaagcaagtgtggggtgtgctggactggtggtgagagatctaatttggctgaatgaacacaaatatggaggacagggatgggtgataaaggctggatgatgactgaaactcagtagtggaaacttgactgttggaacaaggagagtagttttactcagaaagccagcaagaagccattggaactgtatatgctgtggaggcacataacaggagttatgctgtggagataataatctggtggcttgcacaagaagaaacaatgatagggaagagactagatgtcagagactaataaaaggccactgcaggctttatccaccatagccccaaactgtaaacaacttaaacattcatcagcagtaaaatacataaatacattgttgcatagcatttcatcatatgagtatagcacaatgaaaaagaatgcatcattgctccatgtaacaacttggatgaatctcagagaccaatgttgagcaaaagaaatccgacacaaataattcaatatatatgaagttcaaaaacaggcaaaactagtctatagtgttcgtcatcatagtagtggttgcctctggggaagtattgactgggaagaagcctaaagggccttctgaggtgctggaaatagtctgtatacatgagtgtattcatatgtaaaaattcatcgaactgcatacttcagatcagtacactttgctgcatgtctattgtcctgcaataaaaaaataggagtaaaaataatcaaagaaagctattgcaatcatcttgtggaagggaaggggccttcactaaggaccaatgagcataagcaggagacaaatgtcacacagcacacatgaggcagaccgagggttatgaggacttggcaagcgtttggatgaggagtcagtggagggagaggagtaagagagggctctgagatgacaagtgcaggtaaagtgtagagatgtgtgggtatgtgtttgcgtgtagctatggtaactaaagggctgggatgatcacagtatgttgggcaccatatatttggaatgaccatttgattttcagggacatcacaaccttgacagaattacctcagctgtgaggtcctagcatattccagcatgctcctgctccctttgttcccagctacagaaatacaagaactcacgggctgtacttcccatttcacaatcctctggcatctcattaacatccaccttgtattctacacagatccactcttcactctgagagagttaaataaatacattctcaccaaggtcattgcagagcttacatagaaaccatcctatatcctgaagatcctgcagtatgcagttttaggaagcttgtttttgtcttttcagggtcattatgaccaaagaattttgatgcttggtagctaattttcaaaggctacttggattctgttactgcgaccacacagagagatcaggaggatgtacttcccttgcctatcttttcatttctatgtgtatatctgggctctggagaagtggactttggacttctcttccctgctgtgctccgggcttgtgcatttgaattgaatggtataataagctcttgaaggagcgggtgtgctggcagcagtttggagtttcctgatgaagcgtgccacaacagacactgtaggggggtggatgacagagaccaggctttcacagaaaggcaacaggctgtcccagagacaattgggaacaatgtgcactcttcagagcagtgccctgttcctggcttaccaaggcagggaaggtggcccaggagccatattggcatttgctaaggaaaaaaaaatgggggatggcttaattatatgaacataaatgttttgttttaataaaaatcttgaccaaataactgcccagccaactccagggagccagcgtggcatgcgccaaatgtcgaaagggcttttcttcccctggcagttcaacatttgtgtgtagaagctagaaatattttacttatggctgagatattccctccctggatttcttctagagtaaactttttctggaaaggactacggagtaaatatgtcaagctttgcgggctatataatccttgttgcagctactcaactctgctgttattgcatgacatatgccattgacaatatataaacaagtgaatatggctgggttccaatacacctttatttaccaaaacaggtggctgtggaattttgcccaggggctatagtttgccaacccttgctccagaggcccttgcatgctcacagccaagttctgtttgtctttgtgggatttgtctacatgtaactgtctctgcgagacacttagtcattttcactgtgcagacgttaaaatttaaaccactgatagtgattaaaaaaaataaaaaaaaagtcttatggtctgttttcttgcctcttaggtgagtggcaccaaattacttaaaaatctttgaacttgtgtttgcagtacttaatagtaattcatgttgtttatgaagtgagaaattggtatataaaaataagctgatttgatcatttggtcgtttactaagctgcatacacagtgatgcatcttagtgatgcagacttctgcacagtgatgcagaagatggcacaggccatcttcttgactaaccattgtatacctaactcctagtcataggtgcacagtaaatgtttgttcaatgaattaaggaatggaacacgcagatactatagcctaatatctgagagtatctattttggaaacaaattactgtggtacacttgcagtgtacaaaacgcggtgtcctcttacatgataccttggatcagcattcaggcagcgcatccttgcattgtgtcctggtgttgcagatttgctctgctctgttgacacagtcttcccgatccccttggtgtgagagttgctgattgaatcacaaaggacatctgtgcttgtgcaggagcaaagctaacaggtccccacagattggattctactcatttgtgttctgagcactgcccttctagcctattctcagtgaaaatgaaaggaaactttcatgcacgtccatgtgaagagaccaccgaacaggctttgtgtgagcaataaagcttttaatcacctgggtgcaggcgggttgagtctgaaaagagagtcagcgaagggagataggggtggagccgttttataggatttgggtaggtaaaggaaaattacagtcaaagggggtttgttatctggtgggcaggagtggggggtcgcaaggtgctcagtgggggagctttttgagccaggatgagccaggaaaaggactttcacaaggtaatgtcatcacttaaggcaaggaccggccattttcacttcttttgtggtggaatgtcatcagttaaggtggggcagggcatattcacttcttttgtgattcttcagttacttcaggccatctgggcgtatacgtgcaagtcaaggggatgcgatggcttggcttgggctcagaggcctgacagaaaccattaaaataaaattcagaaaccatcagcaacccagtttctcaacttgccttcagtaaataaatatcattgtcataaatcagtagtttttcttgaggtatatccagcataaaatagcattcatattcatagggaatgtattcatatggagcaaaaaaggagcaattcttgatgaagctttgttatccccaatccaatgcagccaggttaacttaatttgagaagctgatcataatgggtaactattttcaattagggcagtaccctaatatcagaaatctttatctgctcagcaggcaagaaaatcaatgattaaattttccaccctatttctgctggtaggtggatgttcctctctagatttcttgatgctttatttatccttgaactttctttctgttgccttgaattttatatgtctcatacaaacagcataaagttggaattttaaaaattttaatctgactttatcttataacttcagcttttattttactattttgtaatgatggatattcacatgcatagatttaaatctaccatcttcttttgtgctttgtgtttctttcaatgattccatgttccttgtctatttttttggttgttgtcttatattttttggcggggcagggggaaagggcgcagaggaaagctgggcttgccaaggcagggacttttctgcttccatctatcttgtgcatctactgccaatgatgactgggtatgggtgtgacacatttccagggctatctgacttggcaggtttctctccctttagtggttaccataaaaaatcaaacatgaattgttagctatcaaaatctaaagttaatcaatatttttatccttctcccatggaataagaaaaatatttaaactccataaaattactgtatatgctgttattgttatcgtgtattttaatttgtctcacaagataagatgaattttgcttgatacggtcagtgttggtttggagttacccaaatatattttgtattttctttgaacttcttttcttcatgcatcttaagaatttcttctggcatctttcttctttttttttaacctggtttatatatatgctttagaatttcatttcaagtgcctctgttggtggtcaactatttctattttaatttgccttaaaaatgtatttattttgctttttattcttaaaaggtatttttgttgattatattattctaggttggcaattattttctcttagctcattaagggtataattccactgtcttgtaacttccgttgttgctgagaagtccgctttaagtctcataattcttttcaagataatatcttttttactctgggtactttaaaaatatatacatttctagatatgtatttcatttctaatttttgtgttttcttttcatttatactctttgttctttggtaatttggacttcttgaagctgtataataatgtattttatcagagtaaaatattatcagatcttacgtcttcaagtattgcctctcttcaatactctttagtaaatgtaggttagatactctcactggagtctctatatcttttaccctctcttctgtatttaccaacatctctgtgctccactctggataatttattctgcttcattttccagttcaataattctttcttcagctctgcttgattttctgttaaaggtgtccattgggttttttaattagtttttatatttttatttatataattcctatttgcttccttttcaactctgctccattacttttttttttttttttttttttttttttttggagatggagtctcgctctgttgcccaggctggagtgcagtggtgcgattttggctcactgcaagctctgcctcccaggttcatgccattctcctgcctcagcctcccgagtagctgggactacaggcgcctgccaccacgcccagctaatttttttgtatttttagtagagacggggtttcaccatgttagccaggatggtctcaatctcctgacctcgtgatccacccacctcagcctcccaaagtgctgggattacaggtgtgagccaccgcgcctggccctccattactttttgtactttcctgttctttgtagatttaaggtgatgtttttgtttgtttccacttgttcagttgttttcacacagaaggctgtcacaaataaacttcttattactggaaactgaatgcccttgtttatgcattccttttttctttctggaagacagcatcctaaggtccttgattttatcagcttaattacagaccacttacaattataaatgacttcttttaagagaccaagtgctttcttatggtgggattcctctgcaaattgacaccattccctgccctcactacagagtagaatattggggtcaagaaaccatcagtaataattgagtacgcacccatgctgcaatgagaggacaaaaggagggagcccagtgccttggcagaggatgtcagggaagactatgggggagcgatggatggagaatgagggagatcatccagtagaccatgtctcaaaagaaggaggaaaaacaaggtcctgaaagtgcttatatttcattagggaggtggagaaaaaagggacaaaaaagtgactgagaagtaataattaacaatcagaaagacactagagttcatcctgggagccacggagggacaagtttcaaacttgagaagatgaagactgcagcaggcagtttggtagtcattagtgatctttgtgtcattagtgattaggaggtagaagtcaggactctggagtcaggggtagtgacaaaatgtagggtttgtagatttagggatggaatcatgggatagcaccttgaggagattgcagtaggtgttggcaaactgtggcctgcaagccagatctagcccactacctgttttgcaaagtggggaatagaaaggaaaaggctgatggtcacagtggaaaagtggctaattgatgaggctagctctcaaggagatgagatctggaaagctggtggaacaatcaactttcaaggggttaggacttgctctgaatcaacagataggaggaatgagcaaatggataaatctaccaaaactttgaattttgagagggagctcaagatcaaagttttagagatcattttctttttgtaatgtaaatatccagaaagttggaaaactctaaccctttgaaagggtaagtctttgtgaggttttttccccatttcattcatttcattcatcttaataaccaacttctttaaatttcttgggggatggatagtttcatttttattgtatgaatctggtacctgacttgtgctttccactatttttaatttctcttttttcctctcaatggagctgactgccccacccccatgaatttttctaaaatttctcagtcttcaagagttaaaatgtaacttctctaaaatttaatgttatgtgtgtaatgtaatgtaaatttgttaagctagaaaatggaaattgtgaccaaggaataaaagttgtctataaacattgtatcagtaagtgatgttaaaactgttctaggtttcaaatttggtgaatatttctggaattcagggcaaaacacaagacattgaagcttatatagttctcattatcagaaaactgaaagtgtttgttcaatcaactaattactgattaccttctatcaattaggcatggagaaatgtgtaaatctaagacacttttaaaaagtcgttcagagtgaagagagaggaaacaactgagtcagtttcactacaggtaataagggcagtgatataagagaactcagggtaacttggaatcacaaagatggtcattcaagccagtttggagttatgaagcgggcttcctgaaggaagtgggcctaaattgtctgaaagctgtggcttgcaagctttaggtttcccaagaatcacctggagatcccagagctggaactgacttacaaaatcggttttgggagtgagactgaggattctgtgcaggtggtctggtggtcgtggaccctatactgagcaactgggctttaaaggatgcataaaaattattcagtggtaattgagataatatcccattgagatgctcagaacatagaaatctcaatttcaaatgagtctgtagttgctttgggaaaatctgaggttatgaacattgagtgcttatggtttatgtatgtttttatgacttttttttaacttggtaatagacctgttagacctctgtgtctctttctccctcctgaatgtgtcactagtccacttaagagacaagtgactagaggacagcttgatgaaagagggactctaattagtgacacagctaacactgtgaaagtggaggcatctgctacagttgctaaatataattgctagagaaaagtttataaatattcatttaaatgtatttctcaaaggctcatgtttggaaccacagctgctgggttgcctaaagaaacataaatgtgccacaattaatgcattcttaaagaaagaaaaaaatgctttatctttaatgtgcaggcatttgagtaaacaccatggatcagcaatttccgtagctaccattttgcatgtcatatttattagatggtgttactacttatactttagaaattcggtagtttctctgattatggctttctagatttaacagttataaatttaacttgtgccgagtgactaatatactatttaatgtcttgtgtgattaagttttgagtttccttgccagaaaatttggctaaagactattaaaatgaatttcattttcctttcaaacagaaatctggaaaccccatttcaaaattccaaatttttcttttcataaaaatagtattgggttaatcttccattttgttctcttgagattagtgtagtaataattattcactgaccacttgtactgcagtatgtgtccaaatgtgaatgaaaggacacattcctgtgtcagtctcatgtaatctcatatattgaatttggtgggtttgcaggaagagacatagcaaagaacagaggcagcctgggaaagccccctggtgatgttggcgggtatgtaggtgcctgagaataagaaggagaaacgtggataaaaaaatatgcagattttcaaggataaagtaggcaagacacatcaatgacctcattaccagaggctagaacaaggcacagagcagactgcaaaatgaacagatgagaatgagaactatgcagcaacaaacaaaatgttgtcatgggagcttgatactcatgcaagatttggccaaagatttgtgcctgtggaggacctaaatctaaaggagtggttctcaactggggttgatttctgtccctcagggaatatttggcaatgtctaaagacatttttggttgtggttctcaacagggggtaggggttatggaactggcatctagtgggcaaaggccaggcatgctactaaatgtcttacattgcactgcacagtcccataataaagaattatctagcccaaaatatcagttatgctgatggtgagaaacccctctctttagccaagaggctaacctgagacaaagatattattcaatgtaagcatagacctcaaatgatacctctcaggtgttatttactaaactgggtgaattgttataatgtgtgtccatttccagatttttatttatttattttttttgagacagtctcgttctgttgcccaggctggagttcagtggcacgatctcagctcaccacaaactccacctcctgggttcaagctattctcctgcctcagcctcccgagtagctgggattacaggtgcatgccaccacgcacagctaatttttgtgtttttttttttagtagagacgaggtttcaccatgttggccaggctggtcttgaactcctgatctcaggtgatccacccgcctcggcctcccaaagtgccgggattacaggcgtgagctgccgtgcccagcccatttccagattttttaaaaagcaacagcttaggtggtaattaaaaatattctcaaccattgtgtgtttgaagatataaccatcatagcttttattaaattcaactgaaaacttgctgatattatttattttgtatcgaacatgaccagttttgttgatacttttcacatttcccttttcttattattttgcattcacttctgaaatgtattccatcacaagggtatccaggtaaatccactactaggtgtgctttcttttagcattacaaagagtaccattaaaaaaacaaaacaaaacccagagttgttttactttttttttttttaaagctcagagttctatggtgttcttgtcttttacattacaaaggttggtttaaagccaggcacatagcagttaggatgcactgatcacactttctggtttagaagcaaaaatcttttacagttatggtgatcattattgaaaatggcatgtacaatttagcatttttagtgttagtaaaatcgttaaaatttatatccagtgaaaaatgtttagttcagaattaatgaacttcctattgccattttaagatctgaatgctgaagccatttgaattttaaggtctctcacggctgcataaattggatttcaagtaaatggcaaagacatgtatgcagtcttgtcagcattaagaaacagatttcctttattctgttttgctctgataagaacgtagaggaaaggatagtctcttcaataaatggtcctggggaaactggatattcatatgcagaagagtgaaactagactgtctatctctcaccatatacaaaatcaaatcaaaatgaattaaagacttaaatttaagacctaaaactataaaactactagaagaaaacattcaggaaatgcctccaaacattggactgggcaaagattttttgaataaggcctcaaaagcgcagacagccaacataaaaattgacaaatgggattacatcaagctaaaaagcttctgcacaacaaaggaagcaatcaacaaagtaaagagacagcccacggaatgggagaaaatatttgcaaattattcatccagcaagggattaacaactagaatatacaaggaagtcaaacaactaaatagcaaaaaaaaaaaaaaaaaacaaaaaaaacaaaaacccaagtaatctgattaaaaactgaataaaaatctgaatagacatttctcaaaagaagacatacaactggccaacaagtatatgaaaaaatgctcagcatcacttattatcaaggaaatgcaaatcaaaaatacgatgagatatcatctcaccccagttagaatggctattatcaaaagacggaaaataacaaatgctggagagaatgtggagaaaggggaacactaatatgctgttggtgggaatgtacggtcactgtggaaaacaggatggaggttcctcaataagataaaaatagaactaccatatgatccaacaatcccactgctgggtatttatttaaaagaaaggaaatcagcatatcaaggagatatctgcactctcatgtttattgcagcactacttacaatagtcaagatatggatcaacctaagtgcccatcagtggatgaatggataaagtaaatatagtatatatactcaatggagtattattcagccatataaaaagaatgaaatcttgtcatttgcagcaatgcaaatggaattgtaggacattatgttaagtgaaataagctagacacagaaagacaaataatacattttctcattcatatgtgggagctgaccagctgaggcagctcacatctataatcccagcactttgggaggctaagatgggagaatcgcttgaattcagaagctcaagaccagcctaggcaacacagtgagacactgtctctacaaaaaatgaaaaattagccgagtgtggtggtgcatgcctgtggtcctagctacttgggaggctgagatcggaggattgcttcactcgggaagtcaaggctacagtaagccatgatccttctactacactccagcctgggtgacagagcaagactctgtctcaaaacaaacaaacaagcaaacaaacaaaacatatgtggaagctaagaaaattgacctcatggaggtagagagtagaatggtggttaccagaggctgggaagggtaggagatggagatgaagacgagttagttagtggatacaaaaatacagttaggtagaatgaataagttccagtgtttgatagtgcaatagggtgtctatagttaacaataatttattgtatatttgcaaatagctaaaagaaaagatttggaatgttcccaacacagagaaatgataaatgttgcaggcaaaaaatattttaattacccagattcgatcattataaatgcacagctttatgtatccataaaaattaaaaagaaaaaataattaaaaaaaaaacataggggaaagcaccgggaatttttagatgaaatgacgacaatttcaaaggtataagttttttgtcacttttgattgtcttttttggaaaaatcagagttgtttgggatgagaacacaattctgttcagttagctttccaaatattgatgtaagtttccccaaagcctacactgtgtcccttgtcccttcattgacacattgtctatggttgctttcaggctgcaaagacagagttgaatagttgccacagagacccgatggcctgaaaagctgaaagtatttactgcctgagcctttatagataaagactgccaacccttggtctagattagtaatgccaccgtggaaaagagttgttcttccctgtcttgcatgcaggcagtatttttcagaatgcattatagtacttgttctcatacgcagctgcattttgcaattatctggaaagttttagaaagtcctaatgcctggacccacccccagggattctgatgtaattagtatagaggaggccctggacaccaggatgtttaaaaacgacccaggtggttcccatgtgtagccaactttgagaaccattgccttatgttgctacacactccggtaagggaagatagtttctccccacaggctggatctgcccccaagtagcatcgcgagtatcattcttacctgcaagttccagtgacataatgcttgaggcaggctgtccccagacttagtggaaagaggacaggcttgggaatagcagcccatcttcaaaccttaagtttctttaaacttcctcaggaatgtagcaagaaatgagactaccactgtaaaatgcattgagtctccagacttagatgaatgtaaaacccaagggcttctattgtctatggtttcagtgctttccttggctctctggtgcctatttttatcactgaacaataaaaataaaatctattggcaatgtttctcttagttatcttccattcaaatgtcaagggaagatgatctgaagttctggaagtatggccatggtcgatttctttttctgcatggtttaggaactaaggattatttcagtaataatcctatttctgaaaacctgccacatcatgttactttgcagctctgtgcgtggctgtcattgtaaacactgtttagagaacctttatcagcatttataaagcatttagtataatttgctgtgaaaccactggtgtttttttagcttaatagagtcagcacatatggagtatttggaagatagcagtttacatcctataaaatgacttttgagtctaaagcacttttatctcagccatttaaaatgattgattagttaatttacactgccaggtactgttctcattttacaaatgagggaaatgaggcaaaaagaggacaggggacttcttcaaggccacgcagcaaggtaggggcaattgaaaactggaactccccaggctgagctctcctatctaatatttccctctggtgcaggagagtaaaaatgcaagtctctaaaccccagcagtctacatcctgaatgcaaagcacccccagcagatgcttatagtaaaacacatgaccgaatcgctgctccttgcttgaggaaaacttctgcaaactttattattatattttgcttgaaatggtgtaaacacaaatagatccattgagaaacagacattttgctttttaaaattaaactgggactccaggtaggtagcatcatccatagaacagttaggagttcatttcaccagtgttctaaaggggcaggtgataatcagcatatgctttcttaatggcatggtttagcatgtggttatgttgtttatttaattcagaagtcttttaaaagcgatactgtaaaatgtgactagccagaagacaaggaaaacaggaatgttcccaacttaatcaactgtacctggaaagaataactaaaaactgaaaaaaaaatccttattaggagtttattaaaatttttaatttgcagcctaagtaccaacagagaaactttgtcctgtacagtgtaatcagatttaatattcatgacactgaccccaaggcaaagctagactcagttatcaaacaagattcacttttctctatatactttctaaggcagcagaatacattttttaaattgtagaaaatattccataatcatggctaagccagatctactcatcaaaaatttcagctaattgagtttattgctttgacactttaaatataaggagacttggcttgagataacaaatgtatccagcaatgtatgtcctggagaacaaatttttgtaaaattataccttttgctcacttattgggtggctaagagttttcatagcagagtcatacctgataaagaagtggattgtctcatttataaattataaacctagtgggtagacgtatacagatggtccccaacttatgatattttgacttaggattttttgactttactgtggtgggaaagtgatatgcattcaattacccacacaatcattttattttttactttcagtacaatattcaataaattacatgagatattcaacaccttactataaaataggctttatgttagatgatgttgcccaactgtaggctaatgtaagtgttgtgagcacatttaaagtaggctaagctaagctatgatgttcagtaggttagatgtaccgaatgcattttcgacttaagatatttacaacttacaatgcgtttattgggatctaacctcattgtaagtctaagagtgtctgtacatttatgttaattaagattttatcattacctgatctctgtcctcatgaagcttacaagttgggggagtttagtgacaagcaggaaccaactaagtaagtccaggtgtggttaatgctataaagaagcatcagacagaccttaggaagcagcatatctgctgggctcactcttcacacttgtataaattcaatcagtgaggaaactgtgaactcagatggattgacaccatctgttactcaaggcacagcacgttcacatcagttccctttgccccctaagttctgcagggtgatgtggaagggggcctgggtagatgctgtgcagtcagtgggtttgtgtcagagctgagaaacactgagttgagaaaactcccagttgtatatggggtctgctagcaaacttgcccatcttcccctccagagagagatctcattattaacttggaatataagcagatcttctctggggattggaaggagaatgaaaagggaggaatctctgccttctctatcctggtcaggaaacaaatctgtgacccaggactatactatctctagcttccaaggccatttgctattgaaacatccttgtacaaagctatcagtactcttcactcagagaacatgcagaaacatctgaattatctcccaacaaggaaataagtgatgtgatacaaggtaattgaaggatgtcaggggaatgagaagctgaccccagagtggatatatggagaggggcaactggtcctaggaagaactgggaaagggtgtttccagaggcaacaacatgaggtggatgatgtgcttggtgtgttcaagggatgccaagaagagcagcatggcaggagctgcatgggcaagcagaaaggtagctggggcaaatttgggagggtacaggagccaggtcattcagggccttgtaggtcgtagtttgagttgggagttcatcagaagagtgatgggaaacctgtgctgctctgtaaggcatgagtgacctgtattttcaaattacagctccaaaccatgtagtgggtaagtcagtcaattttgctggtcatacgtagcatttcatttttaaataatgagatagaataagacagaagatatcagtgccttttatgtagtggaatgccttatataaatattgtttcatgaaactttcatttattatcaaatttcaatattaacttttattaattaacattagttatatattatataattaattagaattgatgttaattaatattgacatttttcccatgttgacatctcttctaaagtcaagatgggtctcacaatcaatagtatctaaagtttgatgaactatgctatgaacgttttatatgtgcatgtgtgaagtgtattgctatgtggtatttatttctgagtatgggtcacagtcactattttaccttcaaaggcctagttatggtagcaaggttggggcagcctggggaaagtggaataccacctagaattggatgcccccattctgggtggggtaattgagagaagatataagtagccttgggctctggaagcaaatagagttgtttcactggccaactataccagacaagtgtgatcaagccatcagagtcagacattgacaatcagatgtaatggggctggaagaataccctgtgaacagagggaatccaggatctgacaaggcttttgggctcttcatagcagcatgcctgattggttaaaccagcaggagtgaagcctcagcctttagtggcatatggtgccaggatggttactaagatgaggtctttggcataaagaaccaggctcaagtcccctcacaaaggatggagcagccaggctgtggcactagggagccagcctcaggatgaagaaactgctctttactggggtcacctccttaaccacttctcaaccaggcccaacatgttgtttgcctactgcttcctctttttgttgaactcttagttacctctatagaggagccattttttaaagatatgctcaggaagagagcccacctgactctgctttgggtgtctaaggtgaggggactgggtctctgggaccaaatggaagtcaagctaaggcctttctagcaaagagggcaactggagtccctgagtgttgggttgggtttacgtgaatcctatgtgtataaatctgagtataatccctcttagagcaggtctgagcctttgggttagagcaggatcggttgctataagtaagaggaggatgctgtgtttgaatcctggtgtggcttacaccatctcacctcttgagaggatgaaatgactgatgagtgtataaaccaccatgaggaggttgtgtcaacaaatataaggaagacataagaatctgtgtgccatggctttgaaataaagcactgtacttctttccctctccaaggtctctctgatgaaaccctatcttctttactccatcgcagacagaaagagggaacaaacactatcttttaagtattgaacctaggctgcaactccagtctagctaacttcatctttttagcttgataatgatgtgtagttcaagttatgtaacctttttccaaggaactgaatttagtcataacatcatttgccaacacgcactctaaaatatgctcttattgtcagtagattatgactaaaattaatcaaatcactgaagtctgtccatgaccagtaaattatcatgtaatagttagttctttacctaattctttgttcaaaccatagcttctgcccttctttgtgggctttacaatatcaaaaggcatttcttgagcttgacaaattgacacatttggcttgtttattaattgttttcaaggataacaaaatttttaacattattttaatgcattatggacagtttctgccagtcaactgaagtgcaatttgaaaataaacatgctacagataattttttctgattttcttgttattttggcttatctataacaaatttcatgccttatgttctcaaatatcaagtgcctagattctttcacttagattttaattgacatgaaactacattcataaatatgtatgttgatacatccaaatgaattaccttttctttagtcaatatatttaggaagtaattactattactaatatattttctaattaggtaagataatgggtgtggatttttaaaaatgtataatagacttctactgagcaaaagctggtatttcatggtcttttaatatctgtgtacaagaacagttctaccaattcaataaaattctgtgaagacaaaaaacaattttgtttgatgctttgtcaaagctataaactcttagtgtaatctccattgggtttatttttatttctgtgatgtttccctcacccaaaatacaaattaaaatgtgccaaagaggaaagtattttaaatgaacccaacctgttttcctttattcttgaaaaatattatttgttatacaataatatatgaaactttcctatactatttttaatttttttgtattagactcatgtgtaatacatcttttaaaaagtaatgttgaatgaatactgaaaacgtagagtctaaattttccaactctttgggattggaatgtatctaagctgaataactcaatttcactttgaggcagttttaacattgaagggaatgctgacaagcctgtggcacagaaagccaaaaaaatttgccatctggcctttcacagaaaatgtaatccaactgcattattcaaattatttggtgtttgttgtattcatggaaagtagtctttaagattgaaagtttggcattactgcactgaaatggggcacttgaagttattgcattttcaggatatactgtctctgtcacaatgactgaactctgccgtatagcatgaaagcagccaaggacaatatggaaacaaatgagtgtggctgtgtgccaataaaactttatttataaaaacaggatcaggctggatttggctcaccagtaacttgccaaccccttcaaacctttgttattcaaagaataatctatgtgctagaaatatcagcattccctgaagctctaaaatgcagaccctcaggccccacctcagacatactgaagtagaatctacattttaacaggattcccaggagattcatatgagccttaaagttagaggatcattgccctaaactactcttcaaggtgaagtaacgggttactcctaggaagatgtgtgaaatgaataagtatgttgactggggcttaagactaggtttagcaggtgaagagcacgctgtttcactgtggacttctaaatgctagaatatggagacctttatctggcccaccaataattttcacttcctactctaggtcttctcagatggtctgtttcatttctttagaggagaatgtcctcatttcttgccctggaaattactggctatgggcacttctacatgagggaatgggtgggataagttatttaatatacaggtgtgtaagtattcctcctattttttttatccatgctaatgctactcagttttgtatttggcatttttaagtctcaagcttgttgacattcttcaaatcagatcaactgccccatctattttagatccctctggtgatatttaagcttcctggactgtgcagagagactcaatgatgggccactgaggagttggaccacaacagagtttcttggcctcagcattattggcatttggggctagataattctttgttgttaggtgcagtcctgtgcattgtaaggtatgtaacaggatttctggcttctcctcattcaatgccaatagaatcccccacccccagttgtgatggccacacatgtctccacatattgccaaatgtacacagggggataaaactgcccctggctgagagccaccaagtcctaggggtgctgagaaatctgtgcctctcaggtgttgtcagggcagctacaggcccaggacatgggcgaccagcctcaagcattccctctgttctttcagtgaggcataataatattaatttttgctggatgcagtggctcacacctttaatctcagtgctttgggaggccaaggttttcttgagcccaggagtttgagaccagcctgggcaacatagtgagacctcatctctacaaaaaaattaaaaattagccaggcttggtggtgtgcgcctgtagtagctactcaggaggctgaggcaggaggatcccttgagcccaggagtttgaggctacagtgaattacgatcgcaccactgcactccagcctgaaagacagagtaagaccctgcatcaaaaaaaaattaatttccatctgagtcacaaaatgagaaatttaggaaacaaagtcaaagtcacaacttctccaggacctgcagctccatcagctcttcatcatcccattactccctctctgagctgctgacacatcctctatctgttctctctgtccattatcagttctgattccattttcttctttattgtcatttaaaataatatctcatgggaaaaacatgaatatgtattgtctgtctggcattttgaactgaaatcttcaccataatgtcctctaaagtaaaatgctagagattgggaaacaaactgaagtttatagtttagaaatctttcacattagaattttgttattgccgtgttttaattgtttggtacatgtaacattttagaaaattattaccaagggacttaatttctgtagctgatcctataactggctcatcccaagtcagagttggtaatatgactgttctttgttaggaagagagctggcatttgctgagtttgtttgagtaataatggccctcaaaaatatttccaatctgatcaaacctaattcatttactcttgtaaaaagagtcactttatattatacagcaattaaaatattaatttttcaaatattgaactttattttccatttggttatttactgaatttgtggtatgcaaatttgtagtttattcaattgactctagtaacagttgccagagggaataagtctgggtcagccagggaactggctctgtaatctacctcctgagatgaaagtactgcatagcagatctgatttacagtttcattcagatagttcatcatttttcagagagaaaaaaaaaaaaacgattacatctagctcagtgctcctgctagtacacactgtgcctttgtgaggattatagattatttacaaaagtggccccatttcttcatctttgcctttgtccatgtttcttgcactgtgactttttggctcctcccatcaatagttggagtctacttctcttccccttgaatctggggtagccatttgccttgctttggccaatggaatgcaggaacagtgatgacatgccttctctgagcctagtccttaagaaatatttttgagggccatcattactcaaacaaactcagcaaatgccagctctcttcctcacaaagaacagtcatattaccaactctgacttgggatgagccagttataggatcagctacagaaaataagtccctgggtaataattttctaaaatgttacatgtaccaaacaattaaaactaggcaataacaaaattctaatgtgaaagatttctaaactataaaattcaatttgttgttcaatctgttgtctttgtcttggaatattgtgcagccctcatgagattaagccagggctagattgctggaagatgacagatgacagatcacatgggagagaagagccatcccagctgaggccacactagaccactaagtcctagctaaccaagcatttgactgcagttgtgtgagtgaattgccaacctgcagagttgtgagcttagtaaagatagataatagttgatgttttaagccactaaatttggggatgatttgtcatatgacaaaaagtaactaagacagtgaaaattggaaaaaggcactgctttgggtggatgaattatataatggcacctcttattctgatgcagacctttctagagtacacattgttactatctccctcaggtatcctaatgcaggctacagaattcagaatcggaaacaatagccatgaaatctagagtcaggttgctgccctccaccctaggcacagccacttagaagctgtgtgatcttcaggagggaacctcatccctgaaagccggtatagggcttatacagttcaggtattagaaaggactcactagataccacagagtgtactgtaggtgccaagggagagctttccatttggccctctgaaggtttgctgaaaaatcaacttgcaaaaggcagattaattggagaaaaggcatactaatttacttaatgtgtacacatggaagccttcagaacaaagacccagagatactgaggaaattgtccatttttgtgcttagattcaacaaaggatggacaggaatatagaaacatggttggacaaatagagtatgatctagtgctaatggactgagtggggaaatccaggaaggcctttctgtctagattcttcttggcatctctaagcagccttccttccttctgggtgtggggcagaaccctctctggaatggggggccttaggacctgcagccaaacaaggtaggtcagagaatttctttatggccagtttccacacaaaaaagcagaggaaaagttataatagtattttcaggttttatggctggctctgtggcaaaggggctctggtttgtatggcatgccttggggaagagggatgctagtttgtatgactagcctcaggggaaaatgggactgagagacaagagagcagcagcaggtcagagaaaaaccttttcttctgaggccctcagtttggggtattgctttctgaacccccaacaatacgcatgtgaagcttttgtttaaggagaaaaaggatatggtgcagtaagagaaagtaaatgtgggcaacatcaggagtcagagagactttccaacaacccagagccctttcttcgtttcagcacatagggccaggctgagtcattggcttgaacatcaggatctgtgtgcccaatcttggcttggggagagttcagagaagctttcaatgcaagggtgctcctgaatctctttcgttataatcaagctaggcaaaccagttaaggcagtgcaaacctgcagtaaagtaacttattaggtgggttgccaggacagtttctaaccaaaaaaaaaaaaaaaaacaacaacaacaacttaaatctcactgcccctatcttggccaacagtcaaaaagcagacctccggcactttcagagataaagaaagctttttccaccccagctgtgaatcagttctatctacacagccttattttccttatttgtaaaatgaggataattatacacctttttacaggattctgtggggtttatatgaggtgattcatgcagaatacttaacacaagtacctggaacttagtaaatattcaaaaaatcttctgttactaattaaataaagagtactcaacaaggagtcagcagccagatttgaaccatgtgactttggacacagcacttcagctatctgggcctcagttttcttatattaaattagggaagtaatgattaagttaccatatcccgtgataatgtcatgatcatctttaatgcccccaaagccaagtaagagcacccttttatagttagttcatgcaagttagcatctagtaggtgaaaatgctagaaaaaattacttttctttattcctaattccaagagggtagtgcataaattctgtggacaatctagtaagcaattttccaaagtaggttgcctgaaggctctaggtttagaaaaagccatcaagaagaggtttgagaaactttggcattgaaagtctgggcatcagagaataattcttttaggaccactttggtggtggggacgcactggattcatgaaccattggtagccatggagttttccctagtggtcggtggactgctagagaccttaggctgggatgttacttgctagacacccaaggaagaagtgagtgagaaactttgtttgccgcagtgcccttcttaactgatgcttggtttcacctctgaaacaatattgacaccctcgtgatgctccctgatgccttaatccccctcattctgcccaaggtataccctcttgctacctgtattcaccctctgtgcatccacactcgctagggctagacactgagtgaatgtgtagctattccctgcagaaggagctcatggctaggagcagaactaatgatttacagcagggattagcaaatattttttgtaaagggccagatagtaactattttagactttacaagccatacagtttctgtcacaactactcaactctgccattggttatagcaccacagcagccacagaccacatgtcaattaatgggcatgtctgcattccagtagaattttatttagaaagtgggggcagctggttttggccctcaagctacagtttcctgacccctggtttggcagaaataaaatacatatattgttaagggctgtgcaacagagtgttttcgggatttcgttttttttttttttttaacatggaaggaaaatcttgtccattttgaaagtgatataacattataaagacattaaggttaatcctcagagtggtatcatgtcgacatatttcagaaaataacaatagtagtccagcaaataactcctccaggtactgaaggttatatttgttctaggtggaaagctggtaagcctctcaaaatgagaatgttggtaacaaataaaagttcacatctgaattagatctctgacacagagaacaaaaggcattttgaaacttgaatacctatagaagccccgtgaagtgcaaggctacttgagttagaagcaacaatgaaactcatctcacttagttatatgaaacgaatcatatatatatataatataatatatatattatattacatataaattatataaattatatatttatataatatataaatatataaattatatatttatataatatataaatatataatatataatttatatatagtatataaatatataatttatatatttatatactatatataaattatatattatatatttatatactgtatataaattatatatatttatatactatatataaattatatatatttatatactatatataaattatatatatttatatactatatataaattatatatatttatatactatatataaatatatatatttatatactatatataaattatatatatttatatactatatataaattatatatatttatatactatatataaattatatatatttatatactatatataaattatatatatttatatactatatataaattatatgtaatatataatttatattatatataatttatattatatataatttatattatatataatttatattttatatattatatataatttatattttatatataatttatattttacatatatataatttatattttatatatatatatatatagagagagagagagagagagagagagagagagagagaatttggccatggactgaaggtaataaataccatttaacaaatgtaatgtttcaacattgaaaatgaagaaaaggccggaaaaaacctggaatagttgacattttgatatttaaaacttttattggggaaaagtttaatgcttcatgctgcaatttgattttcctggtttccaaagcagtcaaaatacagaaactgtagcctcattaaatctaaagaaataagcgagttgatcaagtgtgctcattgggtacataatagatagatgaaatgcaaatacttactggaaaatatgattaaatgcatggtgttttccaagtcgttttaacgtttatgtccaaattaattttattttaggaatcaggtagataaattgtaatttactgcttttcacccaaacttgaattggaactagtattaaaacttatgatctttggttcatgggttaattgagaaacctgaaaggagttttttctggcaattttgaaaaatagaatttttaaatcacttagcaacgtaatttaacgtttttaaagtaaaaataaaagccactaataacccctctatattgtttattctttcttcttaaagacttcactcttaaaatactgcatcattaagcaaggtgcccttgtagtctgaaagcaacatatggacagagtaaatataatcccgattaagctccctgttttatatggaatggcagtagagccagacgttttaaatacctgcaacttgtcaactcctaatttgtggtttcccatcgtactaaggcactatggtatatttttcctaactacagatgtttgccatttttaaccataataaatataccaaaagtttttcaagcattatattatctacctcatttaaagataaacatctgtttgctttaaaattggaataaagtctatgaatcatagaataagtgacacattttataggccatatgcacaaactctagaaatgggctaattttcaaaatttattatggacaggcaattatgtgcttgaaattttgcaagcctatatgattcattacctaagccacattgaggatttttgcatttaaaatgtttttttttaagaaggcagtcacttgggcatatttattttttgaactcagttactagaggtatggccaagatgaaaggcaactgatattggcctaagttcatgaagcagaaattatgatcctcagaaaaggtagctttagacataaggatgctgacaaaatgaatcttcattccttaaagttagccaggaaaagaaatgtttcagaggatacaactcaggttctgaaaattaaaatctgagctacaaatggggaaaattttactttataatttctgcaaaatttgagtttaccttttatgactctgtgtggtctatgacatggagcagaaaaaacttgtaaacataagttttttgacaaaagattagaatcatgatcttcccttgctattgtttaacaagccaaccaaccagtttgtttagaggtgaaattacattatgattggggaatctttctgacattcacataatttatataaaaagcatacacgctcctggctggaagaaacatattcaggtatgtagctttttgtttggtggctatctccaaattgttttaatttttgccagaagactatactaatgtccactttcaagaatataggtgcatcttgtagagattagaaacaggtttccctaggtctttagataacaggcttttctgatgtgtgtaaggtgcaatgaaaatctgtggttctgcattatcctttcccattaaaagatcctttttctgtactgtgcagtcatatacttttattgggagattatggaaagggccttcacctcttgtaccctgtaaaacacaaaatattactatagtatcactatctgccttacagtggaaagtaagtttgacagtaagctttatcctcacttttggtcatattttcttctttcagggaaggaaccagttttgcattaaaattgtttaaatgtatgaggtaatgagagtcaacctagttatttaatttgcatgcaaatggaattgcccccagccttccttttctttctttctcggattcgtgtcagggccaggccatctatctggtgctggaaatcatctctacctcaataacctgcctcaatggtggtgcagtgttccctaatatgggcactgccaagtcaagtgcaatgacaaaacttacgttatgcaaacttattctaagtgtatactttatgtaaaggtgcacattcttgggagataaggcaagtttctgcatcttctaagttactaagcctctctctgttcctctgcataaataggtgtggtatttgcagaaccctcttcattggtgaaaaaaaaaaaaagccaacttatgtataggcaggtagctagaagaggtgttttggcccttgtggttattaactttgagttctaattctttccgttaaatttgacaaatctttattgtgcacctgttatgtgcccactgtactgtgagaatggatgagacataggacctgccccaaggagctcacaggctgcaaggagaaaaagacataaagacagctctagtacatctcagacaattactattactttcctgtgaaaatgcatcttttaataaatgccaggtattgttctgagctcttgatatacgttatctcattgcatcctctcaataacactatgcggattattatcctattgtacagagatacaattgaagttaactaactttttgaaagtcagggttccatgcctacttcattggtacctaactcaaggagttgttggtttcacattttcctggggaaagcactgcatttcattcagagctctgtattaggatatgcatccttctttttttctttctttctttcttttttttttttaaagcaaggtctcactttgtcacctaggctagagtgcagtggtgcaatcacagcagcctcgaccgcccaggctcaagtgatccttgcacctcagccaccggattagctgggactacaggcatgcaccaccatacccagctaatttttaaacttttttgttgagacgaggtcttgctatgttgcccagactggtctcgaactcctgtactcaagccatcctcctgcctcagcctcccacagtgctgggattacaggcgtgagccactgtgcctggcctaagatgcacatccttcttaacttgacattttaaaaaagctttcttagttttatataatcgtttctttgaaaataacacattgcctcctacccaacacaaggaatgtattataagcctccttccccttggactctgcgtctagcctactcccattttccagggccatttctctccccactgagatgctttcactatctactctcttttacaaattccagggcacttaaacctctgtttccaccaggagactgagtatactagttacctgctcctgcagggcacattttgtcttctctttctctcagcctctctattgcattagccctgaagcctggttttgcataatcacaaatttcatttatgcctttccccaagcaaaggtatggtcctcttgcaaggaggaactgctatccgcttagagtaattagcttcctttgcagccagctttgacaatatcatttatttcgcctcaatcaccttacttatgactctaatttgcacagaagcattgactgcaccttttcaaaggaatcaatggagttgctttaatgcccattcttggtgactgagtctttgcctggttgaagttctaaatgcaaaacttttatttccctgtgtgtgattcacttttagaaaataacttttctaatttccaagattttttttttttggtcaaaaggcagaaaacatggcagagaccaaatgagggccatttgaagtggttttctctaagttcaaagagataccataaggacttgctttctttagatcttgctttagctccctctgaggtagccagtaggatgcagaatatatatctctgtccaatttcaactggacagttgttggagctctgtaagttctttgtatctggcagttggcatagctacttgtggagacctaagtgtcagcattagcaatggccttgccaaacctcatcttggtagccctgggctggaaggcttatttctctttgggtcactcctcaagttataatgatgtatgggattcagagagctgaatgttgccttaactgtcctagacaaccccttccaagaaaaagatgcattttctgagtagagtgggagagacacatcttttcttaaatagaggcctagagtagtacctggtacactgctgattcatgtatggagccacatcattaagctcacagacactgtacagggaaccataacatctcacactggcaggcttatcttgggagaaaggccaacggacctttctccataacatctattatggacttttaaaaactaactatgtttttgatgtagccaaacaaactaatcccatgctgagcctgaaaggtcacaccgctggttcaggaaaaacgtccaacttcaaagcaaagcttttctgtttagctgcaaggataggaaaaggggattcgaaaagacaagcagtgtgtgtgtcggctcaaagcttttgatgaagaagagcaatggagtgaaccaagaaaagtgatctggcagagtagcaggtttgaatatgataatattaggggagtatgctggcagggcttgagtgggactgaacactgcaaaatggtgtacttctgtgtgtgttaggaggaagtaagtgggcaatgtagaaaaagttgagttttgagaggtcaggatgtatagaataaaggaatgaaaatctgtagacactttgaccaacaaggaagcaattatagcaattcaaacacaaccccaaattatcattaaatccatgcagtatacactcctggcctcatgattaatgccaaaattaaagatgatcttttcgtaggcaagtgttcattaagagacttttctgtttattcattagctcaatattttttaattgcaaaaattaagtaaaaaaatatcattactgtcattgttccggaatattgggctatatagaacgttaattgaggatccagagagaaatcatatgtacctgattaggaaaactatgattaggatttataaagaatgcacacatattccaggactatactgtgtaatattttaagtgtctggtttatgaaagttatttggaatataggattgaggtaatgaagtatacttttatgaactatctagatcaagtaagataaggaaatggtcaggggctgttattttccttattaggtgttctaataaccaaatatgcctttgagcttaatgactgcagaggtgctttgcgacagtgatttatactctccacttaggatgggttgtgaggtcaactgtggctttgcagaataaaccttgaggaagattgaccattcaaaaaaaggcagttggtgaaaatagttttttatatggttagattgttttactgttagtttttgatgttacgttctagcttcataaaataatattatttcattcggcatttagtttgatttgacttagtaacaaagaaaaaggggcatgtatacttgtctcagtccatttaagctgctataacaaattaccttaacttataaacaatagaaatgtattgcttacagttctgaagactgggaaatccaagattaaagtgccaacagactgggtgtctggtgaggggtccctctgcttcaaagatagtgccttcctattgcactcttacatggtggaatggggggaacactgtgtcttcacatggtggagtatgaaggggagcttccttcaacctcttttattagggtgctaatcccatttatgagggtggaccctcatgacttaatcactttccaaaggccccacatcttaatatcacacaagggggattaggtttcaataggagttttggagggacacactcaggccacagcagtgcccatgtgcagaagtgtgcctagatgtagatctgtgtcctagacagtatatagccctgtggaaaaggcagatgaaagcagcttgaaaggagacttataacatcatctgcatttccccactatgatttataaactgaaaataatcattcaaccatccattattcagtaaacactgatggagcagccattataggcattgattgagcacctatgtgtcaatcagtgtgttcggtgtaatgcaaatacaaatatggatgaaacagtctcttgtctgaaagaatttacacactatttggggatacagatacagacatgatttaaaaagtacaaattgataggtacttaagtggatataaaatattttagaaatgtagggatcgttgcctagtgttgcccaagttaagccattagaagggaagacacagctgtcaaatacgtactacctggaggagctttggccaaacagttggtgcagtatttaagttttacaacaaccatcaagtagcatcattattgcctttttataaataaggaaacagaggtttccagaggtgaagcaacttgcaccagggcaaatgtccacatgggtagagccaggatttctatctcagtccacttcactccagagcccaccttgcctgtgttccatgttggattttgaagggtaagtgggaattcaccagttagtgcgtagaggaaaggaaattttggcctgagaacagagcatgtagaaaggtcctaaaatgtcaaaaagtttttgagtttgggttaaagcattttaagagaaggacagcaggagggaaggagcttgagggtggggagattgtcagtaaacaattaagggctgcaatccaggccgaacatccatctgggagcagaacattttagtttagtcttattttagagaggctcacttctaaggatttttttaattcaacatggttaaaatgtagacaaatttaatttattgaaccccaaatcatgttttttgaatgttccaaggcatttttctcatatcaggacaggatgcatatgatcatttatagataccaggcttctgtgtatgaaccatagtttgaatacatgaaatttgtttttgtttgtttctttgttcttgcctttatgccttgatgttttacatcattgtgtattctttgctttttacatctttaaccccactgattacactctcattagtcctggctaacctatgtcaaaccactgtccatgttcaggtacacaatttgccagttcattaatttcaggcatatttcattctttcagcattcctgggaaagtatgaagtaagagatcaggcatagtctgaccaaattcttgcttatataccacagcatcattggaaaaagtttaatgaatttttttttttttttgagatggaatctccctctattgcccaggctgtagtgcagtggtgcaattgcggctcactgcaacctccgcctcctgagttcaagagattctcctgcctcagcctcccaagtagctgggactacaggcacatgccaccatgcctggctaatttttacatttttagtagagacagggtttcaccatattggccaggctggtctcgatctcctgacctcatgatccgcccacctcggcctcccaaagggctgggattacaggcgtaagccactgcacctggccaatggtatttcttaataaacaaatttgggtagcaatcaagccactcaatggtaaatgggattttccctctactcattctaagagttgattcgaacctctcctgagaattgttcttcctctcctgagaattgttcttcctgatagactgcagtttcacagtacttctgtgctatctgcaacaggcttcccattagtggcactcaaggactgggttctcagattgccaagtattccttaggctcattacaaccatgttacaccaatacagtgttgatggtatcataaaagttaataaccactgcataaatgtcagtttttccagtggaagtgaaaacaacgtttcaatacttagcatttttcagacatgtttaatcatttgcatgcacatttagttatgtgtaaaatggtctatggagtattgtcaaagaataaagaagagaaaaactggctttatatgagagaagagagagaaaaaccagcctaggaagagtgaatgttggttcctattttgggggaaactgattagttagttgggaaggaggtcaaagtaggcaatttgtcctttagtaggccaactagggttatcaaagagaaccatcacagttctgaaggatctctgaaaaccttgagatcttagctgagaagtacatgtaacaagttgtctctttgtgaggtcggccactgtcccctaccttagtaaggcaaggtctgcaccatttctctcttcagaatgctcacattttaaagataaaaaaaatttatttttatgtagtctgtggaccttcattttaggttattttatttgttagggttttgattttgacatcaacattgattttcaatgcgctccaaactttccttacctttgttagttgctccacgttttacaaatgttcatctgtgcaactaatggtctacctaaatgatctgtttcaatgacgtgacttttcagttctttgcctccccttgactgcactcaaggtagatggcatcccagtcatgtcagttgaactattcagcacgttctactgatagcatcctggagtgaggactgggagtctctttacttgactcactctaaatttcaggaaaattacaaacttcactttatttataaacttcaggcctccagttctcagcttagtttagtttagtgagtttttgttttctttttgttttcaagtcagtttttaaatctctaaaatgactgagtttgaggccatgatgtttcaagttattttagcctttaattctggagctaggaccattcttcataaaaacttttctcccaaagcattcccctttaccttcaaggcatgcaataatatttcagaatagtgtcattttaggaaatatatcaaaaaaattaatcagaaagcaatgatgcataggaagacagcttaatgaaatattgtcctaccttgaaccattttttttttcttcatgggtaagttactgattctattagaactcaaattgtgattgctttctaattcatgggcacttttgcatcttgattactgactctaaaggaaagatgaaatttgttttcccaaactattgttattgttgccattgttattgttattaacatacaccatttactgagtgtttgttatttttcaggcactctgctgttttatgagacaggcattagtgtccccacttacagttaaggaaactgaggcacagagcagttcagtggcatgaggtcacacagctggtaagtgacagatccaagatttgaactctgactctaaaccttgagctcttaatattctattacatttgatttttgctggttgactattgttatgactcttccacaaatttctatattattttatgtctcccaacaaaatgtatgaacaacctgtgattcaaggaactttaaaaaaaaagtcccttttcagatattttaatggctcttgaaattaaaattcaaaaagctctggatcaccatagttaatcagaactagaagctcttatagaattgctttctgcttaattctgtaggggaaaaaggctaaatggaaagaaagtaatttattgccaaaatactgatttctgcctctgaattttggcaaatctcctatatcttttagaattgatattcagtagaagagatcggatttgtgaacctgagccatatatttgctatgctctaactactaaagcagatgggttgactgatgtttattcgttcaacaaacatttagtttttggtgatgcttacttggagctagctacaatacaagacactgtaaaaggaataaaataacagttgtctctagggttccataatctaaaagaggaaggcatatctgaaagcaaataggtatatttctataagcaattgctagtacttattgaatatttctctgagccaggtgatgttcaaagctctgtacacatagtgtacatagttgggcaatcaagaccctataaaaaaaggtgctgttttaatcctccttaagaaattgaggcatgaagaggttaagtgactttcccagggtaacaactatcagtgaaagagcaggaaattcaaatacagagagcatgacctggaaccggtgcccttgatggggtcacgggtgggtgtggtctattctagctgagaagaggacattggagcttggttatgaatgacaagctcacactgggaaggccatcccaagctaaggaaatatttggaaaaataacagaggcaggaaagtagaaagcaaatgtttgtggagcagtgtcagatcaacctggtaggaatgacatgtgtatgacataatgtggttaaaggagttaagggtcactttatagagggctgtaaagaccaaactgagaaaattaattcataattcatttagcggatcttgatgtctcactagccatgtgtccattttatacatatcaattcatttattcctcatgatgaggtgatgtgtcatataaccattcccgtttcacagattgggaaaccaagtatacaaagagattaacttgcccaacatcacatagccagtaagaggtagagctgggattcaaatgaggaagcctggtttccgaggccataagtataactgtgatgatgccttactacttagaagtggaatgatgtgatcagagttcaaaacccatgagtgaggacccataaacgggaaaggaaggaaaagaaagacaagtgacttggggagaagagaccagctgaggtcactgtggcactccactggagagacagtcaattgacaccaggatggtagcagtgaaaaggagaaagatgaatgaggtagggatgggatttggaagtaggagctcagagttcaaattctgaccctgtccattactggttactgagtgaccttggactggtggattagcctctgtgctttgattttctaattcacaaagaggggaaatgcagcagagcccgggtgaatgaattctattttggccctgctgattgggaggcgtcagcaggccatccatctggctgggcccagcaggtcagttagaaatctgggtctggagctcaagaaagaggtcaggcctataaatgtacttaggagtcacctctagggatgtaagagttgaaattgctaagagggatgtctagaggggaagagaaatgaagagaagagagctgatgaaaaaccactcacccctcttcctgagaacaggtcaggattgatcaggagattactaggagcatattccatttgtctatattcactagttgatagttaatgtatttttttaatatgtgaaactgtcgctgacctcttttctcatatcagcgttttttacctgcacacgatttatcatgagcttgaggttgtgagcactgatgacacttatttattggtctccacatttgccgttgctttggagaaaatcgctacagcagcatgacctcaacagcagcctcatattactaagttcatgaacaaaacctgaaagtaggttttcccttccgtatttatgtcccaaagtcatcattttcttttctaagcatcatcatatgttgccagagaaattatgaagctgttatttggtgttttattaatgtatgcattcccttaatttaatttggaattggaaaaggtactgtgtgactaaagttgtttggaagagcagttgccccaaatgggctttgaattggcttctgttagtgcctgttttgtttttcactctcaagtcccttagtacacatcactggtgtctatctagactacctgcttttgcctaaggctcacctcagcaggctgcaccattcaaaaaataaaagcaaagcacacaaacacaacaccaggaagccttgcaaaatcaatgtaggtcttcgttgaaggtcttgaggtcttcggtgtgaatgtatgtgtgtgagatatgggggtcatcacatctcactgcaaaactttcccctaattatcattcaactttctctgttttccaaatcctactccctccagtactgctcaaattccatttcttctcttctcttctttctctcagccaccagaccctcctccactttttaaaatcttttgatattaaattagacctcttatctgtctccccactcgcatccccatttgcagtccttgtcaaaaccaacccgttttctttattattcaccatcattaggaagtcagagaggatgaattttaatgctttgaccctgtcaggaaaatgttgattttataatactaattattaaaatagtactgagccccattcaataaatcatatacagcagattcctaaccaaagagcatttatctttttgtactttagtgagatttcattgacctttgcagacgagttgtgttgactttctttggagtctgttcctggcttttcgttgttgtttttgcagccttcagtagatggcaagtgctgaattccaagtgtatggagatctcccgtggtccaccatagtggggaggggggataaatctaactctgaaattctcctttacccatccttgcacccccatctaagcacacacaaagcaggaaaaaaatcgtaatcaaactccttcaagctttttgtttgtttgttcaaagataaaagttaaacctggtaaaaaatgagtacaagaaattccaggcctcatcccaatcaggcattcagtgggtagatggataatggatggaaagatggatggattgatggatgaatgaatgaatggatggatggatggatgaacagacagacaaatgaaaggatggatggatggatggatggatggatggatggatggatggatggatagacggatgaatgagtagatgggtgggtgggtggatggatggatggatagatggctgagtggatggatgggtgggtgcgtagactgtgtaaaaggaggcagtccccttcctcctgtaatgtgtgatggtgagagagatgggtgagtgctcacagcctggttatggatgtgtgtgaccttgcctttcagatctattttagcatcagtttaagaagacacttccttttcttctagcaattgcacctctaaccctttttctagcaaattcagaaaggctgagtagctttcccaatagcccaggtggtactgggcttctacccagagaaacatggatagaactgtcaaccagggctaatgatggtgagcgcttggagaattggggaacctttgcaattcctcatgttgctgattgttattacccattgccaattccccaatggatcagtctatattttgtgatatgaacacatgatttgtggatactgggagactgggagggatggtagcaaatctaatttgtcactaattgagccaatgtagttcagtcctgttaattctgtactttattgaactctaaatctattcacatctcataaaacatgattaatctctctagctctttaaaatacaacaatatatggcgtgcttaaggcttaggaatttgacaaagagcccaagaataactttttctctgaattcatgaaaagcattggttaagctactttatgaacaagaaatctgtcatgaaaaagaaaagaaatcttctttacaaacagtaaagcttaagagaaatactcttaggatttcagatgtaattttgcctttgaaataccttttgtatgagaattttaaaatctctagttttttttttttttaagtatattggaagggtaaatactaaataaagattaatgtaattgtcttaaactacccaaaagtttgaagccagttgtagaaaaaaacaaactagtaagcaaagatatggtatgttgttgggatggcaagctgatggttaataggaaattatcatgaatgaaatagcattatgattcaccagggaataagtggaaaggtttcttgggatgatagtgttttgcaggaaaaaaaaaaaataggttgcattgggattctgtaaataaaggagaggaaggcagagtccaatctgaaattgttatattgggggattgggaatgtattatagacaaggctctgagcatagtgggcttagaaagagtcctgggttgaagttcaaaccttctcagtcattcctgctgaaaccttggcaaacttatataatatcttggcttacattgccatatatgtaaaactggcaaaataatacctactccagagaaccgctgcgtagattattaataatgatgtaagtatattccctccctttttgtccagcataccttttgtacatacgccactgcttttagcaccccttacaaataatttggagtctgcctcctagatttgccaaaaatggagcatacttttttattcttcagtcaccttcttgatttgcccctctatttgttgagggagggtaccaattacaatttttagtgattcaaatggatgctttcattatttcccaaaataatacgataataatatccccttctcttaaaaaagtcatcttaaatcttaaaagacatttttactaattcataccagtagaattggcatttacaaataggatatgaaattatgtggaatctattatccactcttctgagacaagtagttaacatgagtaatatttttcattgccacaaaagtggttgtataattctctttttgtgcacttaattggggtaggttgtgataatatagtgattcatcctggttgggaatgttgtgtttaattatataatctgattgaagaaaagctcctttcttcagactgggcacaggaatgcaggctagataaatttcatattctttctagtatatgtctttaatattttatatatttaatattttccatggccatttgttttaagaattctggcactgtttatcatcttataatatccagaagttttattttttatgtttttatttttttgagacaggatcttgctctgtcacccaggctggagtgcagtggcgtgaccatagctcactgcagccttaaactcctgtgctcaagtgatccttctgcctcagcctctcaagtagctaggtctacaggtgcacaccaccatgctgggctaatttttttttttagtagtgacaaggtctcattctgttgcccagactggtatcgaactcctggcttcaaatgtttttcccaccttggccccccaaaggtctgggattacaggcgtgagccacaatgcctgaccttgaatttttaaaagtaccttataatattgatataaaaattcaccccagaattagtttaattatacatgtgaaaacataggtgataatttttgagaagaaatattaacaaatagtaaatagtaataagtaaactttttactcattctaattatttcatagaagtgtcacaatattgaattttggtctgtcatctaaggtagtatcagttcatttaaattattatttaaattgttcatcacagtagaagtcattatttttaaatattacagtgaaatgtgcttagttttattttttaattttcagtttttctaaatgttgtgttgtattattatatacatacagatattttatatttcattattattgcaaatttttccaagcagaatgatgtaatttaaaataataccatcaattttcatttgaagcagtatttcatatgtaaacatatatttgatatccacatattggacttgttttttcctgctgaggaaatctaatttatgaacagttgtttagtgggaacactcaaagtattaaggatagatttcactagattaaattcatgagggctgataacataacttatttctatatcatcacttacaaacagttacaaacccttacactgagcggtcagcaacttattttaacaacaaaccaaggttggaaatgaaactgtagattttacactgatgaagcttttgttgcaatcagctgatgaccctatttagatgttcagcattctccatccactgaagtcaacctctgagcttacttaggccataagtaaaggaaactctcagagaagcattcactcactgtcatatttctatgagtgagagggaagcagaggatgaggctgctttgtgatttcatttctcatgctagaagagagagaagaaatgggggctccctgggaattccaaccgtgcccaaaggtaaaatacacaggaggacccaggtaatttcttatcacctgaagtaagaactgaagacacttgtcctgggtctcccacttcccaataagcaaatgctgaaggaaatgcttccaggaaaaaaaaaaaaaaaaaaaagtggaccttgactaagccttcactgtccagaagacctggaaaaaaagaggcattttaaaaacacgctttgaccataaactaattgaaaccaaatgaaagtaaagaattaatttgtctgtaggctaaggctggtcttactttatggaacccaaaacttctgtaaattgaataatggagaaatttgcttaaagatgtcagagttatgatgttcccctcataaagtaatgggaaacagcaacaacaacaaaaaaaatgcaaagcaaaaactccatgtttaatgaaaccaaggaagcaagctataaaagtttgccaaactaacatccgaagctaccaacctcgatatggaattgtcacaatgatatttagcctaaacacagggggactggaagaaaagggagagctccataaatgggggaggcagatgggaaacgcccagcaagtgggcctgaaagagtaggctttgggtgtgggtgtctctgtcccccctggagacccatggtgaggtaaggttgaagcaggagtcactcagacatgcagtgtgtgcagcaggccaggccagctggtagaggggctgtgtggaggggagcagtgggtggcagtcagctatgcagaagtttatctcagccgaaaggaaataatttttaaaacacggaatctccacaaacatgcacagatctcccccacaaaccatatgcagaccttctatttgcactgaagatggtgaggaggataaagaatcctataagtcccgatgtgatcaaaagcaagtcacctggggagcgagggggtcggttagtaaggcgccctctggagtcctccataggatactaagcctagtcttgagtagcctaacagctatggtgttgtgggaaaacagcagcgaaagccaagactcttatgctcagccaaattgccattcagtagaaatgcaaaaaagagacatttctgagcatgtaactgaacatgacatttatgacgtctcttgaaacaaaaaccttgattgtgagatctcttcaacaagaaattaatatagaaactgaaatgagtattatgtccggttcaatcaaaggtctaaccaatcatgtgaagtaggattacagaagagaatgcaaatattgtatgtcttcctaatgggtcattaataattcaataatttatataacattattaacaaaatttcatggcaggagaggatgtgggagacatttagggatgtggatttcctcgtatttcatagtcaggagtaaaaagatactgcctaaaatgaatatatgaagcaatagaggcttaaattatattataaatgcaatgatgaaaaacccaaagataaccagtggggaacataaaacataatatagcaaattgaaattgacaatggagcaggaaggggagttaagaggaagctatgtgcattgatttctcttagagttgattgttaatagaccctgtctaaaattagtaacacatgaaacagatgtttgaacatataatacactaataaaggtaactactagaagaccaaaaaattattatatataattatcagcagcaaaacacaaagaaaacagatcatatagctgtataatttaagtatggaacaagaaggagggagaaatattttccttttgttccttattccctttatcctgtaggatttgatttttcaagttattttttatactatgggccttttaattttcataatttaaacacgagagagcttttttttctaattttcaaattttagatttcctttatgtttgtattggtcttaagtgcaaaacttctggcctgttttcttggccagatttcagaagataaagcaccagattcatttgtgagaattgttcataggggtctaacatctgcttcagtcattgtgacctcatctttattgaaaaggaaagttgttttggaactacaatagtgggctgagataaactgtctcatagtctcatatttaattaaattttcaaaatgtttttgattaaaactacccggatatgaactgaatgtcgaaacaggttagacatttcaaattgactttgtaataagttaaaaacaggtcaagagacaggaaatgaaaactggaggtgagcaaggaaaatctcagagtagaaaaaggttcatggaaagttgttttagaatgagtgtttttaaatctattgattaaacccttgaaagaaggtacataatgacagagcaagatgtgtgcaaagtagaggatggcaagaaataagaaaacatttggagaagatgtgcttgcctataatgtgtgattattggccgggcacagtggctcacgcctgtaatcccaacactttgggaggccaaggcgggcagatcacgaggtcaggaaatcgagaccatcctggccaacatggtgaaaccccgtctctactaaaaatacaaaaattagctgggtgtggtggcgcgtgcctgtaatcagctactcgggaggctgaggtgggagaacagcttgaaccagggagttggaggttgcagtgagccaagatcgcgcaactgtactccagcctggtgacagagtgagactccacctcacaaaaaaaaaaaaaaagtgtgattatgctacagttctttctagaaagcattgcataatggagattcccactaaatttgtagatcttgctgctattttgaaagccaccatttctgatgacttactttattgcaccattggcacagccccctgcccccccattaaaaatagaggaacacgtgacttggttctttaggcttgaatttctcagcagcctatagataaacagttcgcagtcttggtgatttcagtcttggacatttttctttcaactgggggacaacctagtgacaatctccatcatttcaaaaaaatatggaacattttaaagtaaactttttattaaggtgtaacacacagaaaaatgggcaagtcgtaagtggacaactcaaggaattttcataaagtaagcacacacttgcttgcagttacatcctagaacaagacacatagcattactagctcaagtgaagcctgtcatgcctccttggcaccactatccagccagggctgatgtctatcctgacttcaaacatcacagattagtgttacctttttcaaactttaatggaatcatatagcatgtattcttttgtatttagtttctttcacgcaacactgtgtttgtgagtttcatcaatgtagtggtatgtaggtgtagttcacttattctcaatgttatagaattctattgaatgaatatatcacaaattacttagtcattaaattgtcgatggacatttgagtcatttccaatgatgacctattacaaattgtgctgacgtgaacatcctactacatgtcatttggtaaatatgtctgtgtatttgtgttgggtacatatctaggagtgtcattgttgagccaaaaggtatttttcataggctcagctttagtattgacttccagttttcccaagtgttagcaccgattcattctcttacagcagtgtgtgagaattccaattgcatttccacctctcctcaacacttgccattatggatctttttctttaaaaaatttaatgtctttaaaattttaataggaggctctattataaacatctataaacctttttaacaaattgcttgactttaaaggaaaatcattttttaaaaatcacaaagtttgtaaacctactgagttttgcttgtaaatattagctgttctttctgtgtgtgaccagtcaaaatatctcgactcacatgttttgcttgatatttcactgaattcaattcaatccaatgtgaacatcaaagatacgtgggattatgaacttcaaattaacgttaaagaatgcttttaggaactctacagattattaaattttaacttactttgtacctatcttttaaatctatttcatcagaaactattgataggaatgattcacttttagttaatgtatctttttcattgtagccattctgatgagtacacaggggtctactattgtggttttcagttgcatttccaaagagggaacattttaacagcaaaagtagagtataaatgaagaaaaagagataatcctttcccaaagagaatagtttggcaacttttgttgacctgcaaatttttatacacacatacatatcaaaaatatgaatgctggaaaatgacaacataacattttccttttaccatgttacttggatcttcgttactttttgacatgcctgtgttagttagtttgtgtctttgctcctgttgttatctagttcaacataaactcaggaaagggagcctgggtattccttttgttctggtatttccattgttattacattcataattgaaattggaatgaataggtatatactgattctgtgaacctagaatggaatattctgaccagactgagaaaagccagtcgatagctcatatgcctgaggctccccgcagggctaggacgagagtgtgggttggctggctttcaggaccagagacagggacctttcctgggcatgtgcctctctgcatggactcacagggaagactctgaacctacctggacctaccaacatagacagaaatgtatctcagaggaatgttctcactggtagtatctgtcattgaccagcacaagtccacagagcagattttagaaagaacagctcgagccgattctagaggctgtgctatatcactcaaacactttctctgcatggattggcccatcttagctcccactgaacaaaccctttggcaatccattattacccacctactaaacattcttcccaaaagcgtgacttctgccttgtggaaggctagaaactcatctcactggactcgctagctgaagctcaaagtatttgagttgctcatcagaaagttgttcaaggacaaatttaccatgaattatcaacccttaagcttcagagcttttcacttgcaaagaccttttgtaataccctgtatctaatgtaattttgcattcgtaattttgtgttcatgctcttaaagaggtctcgcttaaaattgtataaacttcaggtcccagcaaacctggataagcacctggcttctgatgtctaacatcttatttgactgattttatttatttgtttatttgtctttgaaagagaatttagaaattgtatagacgactaacaattctttgtgacagaacattacaattagttgtgaagtgtgttttgattaatgagaatagtggccactattcactgagtgctcattttgccctaggtacaagtttcaacaggatttccttaaacattcatgacactcctaggagaaagacacgactactgtattatccttacttttcacaagagggaagtgagcctcagaggagttaaagaaacgtgccaggatcatatttctagaaagtaataaagccaaggcactttgcttttgctaataatgacctactaaaatgtttaaatgattttctatctcaaacctgcttaaaacataacctagtacaaatttactagcatccccaatattaaattttcaactgtctagtaggtatgttctctgttgggaaataatttgtctaacgcaagttcatctcattcatgacatgttatctcattcatgacatgttaaaaaagacagtctattcccatgtgaatatcagtcattttcagtggaggaaaaatattaagaatacctgagctggaatacctgtctgccattgtttcagagggtatgggaatggctactcatgctcaggagtgggagattggctcgcagcttgatgcagcatcaatgccatactctgcccccaactcagcagacctcagaggcaacctacaaatcttcagacttattaaagaactggctacacaaaagcctgaacaaagctgagttcattttcatggtttcatggtttcacttttttcccgactttattcagtctcacaaacattttccagcatcggataatataatcttgagctttggattcaggccaagacgtcattcctttgctatttaatgaaaacctttcctaactttttagacccaagtaagacactgctcctgacagtataggtcttttgaaaatttagttcactgtgattatttttttcaagtagctgtataatcattaatataaatcattctgttgaagaacacattaaaggaggtgaaataatgctgtatagaactataaaatctatccactaatgtcaagtgacagaataagatgtcattgcctttcttctccccactgaaggaacagggattaaaatgtagcgcaattaaagacgtttggggagaatattagcaaatctcactttactgtgtgaatttctacgtatcatgggcttctaagtttggtttttccttgatttaatctacataaatgaaaaagccatttggaaaacttatagtatggatagcatggcatttttcctctaagggagaggtaatgggatggtttttccttcctggtatttcagtatctacttagcacattataagcatgctttctgcattgaggtttatgtctatacttgtagtactagtgagatgctaccttttttttttttatataagatcttactctgttgcccaggctggagtgcagtgacatgatcacagctcacggcagcctcgacctcctgggctcaagtgatcttcccacctcagcctcctgaatagctgggactacaggcgtgtgccaccactaagcctggctaatgttttgtaattttttgtagagacaggtttcaccatgttgcccaggctggtcttgaactcctgggctcaagcaatcctcctgccttggcctccaaaaatgctggaatttcaggtatgaaccactgtgcctggccaagatatgactttaaatatgcctgaagcacttccacgttctgtagttctcaaagtggctgcaaagttttaatgaaagtgtagtaaatgacaaatgttattatattaggtgcctgaggaaagtgggataaatgagtgaattttcttcctccagaatgagagatttttcaagatgagtgtgagtaggtgaattatatggctcttcctctccagctttcttttggaatgaggttttagtttttttctatgagggaggaatttgcaactttcatattacttctttgctcctaatgtatcagatagtgtaggggccaaggagaaaccttctccttcaccctctgaagattcactggaaatcgactcacaaaaggagaaataatattcaagttgattaatgcccacatgagaaggaacgtcaaagtgattgccccactctgccctgaggtgcagaagcacatataccatcttgaggttacagaaagactggggacgtggattttggaaaaacaggttatgggaggggagaagaggcccggctagcaaagaggatcttattgtgtagatgaaatctcataggtagcagccctcagagagaagagatggtgaatgtttctttcagatctttaaggagtcagagtgttaatcttcctcacattcggaaaacgaagggcctcagagaaagcctgggtgcatcagtgcagatttcttctacagagcaaatctctcctacaaaagccagctttgcggggctgcttctgtctgctggctctctgaacagccatctccaaatatgtcaaagaaatatattttggggtgaaatatttttattttcttcagtagcaaaatcaaagccactatttaaaaagggtggcattagggaaagattcttggcatcagagtcattttatatttgagtatgagctacatacttggaatggactgaatgtttgtgtctctaaaattcctatattgaatcctcatcctgaagtgatggtattaggaggtggggccattaggaggtaactaggtcataagggtggaacccttgtgatgggattagagccctcattaaaagggactccagggagcaatctctttttgtcatgtgaggacacgtgtgactataacaaaaaccactcaattgtatactttaaaaaggtaaacttcatgctttttgaattacatctcaataaagctgcttttaaaaaatacatgtaaccttgtaaaatctatgcattttatgggcacatgttcctttaatacataaatgccattgtgctattaaaaaaagcatagccacagtttgctggtggctactgtattgaacagcaccaatttagaacatttccattatctcagtaggttctgtctgacaaggctgcccaagagagaagatactctatagatagtaggttctcagaatattcttccccgcttctcactattattcccttttaaccttacttccaagcatgtacatttgttgaaatgattgttttgaaatcatctataagacttgtttcaactctaataaaattcttccagaaagctctaggggaaagatatttcttttacctaacatccatttctccaatcctggctattcttattttaaaatttttccttggaagtattggatatttcatacttggggtattgatgttggaggcatctaatctcatcccagtaaataagtagataccttttctagtagtagacttagaacactgtatgtcattggcacaaattattaatattttcattgggagaattagctactaaagattttaaattccttaactatactcaaagggcaaaagaagtgacaactaacatatattggaatatggtctgtgtgccaggccttgctaagaactctatatttagtgactcatttaatcctcagaactctatgaggtaggtactactatcctcatcttgcagataagtgtataactggaatataatgtttagcctctgtaatctgaacccaactgtgtgcaaatcagatgggaattcactttacccaaatccatgacaacaagacctggcattgaatagaatccatcattggccacagcaaacctaatgaaactgtagatcatacaacttcctgggtgactacatgtcctggcaatttactcaggtctttctctttctctgaattgggagcatagaatgaaaacaagttgtgagcaacctgaaccccacaggccacatgtgaggcacatttaacctgctttatgcctttggggctttgctccttgattattttaaacaactttattaaggtataatttatgtaccatgcactcatttaaatatataagtcaatgatttttagtaaatttaccgagttgtgcaagcatcaccataatcacattaagatcccttttgctcattttcagttcattcctgttcccatctctattccctggcaaccgctactctactttctgcctctatagatgtacctctctgaacacttcgtctagatgaaatcatacaagacatgctctttcgtgattgccttctttcatttagcataatgttttcaagattcatccatgctataacatgtatcagcacttcattcctttttactgctgaattgtatttccttaaatggatatcccacaatttgttgatcagttctccagtttatgagcgtgtgggttgttatcacattttggctattaggaataatgctgctatgatttttttttaactttctactgctttctcagattatgcaatatacacacaacttctcatttttgtctctgcccccacccctcctaggtatagacaaggaataaattaagaccccaaggccagtagatatgtctcctatctggggcaaattatttgtaagtccttatccagggctcttggatgcttaagttaaagggcttatgtatttggagaagtgactgtcttatcttgtatatctatttggtgatagaggaaatatggtggttcccatgttggtggcttcgtgtctccaaactgcaggattgcacagtaaatcctcctatattgccagctttgtgacttgccatttacttggactttacaattgtgcataaagaccccccaaaatctcagttcttaaggtgttttttacccttccgttttaaatcccttccttcagtaagtaattttacagtttggtccctggaagtctctgagaaaagtcattacttaccatgatttaaatttgaagagaaaaacattgtgacacccagggaaggagaattcaattctagttctctaagcggaaaagggatggcttcaaaaattcagtgctggatgtctgtaagaacaagtgggggaacctctactacaagtgttcagaatggagctatcccttgctcggttccttatcatttgatttatgcctcactcagtgtgtcagtcctaatgatttttcactggctttccaaatagacattacttctataaccgcaacaacagtgtaaaatatgctgcaaagtttgccctgaagggaagcactgtctttttttttatatatttaaacaagggtacagaatgctggaagctatcatcaatgctagatggagagaatgcaatatctctttccatgatgctgcaaatgtcattgctggtaggtctattaatagcccagagtgatttttgaccttggatttattaaattaaagaagctataaaaatagagatgaatagaatgaactaactgatggaaatccagggcatagtccccatttaactattttcccttatggatatttagcatattatgtgggggtgggagtacagaaatatacataaaattaatgttttctgtataactcctttcagaatgtaaatattactctcaacttaatctgattgaaaataagaaatcttgtcaagttcacatactctcattttctgccatgttgtttgttttcaaggaaccactgctgtgttcttaacaaagtatcatcattctttttttgttttcttttttctttttttttttttgaaatggagtcttgctctgttgcccaggctggagtatagtggcgcagtcttggctcactgcaacctctgcctcccaggtttgagcgattctcctgcctcagcctcccgagtgtagctgggattacaggcatgcgtcaccatgcccagctaatttttatatttttagtagagatggagtttcactatgttggtcaggctggtcttgaactcccgacctcatgatccacccgccttgggctcccaaagtgctgggattacaggcgtgagccaccgtgcctggccacaaagttccatcattcttttggaaagcagggcatccggggagggagcggttttcctctttcctttctcacacttatgcagttggttatagttcatctattggaggacaaggttggggaccctcggtgtctcatgtgtgacatcaaaatctctacctcatttggtgatgaccacaatagacatttaaggccatccctgggacttgactgagcctgtgaatcacgcttgatggagctgccccttctgagattttgagttaatgctacttttctatttttaatagcattctttgattgttcaaagtttgcttttgcttttatgtttgtttccctggtaggcttatcaagttgaatgttacaaacatagtggttcaggtacatactgtacatactgcactataccttgatcattaaaggaatttgatattttaggttatggacccaattaaatgataccagccatgtatgtctcagtgtgaataagttcattttgattctatcctgaatctggttgggattaggaggcattgagaccaaactctggtaattataaaattttgcaaaagattggcccacttagtgagttgagcttgaaaatatatagttcactgggaacatatggggatgccttagttgagggcaaccatccatatatgtacattggcaagcctgatgttttcagcctcgttttttttatatcaaaactaaacatgtagggggaaaaaagatgaaaaaaagattgctgtgtcatttcccttttactcaaattccaattatgaacaagtctgagtcactattggttaacagtcttctgagatgttaagagtagtcatgcaggccaactgatacaaattccttcttatcttcccacaaacttaacaggtactaaaatctcatcatgctctgggtaattcctgacatttccttactagttacaaactaattgattgccaaactctgagtccatgctacatgttcctccatagagacggcaaccaaatctttgggaaactatttcaagaaatgagtgtatttgacaattatttggtgttcaaacaatgtagttttctgagagttatgcttctgctttatggtttatttattttctagtcacttgggagaaactcagagacatctgtagcttcttgtattctatggcttttttttgctaaaatctcaagccatgaaaagaaaaaaaaaaaaaaaaacggtaagtattttgaaccctgcagacctaaaggaagctctgaggctttggaaaatgatcacagaagtcacccaattttgttctcattttgtcagctcacagtcattagagaagatgaaatttctctgaaaaaacaatgagtcaatgcagtgtaattgttgagtttaatggccttatcttacaaaataatgcaaactggttatttcttgaactatgtcagactgtgcaatcctgacattgcacttttctgaatctagcatttaaggtacatttcaaagaatacttctgtttggttaagagatggcttttacaaatagccagaacaatgaaatttcagttggaatattaaggaaacctctgtaggactgcataagcaataaaattgtcaaggggaataatgggtttgccaactctggaaaggttccaggctcaacttgacatcacctctctgtgataatttagaaaccacaggagcaggcttgctttaatgcagaagagcaggtggatgagccactgggctttgctgggaatgccagtcctgtctttccattccctaagatttgattggttagctttttctgctcacagggaaaaagttagatgcaacttgctagatgcagtttgaacccagtgattttcaaatattttgagaaaatgacacgtttttgcattattttttgtgtattttggtctttggatatatatttgaatatatatttcagagtatattagggcttctgtaacaaactgggaggcttaaaacaacagaaagatattctctcacagttctggaggtcagaggtcccaaaccaaggtgttctcatgattatgctccttctgaaggctctagggaagcatctttccttgtctctagtagctccaggcatttcttggcttatggcagcatcactccaatctctgcctgtgtcttcacatggtctcctgtgtgtttcttctttttggcctactataccttatcctctttttctcattggatttagggcccagccaggtaatctaagattcaacccattacagacagcaaaggggactccattaaatcagtaggtagtagaaatatgtccctttttttcttctagcttatataggcaatcttaatcttctctgggtctttggaaatattaggagggaaagtctgtcatctagaaactttctttatcctacccaatagtaactgacgattcttttttttttttagtttttatttttttattttattctttttattatactttaagttctagggtacatgtgcacaacgtgcaggtttgttacatatgtatacgtgtgccatgttggtgtgctgcacccattaactcgtcctttacattaggtatatctcctaatgttatccctcccccctcctcccactccatgacaggccccggtgtgtgatgttccccaccctgtgtccaagtgttctcattgttcaattcccacctatgagtgagaacatgtggtgtttggttttctgtccttgtgatagtttgcgagaatgatggtttccagcttcatccatgtccctacaaaggacatgaactcatcattttttatggctgcatagtattccatggtgtatatgtgtcacattttcttaacccagtctatcgttgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctcgatccttgacgaatcgccacactgtcttccacaatggttgaactagtttacagtcccaccaacagtgtaaaagtgttcctgtttctccacatcctctccagcacctgttgtttcctgacttttgaatgatcgccattctaactggtgtgagatggtatctcattgtggttttgatttgtatttctctgatggccagtgatgatgagcattttttcatgtgtctgttggctgcataaatgtcttcttttgagaagtgtctgttcgtatccctcgcccactttttgatggagttgtttgattttttcttgtaaatttgtttaagttctttgtagattctggatattagccctttgtcagatgggtagaatgtaaaaattttctcccattctgtaggttgcctgttcactctgatggtagtttcttttgctgtgcagaagctctttagtttaattagatcccatttgtcaattttggcttttgttgccattgagcaactggtgattctaaattacattactaccaggatattttgctctttgaaaatacttgcctcatgggtgatactttttcaaggcccatatgtcaagtattagctaaatgtttgcatttctctttgagtcctgggacagacaggcagggctcacagggcatggaatttagcagtggttacatctcaagactgtataagtcccaagagatcagctactagctgacacgctaaggagagggatgtcagaaaattctcagcagcagtggaggaaagcggaagaggagtggtacccagatgaagagtgaataaaatccccctaagccaccatcagagaccaggccagccactcttcatttccatggcccatactgccagggctttgatgggtacatagtattccacaagttacagtgccaaccaaatacagttgcaggtacctatcattaatgttatttggcacattaaacaactcagacaccctacctttgagtcaccgtttattccattgttgtggcgtgtgtgcattgtaaagaagaacttgacagcctctttagggagtgcggtgacaagttgccaacatgacagccaggaagtggcatcttgcaaataaagaagcaggtgatggccctagtgttagcaccatgtggttagaaacaggagagtacattaggtgatggagagcacttaggaatgaggtcagcttttctaagtttcattcaaacaacatctattgcaagttcattacaacccataagaaacttcatttgctgtttagaatctatgaggtgtcagaaacttatgtttccatatcaaggaaaaaatgaaatctccattttttctcaagatagatgaggaatcagatcctccacccccaagccctaccccactgccacacacacacacatacacttctaaaatatagtgtattcataaaaagtgtgaggtatagtaaggccaacagatcaggagatgactgccactgaagagacagtttgttacagttcccaagaggagggggtctattacaccatggtggggcatgtgggaaagcaccagcataggtcaagaggcggaaggagaagggtgcaactgtgtacaagagtctttacttgtggttttcatgggaaggaacaggtaaggcaggatgatcaggcttgggagtggccagtttcagtcatttcggcctgctctggggcaaagcaggtgtccttggttttctggctcctggccctggggtgattagggcaggtggatggtggcctggagtatgagagctccataaaggaggtggttgggctgtgggctgtgtattggttggtttgtatttgaaaactgtgccctctggaggaagaagactcctgaagagagatagagatggtgagggaggcaggagtccaggcaaggtgactcaggcataacatcctattatctaaagcaagatgtgtcaggtagatgttaaagcaccaagattatatagaagctagaaacatggtaaatatgcaccccgtcatgtgcgccccccgccctaccaccaacaaagccatagagactgatttgttgagattcaaatagcttcccctggttggagactacttgaagtcctgaaattctcattggttggttgattcctttctttctttacttattcctcaaagtctaatgcacatcagccaggaaagttatacctaggggtaggcttccagctcctgacctcacctctacgtgtcctggcctagaggcccattgcgttcagctggtgttctgctgagacatggcccttaatttgattctgtatctttgtaaacagcccatttgagaacacatctggggcttccttcctggaaaccaagctcaagggggtagatgggaagcagaaacctgaaactggtggtgaacatgaacctactttgcagtatgaaggatcctttgcctttcttttccacttcttgatgccaggatgtttggagagggtgggagaagggaacctaaaatttgaagcagaagatctgagttccaatcagagacttgcacctcccttctgtgggaccttgggccggatacacctctcagcccaggccttacagctctaaaacatgggtaattcctgctagaggggtcgattagatggtttgagaaaaggctttgcagataagatagagctctatcagtgcctttcttgattgtggttcctggccacatgggtatagggacaggcagttttgaagtagtgagcttatcatcagcacccttggcttcagttttgtggctcctattcctacctcacactgttcttttcaccaagtgctggggccttcccactgtccctctgttgtctgagcctgtctttttgaggtcagacctctttccatactcccacgatttcatggcctataatatgtcctccttctccttcatctctttggattcacttgcctctacccattccattagggccattccaggtagaagggcacctgtcctgccaccagggcaggggcagggggcaaccaagggaggagagggctggaagtttttattttctgtgtcttgtctcaagttttccaccttatttctgccttctgtcctaccatcttctttattttattttctactgtattttctgctccctgtaagtcattcctgtgttcttttatttgttcatttattcattcaataattccattcactaggctctgtgctcagcactggagagagatgaataagcgttgccctcaagggttcagattggcaacaaacaactgaataattaatgccctaaaaatgtgttttgccttatgataggggttgggatagagttggagaaacttgaggcaggaagctgctgagttggccttggggttcagggaacatcagcagaagtaagacttcagctgggtctgtctgcagtacacaaaagggtttgccaggccaagaaagtgcgaggtcatttcaatgaaggcaaagaatatggtcagccttacaaagggatgtatcaggagtttactgttggtggacatagaggatgggacctcggggccataggaagctgatgagaaaggtgaggctgaatgatgatgaacctccttgccatcaggaaattgaaatgcatcctggaggctgtaggcaaccagtgggattgaacaggggagtgagaaaattagacaggatcatattagcaaaacataactctgatggcagtgcagagggtggactggaggcacagagactagtttcagagtctaggtgggagtttgcagcagttgtccagaatagagatgaaaatcacataaataaaccaaggcattagcaattttcatgcatttattcatttatcagaaatgatgcagacactgtgtatgagcacacccacccagtgtccccatgggccagactatgccagctcaggaaatctgatatctcacaagagtgatccagtccttgctctgatggatatacagtctcttaggagagaggcattggatccagtgacacacggccaagtggcatgtgcattgaaataaatctgcatggggctgtggggcattgagcaggggctttgagccagtgccacttgagccgaaagttgaatggggctgagtgtatagtagctaagtcttgaggtggctgaagcacagaggaccagggtagaggggtaccaacccagcagggtccactctgttctgctgcttctctctctgggtgggctgctgcctgcggtgatggccagggcagggaatatcatcaaaaaccaggcaggcacacagactctgcacttcaggccagctccttgggggcatcaggagaccaagcctttgcttttcctggtccgtggcttgtacttgcctgggagcaggtgaaacagcagagacatatacaaccttgcttttccattcacatacctgcctagacttagtgggggaagaacaggatgactagaagttctcaaacatgaaggctcggttttctgtaaactccaaactgcccctcccctgcctttttgccctttctaaatacagatgaggtttctatccagctggaccacctctgggtgggcagtactgccccttcccgatcccattccggcctgcacatatagcactgcagcattgcctaccccaggggcacccttcacatttcatgctaatgaaggttgactcctggaatcatggctacattgcacatagcaccttcttgagttgcgcaatgaaccatccttagtggctgccctaattgccgatttccactttgacaaggatttatggatgccagtgtgcagagaggagattggagggcgtgggattcgagtggagatgtaaggagtccagttacggggccgctgcactcgttggagaggagtcgatggtgcttggggcagcagaagtgtcggatggtggcaataaccatgagggaaaggagatgcttcgaggtcctttcaggatgtaaaactgatggacctggtcagggattagacatggaaggtgaaggagatgatgtcaaggcagaaccttaagtcaggagatgttaggagctagtgaagagttttgtggaagggatttatcatgttacttaaaaaggaaataagagaataaataggctgaatgtactttcatcttcatgtaaaacaaaataaaaactcttcttaggaggcttgcatacctgactatacctgtctatcctcatcactgacacccactaatcagatctctatctaggcttaggtccctgttctctttctcacccatcctcctgcatgaccttagcatctgtggagatgatgcctctaatgcaatgaccatacattgccaatccattgcagaagccctctctttctggtacatcccagagcttggcttttcccctgggagacaggagagtgtggtggtgaagagctggccccctggagtagactgcctgggcttgagcaagtgactacatctctctgcctcagtttccttcccacaacactcagaggcaagtgctaaaggagatgaaatatataaaccagtgacactgcagcccaaagctttggtctgtaccatttcaggtagctggagataagtgtacaacagctgacgttaccaggaggaagaaagagactgaatataatgtaccaccaaagttagaaaaaacaactagtataaattatttgtgctgtattctttccagtaaagtgaggcccagtgctaaattaagaagggaatacagaaataaaaagaatggttggcagattactacctggcgagggaacatgttttacatcttctgctctgtgctatttttttttttttcaagtcaagtcaatagattcaaaacatttaaacatgacctattatctaaaaacaacatggctgggtgcagtggctcacgcctgtaatcctagcactttgggaggctgaggtgggcagatcacttgagttcaggagttcaagaccaacctgcccagtatggtgaaaccccatctctattaaaaatacaaaaattagctgggcctggcggcgggcgcctgtagtcccagctactccagaggctgaggcatgagaatcgcttgaacctgggaggtggatgttgcagtgagccgaagttgcaccactgtactccagcctgggaaacagagcgagactctgtctcaacaaaaacaaaaacaaacaaaaacccatgatatgtaataaaagctataagttaacaccaaacttacaaaaagcatataataaattcagaactaatttaaacagtttctgcctgtcctcctttccttcccctttcctctgccccgcccttcgtctttaccccacttcatctttagctactctctctctctcttcatcagtagcccccagaaaacagaacttcgtaacattgtatcatttgcattctctgatctggggactcttttccctttcaaggggcagtctgctgtatgtaagggcattttttaaattaaataatcttaaacttttattttaattttttaaaattaaaataaactcagttttttttttttcattttgagaattctttaatagtttatgacaccacgcaagtaactggagtcatgctggtctgtctccaaacaagatttaagaaatcctgtgttagagcgtgggttatatcatttaactaacgcgggcctcctttttgtctgaattgatttcaaattaaatgcaatacatgtatatttgagacttgagctggatactgtttcaacattggagacacaaaaaacaaaacttctgaatagaagatgtgtagtttagaatgggaaatagattcaaatgcataattatacaatgtaagaagtgttataggtctatataaaataccaaggtggccaataaccatgcctgtggcattctgggaagacttcatggaggaagaagtgttgtttaatctggttcttgaaacgtaagtaggaattcaatagttggagagaaaatggcagagtctcatagtcagtggaaactgctgttataaagaagggtcctgaagtacaagatgcatgatagagtcaaggaacatatgatgtgagtgtgactagagatcagtaaggaaggctgaggccaagttcagacaaacaggcctagttcctatgccaaagagtttggacttagtcactagtagtaatctaaatcatccattcagagtagtgactttcctcctctattatatagaaatatgtataatatatatattttacgtttcatacgtatatatgctttttgcctcctctccaatacttaatggctctggtttttttattggactgaacttttgcatgtgagctttctagtgttgagcaaatgctctttcatttatcataattttccaattttttaagaaaaatcttttctgctcagtaacaaacacaattcacaaagaaagagaatgtccacagggaatttgcttccaattggtcacttcatttaaagtttttgaactggggccgggtgtagtggctcacacctgtaaccccagcactttgggaggccgaggcaggaggatcacttcaacccaggagtttgagaccaggctgggcaacccagtgagaccccatctccacaaaaataaataaacaagaaacaaatataaaatttttgaactgggaaagcagatgaagaaatgtaacaaaaagcaaaagccccatcaattgggagttattctagctatttcacccaggaggctcacgtcattactgtcagggaaatgcactgtccctctgtgcttggccttgaccatatggaggagaaaagcttgctgggggacaagagaacaaacccaaaggcaatgcttcctagagctgcctgtagccccagggcagtgtctctctccaagattcagccttcctgctgcaaaaatctgctcacgtgcaaaaggcaggggtttggcagatgcttacaaaatgttacaagtgttccaaagataaaagtattacgtgagaagaaggaaggattctggtgaaccctggcctgtagttgtaattctcaaagttttagtcagtgcgacagctggcctttgtaaaaactgctagaacccaaactttcttccttaaacatgttttaaatatttgcttctcaactgcttgtcttcagggactttatcattaagaatatttggaacccagaaagcatctgtgtcttcagtgagatataaaaatagacccagtctactatgctgtccagggaatcttattttattaacaagcaagtgatatagtagtatcattgccaaggggaaatttctctctcctgattaagtgtgcttcctgttattggatagggaatgcagaaatagattgcttccctttttgccttgactaccaggaaacctgtagttttatttaacattaaattgctgtacactagctatcttcagcctaggttttcttaggaaattatatcacccccttctctatttgaactttgtatacttgttttaatggttttgtagtatctgtatttcttagtataaattatccaaatgacatttacgtttccccaaaaaatcacaataggaattggctacccatatggcgtagcctgttgtgtatgtatctcctgacctgaccatagcccagccagtttatctggtcaccattaagtctgagaattatggtggcccaagatacttgagaggtgggtagaatgacaagaagagaagaaaaagcatggggagtagagggggaatgtccctcattaacccttattttctaaactgatttacttgtggcttaaaaaactgagcacgaaattcctacatgaagagtttcttttggtttcattttaatatgagtatttcaaagattcctttgccttcaacttgttagaatgtcatgacagtaacgattgcaatcatttaagaagtctttattatgctacaggcaacctccagatctgcacaatggtagtttctggggagattaaatgtgctacagtatgctaaatacttagcacagtggctgacacatgagattaataaatatgcctatgatgatggtaaagaataaatatgaatagagtggccacatatagcaaataaaaatacaggacgcacagttcgatttgaatttcagataaacagcaaacaatgtaagtttagtgtaagtatggaccctgcaatactggggacataacttatactaaaaactattatcccatgcaacatttgggacatacttattctaaaaattattatcccatgcaatggttaagatataactataccaaaaaaattgtttctctgaaattcatgtttaactgggcattttgtgctttatcaagcaactctaaatgtgaatacatgtagaatggtagcttctgataagcactgagatacttccaggaaaccagccctgctcctctgcagagaagactcacccactcatcatctcctgtgctcatccagaagtctgggctccatcagtgtttcttgatttgattcagatttcctgtctctatagtcaatttaatgtcagccacgggcagcttcccagtgtttgacattcgctaactttcagaagctgccggaaacgtgtcagccttactctggtctttcccaaccttggctgaacaaaagcatcgcctgagaatcttaaaaatcctgatacccaggtcacattccagaccagttacatcagaatctcagcaatgaggccaggtatgggtatttttaatgctttccacgttagttccagtgaatgcctgggatgagagctgtagcctagccttacaggccctctaaagccttggctgaagcagtgatgctggctcctcccaggacctgctggaatgttcctccttgtgttctgttctacttttcaccatccctactagcagtatttcctcgtcttccaaaatagcagggtctgattcctggtaatggtgctgagaccaggcgtgctgggttctctgagcagagtgtgtcgaggctattgccttttgctatacaggttctgtacattgggcctccaggttaattgggtttctagaaggatcctaggaagatgacatgtctttttcctttttgtcacatgctgacagagctggcctccctttcaactgggtttgaggtatttcctcagaggagagtgagctctgagttgtagaagtgtctgggtgtgattcaatccaagcaacaatcctgaggtactgcagggccgaacaccatctttctgggactgggtcctcaggacaagcaaggagttgatggaccaaaccctggtttctagtgccacaatggagccgagaagtcctttagaactttgggggacagcaccactgacttctctcctcttgccgcctcaccagttacaggatagtttccttgtattttggtcttcatcaggtacaaagtttaaaaaccttgtatagcttagcccttgatttgtaaagtcaagtgcataatcacaatatgcacaacctaatgttttcacaaggcaggttgatcacccagtttgctctgtgtgttctctcgattgaagttctaaccgacttcttagtggaaaggaaataattcattctgcagagagaatattacatttcgcatgctttaacctgggtgtttaaaaattcaaattctcctatgacattgcactcccttttttgcattttaattattctggagctgtaaagagagttcaggcactaagtaataatcagatgctgaatgcctaaactctacagagtggttgcttttaaaaacctcaatcccagataataaatagtgggagtttatcaaggcaagtggcatatacttttcctgtgttttgattcagatgtgtaacaatttctacctgctggtttaaattggcccagagaacaccttttgtgttaagcccactcactgctagaaggaaccagcatcaatctgacaatagaataatattatctcccaactaaacaaagaaagaagccaataatccaaagcccaaactgtgcggtctcctgctatttttagaacttgaggggaaaagaatcctctttattgtaaaaatgatccaattaagtacgaagttagccactgggaaacacagcgttttctttgcacaccattttggagaccagcattccttttattaaagcagaaaatgaagcccacaaagctgtccgctttccaaaggcggaacggagggttccgggttcgcttggttacctgcattgcaaatgtcagctggcagttctggcaggctgcatcaccagctgcatgaagttgcagaagtagcttgaccttatcatactaagattacagaaaacttccatcctaactctgacttagctctccctgaatttccccaaagccttaaattcagtttgcctttccttagttctcctggatctcccaaatgagagctctgtagattttctgcagggaaattattctaatttaacaataaagttgctgtgcctaagtagattcatactttgaacaggtttaaggaaaacaaagctgagcatctataaatctttatgcaactaggagctgttgataagtttaggagtcaggctacccattcaaaaagatattatgttacagaattttagactctaaattttgagactagagagaaagagactttctttgagccccaaattagaaagcgtaacttaaaatggcaaatcatttccccaaagcctatatgatccatgccagaattatcgatgctgagcttggactaactccctagccccgccaggcccctcactgcctggccagctctacttgtttctcactagggtgaggcaagtcagctgcttgcctggggagcaaaacttaaggggatgccaaatacgctgtaatcaagataaataatattggaaggcagtcctttaaaaaacaaacgaatgcaaaagagtccgagatgaacaaaaccttacttgccattttaaagaaaggcaggattcaagagggctaagattagggtgagggtaggaaggcagggccatgcaagcgcagggtcggatcccatctttatataaaactttggtgttttgacagttgatgggtggtgctgtttcttgggggccagtatgcatccagctggcagtttgggtagtcaacatcacctgtgcctccaaatagaacaaacagctctatcctccatccctagcatatcacttagttctgctttgtttcccattagttacccattctcccccattctatgctaagcccctaaaacacaaggatcttgccatacttacctctgaatcctcagaacctagcagagtgtctggctctggtttgtgatatgcttccctttctgtttcattggtcttagaatcatcttccagcctctggctgtccaatcccgacctagcgtcttctagacttggcttgtccatttgcagtgacatctgtagcactggtaggaattaccatcttcacaggtgaacctaatgaatggaaacagtctgtaaagcaggatggttggcttgcagattatccaccctgaccacaggcagagttgacttattagttatctattgctgtacaacaaattctactaatttagtgacttaaacaactcaatttataatcacacagtttttctaagtcagaagtatatgtcgtgacagggctggattctctaagggttttaccaagctaaaatcaaggtatcaagccaggcttgtgggtcaccacttctagagcctgggtgctcttccagactcagtttgttggcagaattcagttccttgcagttgcaggactgaggtcctgatactcttgacatgtgtccccttcatctgcaagcccacagtggtacactggatccttctcatgcttccagtccctctgacttcttcttctgcgttacttttctgcctttaagggcttgtgtgatcattaatacattgtagccatccatataatctgggataatatccccattttaaggtcagccgatcaataaacttcattatgcctaaaagtctcttgcgatccaacaacaccacagacatgacactagaaggtcaaggtcatcgggggcctaagttgtccccaccacagctggcaattctgaaggcatccacataaagaaagcggatcatttgctgttcctgttggaatttcaaggcccagccatccgtagttgcttctcagcttttcttcccagcgtatttgggaagatgggagggagtcagctgattagaatcacagagctatttctgatgggtctgaaatccctcttgtggaattcttgtctttttctgggacttaggcagaaatatttctttgagaaatggggaaatgcatcctgaattctaagaacatgagccccatctgctcaggaggtaggatctatcattcattcctgtgttcctcgatggtagggccgagcatggcccatgggaggcactctggaaatgtttactggaataaatgaatggatacatgaattgatccatcctaagcatcttgtattaggagtttttgaactgatatttatagtcaccatttcctaccagctgtttccatatacccctgaatgctgggaggcctcattcgattgtccaggctccctgtgagcaatcataatcataaaaaccttgcttcccttctgagaaagctggatggaacatttgcctgaaaattttccctcctaatcattggtgctaacatatgcatctgtttctccttccctatcaccactcatgctccacaggcttatactaatggcttcacatgtctgtgctatgattagaaactgaatttgtatacttaggtctggtgttgagccccagaatctactagatgttattttttaacctgtcaatttaccaactatttgtgaaatctcctaaccagatttcccattgactcctacgatgagatttacataacttgatatttatttccacactatcaatgtgtgcacgtgtgtgggtgcacgtgcatgtggacacacacacacacacacactcattcacctgcacacacagtttctttatccttggttggcagatgtgaaaattctgaccatttgtaagatattgggtgaattagaatttaccaattattatttggcttataactcagtctcctatgagtttggttagtgtaactttccagagatctgcataagccctggttaaagtgaccaaatagagtttcttgatctgcagaactgagcagaactccttagacctgagtgatgacagtctgcatttcccaaagaaatacttctgccaaagttcctgggtacttcctcccaatggggtgcttgctgctcccctagggtctcagtcaacctcagtcatctcactccctgtaacagaggtctcaggaaaatgctcctgctgtatccagatgcatgttttccaaactcacaggttgtgaaataaggttaagaaaaggccttcccaggccacactgagattctgccctgcatatctaaacacgaaagcacacagggcaacatatatagccatgcaaatttaatccccaaaccaggctagaaagttggggcaattttaagggggacaaaaaatcaaaacagtgttgtctttgcaactcagtcaaatgtgaactgtacgtgaggggaaaaatgtaaaattaaatgtaccaggaaaaatgttttcctgcactgccggtaacaggtaatcagatgggatgttggccatggcctggtagctacacgttattatgctatcacatactttggacagtggctttcattaaggttgtgtttagtgttatggaacaaagatgaatcaaagccccagtgcctgttttcctggatcctttcgaatgaaggactgcagagccgttacttctcagcataaaactgacacaccacaatgcatctggtggtcatttttcccagtcttgaaagttgctgattgaaaaagagcagcatgacattctgctcacccaacatcaccgtcactcagaatatctccctgggtgcagatgagagctcacaaaaggtgcttgttttaacagacaatcacaacgtttcaggtgcgtgtgactgggtggatgacatgttggctagaagtcgcgatgctcgcagaagtgcagtgggtgctggcagtgaaatgtaagctagccctgtaataaaagctcctgggaatgcagaggatgccttggcattaggcattctcctcgtgtttcacataaatgcatcctgttctcaggagccgacgagcagtgcatttgcactggctcattcaaattgaatgttggtaaaaggagagtcctgtgcaaacagaacagtctggcatctttgaaggcaggagcaaggttaagctatcggtcgcgttctctgctgtttattagatgttatttgctggcctcagtgcgcacccaaggtacgttgcaaagaggcaccgatgggggcgactgatgcttgcagggcacccatgcaattttgcctgggctcttttggtcaataaagttcaaggcttcatttgtggtttcacctgttgtcttcaagcctgccggggataatgttttgctggaagagaaaactcctctggagaggaaattggtattgtattttagtcgttgttcttcttcttgttcaaggctacagctttaactttgtcacagcaagagtaaggacagcgagcctgtagagagcttttcgcaatgtgctttttcaattagttttaacgggagcgaagcatcaccagcagcagtgttcgcttgctctctagtcatgtgctgtgaggaataaagactctgtagggcagtgaacctgaacttggcctattcatccatactgcattgagtgattgcatggagtggagtcaaatgccacttgggggtgaagagcactcatcatcttgcattcctgctggatatattaggaaggacccttgacagaatccagtaattcaaaggtaaaccatgaagtgtgcgctgtgtgtaggaacatgtaagctgaggggagattgcacggagaaagagggagttatatttcacttttgggggaatgatgtatgtcttagattttcttggccaatggatcagtagagaaagggagagattttctcttgctgctgacttattggtcagaagttacttttccacatgatgatatattttcttggccccaagtactcagaactttattgtacttctgtccctgaaacaggagtgtttttagtgagaatcctggtgaaaagcgaagttttgaccacagaaatgaattagtacattctttgctgcctctgtgttcttttaggtgaaatctcatcttaagaatgcatttggtgttttgaagtagtggttctaattgtttactttcccaaaatctgtaagaaatggctttcagagacacaaaaaaccctgcaaaatgtgacttttgccttagattcctttctaaagatatatagtttaccacattccttagggggcaatcttgaggagagggtgaagctctaagttaaaacatgtcaaccacttaatgaaatttagtaccatcttttgtaaatgatttttacatgtgtttgttaggtttaaatcaagactctctgaagcaagcaatatctttggcaatataaattccgtgcaagtaattgatgaattttgtgactataaacttgtgcctagtaaatctcttgtccacctctttgagctcttttacatgctgcattaaaaatagaaggataggttttaattaaactaggtattggatttgccctcagggagctgaagtgcagttatgtggacatgtgagtccatggtttccaatatacttatcatataaattgcaatttaaaaataaataagtctgctgctctttagatcttcaaggtattttcttttatcaccctgtacaacagaatctactgaatatttgtttcaatgaatactcaattgaatagacacatgataatttgtaatatgttataaatttatatataatatacattttattgatatgctgccgtgtgtgtgtgtgtgtgtgtgtgtgtgtgtgtgtgtgtgtgtatctttcagagggctttttcaaatgttagattgggagcaaggcaatttgtcagcagcagagttagttagcaaaacagaataaagcattcttggcatataaatattggctctcaaaaagaagagagatgttcaagtatgcatcattcaatggtatttcacttgagaaacaatgctggtgattactcaaggattcattatgtcatgagtgtagattgacacgtagattgaagtttcagcaccaaaacctgtgcatctgatctgagaatgagaagctgggaattgggacaaaaattttgaggagagaatgcaaagtctccgggggaaatcagtattggaagttttagcttctaatggattccactctggtactagggctcaaccgtatggtaacttggtaggaaaaatgattttgtttgatgacacattcttcaattgttctgagcctataaaagcgtatctatcttttccactccgttttgattatttaatgttttgtttaaggtaccagttaggttctcccaaggaataatttttttgtgagtttttcaaggtataaatatgcagttgatggcaaaatgtcaaagtaaaaagcaaatactttataaaatatgttactagattttcagaaatacagctttgcagaatgagtactgtgtttagaaaagtgcaagctcaaagggcaaagcagaagaggactcataccagtttttcctcattttcatttgaaattgaagtgttattatcttcttacctttaattagagtatgtacagctgcatgacagtagaaaagagggaaaataagctgggcctttgttccagaatatttcagttaacttggatgagcaatttagtttctgtcatgggaactattttgcttgaactaaagcaagtatctcttccacccgtgaaaggtgtccagagccccactgggactgcaagttgctgcaataatcatttctttgaggacccgaccttgcgttgcctgttaaaacagctgggaagagttctgtgatgctggaagtcagaaacgcctgtgcttgatttatttcctaacatgattgatcaaagcaattgtgatatcttatattatttacagagcagccttttgtgaagagtccggagtggtttttggacattatctaattatcagaatggcacagggaaatagagagctcatagtctctccactgtacggttgagaggacagagagacaggcaaagcaatttatctgagatgattcagaaaaatgttcacatacagctagaaaatgagccaaggtgagttatatggatgagtctgggggcttctgtctctaaagcccagttggctctcagggtgccctctagagtcctcagccaaagaggaacatattctatataaactttaaggactccatcccaacaatttgtggttataggattccagtgatctgtctgacgtctgtgatgatcaactggagtgaaagcaatgaaagacatgcctgtgggctgcaaaaaactggggtcacagaattattagtgaatgtcactggaggtcttcacagccaatacagaaagcaacaggccatatgatttcctcatgtttagacttgaaaaatatttgaaccctatccagaggcctgtgaactgtagaggagagaatcaggatgctttctcgtccttgatatacgaactatgaaactgtaaggaaacatgcttccttcagtgtttcaacttttatgtattaaggcaggccaagtttgctcaaagttgattaaaattattaggaaattaggcaaaagtgttcttataactcatgaagtgttattctctttactttattaaagtgttttttttggggaagaaattgtatcctagttacaagataagaatatgatttcacgtacatacagttagcaaatatataccaaagtagttgcatcttagcatcttatttagattcacatgcagttggatggcaagcgggactttccagaagaccattacaaattgacactgttctggctatggtcaaattataaatggactgctgacacgataatccagaggtagagtctgagcagatggatcctagaaggaagatctggaaaatggagtaactataccaggggatgagaacaaataatccataagaaggtcttcacccatggcctggaacccaatggtgtgctcatgtgctgcctctgaatctgaacaggtggggaagcatgctcagaggaaggcaacatagaaacagagccacaggggagagtggaccaggcttgagactttcagaggaggaggaaagaccaaaggactggggaagagcaagaagacctggtggagaatgaaggagcccaaaaaacccctacagacacaggtgctgagagtcagggacagaaacacaaagtctagtggtgaaggcagctctttgcacccaagtagaaaggctgatgtgagatgagaatttcagtgagcagaacataaaactccctaattagtcagttttaaagactgcaaggaaagcaacaagacatgcttaggagaaatggataagagagaaaggaccctcttttcctgtgaacatgggtagctgagaaacataggggttaggaaaaatggggtgacccagaaatagaggacagagatccaaaggatcgccgggcagaggggtatgatactggcagggctgggaagcagagagggctcagaggaaatgctgtgagtgcccactgtggattgcatacttggggatgctgtgacccagagaagctgggggcttttctcacctacacttggtgactctcctagcatagcatagcatagcatagcatagcatagcatagcatagcatagcatagcatagagcatagcatagcatagcatagcatagcatagcatagcatagcatagcaagcaataattgtttgctgaaaaaaagcaaacttctgtgctgggtgttgcttacatatgatggtccatcctcctttctagggcagtcctcaggactaccgaggaatgtggggaatgacttgcccagcatccccaattttaaaattgtgcccactgcccagccccagcatcccctatctatcatctctcagccttgtcttaatcagaagcactcaccaccagttgacatactatatgtgttaattgtttgttaaacatgagaatggaggttccctcctggtagcaattgtctatcttgtacactgctttctccccagagcccaaaacagggctgtaaacataatagggactcggaaaacgtttgttggatcaatggcttgctcctaattcatcttgtttatagcccttctctggaacttttcccatagggctggtattacctatattctgtgctctaccccctgccccaaacaggggcagcaaattatgtcgtactagtttttaaaaatgctcagtgagtaggatagctccttacatctgtggaggtacctaataaatatttacaaagctgagattatttcaaaaaaacataggcatgatttccatccttaaaacttaaaatgttatagtcagactcacttagagcatagcacatagacagaaaattccctaatactaggagaatatatttaaactaattgttctcaaacaagggagattttgccaccttccctctcccctggggatactttggaaacatctggagacattgtcacatctggtggtgggggcaggcagtgctactggcctctagtggctgaaatctaaggatgctgctaaacctcctgcagtgcgcaggacccctcccatcagagaaacatctggctccaaatctcaataatgccaatgttgagaaaccctgatttaaaataaaaccctaatcacattgttttatgacgatttttattattcatctctgttttccattgaattctgtgcttctgggtggcagtggtttgtcttactcatgcctgcgccgcctgagttcagcacgacgcctagcatatattaggtttttaataaatgagggcaaactgatgaatgaatgagtgttaatgatgccagtaaaggtgctccaggctcctctttgaaacaacagtatatttagaaactgcatttctaatcaaacacttgacgtgaaataaataatcaataggttcaatgacaagttgcagaagcagagacacggcagccacacattcttgtctttattgaagaagtctacggagcctcgtgtcatggaatattagcactgaaggggacccaagaggtcatttagttcaacccttttaagttacaggtgagaccactagaacccagggagatgaaaggattggcctaaggtctcacagttggatgccagaactggaagtaaaattgtttctaactcatcaccttggcatgctttcgtggtgctaagctgcctccattatatcagccccacaaaaattggcacaacagattgttgtgattacatgaggtaccacccccaatgtagcattgaatgtaacacatacaaagtatatctttatcgtattgtagaatttgacctcgaactaatatgctaggcattaccatcattaatataaaatttaaggccgggtatggtggctcacacctataaacccggcactctgggcggccaaggtgggtggatcatttgagcccaggagttcaagaccagcctggccaacatggcgaaaccgtatctcaccaaaaaaaattcaagaattagccaggcgtgatagcctgcacttgcagtcccagcttcctgggaggttgaattgggaagatcacttgagcccaggagactgaggctgcagtgaactgtgatcgcaccactgacctccaacctgagcgacagagcaagaccttgtctcaaaagaaaaaaaaaagacttacaataatggaatgttagacctggatgaagccttggtaactgtctggcagaccgctgtatccctggacaaggaggaaagagatcaggagctttatccagagtcatagaaagaggtcactggatctctctactctgtgccctttttcacaatgggatgttttcctaaaattagttgcaaagagtattacaggaaaacaaggttataccttcagataaatttagaaaatgcaagggtaaacaaaaataagtaggtatgtttgccagaggacatcccagagttttacgtatattgagtaccactctaagaaggagatgtaatgcatggctcctctaaaagttattaattaggaaataatttattagatgcaccagtgttcctcagaatataacttgaaaagaggctgtcccacttcttccaacctatctaattgatagaaattaagcagcaggcctgcttagatttcagagggacttttaggcagacttcggatggctgatgtcttttttttcccccatatcttttgagaaagctgtccagaggagtttgattctttatgttctgtttctcatggtatgtttcccaattgtaagtcaaggtttcagagttattcctgtgacaagtcttgcagaaacaggtatggaagcacagtaaggtggaaagacactgggctagaagtcggagggtggtgccttggcacatcagctaacatctattggttatcagtgaaattggacatgacctgaatggccttaagtgcagaatttcagtgtaatcacatgacattgtggggctaggcagtttaaagagcacactaagaaattctgtgtttcccatcgtgtctatgcaacggaaccttagagcagcttggtgtagagagggcaagtccccttctgacctgctgcctgtgatcccacactgctgagaatatagatcttattcagtaataccaagggacaaggtcagtccttcagttactctgtataattgtcacaaggtcagtaattaagtggacttgaatttataataaaatcattcccgagtggaaacgccaatcaacaaaagtttacccgttacacattgagtcttaaagagggaactgaactacaccaaaaattgcatatttcacaaatatgtttaaaacaagaggctttggtgaattttaaggaaagtatattaacatgtaattaaaaacaatgaaaaaggagaatcaaagagtttctaagaataatttagattgtcactgagcaaaatggtagataagaacctgcaccttaacccacaaataaagcagtccaaagagaaagagggaaccttgtttgaaaaagctgtttggaggagtttaagatagtgctttgtttttctcacagtaagtttcctcctaattgcaatccaaggcctttaaaatcattcctttgacagtcctatcacacatttggaatgtgcacaaataagcagaactctgcttttcaggtgagctttgagattacccatctcttgcttctcttcattgaacttgaagattttcaagtttcccaggagcaaaaccttacttaggaaatcacataaagaacacccctatctgcctcataattggaaacaaatcccagcccttcagagtgaaaccaggtgttcagagttaaatctcataacatctggaaggagctcagtgcagctgaaatttccaccaagtgaaatgaccctctcaaatgatgaggtacaaagcaacaacctatttctgtggaaaattacatgatagagaaaagcttgggagagttggcacccaaatacagactaaatggtttatgcagtgggtgaacagaggaaaatttatgagcagccaaggacgaaagtatgtggatggattgattaggagggactttttctaatttttgtggttcagccttgaatttgatagatgagatcctcaaagcattctggggtctatctaaccctctcagagtttgtacgtcatagctgactgcttgttgaattggtacactctttacctattcagtttgcttccgggaaataaaagaaccagaatgaattatctgctcctctgcttgttttaccgtagccgacttatcatcatctttgcatgaaaatgccttagcagttcttgtgtgtttacctaatatgtcactggctacaaaggggctggcagtggatgatagaaaaaagaggtgcagcttgaaggacaaaggcttttcatcaagagtaacaagtggcgatgatgataaatatataaaatggcaagaatttgtcatcagaaaaggagattattttgttataaagagatctagctagccttatggggcggggtgggggctaggcagagaggctgaccctaaagaatcattacggacaatttgttttttgttctcatccatatcagaagaaaagcatttgctgaacagttagtagttatactagaaagaaatcaaagtatgcaattcttggcaaacaaaacataaagagaagcttttttaaattttattgaaggctatttttctttactgtatttagttttaactttgtgttcattggttgctctattcttttaactaccgagttaagaaatcttaaaacaatagggaagccatcctttctttgtctctgagtgagatgaatgtctaatgtttaatgatattaggaagctttttagtaacaaaatttgcaaatgaaaccttcataaatatttttcactgttttggatcccacaaacattctcagggccacagatatgttaaacttgcgttaacaccatttcacgcagacctggtaattaaaggctgtttatttctattttacggcattaaacctaagcctctaagaaattctaagacagattaaataatgtcaaagcaactgcctgaaagatgctcaatggaacactagtcttattgattatagagtgaaatgaatctcactcagaggcagaagaaaagttatgtcgatgaacaaagctttttaataaggtgtcacgattgaagagagaggttgaaatcaggtcaataagaaatgcataattcaaatgaattcatcgtggatcaacatcttgccggaaatccctcttgtagatgagatttaataaaaattatgttaataatgcaacttcttaaattgatatatgggtatcatgtcagggactgctgttttttgtttgtttttttttttcctgtaagtctctgaggactagatgagcaggatggtatatgatataagacaaattctgaaatcctaaaatactttctaccccttctctccccttccattctttctcaggcatacaatagatttgtctcggttgtggtcttagcacatctgagagccagcgtccatgtctgtgagtggtgtaattggccattgaccacctcagttaccactgtggcagctcttcctttgctagccttacctccaggatatgggaatcaatcttaaaaaaaaaaaaaaagtagtatagttatatagtaaaatactgtacagtgatgccaagaatgaactactgtcatacagtatggtgacagaagtcagaataatgaaaacttccggggagaactgggtattcactgggaaggcataagagggaaacttctgggtgctggatatgttctatatcttggcaaaagtgttagttacaagggtctatacatatgtaaaaactcactgagctatacacttatgatttatgtacttcattgtatatactagattttaattcaaaagttttaaaaaatcaattcaaatttgtagatgcaagatatattcttaacaaaactaaaaataggctgggtgcggtggctcacgcctgtaatcccagcactttgggaggccaaagcgggcagatcacgaggtcaggagttcgagaccagcctggccaatatggtgaaaccctgtctctactaaaaatacaaaaattagctgggcatggtggcgtgcacctgtagtcccagctactcggggagctgaggcaggaaaattgcttgaacccaggaggtggaggttgcagtgagccaagatcatgccactgcactccagcctgggtgacagtgagactccatctcaaaaaattaaaaaaaaaaaaactaaataaaaataaaatatctatatgatatagcaatcccacccccacttcttttggttatttacccaaaagatcttaaatcactttgttgaagagatgcctgcactcccatgttcactgcagcactattcacaatagccaagttatggaatcaacctatgtgtccatcaacggatgaatggataaagaaaatgtgatatatatatatatatatatatatatatatatacacacaatggagtactattcagcctttaaaaaagaagaaaaccatgtcatttttgacaacatggatggaatgggagaacactatgctaagtgaaataagccaggtacagcaagacaaataccacatgttgtcacttacgtgtggaatctaaaacaattgaattcatggaagcagagtagaatggtgattacaggggctgaggggtgggaggaacagggagatgttagtcaaagggtacaaatctcagacacgaggaataagttattttgtgagatctactgcacagtgtggtggatatagctaataatagtgtactgtacatttcaaaattgctgagagtggctgggcgcggtggatcacgcctgtaatcccagcactttgggaggctgaggtgggcggatcacctcaggtcaggagcttgagaccagcctggccaacatggggaaaccctgtctctactacaaatacgaaaaattagccaggcgtgatggtgcatacctgcgatcacagctacttgggaggctgtggcaggagaatcacttgaacctgggaggtggaaattgcagtgagctgagatctcaccactgcactccagcctgggtgacagaaagagatccatctcaaaaaaaaaaacaaaaccaaacaacaacaacaacaacaaaatttgctgagagtaaatttcaaatattcaaatatttaaggtaatggatatgttaattagcttgatttaattattccacattgtattcataaatataacacgttatatcccataaatatatacaattataaatggtcaatttatgattaaaaatgaaaaagatacattgtagtgaatgtatagaagagtttacttttcaaacaagaaaggatccctgaattgtaaatactattattttgtgtaattaacaatggtagcagagacccttgctaaatacttaacatgtgctgggtactatcccgtatgtttcctcatttatttctcaggaagccttgcaagacaaacaatcgcatttccatcttctaaatttccaccaagaatactttgtcttttgatgttatgtagctaataaggttgactgtgctgagatttaaccctagcttcatctgactccagttccattaggggatctaacgaaattgtgcctgcagtagaaggcaaattgaaaatagagtctgatgaatcactaactttgcttgttgtagtttctaatctctccagaatagttctaatgcagttaacatgaataccaggctgcaatgttgaacttcagatttgtgatggaggaataaagtcatgaagggaatcaaaagtaggttcccaaaacttgccaccattgtggttttattttcagtctgaggagagaacttgtcaatggcataaaagagagagtatgaatttcaaaaagaaaagaaaaattctatgaaatataagttaaataatttgtaagtattgcagatatgaagtttttctgtttacttggtcatgatcccttttaaccagctccagtttataccaaatatttgttcgtgagatgatcacttttcctgtcagctctttgcctttaacaaaatataagatttttgctcagtgtgtaataatctgcattacttgtgctctccagaatgcctgatgtacttagatggtgcaacaaaacattttaacttcactgtgagtcattttctccatcacccttgaatggcaaaatagtggaatgagactgagttcttagtcacatttgggaccttcttattgcagagaaggctagaaattgatgcccccaaagacacagtactttgtttatggctatattgctcaagagtaatgacacaaaatctgacattaccttatgatgtttgtcactttttttctgtactgtgatgagtcactccatcgatatggccaatttttagggtccagtagctaagtcttctttatctttccgaaatcctctcctaattttctttctgctcacagaattctgatgtcaatgtagtggctcaagaggtactttaaaatgtaatcaagacagtgttgatgtaaatcatctattaaattcattcccccttatgtctcaacgacttcactgttgttcagtaatctctgaggttttcagatcaacatggcaggtacttcatagagtcagtcctttgacatagaaggcctttaaaagatgtacaatccaaaccccttatcttagagctaaggcccttttaaacataggatcataaacttcttacagaacacttattaagagaaacatttagaattcttttcgtaaggaaaatactcaagagaataatatgcttactaaagagtcattgcttcccacccacccccatctccttattcatgtgattgaagattgaaatggggaaggggagaggagaataacacaaatcagactcctgacatttaagatgcttttgttgtcaagaaagaaatagcttctccaggggcaatgtcccaggcagaagttaatgctacctacagacatctgtgaaaaatgaggccacagcatgatgcactgcactttcagaactcatcggctttcagtgatgactgtaagcaaattagaaaaggaggctttctggtgattatctagatttgctcaccctcgctgggacattagtctctcaatactgctccttgtagaatcacagcatttgagaggcaggagagcctttagaagtcatttggtatctggtcctcattttagaaatgagaaaactgagctacagagaggtgaagtaactgactagctggtgcagagctcactgggaagccacgtgctttgacttctgcaccacgactctgtcctccctgatgtcactttgccatgtactgaaaatatctggagctacctaggtgagctcctcagggttgaggagcttctggatagagcaggaacacagtggcctcacccactgtcaagatgcaagactaacatttctggctacaaggagtattaactttaggcttggtgagtcctgaccactgcctcttatcccagtgttccagctgcatgaatgtctcaagtaaggtcttagtagactttgggccagctttgtcaaataaaacattgtgctgtgatggaatcctgtgctaatagctacctgtagctgttgagtgcttgaaatcaatagagctgtgcaactgatgaactaaagttttaattttatttatttatttattttttgagaaagagtctcgttctgtcgcccaggctgcagtgcagtggtgcaatcttggctcactgcaacctctgcccccactccccgaggttcaagcaattctcctgcctcagcctcctgagtagctaggactacaggcgagcaccaccatgcctggctaatttttgtattttgggtagaaacggggtttcaccatgttggccaggttggtctcgaattcctgacctcaagcaatctgcctgcctcgacctcccaaagtgctgggattactggcgtgagccaccgcacccagtcaattttatttaatcttaatttaaatctaggctgggtgcggtggctcacgcctgtaatcccagcactttgggaggctgaggtgggcagatcacctgagttcaggagttcgagaccagcctggccaacatggtgaaaccccgtctctacaaaaacaatacaaaaattagcccggcgtggcggtgcttgcctgtagtccggactacttgggaggctgaggcaggagaatcacttgaactcaggaggaagaggttgccatgagccgagatcatgccactgcaccccagcctgggcgacagagtgagacttcgtctcaaaaaagaaaaaaggagccacatgtgactaatggctaccatctttgacagaccttccttccttccttccttcctatgtctgtgaattttcaactcaggtctaagtgtctgcattattttctttctgcttcccatatcctagagataagaccatcctatttaatctaaactaagtttaggtacagtaaaaatattttaaattatttttgattccacttcagtgtacacttacttcatttttgaaagtaacaaacttagtgagccaagatcgcgccactgcactccaccctgggtgacaagagcaaaactccgtctcaaggaaaaataaaaataaaaaaagaaagaaagttacaaacttaggagttcatggataagaagggaacaagttgcatcaatggatttgaagggcagggactgcaaatccagtttagaaatgttggaacttcttctttgtgtcttctacctctatccttctgtgctttgatttctccgcttcttaagaataaagtactactagtagaattgccagattcaacaaataaaaatacaggatgacttgcatgtttgtatgaaattcaaatttaactgggtgttctatattttatctggcaaccttattaatccattctacccctttttaattctttctgttacttcagggagaaagaaaaaacagaaaaaaaaattcttagacatattttcatcatcttttgtcttttatttctattttcctaatagaattttcgtgaccacagaggtaattttttaaaagatgatacattattaatctaaattaagataggcttggcttatcttgccctctgggttggaaaacaattaagttggtattgaactgaagtgtaaagaactgtaaatttctaaagagtcattatattccactaatgtcctttctaaatgggttatttgtacagaagccccatttttaaataaccaaatcattgatctgtttttaaagcaagagcagttttgttgttgctgctgcttttggaacaaatatacctggattttcaggaaaatgactgaagacattgtcttttgaccaatgtctgtctccaaaaaaattgggaatttgtacatatttttttctcaagtaatccatttgtcaagatagcatttcacctgtgaaggaatacaaggtaataaaatatttctcttcagatctactcagatgcatttttaaaaataagagcttttagagaaaatcttagacgcttgactacttatgaaagatagaaacctgtaggcattctgtaaaacttgaagttttacaaatcaccatatatgtgtgataataagttatataagttatcaccatatatggtgataatgttatcatcatataaaccatatggtgatataagttatcaccatatatgtgtgataataagttatataagttatgtgtgatataagttatataaatcaccatatatgtgtgataataggaataggcaatagtgttgacatcaatatggaaatgtcatgacttattttgctatcactgagtgacagctgtcacaattaaaagaaacaacattttaaaggggaaataatcacagtggaatcctagaatttcagggttagaagggaccatatatctctgtgctgaagctgagagatggtgaaatgaaggaattgaagttagtatttataagatgatgaaacagaatggtggctccttttcaaggccaaatgaaatttgttttggccttcaccctgtaatctttttttcccctctcatgaagttttcagttcttattcaggtagtcttttaattgcatttccagacaaaattttaaaatatagttcctaatacattttttaaaaggtcttagctgctatttcctggcctttttgatacgtgaagaattatgctgcagacaaacactgggtgttagtgatgataattctctccctgtctttctcatttgtctatatatccatttgttctttcctccttttctcccttccttcacccgcctccctcccttctctttttttcttccttccttcttacttcctctggcatggcagtgaaaaaagtcatttgttttatcgataaagtataacatagaacagcctagaagagttgcaatgcatttgttgtttttaatccccatatttggatttgtgttctgactgaacatgctgatctgcaacagatatggagtatagagtacctgtttataaagattcaggggacggggtaggtaatgttgctcacgggacttgcatttgggtcacaaatgctgaccgacataaagatgactgagactttcaggcaggccacgtgctcccagcgtgtacttggttggcatttccaggactcagaaaagcctgaatccagcttgccacatctgaagcatgaaatttccgacttatctggctgtgttgacaaatttaactatcagacatctgttggtgtaggtgttgggcactgaccaataacaattatagcctccaactgcttgtatgaggcataatgtagaattggttaagctctgttcacaaacacaccagcagattacagtcccaggaggcttctctggggcactggggaattgtgaactgtaaggcagctaggcctctaacaaaacccttccaacagggctgccttagcttggagaatgaaaagaaatcttgttgaagatatgaaagccattaagttggtaccttacatgttttttgttttttacctgcaaagatggtgatatgaactattttaaggagcaaagttttcacaaaattaatgggcaatttacttccagttactcatctaataaaggatgaatttgataatttttacattatatggatgttattaataggagtttcattcacaatacctggaaaatataaaattttcatctattctctcttattttgacataatttctcttgagagttatttggggctctagagccctttctttgacttgctttgcctgttatttggctacatattttactaaatatctacactaaacttaatattggtttaaacctggagcagtgatgactgtgctttggaagaatacaatttttttaacttttatttgcgtttattattgtatgctaaatatattcccatgctgtaaatttttgtttcttgagtttcttctagggtgttttctttttttctgtggaatcagtaaaggtcatctggatgtggcaggaagagctcatgtatggttcatctgactgtgagctccataaatccagtggcacgtcttgggttctttgttcacctgaatgtgctcaatgaccagagaatctacatctaaaccctcaagttcgatgctattctctgcatttttaagcatgtgcagcaaaaattcagcaccttttttaggccagcttggtagctttccatatatgcatccccttgatggcccgggcaatttcacagatgttcttaatgtgaacacaaatatttgaacctcttgatttgcacggctttgtggtattttctgggtcaagtgaatagttaaccattttttacagatcaggctgcttaggggaagagcaagaatgaaacgtgagagatttgactgaggtgtagaatttgagagctccttgaagttgttttcagttctacttcactatcagtgttttgatacatttcctgactttctttttctttgtaggtttggagatttaaaaaaaaattttaatcatcatcaaaccataaatacaattttgttttctgcattttaagttaacatttgattgtaagcattttatgtcactgtattctctttaaaagcacatttttaatgattgttatcccactaatgaatattccacgttttgtttaatcattaacttataggtgaatatttaggtttcttccaaatctttgctcttatataaaatacttgaatgaggtatatctgtgtgtataattaaatgttttggagtttgagagataaattcctgaaatagtactggatcaaaaacttataaacatttttaggatttaaatacatctatatatacatacatgcatacataggcacatactcataatatctacatgtttgtgtgtctgtgtcaagttattttgcaaagggtttccatactttcactcctaaaattgatttgtaagcaattttaatgcctccttgccaacattgcattttttctatctttgctaatttaaagagaaaactgattagctcattgcaatgcacattccttttattaccaatataaacataatccttatatttggtgatttattttcattctacttaaagcatcctcagtgggacttgtgatgatgttcataaactgatcaagaattatttcccaggtactgaggaggccggcccaatgctggctctcaagagttcacatatgcatcaaagagctcaagtgagacagccctagtaagcattcctctgaaccccttggttttgagggatggattgtctcttggtccttcaccctgacgcaaccaaacgcatcatcctaaagaaggggtaagatctgagtgagtataccatgacccccagacttgcataacaggcctctaaacctggaatatcaagagtgaaggatgagcaatgtttacagaaacttttttttaaaaaaaaaaatacatgtttataaacacattcacatccctcagaactagccttctatggaatgcattctaagaaatgtactctgtgtaacaacaatcaactaaagcatttgtggtgttaaagcaatgtgagtaaaggaaaaaaaatcaactgcagctatcaagtcatgagcatgctaaattgatttgaaattataaagcaagagtagatttcagttctttaaactagaccattttggaaaatggatagcgaggtcaggtttttattgtagcgaggatgtgaaaaacactttgtctcagaatgatggatgtttttgttgctttctttgaatgtcttaagtacttaagtgctttggttatgtcttggcaggcagacttaagtggccataggcaaataggagagacatcaggggcctcagcctctcgcctccctcttcttttctgtctctgattggctccatggtcattctgcagtgtctctctaatgtggactggataatgtgaatttttccagaaaagccgcaagccctatctaaatggctggcagcatggttgctattcacaataataacacaatgtaataagatgtaaaccacacgagggcaagggattttgtttattttattctctgctacatccccaggaactagagcaacaccaagatcaataaaaagttgttaaagatgtttaacagaactgtttacttcttagcagtaggagatgagagcccctagagccatcatttgttgatgattctcctatcactgggggtcctttctccttataagttaggtaaccttggggagcacacctttgatttgaccactttgcaaactatcctacttttaattaatgtactgagtgggccccaattctgggactgaactttctcaaaattaaaacctgagggaagttacattgtacatttacctctgccatggtttagtaacaaagaagatggagtgagcttgagattttttttctgatttttaaaatctgatttaattttgtgtgccaaaattaattaaaaacatagttctcgaaatactggcaatccctatggagagactttgatataaccaatgttgtataaagtaaaaggccatttagaaggattccatgccaactaagaaattcaatgcttgctccttcccatgagttccagggaagagaggaagcaagtgtatgtaagtgtgggagggtgtgacaggaatcattattagctttcagatactgcatggttctaggttctgggtgaggagtttcacatactaaagttattatttttgtgcttcctggaattagagaagtgctaaagttcatttggaagatgagcatcaaaattatggggccatatagtcatgtcagatggtcctaaaacgccagtttctccttttttgttactgtcagaccagtttcagaaagctttttggtttacaaaaaaattatcaagggggggaaattatttctaagcaaggggtaaaatgaaatccatccaaaaaaaattaatgttgcctagttgtaacaactactttgcaaggaaatctgcagttacgttttaggctataattgtttcatatgggatgactgtgatttgttttcatcattcatggcatgaatgttctgtgtttttcagtcttctctgtgacggctagtttagacatatctgtggaccatctttaaagttgtatcagtccctttttttttaaattcatgtttcctgttccatatccagggcagtaaaatgagcaccaaattagtagtcttactgggagcaaggctcagcctctcagaggatcccttttcctcaaactcccttcacctggctaactggtttgcagcctccacatctcagtgcacacagcactgaggattgttcatgtcttcactttagtgctgattgcgctgtgtgcttgttgtgtcaccattcaagcagtgagctctgtgaagaaagacaggttcatgtccaccttgttccctggggtatacttagtacttagggcagttccaggcacacagcagttcgatgtagatgtagatgtagatggatgtagatatatgtagctatagatattagtgtagctatagatacagatgtgggtgtggatatagagatagagatgtagatatagttgtagatacttgatatacaattgacccttgaacaatgtggaagttagaggcactgaccctcatgcagtagaaaatttgttataccttttgacaccctcaaaacttaaatactaattgcttactgttgactgaaagccttaccagtaacataaacagtcaattaacacgttttgcatgttatatgtattatatattgtattcttacaaaaaagtaagctagaaaaaagaaaatgttattaaaatcataaggaaggaaaaatatatttactattcattaagtggaagtagattatcataaaggtcttcatcctcaacatcttcacattgagtggctgaggaggaggaagaagagaaggggttggtctggctgtctcaggggtgccagaggcagaagaaaattcatatataagtggaccctcacagttcaaacccatgttgttcaagggtcaactttattccaaatatttatgctataacattacactttaatagaaagaggtgatgttaggcatcaaatgaagagggcatttgctcttcatttgtgcctgaccatgtggttctcctgggtattccttagatatagcaatcttgtcccacatcagtttctcaggttttcacttaaaaggtatttggccaaatagccttaaaacaaactcaatgcaaatatttgcacttgtttctgattccccagacaggggaaagtgacgcaggcatactacttatatcccattggttaataaacccattttcttaagagggctacatagccttccccttccccccatattgaggttagatgaagtccatataaaataattagtaacattaaccttcaatgagatttttagaaagtaagtcgaaccatctgcttcttcataattgtcatatttaatttactgggatggctttttgattagaaaatgggcaaccactgtcttcttttgggcagtctgcctaaagcagagagaaaacaccaactggcagagtgctaagcctacaattacgggaggagtattcatttcaatggctccccctcttggatgtcatcacatgtttgaatgtagcaagcgccatgtcatatgtgattcaaggtcacttggtttataggaaaatcacattaacaatcatcatttcacaactataaagtgtgattttgaaaatattactttcttgtactttttacccctactcttgagattttttactgcccttttcgacctaggatggatgccaagctgccactttaatttatatgacatttatgctcattcaatttgatgtctagcttggctttcaaacaggttcaggccaaatatcaagttcacaaaagagtttcatttcatttaattagagtttgttttattactgtttctgtttgatagtttaaggtcatgaaagaatttgtgatgacactgatttgaagacaacacttggagctgatgttgtgaccaacagttaaacaaactacacaaaatcctgaaactcaaaatctcaaaactccatttttagcaagtctcataaaaagggttctcgtgtttcgttggagaatgtaataagaacatagtaactaaattgcatgccccttaacttaagccagatcttagctgaagaaaatctgtgattagaagcaagtccaatgtccaagtcacatattcatttaacctttttaagagaaaatggccaacttaaatgtatttgaaattaattcatcagttatgttattattgagggaaaaagtgttctaggaagaggggacagaagctcaaagaccctgaattattcctacctcagggtgaataattcatcagttatgttattatgtccttcaatcttgatgagacttaagaagtgagttaagtatactctctccctctctctcttcctttctctccccttccctcctttctccttccttctttccctccatctcctccttttcccccctccttccttccctgtctcctcccctctctcatagttggagaatatcattctccatgcagatgctggtttattttggcagctcttggaaggttgagtgaggacagtctgaggacagttgcttctaatagtttttggcttgtgttgctccccatttctggtcttcgtcatgttccagattttccttgttattcttatctcccaacactctccctgtctttgggaggaccaaatgtgccagagataaatgtggaaataagaaaagaggaataaatatctaacataagttgaatctgttaaattgggatgatgattaaagatatcggttttataaagagagtcagttggccttagatatgttatcctatgaatatttcagagacataataataatttacatgataccataataaatctgagggctaatggctccaatattcacagattcatccagtgcacaaatagtccatttacaaagttgtatttgtttatgtatttacaaagtagtgtactagatactgtaggagctattgttctcaagtggctcaaaagcatgtccagagttgactacagagttaaagtttgtaccagaaggtcaagtcatgctttgagaagacacagccttggaggatgagttttttgggggatagtggggtggaggccctgaccactctgaaagtagccagctgtgtgcttggagttaaatcccatggtttcctggcctgtgctagggaagtgagagttcagacttccaaggtggcctacaaggagaataagaggttgaggagaaggaggaagagactggctggactaagtacagctagcagctttggcaagaatggcctcaatgccacctctgcagtcttttgtaaccctggctttctctatcaaaactagttataaccttctgcgccaccccccccacaaaagcagacagagtgatcagggaagaagtctctgtgcaagtgacatttcagactagacctgactaataagatttgagggaagaaacgttccacaagaggtccaaagcccctgaggtgggaatacgctccatgagtttcagaacaaaataccctgcttataagaccaagaggacttccctacctcagtaagttgcaccatctcagttactcaagtcaaaccccaaggattccttcttgtctcctttctctccctcatcacttcctaaaatctcatccattaataagattctggaattggcccgttttatttgatcaataccatcagcaatcaaggtccaccactgctattgtctgaatgtttcctaaaattcaaatgttgaaacttaatccccattatggtagtattaagaagtggagcctctagaaaagtgattaagtcatgagggctctgccctcaggaataaactagtgccttatgaaagggctggagggaaccagtttaggccttcctttattgcccttctctgccttatgccatgtgaggacacagcattggtccactccagaggatgaagtaacaaggcaccatcttggaagcagagatcagcccttaccaaacaagtgaacctgctagcaccttggtcttggacttcctagcccccagaactgtgagaaataaatgtttgtttttatgaattacccagtcacagatattttgttacagcagcacaaacagactaagatgaccaccatgtttcttctggattactgtagatgcctctttactgctctttgggcttcagtgcttcccccttagaatccatttattaagcaccagccagaaaggtcttttacaaaggcaactcaaatcgtgtcatgccactacttataaaatgcaccagtgtctccccactgcactaagaatctactctcaaatcctcaacatggtctacatggctgaactaatctggactctgcctgcctttcctgcctccttggggatcactcccctgctccacttttggcacatggtctttattttgcaacccattaagcttattcctacctcagggtctttgagcttctgtcccctcttcctagaacacttttttcccctcaaatctcattattcaggtcttggaaaattccagtgtcctggccactccatctaaagtagcacccctctttctactccactaactccatcccatcaccctcatttggttttctgatggtttttagcaccatagacattctcatttattggcttgcttaccacccactcctctccctgcccgccgcccaccacaaacccactgctcctaaggatgtaatctccctgaaaaccctgtatatccttttgatcactgtcggcccagcacctaacacaggacctggttctcagtaaatacctgttgaatataagagtaacacaggttccttcagaattgaccagcagcaccatgatcacactgctgctctgctgaatagatgctttctgctctcccctggctgttcttctgccttaaccttctgagagcttcaagctcctcctgtttctgtcttgatgtatgacccccctcagttggttcatgactttggcccattcttggctgtgtttccctgctgagttctacattagtgactcagatagtgtgtaccagcctctgacctcagcctaatactgtttgtgctgcttgtgtggccaagtgtaaacttttttagagctttcattatgaatattttcaaacatacaaaaagccaaggaaatcatataaagatacataactatatacccattccatgtacctcaatctagatttaacagtcattaaggtttcaccatatctgtactgtattttgaggaagtatcctaaattacaagaatgttgagtatatatccaaaatattttaggctgcaccttcagactttcttttttacatatacacaatatcattctcacacctacctaaattaacaatgccttcaaatcacgtagtacccagtccatattcaaactttcccaattgtccccaaaatatctttaaaaagctaggatcccaaaatggcccacatttccattggttattatgttttttggggtcttttaaatcaagaatacctgcctgccttttatttaataccaatgacatgttgaagaagtcatgtcttgtagaatatctcaacttctagatttgtctaattgctttgttgtagtcttgttaaatattttctttcatcacctctaacttctgtcactggaagttagaattaaaagtctgggtaaagtccaaataacccttttgggaaagtttttctcaggcgtgatgttgggtatcacatcttatctcacatctggatgaacataatttctctttgttccgccattgggttcaggtgatgaaagcttgatccttctgttgtactctatgtgtttcttcttacaaccagcaaataatctatggggtaaatatactttttttaaaaaagctatttttgctgtcagcctcagtggtttaaagtaggagtcagcaaactttctgtatggaaccaaatagaaaatagattcagctttgccagccagccagtccctcttataactacttgatgctgccattgtaccttgaatgcagccacagattatatataaacaaatgagtgtacctgtgttccaataaaactttatttatgaagatacacaggtggctactggatttggcttgcaaactgtagaatgctgaggcctggtttaaattagcatcccttggggatttaaaaaaaatactgatgctcaggccccaccctaaaccaattaaatcataatgtctggagatgagaccctggcattggtatttttaaaagctctccaagtgattctaacatggctactgatgagaatcactggtttaaagggagttatctgctctggaggcaaagagttcataaggtaaggtagataggcatgtgaacaattaaatctaatacaagagaagggaaaataattgtagaaaaacaaaggagaactcatagaaagaaggatgggggttggggcacagtcagaaaagtttctccagcgaccaacattggagccattccttaaattctgaacttttttttttaatttttaatttttatgagtacatagtaggtgtatatattcatggagtacatgagatgttttgatacaggcattccatgcataacaatcacatcatggggaatgtggtatccatcccctcaagcatttatcctttgtgaattctgaacattttttgattggtgcagagggtgtggaaccagcaggcacaatccatctctggccaaatttctgccaagttctgtctccctcattaatgtgaaatcaggaacataatgaagacttcgaacctgtacccaggagcctttgattctttgcaccttgtcattatcttacttttctggaattaatatattagtgactaaaggcaaatgaatcattaagttttatttacttaaatgtcagcttttttaaggaactgaagataaaaatctgagaactaaggaacaactcagggacaatggggcaggttctatacacttgcctagaatctactctctcgatattatttccccaacaccactggttctttcatttatttattttagatggttgggggtgggattctgggaagtgatgaggagattagaaatacatagcatcatgatggaagcaaactaaaaaataaggtttatctccgattatgctagaggtcctcaaccagggcgctcttgcccccaccccagactcttctagaggacatttggcagtgtctacagacatttttagctgtcacaacttaggcaagggagttctacaggcatctagtaggtagaggccagggacatgttgaacatcctataacgcacaggacagctccaccacgcaaaagacttatctggccccaaatgtcaatagcactgaggttaagaaaccctggattatgctgatacattcaaacacgcacagattttcaggaaattttctgtcttgtatttcaagaagtatttataattatccccataggtcaagtttttagtaatctctgaagtcacaaagatatcttttaaccaagtagagggtggtggcattatgtatctggaaatctaaaaattggcttttcgatgttagagggaaaaaatcaaattagaggaagccctattattatttaaaaaatatcctcaccacagtctcttgcccttggggcaatgcagccctctctccctccaaccactctgggtaggttagtatttgccttcggggaagatatgctgaacccagtgtaactgatatgggcaatccatatcagaagtcctcttctcaggtttacaggtagttacttagctcagaggctatttctcaactttagtcccatctaactctgcattgtagcactcagtgaagctccaaccaaccatgagcttggattggaataagcccctttgttgctgcaattctatgtgtactcaagtgtggtgcaaataagtaaaatatggcttatgtgttaatttcctatggctgctgtaacaaattaccacaaatgtactggcttaaaatgacaggaatttattgtcttacatttctggaggtcagaagcccaaagtggatttcactgggctaaaagcaaggtgtcaggagggccagttccttctggaggctctaggggagaatacattttctcaccttttccagcgcctagaggctaccaatgttctttgcctcatagctccaaatcactcagacctctgcttcgatcatcacatctccttctctaactctcactctcttgcctccctccttgacttatcaggatctggtgatggcactgagcccacctgtatactctgggatcatctccccatctcaagattcttagttacatatgcaaagtcccttttgccttgcaatgtaccatatttacaagtttaaaggttaaaatgcagacatctttgggggctcttattctgcctatcacagcttgaaagcgaccaaatatgacatcaattgtgcttgatgctggaactggtcacatactttattctattactagccgtggaacatgccacagagcttgcgcaccagagtcaaaggacctgagtttcagttctggctccaccatctacaagctgtgtggacatgggaaagtcacttcgccttgcctcagattcctctatctgcaaaataggcattccaataacacctccctagtagggtgactgttgagggctataaatgaaataaggtacttaaggcagtaaacctaacacctgacatataataattgtttaagatacactagctattgatgttgtcactcatggagctgttacaagaattaaacagggcaattcataggtcagtagactttttctgtaaagggccacataatacatatttttagctttgcaaatcatgtaagccgtcacagctacttaactttgctcttatagaacaaaagtagctatagacaatatgtacatgagtgagtgtggctgcattccaataaaactttttttgtaaatatgagcagcaggacagattttgtgtgcacagaccatagtttgccaatccttaatctagaatattgtgattcgggcctgactatatattgttgtcgacagcaaagcttttaaaaaatgataatagtatatcttcgttggtaggcaggtctatgcaaacctacccccaaagtttgaggtagcagagagacaaaagaaagaggctaacatatccagtttcttagaaagagacatttaataggcactcacaaacggaagccatgtctgtgtctcgagtggtggctagacaagatggtggatccctatgccattatctccagacccagggcttatataccatagggaaagggtgattcggaagggatatgtaggaccatcgaagtataataacatcaaggttgtttgacctaagggtaggacttacatactagatgtgttttctgttaagaagcaatttttacttgctttggttccatccaagatggagctgctttagcctttacaatatcacatctaattctcagttttcttttaattaaaaatataattactcttagttttcatttctgatttcagattaaatgccaaaagacactgctttgtacatattaagttttcaattgcactttgttgacaaataaaacaatacctggcttcacctcagccccagtgaatcaaaattcctgggggcaaggcctagctaggcatttgtttttgtttgcttctcagaacaagaggaggggctgccacatactgggcacttgatcagtatctactgagtatgagtaaggaaatgtgcaacacgccatcagcacagcacccagcccatactgaagctcagtaaatggtgcccaatcatttggggtcttttgattgcaaagaacaaaaacccaaactggctaatttggccaaaataggaaattattagaaagatatgcaggcactcaaacaattcaaggaacagatgtatcagcaaggacaagaacaagggcagtttgcaagggctgaccttgttcagcaactcaggaaggctttgcaaggattcttcaggaggataatgacatcagcctttttctatctttcttttcttccattagagagagaatatcccccccttggctagtagagagtggaacaccctgactggcaaacctcaccttcacatgactaacagggaagagtttgtatccaaggcaaaaaattgagaggtcttactagaagaaggggatagaggcagtgcactcagccattgataactggttgttgtttttgttaagacagcttgtaatgaggtaacataaaaaagtacttcccacaacagaaggcatgtaatggatgctcaagccattgctctctggtggatttcaatacagcacctttttcaaaaatatagcagcggttctcaatcgggtgattttaccatctttgtggagaccttgttgggggcaggtcactactggcatctagtgactagatgccgaagatgctgctgaacaccatatagtaaagtatatgagcatttgttatggtgctgcagttttcatttattctagctaaaagggttgtgctttctccagctgctaatctatttatctgtgtgccccgcactcttactttagagatcaagtttgatggaaaggaggcacatttgactgtgttcctttaattgaagacaatagaactttggggagattctggagttgaaattagaagagaataaagcaaagatgtaagaacctaaggacacatttctgaaatttacccctatgagattacttcagaatttaacttgctaaaaatagatgagcagaagaaatgaaatttgagaacattcttgttaatgaaatgcagaagaatagtttaatggtcaaatagaaatgatttcaaaataaatccagttaaaactaatgagttttatgtttttcagttttactgaaggaattagtccataaaatgaaaaccatcattagcaaaaatcatttggtataatgacatttccgttactgttcgtgggggtaggggcaaaaaggtaccaagtaatatcacctttgaattctggtttttattctaaattttattaattctaaaaggtgctcattaaacatttttcttcccttttttctcaagtattcaatagtcctacaatatgtgaatatcaccccttttttctttcctgaattttaggaaaacagggttttaaagtatcttagtgaagctttatgtcagtgctgatttgaacttccaatttaaactgcaaccttttttgtgagtggggagagcatcagtcagattaattgttttatcagtttctgacactttatcatcactgattattgaagacttcctgatgtggctgagtaactcattcattcccctttatccccctatgccactcccatttacacgcccaggtaatttttctactgagtttagtgtgaatatttctgtgtgcattcgtttttgcaagggtgtattattgttttacacacattcatttcaatttgcataaatctttttgtgctatatgtttcattgtgtgttttttctgagcctggggatgttaagatccgtctgtgttgctctgtgtatttctaatctgttttttttccaactgccacctcatgctccatggtgtgctgcaaacttggtttctgagagataaccactttgcaccagtaacttgcagttctgcttttgctccttttattatggagtcataaaagcgtaatgaaagaaagagctcctagctgtgagtagcagctaaaatgccaatttcaggtctgtcaaaattgatcctgcccacagtcctctaaaatgctcttacttttaaccctgctgaaagaaaaatctcttttcttaacccccaactcttcctaaggctatttagcttctaattttgctgacgcggttacttccaccaagtaccacttaaatattaaagtataagtagttgccgttccttccttattacctttatcagaccctcttcatcttatcacggacttaaagaaatggtttttgaattgtcctctctgtcctcattgtctcttctagacttagagttcttttagacttagagatatgtaaaaatcatgtattactcgtgaccatatgtaaaaacggatatataagcaaaatagaattgttaaggtattcctaaaacttcatcgcattcagaaccccttctgagtgcctttttgactcagaatcactgatgtccacttttgttcacatagcagttgttcatacaactgttcaaacaactgtgccatcaaaaacattggtgatgcagcattcttaggagctctaggagttcccactattgtctctgagattttcttccaaactcccaacacccactcttcaagttttgactctgggacttttcttgcttagcctgagataagccacgcttttgtaagtatcttagtagcacatggctactattttcctgtcttaggtcccgaaagcatttgtccctttgctagcagatatgaaaatgtgttcacttcttcagcaatgaatatttgctttgctgatatgcaattcacaccccactgctctgtttccacgcttttctgtgtaccagtaactttccatttcaatattgaatcatgatgtaatcttttggaagacaatttaaatgggatttaagctaagcatttgtagtatcagcactagacgtaattcagttgaggtgaggaccatataaatagcaatgagtacattgttcacacttgtgcaggacaaactgttgctttgtgcagagcaatttaaaacaccattgattataagacatcctgttgttaaagatgctaaagcgtgggaaatgtgcatcttgtaaaagacgaatgcagaggtaggtactcaggatgcaatatggtggctccatagtccatccgagacctgagctatttctgccctctgttattgcatccttagcacatggcttccatcgtcagtgtcactgcatggtccaagatgacctagtaagctcctgacatcatatctaggcagaaatgaaggaagtcaaaaagggcaaaaaggccaagggtctacaactcactggataccactgacttgaagggaggctgcctggtaactacagtcttttacttgggcaagtttgtcccctaggaaaaaacctggaagaaggagagaatgtctgctgcgtaatcaactaggagtctcttcatcatatccttttgaaagcctcaattcctgtgcagcctgattcacaggccacttcagcctaatcatgtgatgattcaatgcataatggtttgtgacaaattttagcattttgctcttaccattatgtgtgattcaaaagtaagcacaaatctataataattggtatttaatgtgactaattcacttttccctagtgagtctacagattccttgagcagatctgtcttctaaaccttagttacttctcccacacaaccacctaccccattgcccattgtctgaattatcttacacaaaacaaatgctccatacatggatttgacgtcatcttgcttctgtggcctcaataagtgattgctgcttccagatgatcagtatctgaggttcccccttggtagccaatgaggaatttcataaaagcagcagcttgagaagaggacatttttagagtttgcttatctcctttgggaaactcttaatccatattctggcaagcatcaggatacttttaggagtgatgtctagtacttcttaactgacttcctaagataatcacttctggataaaacacctctatagcatgcagattaaataaactcagccacagcctgttgtgagattcttagggccatgcctgataatggcagcaaaggtagaggcatggatttttctgagagtaaagactcagtggttcctgggagaggaatttgtgtttgtggttggtggtggtttgcacttcatctcataggcacatagtgtacaaaagcaaataactgctgatttctcagtctgagcctttctggttgaatctgaatcatcttgagtatgagcatcaaatgttatagaacagcttttgtatcgggaacatcaacaagggtcctggtagcaggacatagacataaatatctaatagcattggccaatgcctccatgggtagtaaaaataataatactgatagtcatagtaaaaaaaaaaaacacacatttatggcactgtatgtgccatgcactttatggacattaatttgtgcagccctggccacatttctagggctacaccacatcattgtatgctagatgacttccagcagccagtctctgcatctcggagggatttttctgaaactgtttaaagccggtatgcttttgtctgggagcactttaaaaatgattgacatgagtcggtatatagatatcccagttcctttgctcctcagatgggatatttcagacatgtgagttttatactattcccagaatttcctggcaggattaagctccagtcacccagtatggtagctggctggataatccattctttattgactgtttgttttctcttcccagcatagtttccttacccttgcacaggaatctttgtattggggtctccttctagggaaatccaaactaagacaaatattaacatcaaccccgtgagttagatatgatcattacatttatttttgcagacaaggaaattgaaacatgcaaaggcaaaggaagaggcagaagtgttcaaacccacgttgtgagtctggtttgagagcctgcattctagctacaccaagtaaatgctacaggagctaagtgaaggagtgcactctgatggagaacagctggcccagtggtctatagattcagttacttttctaaaacaagaatgtcaggtccaatgtacaaagagaacgtgttatactgactattgcattcatgactaggttcctggaacattgtggggcagcctttaaatgtgcaaattcttgtgtttgaggacctggtgtgcctaccaattaaaccacttggaaggttgttttaaaatctggtgccaatttggggatgttcagcccttccagccaacaaccctccagaattgtcagcaatctaaaaggcaatatttcagtcttctatttctttcaaattcatttagtgtctaggtgataatttttttcaattaaagcccatagggctatggatttactgttatgagatggtggccttccctgttaaaccagtgttggtctgtgtgactataaatagggatttccacagttttatatatcttggctaaatgaaaggaatttaaatgttattgctacaaagcattctttcagaagcacttagtgatcatttaatatgcattgcttctacctttcacattaatatcctcatgcagtaaatcagataggtcctcactaatcctatccacacaacacactatggttcattaacagattcctatcagtgtaactttgatctgcccattttcaatttttgagttgtctactttctggcagattacagttcaaaaggtctatcattgattcaacatgaaatttcattatatttgaatcaaagactcattggagtgacttaaaaagctttttatgaagtgaaaaagttgtttcttagcctcagttaatttattttgttatgttatttgatcccaaagttcacacaaaactaattaagtctcaattcaacaatgatatcatcctgaaaatgctttgtgtcagtatgcagatgcttgagacgtatttttatattcttctattacggacaggactaaggaattctggaacccaaggttctgcttatcttaggtttcggagagccattagtatatacaggccttgaaagccttcatcatgggttgggattttagagaagagggagcccaaaaataatgaaagagcaacttcagtagaagagagaggacctgacatttattgagaactcattatgttctgaaccttatggtggtgctttacatatcactacatctttcccccaactacagagagagattaagtcattttcccaagttggttacaagagagactttttcaaacacaattctgtctgactccatagttctacttttacacgtgatcactacactgcattgaaagcttcaatactaagtggtagagtttttcttttgtggaaggatgggagctgatcatctttttggtggtcctttagataacaccatgaaggaaattgtctagagttcaggctgctgctgacattttatctaggtggtgagcactaccaagataaggagggtgttgagggaattgcatttgggtcctggtgttccatgtaagccattctagatgacatatgtaactcttggcttacccaagattaatttaacattattgattcttagttgatttgtctccctttggaatcatcgtggaggcacataaatcctgagactaagagggtcttcgttgtaagtacagccctactgagcatctctggaggtggccaaagttgcatcagaaaagcagtattgctgggcaatatatgttgttttcaaaaagatagtcctgagccctgcaacccttacctcctccatccatcctctcctccccagttggaaaaaaaatctcatttctttagttcttagtgtgaggaaagcaatctgattgatatatttgaaaaaatatgattaaaggattttgcaccagaattcatcttccaacacccccttaggtttttctatctcctttactgttttagttttgacaacaataataggggggatgagattgattcacaaggctctcaccaatactaaaattgtatgactaacacccaattgctatttaaatatgattattaatattattaaagacttgggattatttcctgtgttgtgtttgattataatgcccagcattatacatgatatatccagagtcttcctggtttattgctcatgtagcaaaatgctgcctccattgatcaggatttggaagaatgttggtgattatctcctgagaatagtgtattctttcactttgaaatatgtttctaacactgctgtttacggtgattctgattatttcaaggccatggtatatttgtattatttgcgattatcagctgatgctgaactttcagaaaatttgctaattatcaagaattcttcatgacaatatgagacctttgggcagcacataagataattttaaagtgaaagaactagtccgtctcctgcaaaatgatgcaatgccaaaagcaggctgttaaggaaatgctaacatttagtgagcatctattttgctctgaatgtttcctttccttccctccctccctctttccttccttctctttctctattttatgtttctttttctcctccctttctacctcttccgcccttcctcctcctttcttccctttctccttccttcttttttctttctttctttttttggatataaatagtgattgagcaaggaccacaaagcagctttctctcctccttaaattccttaaaggaaagtttgttcttagaggggcatggcagatttcctaatgagcatgccctcacctgggcttcctggccatcagtttctacttccacagcagttgtgggaatccattgttactttgttaattaacaacttgtatggtgtagcctttgaaggcagggagctacttcttaaacacagttctattactctctaatttgtggcattaataatccgttctttttcgatttatgtaagatcttttcctcttaatagttgtggcattttctctgagataaattttcataagactcaattccaagttgtgattttcaaaaacaggagtcgtgtggtcgaaggatatttcaacttgtgtcttatgactgtccttcatttagccttttgcctctttagagatgggacatatgatgagagctgatttgtttcccttgtgggcaaggaaaaacatttttgaaggtatctagcatgttaaaaatcaaaaaatgcttcctctgtgtctttgtctggttgtacctttcctttagccactttacaaaggaagtcacaccatacattttgtctgtctttctttaaaatcctttattttgggaacaccagaaaaaaaattttagaaggtattctctcatctttgcttaatctctttccttagtcatccagagactattcctacttaattgaaaaaattcaatttaatttatagataaggataatacctttgagatttaaaggctcggctcagacctcttccgggagggcgtgtctgactcttatgtgttctatagcatgagtgcatactctaatatttcttcagtcgattcatttatctctttatacatctgccatcccatcagcctataagctactttttgcattgccatcagataccaccatactggacacagttacactagtatcacttcaaaatgttgctagatatttctatttaatatattaaccaaggaagcacacatatttctatataataaatttagttttggcccggtgcggtagctcacgcctgtaatcccagcactttgggaggctgaggggagtggatcacctgcggtcaggagttctagaccagcctggccaacatggtgaaaccccatctctactaaaagtacaaaaattagccgggtatggtggcaggcacctgtaatcccagctacttggggggccaaggcaggagaatcacttgaacccaggaggtggaggttgcagtgagccaagattgcgccatcatactccaacctgggggacaagagcaagacttcatctcaaaaaaaaaaaaaaaaaattagtttaaaaatttgataactttattatcagttttttttattatcttgatgatctattatcagtgtaattcatttcctttgtaattctatgtgcttttattcattttattcatttaaaaacattgttctggccaggcacggtggctcaagcctgtaatcccagcactttgggaggccgaggcgggcggatcacgaggtcaggagatcgagaccatcctggctaacacggtgaaaccccgtctctacttagccgggcgtggtggtgggcgcctgtagtcccagctactcaggaggctgaggcaggagaatggcatgaacccaggaggcagagcttgcagtgagccaagttcgtgccactgcactccagcctgggcgacagagcaagactctgtctcaaaaaaaaaaaaaaaaaaacaaacaacaacaacaacaaaaacattgttctgagaaggggtctacaggcttcaccagactcatggggctcgtgacaccgaaaaggttcagaacccttgctggaataacgtgttctaaaattcagaaacacttcaaaaaagtttgagaggatgattttacagcccctcagtatggctgtatggctgtccacttacattgactataattcccttgccatcaccatagagacagcttgtggactggctagtgcatgaaagagcagaaattgggtgacactgagctatattctaggcccagccgatgactcagggatttgagcatccatcagtgtttctttcttttttttttttttttttctttttttgagatagagtctcgctctgttgcccaggctggagtgcagtggtgcaatcttggctcactgcaacctccacctcctgggttcaagcagttctcctgcctcagcctcctgagtagctgggattacaggcgcgtgccaccaatgcctggctaatttttgtatttttagtagagatggggtttcaccatgttggtcaggctggtctcgaactcccgacctcgtgatccgtccgcctcagcctcccaaagtactgggattacagtcgtgagtcaccgcacctggccacatccatcagtatttctaagtgtaaataaaatttgtttctatgtgacaaggttgagataagcatagaagaaaactgctgctgaacccagaacccagacataatcatgtaactgaactttcttgctgcatcctatgataattcccttgttgctagcttataaatagcggaaaacagccaccatttcttcagcttttctccagaagggccaaagatgttacatttatttttgtttcttcttcttaaataattcttcatgaatttcagtttcccagaaggcctcacaattttctaacaccccagatacctttcttggtatttcatgtcatgggttatgtttatccaaggagactttattcattggatttcttaataagaaagaatgacttgattatttatgctctaatattccctatgcttttaaaattgctgacccctccctcctcctgtatcatgatactatcttgcagggaaagtagaatctactggatgaaaagtccctcaacctcctgcccccaaacctattgatttactcatatccacatactacatcacctcctcccccttgtgagggtggaagataagttgtttttcctgtctcggacaaagcatcctgtctcctatagtactgcaacagattgaatccagaagccgatagaaaaaacccactgtcatctgtcgagcaatgtattaaagagatctatctgcaaaattgtaaaaagatgctgttcttctcaccaaatgtttttgttttggaaaatatggttatgttttataaaaagatatgacttatgaaatagaattgttgtttttaaatacataaaaaatatttcaataatttatcagttttactttctagtatattagatatcggtagatgtaagcaacatgcacaaaaactcttcgggggtcctcaaaaatgtttcagagtggaaaggagtcctgagggtgaaatggttgagaagtgctggtctaaaactccccaacccagtcaaatctggcttctgcccatatcagttcactgaacctatttgctccaaggacaccaaattcaagggcaagtccttactagacttctgggaatcattcacactgttcttgaccgttcttctggaaatgcttttcctctgacttacaggagtccagagaggaacaccatgtacactactggtgttcttcctacctccctggctcctcctcctttatctccttcatgggcttttcttcctctgcctaaccttaaaggttaacgacctgtggggccctcacctcctcccacactccatgcttctttgttttccgttaccgtctttaggctggtgacagctgtgttcagcccagatctttctgccaatcttcatacctaaatactgagcagcttgctgggacacctctacctgcctattccaccagcacctataatttaacacgccctgaacttatcatgtcaccatcacgcctgctccttcatctctattctcatggcccacactctgtctagttgcccataccagaagtttggaaaccattcttgactctttcctttgtcttaaaccctcactgtctttcacaatatccaagcaatctccaagctctgtgtcatcagtgtcctgaatcctcaaaacaatctgctgttctctaacttctaacactgtcccacccgggcctccattgtctctactaatggcagtagtctcctaactggctcttttctagcctgttttccactgtgccaccagggtcatccttccaaggcacagagctcatcaattcactatttcttcaaggccctgaaacacttgtcccctccacctctcacctcacttgctgcatctctcatcacctgccctccctcggcattctgtgctggctccaagggcttccatgctgccatgggctctccccttcagcccctcacacatgctgatccttcatccttcatcctgggccaccatccctgccccatccccatttacaccttcttaccctgaacacaggcagtgctgactaactcaacaccggtcgttgatattcaagtttagatttctgacacacatctagccttctgtaacaccctatgtgtgctctgtgatggcgtttgtcaatccacacatgtaaccgcatgtttgatgtgaccttcagaagggcagcagccttgtctctcttacatgtcatagaatcctcacagcatccttttccagctccatcacttaaccacaatctctccgtacctatttgtcgaatgaggaaattcgtatttcttttcaatttatctttcactttaaaggtgagcagatttactgattttcctttgtcaaacaatcacaggtggcttgagcacagaaaggcagtgatttcagtgcttacaaaaatatagcatttataggtgttcgaagacatggatataatttcacctactgcctgcatgaaagactatctgcgtcctgattggcaatgggagttggcaacacattgaccaggttaagtcttctatctatatatgaggagggtggggtgtgaggaattgacatctgatcaaaagttattgtcctaagaagtatgtcaccaaaagtaattccatttttttatgtcaaatgtgacctttacttataaaaaccctaatgacaaaataatcctttttagaaaactgttttgtcacatctgtgagacaatgtaactacagaagttaccacaacacatatgttctaatcaaataatattggtaggttaggcttccatgctcacgtctcaaaaactaaaatatttgcaatggaggtaaaaggctttttctatctttttcataaaaaggcttaatttaaggcctgatgtggaggtttaagcctgtaatcccagcactttgggaggtcaaggcaggaggatcgcttgagtccaggagtttgagaccagactggacaacaaaggaagaccccgtctctacacaaagtataaaaaattagctgagcatggtggtgtgtgcctgtggtcccagctaccccaggaggctgaggtgggaggattgcttgagcctctgggagttccaagctgcagtgagctatgactgggccactatacttcagcctgggtgacagacagagaccctatctcaaagaaaaaaaaaaaaaaaaaaaagctgggggggcaggggctgaatttctagttgatcacataaggagaccagtgagatgtaaacctaggcagtgtcccaaagctgttccggttcttgccttggatatcttcttgctgtccattcttactccctttattatgttcttccctcttgcccttctctcaccagaccttcatttccacaaacacttaggaagtaaaaaagtctaacatgtttgaatccttgaaaacagggtgtaaaacattttggtatgtaaaacatttttggtatgtaaaacatttcctttccggtattatcatttaatgtgtttaatcatgaattataagtgagtatggctttggggcgtgcttcttttgaaaagaaaagggcacatgatcaccacctcctgtgtctcttatctggtacatttcccttgaaggactcagctcattatctggcaaagacgaccatggtctacaagtcagttgggttcaacaaatgcttattagccatcttctagaaacagatatcgtgtaggacgctagagacaggctgtaggctttgatatttggggtttgaaacctgaatagggagcgtcttcctcttattacattcactttattcaatcctattcatctgaaaaatggggaacataggtattatttcaaatagctgttcaaacaatcctagtttattcatctgaaaaattggggaaattttcagatgaataaactaggatcgtttgaaaggctgtttgaagaattcaatgagataatgcaaataaggtacccagctcggtgcctggtacccaggagaaactggataagtaatggctttcagaatgattacagaggatgaggaaagctctccaggattccacagtgagctagaaagcggtcttcatttttgtaagaagtgaaacatataggagaaacaaatgtgaaaatacatttttataaaagtgggaaatagttagtcaattccactctgaaagtaaccctcttgctttttggtttaatctgttatagatgaaggggattaactgccaagagacttgaacaacacacaggttttttttggttcttcatgcttgcacctgttaaaaggcagaagaggtccaaaaatgggaaagatgtgacttttttgtggaggctcatgtttactagagggagagaagggcagtagaccgcatatgtcatgtttgttcaaactgagctgagaatttgaggggaaagggttttcttgacagctgggtatttcatatcctgcctgtggaaactcagtaggtttccaagagcaaagtctagaggctataaccttgtgctcctgatgtccttgtgtgaaaggattattttctggctttggaagagcaaaacacctcttaaaaattccggctcctgaagtgttgttgcagtgagccgaaccaagatcgcgccactacacgccagcctgggtgagagagtgagacgccgtctaaaataaataaataaataaataaaaaataaaaaacaaaaatttcccactcccgaaatctgttggtacatgatttcattctgaataaggtcatggggtccagttggcagtaatcaaacattgttcaaaacttgaccctaaatcgtagttcctcccaaaggtcttggaaaaataggagattaggttttaaagggaaggaaaacaaatgagtgcttctccttaattatgcttttggctgccactgtggggattatgagctttaagcttctaagcttccacctttttgatatatttcctgttactgtattattgttgcccaagtgagggtgggggtgcagaaaggtttgcaagggaaaaataacctcatcaatgtaactgaaattcctttctctgcaattcagtggctgactttattgttattgtacttttgaaagatttgtacagttgtctttcaattgcataacattgtttttcatttatggagctaattgcctgctagttactgatgctctttaaccttatgcattgaacttttactcattttgaaattagataaacttcatgcaatgatgttagcatgtggggactgctgacaaagcccaataaagctttctgtgcccaataatctcaaatcacacactactggatggcttaggcttgtcagcagatactaacaaataccaccatgttgtcttatactgttaagtataaaacaagaaaagaaaaaaggaacaaaaaaaacagaaaagaacaagaagctttcaaaataaaacatatcatgcccttttgagtttaaggggccatctcgggtttttaattacttgttactagtagcatggcattttgtacatttgcacaaaaggaccgaaacttgtcattgtgaagaaatgatgggcagtatctatcttgggtatggttaccggtcatagagtagttctactttgagcttgccatacgacccttgtcatttcttttcagattgatttttcctgccccatgttaactatccagctaaagacacccttcctttgaagaacatctgcaatgaaggctttacttagtcactgtaattctagttctattgatttcattttctgttgtcactttttgtatataatatgctattccttgaatagtaggacttcattttaagacttttttcatatttctcaagaagctctagaaagaactttttcaaaaaatatttctcttggcacaaaagagtctataaaatatgatcttaaatggtaaaactgaaatctctagagcagtgcttatcaaactttaatgagcataattgtgacctggggatcttgttaaaatacagactctgatcagatagatcgagggtgggacccgggcttctgctttctgttggtcaagggaccacattctgattagcgaggttcaaggcctatctgaagttcagacttcaacttagacttactgcctatgcaaccactgaccgtgtatctcccaaatgctccggtctctccatttgggaaataattatgccatttaccacatcatgaaaatatatgacagctttcaacattttttaataatctgaaagttttctgagcatccctgttcaccagtggcacatgaattacaaataaagattataatttcagaatcttgtgtactggggcaaaggcaatgctacttctataatgcgtttgctttgtcaaagacgagccttactctaaatccctcagtaattcagttttttttcccccaagggatattttctgtaggttgaatatgaaaaacccttctttaaaaaatattcctaaacagctttaattatttgtaccgaattagtcacttttcctgacatgattcaggaagacaaaataagtaagtagagtgttgccttcttcacaagacagacatacctactgagcttatactcgtgcttaattttttttctgtgcctttattttgttaggccacatttctcaaagaagtgccaccttcctcctgtttagtctttttgctttgtgttccatcatgttcttctatctgcttgtcagaacaattttgaaagttatcagaaattgccagccaaccagagttgtatttcttgttcccttctcttcattgtcagtggaaacaaaacaaaaattatgtgtaaaagggtgctgtctcttgtttttcctagagctctgggcctactaaaccttgttccctgtcactattgagggaatctgcaagcattacattatagatacaaagtaaacttgttttatagagattaacattggaatctaagagaattccctgataagataacagctggtatatttcttatgtctcatgcattggttctcaaccgggggtattttgagacacttggcaatgtctggagacattttggttgtcacagctgagggtgggtaggggctactgacatcctgtgggttgaggccagagatgttgctaaacatcctacaatgcatgcggcaactccccgcaagaaagaatgatccagtcctaaatttctagagtgagaaggtcttgagaaaccttgatgtgctgttactcaatacagtcttgattgcttagtgtggttgttttactctgtctttactattcttaaattctactggactttattttgttttgatgcatgagggtgttagccacgtaattcccattagagtgatgagaattgtgtatgtaaatactcttcggcaatgcagttggactctcatgaggatttgatgatatcttttgtataggtaattttgtatgctttcaacagcaggtgattttccatatatactaaaccattaaaaattctagaaagttatttttcaaatcatgaatgtcttatgactgttacttgagcaaatttattttaaaatacattttgacaataactatctcttgaggaagactgggattcccagactagagggattgatccctctttctggaagaaatatggagtagttttcagtcagagtattttaatgtggcttcaggagagacacattatagaaacaagatagtaacccctcttgaattgcactgatcctgattgcctgtgaagaagatggttgatctctgcaccatcttagtacagagatcagtggccctcaaatcttctactttcagggctaagaggggcctgagggatggttgagagcagtcccctaaccttagagatgagtattcgcagttggaaactgattattcatggaatgggaaagagattatacaaagaaaagactgggtcctgaaatcagtgacccagtttgagctaatgtagacaatcttgttttgcataaggccttgttattctttctcatcagggctgctaacctgaagaaggaagtctgcatgccgcccacctttctctacccttaatagaccttaagccacccccaaacaaaacaaacaaaaacaccacagaacagggaaaatggaaggagtaataaagtaacctgatctgcccttccataatcacagaaggatgcttgctcatgaagaacactcctatcagtccgatggttaatttcacctcctccagaagccatctcttagcttctactcttctagcatgcactcaaatcttgacttggaaataaaacgccctccatctgatctctattttttgaggcttctagctgtagtttttttttgtttttttttaactggattagaatcctggctctattactagctgtgtgacctcagggaaattacataaattctctgtacctaatctctgaaaacgagtatcataggagtccttacactgtagataggatggtgagaattagctaaattgatatatgtgaagtgcttaggacaaggtttggtacattgtaagcataatgtaaaacattagttatcgttatgatgtatatacatactcacttatatttgaacaccttagaacttaattttgtttcgatgcaaaggataattaattggttgctgaaatccctcctccagtactttatcaccgcatatttaagaatgttctgtctctttagtacaaaattttacattcataatgagttctttttctcccccagttccatcctcatctcactctctcagggaaaaaaacagtctaccaatcagaattgggctagctgaaatcaacacacaggccagtgcatacatgttctccttgggtagacaagtactatgcaaacacctcaagctaagggtactagatgagtaggcaagtgatgatgaaaacagagggatggagacaagctaggagaacaggacaatgcaagaataaaaggaatgaagctaaaggttggtgtctttggggctctgagggggaagacacaatggagaaggcactagtcttctgggatgatgtgagcctttgtctggaacaagatgctatttaattttgttttacttttaatcaaaaatgtaattgcaaatagttttaaaaggctgatggtactaaagggcttatgacctcaaaccaaaaatctgttacctcctcctttcccctgccttgccctgctccccagacacaaatatatttaactctcataccttatttattctagaagtatattcttgaaaataacgcataagtcacttttttgattcatccgattttagacagtatcgttgactttttattatgacagataaggatgttaatcattttccttttttctcttttttttttttttttttttttttttttttgagacggagtctcactgtgtctcccacactggagtgcagtggcgcgatctcggctcactgcaagctccgcctcccgggttcacaccattctcctgcctcagcctccccagtagctgggactacaggcgcccgccaccatgcccagctaattttttttgcatttatagtagagacggggtttcaccgtgttagccaggatggtctcgatctcctgacctcgtgatctgcccacctcggcctccccatttttccattttaatcacattttaactttaaaaaaaatccacagtgttttattgttttgatgatgtaaatgttattctctgcctagccaagtatcacagtatgattatatttcctttcttaaagaactgttttggttttataattgctttttgtgtttatttgtttcttaaccatctggaaaagtctatataaaaccctaacaattccttaaaatacctctcaacacaattttcaccagggtctaacatgccagaaaattgatcagtttatagttttttcctggatttctcgaacctcttatttcaatcttgggtatttttttctttaggctcacttggaagctctcaagtgaagacagccatcatccaacaaatttcctttgtttctttcactggtgctggattctgtttctcctaaattccatttcatcttctgcttaggtttactccctctgtttgctggaacatatcttccagtactttattaagaaggagtgcatggctgtaatatcttcgcttctttctcagcagatttaattatagtatctttgaagttattttctgttcctttgtccctgtttcatctgatttcctctgatttctttcattttttttcttaattttcatcatttgttttctctgtgtgtgtttggttgatttccatatttcaatttgtagttcttcccccaatgtcatgtggtccttgactgtctgctcatattgaaaatgaaacaggaaaaaaactagttgcatgctccatgtataagattagggcttgtggattgatagacttcactgtgggataactgggcagacagccaaccatttctttggaagaccccaaatattactactagcagctcttttcttggaagcatttctatttttctggggaatgaccccccaatctgctgcctgtgtcaggggaagggagctgataacaagcctgggtgacagtcttctccagctggagaaggggaagacactgggaactcgccattcagtatgctgacttccacatgagcctcccattttcaatgctctgtggcttctctgtccaaggtgactgcagcctctctgcttacatttcagtttcttctacggcatctccactgattgtggaaggatggttgtttgactgcaatcagtagggggtgcaggcccaccttaataaagctctttctcctgattatcaatcaaggtcctcttttcagcctcttgcctcactctttctcccactgtaactgtgcctctgactgctaaaaccttctggagttctgcagaggtagaatgcttgcttctcccattagcaccccacctcttccaccaaagcacctagcttccacctttctcctccgtgctaactttatttggctttctttccattctttctgtagttgggggtatagttgtcatgaagttgatggagattgtcctgtttcttattattgtttttacatagttttcaaaggtagagggtgtaatgtctttcccctgccattttgaaagcgtgactctgatgccctttttgtgtcctgcaactctaaattgatgttatggtttgaatatgtcccttccaaaattcaggtgttggcaatgcgataggattaagaagtggggcctttaagaggtgattaggctgtgagggttcctccctcatgaatgagattaaggcccttataaaagaggcttcagggagtgtttgtctaacttgctagcttgctcttctgccatgtgtggacatagcatttctcctttctggaggacacgggattcgagatgctgtcttagaagcagagacaccaggccccaacttgccagggcctttatcttgggctttctggcctctggaactgtgagaaaataatttcttttataaattacccagtctcagttattgtgttacagcaacaaaaaacagactaagatagttggtaatagttttcttttacctgactcatagggacaaattactggagtagactgaagtgcaaaaaagctaagggttgttcttatatgatcttgtttaccataattccatcctaattaatttggtagtctttccagatgaaatcatttgccattccccaagcttgacatgcactttcataactccatgaaaacccttactgaatgtgactttcaggaaaagacacacatctgccaagtttcctgtcctgagtggagtttcctcttggcaggtagccctgccttctcttcagtgccattgttgatttatttacccatcagtctcccaaaccagataggaaagctttgagggaaagacatcatcttatttattatgaatctttgatagcagagttccttgcttatagtaggtgctcaattaatatgatcaataaatggatgaatgatacttattttggatgatagttctcaaaaagacaaagacagggttcatcttaacgcctggttttgcctcttttcctggtgccaaggccagtttcactagcagctggacattgatggccctcaatgacaaggtgaaggataagttgttgctgaacactcgttctgattaatgaattacccttttgagtttcacatctttattttatggccactgcatttatactcagtctttctgattcatgttaaaatttgttaaacattattttctaacatatttcacagatatgtaattttgtctctaggtaaaatgacatcattgaagtatttttggggtgaaaaatattctcggaagcatctgactctggctgctagttttccagaccaaaattccaataacattcaggcttcagaggagtatttgtattcaaattacagagagaaattcagtcttctcctttaattacaaaccaaattgcacattaaacatatttcagagagatgcagctttctattttggcttttaggaacgtatcttcaaccatttactcattcatttatgcaaaaattcagtgaaaacccactatgcgtcaagcaatttggggggctttaggaatgcatatatgaataagatatgttttctgctctcaaggaatcaaggagagaggaaaacatagagaaatcattataatcaaaatgcaatgcatcccctatgaatatctatggatcgtgagaccagtgtcaaagggtatgagcatgacatctgacagcagagtttctataaaggaaataggtggttatgttcttctcaccatatttttgaataacagtatgaatgtaatctgttcaagcaagatttagattctaacccatgagacatttactgactacctactatatgccaggtgaggtgcccaatacttaacacatatctcataaaagtagcaagatgaacttcagttgcattaatatttaattaaagcagaacagaataaacccagtaggtaaatagaaacagttgagaattttccatccatgtccattcccatgagatttgggggttctctcaaaggcccgcagagtcattggagtattcacgcccttttctcctcactcagtgcttcctgtgttttagggtgtttaagaattactatataagattattagacacaaaatcatctataataaaattcatggttgataattttgtttacacaatatgtttgccttatatactaaatgtgttttctgttaagaagcaatttttacttgctttggttcacatcagttcattttaaacacgaaaaaagcaatacctttaagaatgtgtcatttctgccttatctggactaccacattctctttattgaggactcaaattctgccaaggagaaactatttatttgaaactaaacaaagagaaaacaggcctacggtctacttacagagagaaccagagcccctccctgcctgccttaactcagggctctacatctgttttagacaacttttgggcagcattgaacattatgagcccatgtctgccttgggcctttgcacttgctattcacctttcttggaacatagttcctccagatattagcacagcctatgcccacattccctatcctcaagtatcatcttctcagagaggccttcactgaccactgtaaaaactagaagcccccacttcccctccagcacctgctaaactccttatcctcctgaactttttctgcatagtacttaacatccaaaatagcatgtcttagttatccattgtcatgtaacaaattacttgaaaacctagcaacctaaaacaacatttatcactgcacagtttctgcaggtcagaaatctgagcacagcttatcttggttctgaggcttaggacctcacataggttacaataaaggtgtcaaccagagccacagtcatctcagggttaaactggagcaggatctgcttccaaaatcacccaaatggctgatggcgggattgaattccttgaaggttgttggactgaggggctcagttcctctctggctgtgggccagaggctgtcttcggttccttgctatatcagtctctcagtagggacgcctagaacatggcagctgacttcatcaaagtgaggaagcaagatacagggagagaatgccagcaagatggaagctataatctttcaatcataatctcagaagtgaaagcccatcattcttgttgtgttctatcattagtagagaggaggtgttactatgttgcccaggctggtctcaaattcctagactcaagcaatcctccagccttggcctcccaaagtgctgggattacaggcatgaaccaccataaccaaccttttaactacagtcttttatgtagaaaatgaagtgtatttctctgctatggaatgcaaaaagtagccatagaggttagtgaaaacaatattccaaaaaggggaatttcaaagtaagcagctgagttatgaatatacttcagtatcctaaatagtcctttaacattttatgagttaattttgagctaccttagttgtcagtttgaaaatcacggttgagcattctatctaagctttcaggagcagagaagtggtttattatcttggagcctgtttttgtaaacaaagtcatgggcagaccagaaaagtgcagagcaaaaggcaatctatttctgctgacatggaaaggagatgaataggattaagctataaatacagcctggagattgtcatctcttttcctccatggacgcaacagtgcctcacattacaaatgatttccaaggacctgaaaacgtggaaactgaattggcctcttgctggtaaggagaaattactctccagaggttggccaaaattcacagttccatcttctgagttaactgatcaaaggggagtgagcaggtggtacaatttgaaaacaagttaaaggtagccaagagtggaatcaggggtgaagatactaacagcaagaaaaatctgctcagaatgcagatgattcaaaaagcacgatccagaaatccaattcaatcaacactgttttctgacaacttattatgttcaaggtatgagggcccgtacaggtacaccttacttcctgcccccagataacttacagtctatttggaaagaagataaatatttgagaaattcagcagcaatgaaagatttcagcaaaagcagaagagcaaccagctgacaatacattttcagttgccaactaagtgatatcagccttaaataggagttcagagaaaggaaataggttagttagcctgaaaaaaaatcagggaaatatttgtaagcagggcgaaatctcagctgggttttcaatatgagtatgactttataggtggagagaagaaggggtaggggtcttcccggtcagtaaaactttgtaagtttatttaaaagcttggaggtgataaaatacgtattgtgttcgggagtagaagcttcaagcgtggagaagagagagcctgtaggagactagtggaaggacatgactagtggaaaagtctcgaagctgatggtagatctcagctctaatgctctacatgatatgacttttttcacacatggttgtgttccttcaatgcttgtgctttaatttgcataaatcaaataatgttttaaagatcctgtgagaagttgctgtttagggaacctctgtgatgaatatttaactctcagtgtaccaatgaggataactttgtcaaattacaagtttcctaagttaatgtaaagggttgtggagttggtttaattcatgggttaagcctacgccttcttctctccacctataaagatttttactgtttccctgtgatggtcttggctctgctctcctctcagtgtaggcatcatcctcactctgttttcaagatggaggtcctcctgtctgtgccagaaaacatcaaaggaaggaaatgcatctctgccttaaactctccaggaagtgagattcttctagaagctcccaggaaacttccactcgaggctccttggccttagttacatcacatgccctttcttcaaccagcctctgtaagctttgaatgccatacccctgtttagctcagacctggcttctaaaaccacttgcaggcaggaatgatgggagggacttagctggtttagaccaatcagggcccactcctggtgctggggtgaatacccaaagccaaaagcacagggcagctacacagtgcaggaggcacagaatgggtgttgggggaaagccacaaggttcaggcattcatgttttagtttgggtgcaaatatagaactttatatacagtttgctttttaaaaaactactgttgctattcttgcatttactcagccatgttaattgtaggatcttttagccaatgccagcaaaaatcttgtttcagattttgaatgggattttagcaaaaataactttgagaagtgatcccttcacagagttgaactttttcatccttgaacatagtatgttactagttattcaggccttttatttccgttaatattttatacttttttaatgtgtggttcttcatctgtgttttcttcataacaatttttattagattcatgcttactttatagtttttcttactattataaatggagtccattcttctattacgtactctaactggttaaaatgtggcatttagagtcttaatgattgttatatgctaatctaacctgcaaatattaaaaatattatttcttcctttacaatcctaaaacatttttaaatcactctgttaactggaatctctagcacaatattgaatatctattgtatattcaatatatactgtatattcagtatatgctgtatatacagtatattcagtatatgctgacagcagatacttttagttatttctggattttcactggaatgcatcttaaacacatctaagtaggttgttttctgtacatttttagtaggtagccttttaatgacttaagaggtttccctcttttctagcttactataacatttttttttatcatgaatagaggtttgatggtagtaaatgctttctttgctgtgattatgattatttgtacatctgaattcataaataagtttggccttattttcctatttgtcttcgattttgtttttgtggttatgctagtctctagaaacaagtttacaggctggacttcttttgtgagtataaaatagttattgtaagataggaatcattttactagaagtttacttgaaatctccagtaaaatcactagacctagtgggagtttttgtaggaacttggattactggcccaattgcttttgatctcttcaggtttattggtctattcagattttcggttatttctttgtaaaatttcccagattttaaatttattaccttaaaattatgtctagttttctcttaattctgaaatcactacagcatctgtggttatgtccctcttttattttctttttttgagacagagtcttgctctgtcgcccaagctggagtacaggggtgcaatctgcgctcactgcaacctccgcctcccgggttcaagcaattctcgtgcgtcagcctccagagtagctgggattacaggagcccgccatcacatctggctaatttttgtatttttagtggacacgggtttcatcatgttggcctgagcggtctcaaactcctggcctcaagtgatccacccacctcagcctcccagaatgctgggattacaggcgtgagtcaccatgcctggcctgtccttcatttttagtattatttatttttgccctctctctcttttttcctctttctagaggtttatttcattagactttaacagagtggatattagctttattgagtaactctggtggggagggttgtttggttggttttccaaacaagttggtttaacttcttttacatttcattttcttcttcttgcttcatttggcattttccagcttttaaagctaatcaattaatttatttttagctcatttttattttctgaaataaaacatatttcagtaaattcatcccactaactttgatatggactagctttaataaaaatattattttatagtatttttctctcttctttaaccaagaattatttacacataatttagttttcaaatatttgatatttgaagtccttttgctttttttctttactgatacataacagatgcatatattttggagtacctgtaataatatattcatataaagaacaaatcagtgtaattggcatattcatcaccttaaatatttgtcatttcttcatcggtttacttatctttgctattattaccttgtgatgtttgattatagtgggtatgaaattagatctttaaaattaagagagaattattttgtcctaatacctagatgatttctaaaaagctgaaaatcttttagtacatgagtttaactgatttatatttgttagggctattgaaatatttgcagtaatttcttatatcttctctttttaatttttaggttttttattttctaatttctgtagagtggattgaattttgtgcctttttattgcttggaagttatgcatttcatttgtattatttttgcttccctttcttattaacaagcttgctataatatttttctggcaaaatctaaagttaattagtagttgccctcccaaacaagacactttagcttccctacaatagtcccagcagggaacctatctatccccaactcccaaggtggtattactaggaatctggaattttaattccaatttattacacacacacacaaacacacacacactttttccaggtagtatttatttagatctagcaatatattcttttttctttctttctttctttcttctacctgcctgtcttacccattttttttccttctttttttcctttcagttaggctgggatagtcctaactcctgctgtgcccagctgtggtctttcagtggcaaaccgtctgagttctaagcttcatttcattcttactcttgaatgatggttttggattctagttgttttcccctcagaactttttcagttttactcagccctttaaaggtgttactccattgtcttctggaatttactgctgtgataagaaatctgaattaatctctttccatctgtgtctcataggtaatctgccttcgtctcttttcctttcacgatgctcccattacacttgatctctgaggttttgctatgaagtagctgagactcaagtgaacctttcctatgagtttataaacgttagtctattctaaggctttactgagaaattagtcatactattcattcagtttcttggttagttgtaatttcaaatagaataaaattttgttttgtgagttctgcataggatcaaggatcaaaatttactgctaaacaatatgtggatacctccatctgttttttacctaaacctagaaaataaggcagagaaatggataaatcatactgcttctggcctttagaaatttattattttgtgattttgcagccctaaaaagaattagaagctatttggattatatccaactatattatttaacaactgagtatgtcagcaaaccaactcacaaaaggttttcaggtgacgttataagggaaactatttccacaattttagtaaagttctaaaaagtcagtttaagcagacacaacacacaaaggctttatgaaattagaaatccaagagcagcatatcaatgaagtgaccttaatttgcctatcatcctttatgcaacttgggattggatataaaattgttctacctccttggtcattaaatatgctagtccattaatgcaatttgggcaatactagattcatagtgttatataccagactcttactgaaaagacagtgttgggggaaaattgaatgtgtatattactttataattccaaaagtggtttctcattcattatctcatcattcctagtaatgatatggagaaagtattagtattcttattttagagagaaggaagcttcagagatattcaggatgtctcccaagcaagagaacttagattaagtcagacagtctgggattaattcagtgcatcacatgtcaccttgtaggtggtaggtgctcaatacatatttgcttaatgaaggggtgacaaaaaccccgattctgatgccatacccaaggcactttctactttcacggctgcctttaagtcacatggaattacacaactgctgtggaggtggcaagaaatagaagtagtaagaataaaggaatttttctaaactgaaggtgaagaggaacactgtgaggtagaaactatgatttccattttatggatgaggaaaccaaaacttagcaccaggagacagttctctgtgcgtcgctcacctttccacgtgtcttccgagcagaggtactaactgcctttcttccacactatccttataaggatatgtttgtatagtgaacaagtttagatgacagaggtagtgactccatccagagcaaaggcagagttgttcattgtccagtataataaagataatgtctccctccaggacaaagttcaggtgggcttatgaaatccattatgaaagattcaggttttctacgttcaggattcctgtccagtaacccagtgtatgcagccgttgcctcactctctttgtgtcttccaatgggaattggggttctggaagtggcacaaatgctaatactctggctacggctattgctctgagtaataaatccctttctctgtgacctaggggtctcttgtcttctgcaaacatccgtgaaatgatggcagactaacacgttagcttgcaaatagggtcaaatctcaggcttttcattgttcttgacgcttagcaagactcaaaagcatctagctcctaagtacgggattcgaacctaggtgtgatggacctcaaaaccagagctcctaacctccactctttactatttcccatggaaacaggcatgaatcatctcagcaagagcccgtggtgttgtgctgtcatggtgtaaccgaaactgttttattattacattctgaactgacaaagtccagagctcatttcgttttgttttcttttataacccttgaaattatatccagccttattcaaaggcaagggaaatgggtgacttagattgtatgaggggcaggagaaggtcacctgccagcagatgtgatgtttccattgtgagcaattcacattttcctattgaggcattgtttgttaaaatgccgtattttgacttggttcaacataccaaatggttgttaaccgttggaaccttagtttgcattagtttgatgacttgacctttccaaaaatggggggttgaaaactagagttctataaaatgagacaaaacaaaagaacaaagcagacagttaaaaggtctcaaatgtgagttgcaaaactgccagctcccgtatgacgtttaaaaagtcactagatttctccaagctttagtttttttaaaaatctataaaatggaagtaattatctcaatggattgctttgagggtctgatatataaggttatcaaatttagaaaataaaaatacaggatgccaagttatagttgaatttcaaatatgcaacagataatgatgtagtataagtatatcccaaatattgcatacaacctactaaataatctgttttgcatctgaaattcaagtttaactgggtattctatattttatttgcaaccctccagataaataatatactgtaaagcaaccttgatttgaggatttgtatttaaataatttactaagaaactactcccaggggtgactgtgacctgtaagggagtaggaagaggagaacagggaggggaggagaaagccaagcaaatgcaaaacttcagggaattcctacagagcagagcttcagcctgatcctgcagggagctctgggatgtgagtgacctggcagatatgtctcagccagaggtggggaagctggactttgatattacttgcatctctcagttagtgattaaggggtactttcagctctctctagtaattggcaatgcaggtccaagggccctagggaagccctgtaaagaagatctgcaaatgcaagtcattgaaaaggaaaacacatagggtgtgtggggacttgggaggggggggagcagcaacagaaatgaaaaagaggggatctgaggaaacttggaaaggacaccaactgtatgcactatagtgccctataaacttacttatagagtaccatgtatggttggtgacagattaagaggcaatgagaaacaggattctcagtgaagaaaccaaagagatagatagtgaagggccctactccccaaaatggtaaatgtcataattcttctgatagttctagctattagaattgccaaatggtaaatgtcataattcttctaatagttgttctagtagttctaactagattttgatgctcatttaggaggttgggtagcatctcctctccagtttcatttgcatgtatctgcgaataattcagaaagactgcagcccctacagaacaacctcctcttcactgtgctgttgaaagcccagctggaggcaactgtaaacttacaatcgccagcccttgcaggacatctcttagggaaactacagagcataatttggaagtccatgaagtgctacatggctttgtctaaaatctcatggggagaaattgaatggccttaaactgatgcccaaattgcatatttaaaaaaccctctaatttggaggaagtctccccaggaggctgtctctgctgcttggcctataaaactctaaatattacaattaaaaataacaaagtacacaactggaaaataacatctattgaaatcataatttattcatttgtttgttttttttcccccttctctctccttcaaataatacctccacgacaaaaggatcctctagtatcacactcactccccctcattcctgtgggagactcccaggatgcaaaatgataggcagctggggcagggcattttgccactgccttctgcattatttagaggcaataaggagcaaactgagaagctggggaaagaagaaaagagtctttggcaagacacattggagtatttctttttaagaattgagtgtttgggaataaatgaatggtgtagtagcaaagtatagaacaaggtctctcaattctgtcaacttccaggtactaaggctgtcacaatgataatgacatgccttttaactattgagcccctccctccaagaagttccacctaaggagattattttaatggaaccatggttcttgaaactgaccactagggagcaattctcatcgatatagtttagcaacacatagctctttagtgactttagccacaagaatttggggagttgggatgtttccaagcacagtgtaatgagctcctttcagagaggcacagctttctagagcagaacttcccaatcactgtgctacaaatggatagaggcagggtaaccatatgtcaccgtttgctggggcagtcttggtttatatctgtagtcccagcaaaattattaatagtgcctcctttcactagaaccattgtcctagtttggatgataaatatgaatgataaaatatatggttggttatatgtgtgccaagatttttatctccctagtcttcagggtggctagagtcacagggctgtttgcctcaggctgtgagcaatcttgtctattttgttccagtctgctatacaaatattaacagtgggcacaggataactatgaacactgccatggagacaaggtggtcttaggtgaaagaagaaataagtacagagaaaattaacatctaggatgcaagtaatgcagccaaactttccttgtgaatttgacaaatagaagtacttgtggttctcctgtaaagaccgtctaattcaaaactgtccaataaaaacaaaatgcaaccaaaaccataagataccactttacattctttaggattcctaacactaaaaagtcagaaaattacaaatgttgatgagggcatggagaaattagaaacttcgtacacttctggtgggaataaataatggtgcgaccatcttggagaacagtctgactggctgttcctcaaaatgttacacagagagttattatataacctggtagttccactcctaggtttatacccaagtgagatgtaaacaatgtccacacaaaacctagtacatgaatgtttatagcaacattattcctaatagacaaaacatgaaaacaacacagatattcataaagtgatgaatgataaagaaaataggatgtatccatacaatggaatattattcagccataaaaagagtgacgtattggtacatgatgcaacttagatggacttaaaaagcattatgagaagcaaaataagcccattgcaaaagaccacatattgtatgattttatttgttcgaaatatccagaataggcaaatccacagagacaaggattagattagtagtttccagtgggctgcagggaggggagaatagggagtgactgctaacaggcaaagggttatttttgggtttgatgaaagttttctaaaaatagaaagtggtgatggttgcaaactctgtgaatgtagtaaaaatcagcgagttgtacacttcaagagagtgaattatatggtatgtaaatcatatctcaataaatccatagcttaatatgtatatacaacgcaagccacatgtataattataaatttcctactagacacattgataggtgaaaaagtgcatatgattttaataatgcacttcatttttaaactatattcaaaatatcattttaacatataagcaatgtttttttaaattggtaaaatactgtacattctttttattgtactcagtgttaaaaattcagttttacactcacagtacatctcaactgagactagccacattttaaaaactcaaatatcacatggtactggcggccaccatagtagagggcgtgggtctaagtaatagttgttaatagctgctagcttatgggttttgtgtgtgtaataaggctacatctgaagactaaaatagcctaagctcttgagagagtttagtagaagtggaaacaaatgaaaacatggtttcattgggttgtgattattcttagggccagcttgtttgtaccttctagcgttattggttatgctgccaaagtaaatgtgggacgcagatgtttttgctttttgtggaaaaaaacacaaagatactaattgaacccatttaccattcatattttgacctcctggataagtgtgtcccagccacatggtgagttagccttctttgaaaaacttcaacttgcatatcatttgcgtcatttctctactttctgaatcagcctaatactcattttgacacttctaacttatcttgaaagtccccgttttttcatgttctaattttctgtccacctgatggttttcggttccttcaggtcttgacagcatagtatagaacacatcctaactcactgtatgttgttctgcccatcccctgatttcagagagatgtagggttttcattctcctgtagggagacataggggttattcatgaagcagagaaagaaaaaaaaaaatagaatatggggaaataagcagatctctttccaaaagctgaggttttctaaggaatatggaaaataagaggttcctaaaggaaaatttcttgcctgaccaaaaacataattatttctttcattaatttaggtggatgtgtgtttatgttgacaatagagaataaagggggtggtaagctctatgcaaagagggctgtaaagaacagctgtcaagacattttcttatgagaatgagaagagaactacctttgcaacttcaaaaatggagacatggtatttgtactttttcttttgctactagacagtgaagttcttgggacctaagggcagggttttatcttgttcctctctttctccacatcttagtccattttgtgttgttataacaaaataccagaattgcctagaatactgggtaatttataaacaagagaaatatattggctcacagttctggagttggggagtccaagagcatgacactgacatctggtgagggtcctcttgctgtatcattgcattatgggaggcagaagagcaatagagtgcaagagagcaagaaggggccaaacttgcttttataacaagcctactctcaagataactaacccactcccatgataaggacattaatctattcatgaccaaatcacctctcattaggcaccaccttccgacactgttgcattggggattaagtttccaacacatgaactttggggaacacatttaaaccttagcactgcagtacatatttcacttattctacaagcaaccatcctgacctgagtttgacttgggaaagttattacaacaaagttcctgttcttgatcctttgggagctctctcattatccctgtcttagaacttggtttagctggctccagggctttcatgatggatgaggtgtggattggttagttcctcttgcaatggccactgcattagttatcataaaatttcatgtagagcagtgtttctcaaagagtggtccatggttgggcatcaacagcatcacctgggaatttgatagaaatgaaaaactgtaggtccctctacagatttactgaatcagaaaatatgttttaacaagccctccaggtgattgtaatgtgtgctaacgtttgagaatgctgacgtagagcattctgtgctacattggtagtatctcatgcttcacttgaggggctttaaaaataaataaaaatggaaattgtggaagaactccacctgacaaaagttcaaatagtagaattagagaaaagatgtgcaaaaacagatttgggaataataatcagatcatttgttgaatgcctgtcacgtataagacactcttctagcaccttttgcttacattctctctattcctgacaacaaatgtaaaaggtcggtagttatatatccatttatatccctattttatagcagatgcaacttattcaaaagaggttaagtaatgcattcacggtcaacagctaataagaggcagcagtgaaatggaagttgaagcaaagtctgtgcacttatagcaactagacaggaataaatatgaattttgagctgttggtaagtggggtattgttattatgtacttttttattatgaaaaatgtttcatggctgacatggcatttctactctgttttaaaagattttggcaacagccatgagccagttcaacaatgtatgtcagatttgtttaaaggattttcaaactgtagcacaaagaccaagcctgtgcaggtctcacatgttcttgtgtttgataacatctattgtttacaaaatgagagatgctttatcacaagggttgttcaatggattgggcttcttactgctaatgtgacttgggtctgtgaactcaaagatgagagttgagagcaagagagagagaaattgtaaactcttattctcagggactgggtagaaaagggagaggctatctagaccactgacttttaatcttgtttgatcaaaacccacagttagaaatacattgtataatacatttcaggacatacatatgtacatatttataaaacaatcaataatgaacagaatatttgtagttagtatgtatgacaaacactgatgcttgctattttagtctatttaacttttcatactagccaccacccactgcagagattttgcattccactaagtagcaacttgcaatactgaaaatattagaatattgaaaaacattatttagagcacacattttggggcaattgaggtgttttgagggcctggaataaggaattagtattcctctagtgggaagaagataatcaaagaggctctcatcttgaattgtagcacccattattcccacgtgttgtgggtgggacctggtgggagataatggaatcatgggggtggttctcctacacttctcttgtggtagtgaataagtctcatgagagctgttggttttataagggggaacgccttttgctaggctcttattttctctcttgtctgccaccatgtaagatgtggcttttgccttccaccatgatggtgaggcttccccagccatgtggaactgagtccattaaacctccttttgtctacacattacccagtctcgggtatgtctttgtcagcagcatgaaggctgactaatacaccaggggtggctccaccccttttggggcatttggaaatggctatgagcatgatgtagctgtcgcaatgagagcgagcactgctggcgtttggtggttgggggatggaatgctgactgtggtgaggagcgtgggcaatcttgcatagcaaagtttgtcctgcccagcatgcccatagctctccagtggaggaatgcaatgtggacctttttgccaccaagccagtctggtccctcagatccctagcagccaaagactagatcccagggactctttgggctaggctcctgtggttccaaatgacgaaattaataccccagtcctaaatcagtgatggcaagaaacctatcagggaagcaacatggatgaccaaggcagaatttctcaacctcggcactgttgatatttggggccagataattttttgtccttgagagccaccttgtactttgaagtatatctagcagcatccctggccttaatgctagacgtcataagcactgcttttcaccccccagttgtgacaaccaaaagtattgccagatattgccaagtgtccccagaagggcaagtccccctcattaagaatcaccagtctaaagtaatgaagagaacgccagacaacttttattaagaatcaccagtctaaagtaatgaagagaacaccagacaactttttaaatgaatttcatgtaagaacaggcacttcacaagtagcatgcctggaacaagcctgccccctcctgcaacttttctgagtcagatggaatcaatgcaacacgtcagtggtttatggtcttttatatttccctaggttgcaagtggttagtcattttacagcctacctacgtcatggatccagggccttattctgtttgtttacatgtgaaatatataaattgaagtctgtacagattcctggtaaaatccagttaagacaatgcatgacacatggggccactgcagttattatcaaaacaacatacaaaaataagcatcatccctctgttaaggtcccttaattctcactgtgtttcctttctatttcatcacatcaaactaaatgcagtgttgccttcgaacatctgctttcataatataaagctgtcttttcaacataaatcttactttcaacttccctaggaaacatgctttggatttaggtgtcacgggtggtgactgtccttgtagaggactgtcgtggtaaacaaaggtgatatttgtagaatggtaattaatcacatgcagcaggtaatgcttgaatctttttagaatcctctgactgtgcatgttcagggaatgatggagtgtttgtatactcagtcaaagtgaaaacattttgttgtttccagacaaaacaagcctctcttaaaatttattgaattcctatttctgataaatgaaatgatctatgcatttgttagaattttgtccttttaacggtaactacatttagagctgaaaagaataaaaatttattatttaaaattcatgttatcggacaataagaggatcacaggatttgagtaaaaaaacaaaaaccaaaaacaaacaaaaaacaactacctaattcttggccccgaaacactttaataaataaaatgagctcctttcctgtaaataaaaattgctaaaatgtacaatgtagactaggcaaattcaagaccaataagtacagttttggtccttctgaattttattacttctgccattgattgagttaagcaatctttggctggaaagaaaataacattcctggcatatgcctaggaaatattaaattatccaggcaaatgggtttgtttttttgtgcaaggaagactaataggaattattgctatcttcatggaaatacagggatcataggtcgcttgtactgaaatgaaggtgcttctatttcatgctcttaacatttacatatttgatttcaaattaagtgatatgttgaagattaaacatctttggatacaatgagtgtggaaagacacatctgatctcatgtcagtcttttcctactgagtagtgctaccaatccaatatacacacaaccatactctccatgttgagcaggcatggacttaatgtcccctctggttgatgcttaagggtgcttaggatcccgcttgaacagcccacctctgctcagaaaactagctatctgatggccaagcaccctggatacaaggcttaaaggaattaattctctatttcatacctggctgatctgttcatacatgcagaaatccatgagtgtcccatgctatttgaaattctaaatgaaggaattttcacaatacgtatttaggccaaactgattgtggtcaaccctctgctctctgagaaattctttagagagaaaaaccataggataaacaaatactggatttagcaatcagaaaaattattcttaaaactttttttctaacttcccaactgggcaactgtggacaagttgctcaaactttttgatcctcactgtccttgagtgttaagtaagagttaccattttaactaccctatatctcaatattgttgtcagtatttgagacagtaatatatctcaaattgctttggaagctgagtgcactcaaaatataagatactgttgtcgttttttcagtaactgaaattggattatcagaatgactggacttggagaattagccagaaaaatttttcttaaaataatggaataatccaacaaaatataatactgacacaaatcatgctactactaataatgatgcttttcacttatttagtacaggataaagattgttgttctctctgtttatgataactttagccagtttgtctcttgccttcatcttggattctgattttatgtttcactactcatgatatccttatttataggcagttcaggccaggcagggtgactcacgcctctaattacagcacttcgggagaccaaggtgggagcatcacttgagcccaggagtttgagatcagccttggcaacatagggagaccaccatctctattaaaaatttaaaaattagctggacacggtggtacattcccatagtcccagctactcaggaggctgagatgggaggatttcttgagcctgggaggtggaggctgcagtgagccatgtttgcgccactgcactccagtctgggtgggagaatgagaccttgtctcaaaagaaaagaaaaaaaaagaaattataggcagaaattatttgaactggctctccttttattcctgtgaagagattttctaaatccattgtgctaatattaggggagagagatgtattatttaaaagccaaaggaatgattaaaaaaaaatagaaacaaaagctacaaaattaataaaaagaaatcatagggataaaacatcctaactctctctgtttgggttaggttctatgacctgtaatagaaaattaatagtaacagttatatataataatgataataaacagtggtgttaaaagacagaagtttatctgtcctattaaaaaaaagggaagttgggtaggacaaggcttggttggacactgcacagtcaccaagggaactttctgttctaccattatagtgaattgcttttaatttcaagttcatctcatgttgtaaggtagcctatgaatccatgacactgacctctacattccagagaataggaaaaggattgagacagaaataaggaaagacatatgatttctcagcataaagcaaatttcatggaaatcccattcaatattttcactgcaatatcattgcccacagcttaatcacatggcttcagtgagctccaagactggaaacatagccttttaactgctcatactcatactttttgaaagagagattattttaccaaggaagaagggaagctgactattggatagcagccagcaaaaactgccatagttttcctcaaataaacatgtaaccatctactaaactgagatagaatgtttgatggggaccttctatgcccagaataattgccaataaatcaatggaaataactctttggtttggactcagtgttgttctatttatccaaaaaaaaaaaaaaaaaaaagagagagagaaacagactgagagacataaactagagtacattaagccagtggcccctcatcttattcaggaaaaaaaaaaaggcgaagtcctcacagtgaatggtcgacaaggcccttcaggacctggcctattacctccatgacatcatttcctactgctcattccacttcagatccaccagccttaaatgtggcaagcagatatctgccttaggatctgcgcactggctcttccattggacctgaatcacttcccctggtatttgcatggttcatgtcttctcctccttcaagtctttgctcggattccctcttctcattgaaacctgcctgatccagagagaccagacgttttgccttcttttattcatagtatttagaaccctcagctcatccctgcccccctccaatgaacagataattaatgacactttcctctttttcagacaatacccaattgtgtttggaaaatggttttgaagaatctcttttggtctttcatgggttttctaattttctccttccatgagatacattttccgtctgtttaattgggaagagagttgagggacattttcagaaggtgtggtcttgaaggaaagggacaaagatggcatacatatcatattttgactgatacctatttctgtgtatataaaaatatgctcacaggtcaagaaccaggaaaaggtctttaaatatgtaatatctttgcttgtatttgtctcaaaagttttcaggctgttagcacagtcatttcttagtttacattgtaaaaccttgttttcaaattttatattgcttacagcttcccactattgataccctcagtgatatgtgtgtatgcccgtgtgtgtgtgtgtgtgtgtgtgtgtgtgtgaattctacttactttcctcttttccattcctgtctgtgtcccaagtgtttgcatattaaatacattttcctttttttccagcctcaatagctactttattttttctgagttcacttctcaccttctccttgaacttttatctctagcagctctattctttctcttttctaatcttttcccgctacctttctactattctctaatacttatactatgagacattatatggactgtatcagaagagatgctgtataattatctcagtagaatattatctcctttgctgactcgtttttcctctgtttacagggataataatgtcaaccacaaccagcacccaaattgcaaaaccgagaccaacaagggctgctgtatctgaaaggatgactctgactaaaaaaagctttatcttttcaggataaatacaaattgcttattttttactttgaatctcccatttaaattgtcattctcaaatagtaatgattttaaatttttcaaaaataattttagatcactcataattaaaatgggatttacagatggatatccatctactttgtcatacattatatcatggaataacttttgtttaatatctgcatcatattcattgccatgagtattatcttgacatctttttttcccaacaactagatgaggagagcaaggaaaagtgattaagaatttgccataatcagcagaaaacagctggtataacgggccaatgccaatttcccaacatggcagtaatctgcattgtcagtccctctgttctctgtcagcattatcatttctctcctgcaaggcctatgttttaacgaaaagtatgccccctcaaaaaaagattgaacatctcccaaattgaatatcagttaaaagcaagcctatttttaatattaatattcattttgtactgtgaaattgtcataacatgttatgtcctctcataaatgttgaaacaggtccatgattcagtaccattaaatcacttgtaaattaccactgatgagactaaaattgctacttctaaaaacgcactgctgtgagggcttcctgtagcttggtgaattaccacctcaaaactgccttacacgttgtcctgtctgctcagacatgatgaatgcttgatggccactgtcctggagctccaaatggcaagcccaggcttccagcccggcatggatataattatctctacttttgattttgcctgtagaaggtagagtagaatgtccaaaaagtgtaattatataatgtgactctcattactcaaaaataaaataaaaaaccacctatttggcattgttacttagaggcaagtagtatagaagcactgttggtcagtggttatgttgagttttgttgcccattttaaggtgttgtgtttatctcatgtgatttttcaaaatttcctacagtaggcagagcaaattaagcaaataaaggagagaattacgcctcagcaactgtccaaagagtacgatgttctgcttcttgaaaagcagatatatttttaaagcaaagtagctacaggaggtcagtcttaatactggaatggttagagaaaaaaaatgagggaatggcaaggttgctcctttagttttagattttttgttgtttatatttgtttacttttgaagtgaataatttacttaaggtatttaataggaaaaaaattatgtcttcttaaaaccagcacaatctttcctggtaattctgaggaagtatttctggattccattggtgggagtaaaatggtggcaataaggtcatcgtttttttcattagcgtatcatccctcagtatcagttccgagttattttgatatcaaggaccataaagctggttacaggaagtttgggtttcccagtaggcaacatttcacactatattctatcgtttattcatttataaccatcacgtattaagcccttttatgtgacagaataaagtaaaaacagaacatgactttgagctagggataacagcatctgaaaaattcagccaagttttgatttctgatatagaatgagcactttgatgatttgcatggattatgagtttatttatacaacagtgaacctctgacttttattttaatgttctacgctcctcaatcgaacatattaacataccaaaccaaaaggttgacattcaaattttattcttctgttttatcgtgaaggcttagttgttatttccacatgttctattttgtaaatgcagatgaaataaatatggtgcaggaaagctttgtttgtaagcagatttgctacttgtccagggaagttttttaaaaaggcagaagaaaactaatctttattatgacttcttagaatattcaaaaatagcattgtcttagctaaaagttggtcttcagattcataagtttctatgtgaatattaacattttaaatgagttgtgcttccagacataaatcaatcaatgagcttatctttttcctaaaatttcaatgatggatctgtaagctttgatttttcagaaaccagtgatatcttagagattttggaatacaaaatatttttaagagaaggtacttggaaaacacttgtatgacaaattcctattttctaagctaagaagacattccttgctctataatctcttctaaaagtcatgtgagtgttgaaacaatgaaatttctggaagaactacaatactgcaagattccacaatgcaattaagaataaccacgtgatcgtggactgccgagaatattgaatgtcaaagaattgctggagggtttttttttttttgcaaaggaaaatgatgttttgatgatcaagaccagatttcccaatgtaggtttacaacaaaaagagagaagcaagcccacgtgaggagttaatttttagacatactggtgatgtgttctaaaagaagaactcagatgttaagctttgctgcagattcttatccatcactgtgagctgatccttccagcacagtgggaaacctcgttttttcagagacaatgagttcagtgggataaaagaaagcatgaggtttggagttagaaagccacgttttttttttttttttaaagctctacctattagactaaacttcaagaaactataacctcatcatcttttcagtgaggtatcactaagcctacctatctctccagggttgatgcagggccgtaaatggaagtttattaagtgaaaacaacttataaattctgtaacattacacacattatcctattatttaacaattaccatatagccattataaaattagaataaagtctggagttaacagtaatataccaaaaataattgctcagttttgacaaatatatcatgtgacgctgggtgaagggcatgcaggaactatttatattatccttgcaacttctctgcaacctaaaattataccaaaataaaaagtttattaaaaataaaagaaaaaagcaccctgtgcttcttccactaacagaatgtcgcctgacagggttagacacgttttcaggatcctttcatcaccaccgtatatgttcaaagtaactttatcctatagttctgacaaaaggttaggactggaaatacaaggttttgcagaaccaattagttattgtttaattaaaataatggtaatcttgtgtagagtataaaatgggagactctggtgatagattgctattgcccagcatgttaagtcctcatcattcatttcattgcatctgtgttgcctgtctaaaataaaacatctcctatgttccacaaaagaccctaggcttcttatataagatgattcgtgaatagctccttcttggaatacaggagcaattgttgagagtccaggtatatagtaattgcagttacagagattcaagaaaaatgaccagtggcctaggacatcattggaccaagtcaagttaggtaggtgaggtatatgagcttccatcaaggtgtctagattcaatcttaatgcactgaaggtaaatgtctcatttgggaggaaaggactggagtgctgcctcattattgttctaccacaaactggtcatgtagctttcaaacatttttagtgaacttacacatgcctaagtttcctcattttctttgttttttcatacaagtgagttccactgggttcaagcaattctcctgcctcagcctcccgagtagctgggattataggcatgcaccaccgtgcctggctgattttgcatttttagtagagacggggtttctccatgttggtcaggctggtctcgaactcctaacctcaggtgatcctcccacctaggcctcccaaagtgctgggattacaggcatgagccactgtacccagctggtttcctcattttcaaatggacataaagataacagacctacattatagagctatagagagaataaattaaaataatctatgtaaatgccaactacataatatgaactcaaaaattactggctgatgtgactactcaagtcttctttctccatctctttctctctctcttctttcttcctttccattctctctccctttctgtctccctttcttcctttctctttataccttcatttagtggtactagaaccagttcctaccagcttgggagagtcaataaattattaatagcatgaaattggccatgccgggaatatttacattacaaaaatcaacaaaaactacaaattagattgcttttattttagccagtttatcagcatatcactgcttgccccacctctaccccctcctccaatcttccttcttcctccctccctctctgtcaaagggaaataaacacagaaagaaatcaccacagataccttcttgagctttaattcaaagaggggatttgtcttaaataagaattactctttatgtataaaatgaccagaggataaatgacagatgaaaataacttattgtaagattcttaaataattttggacatttgctgctgtaatatttgcattctgcaaacaggtttaaactgcagtagataataaaaaaattagatagtatcttcctccacagtatgtttaatttatgcttcagagtttgaacaaaagcttcctactatttagattgtgcttaaaatgaaatggatttggtcagttccacactttcatctctacctcatatgtgaggatgagaagttgtcattcaacagattcccttcaggtcagttttgctggtgctgattttgaccctatttgtgattttccacatgctcagcttcaccgaagtaatacctgaatgatttgaatttttaagaggctcagaaataaaactctagccactctgagagaggactctatctaaatcctgtagactgtcagtcagtaaactcttccactgtttgcaatcacagctgagttggttttgcagctggtttttgacaaaacaaatgtgttctgtttgtccccttcgtcaaaaggaaatgccaacacaatcttgaagaacattttctggtgggaatctacaggggaactggagagagggtaggcagttgacatactacagagaagaagaatctagttcattagactactgaccctctcataatgattgtcattgcagtggtcctcatgtttctcactccactgggccatgaagaaagatatccaaaatagaattgtttggcgatgagaagagtgctctgttcagaaatcctacgttgcatttattatctgccaggcactgtgttagtactttgttgaatcacctctcatttaatcctcatgaatactacatacggtatagatactattattatctccatactagaggtgagtaatttagacacagagagcttaaataacttgacaatgtgatggttaagtggtggagccaggattcaacttcctggggaatatattaaaccacttcactatatttcctttctgcaaatgataaggtgtcaggtaagtgttgattcttgtgaagtattacgttaaagaacccagcaaaatgcagtaatgatgatagtgatttcggaaaatggtgattctatacattttacagctagcgctacaaaatgctttaccatcaccgtctctcttaatcttcagagcaaacctgtaagatggtgaagaccaactgaatgtttagcaaggagttaagatagcaagcctgaaactgctacctttagaagggctccttatcaaggttggttcctggctaatgcataggaacttgactcccaaaatgttccctccatcacttaatgataaggtttactcactgtgcctagacaatttgtacaatgtaatttatggtgaacaactgatttccttctgggaacctggaattttagaagttgccaggcagagggtgcctacatgatcagcacccaataaaaactttggatgttgagtctttaatgggtttccttggccaaaaacctcagacacacaaattccttcatttttattgctaagaagataatgcactcagtgtgacttttcatgagatggagaaaggatagcaagtttgtacagggatttctccagaagattctgcagactattgctgtaataaatcttaaccatgagtactactatgagaccaatgagtccttctagttaatcaccaaatatggaggaggttttgaggacccccaactcactgggattcatggagtttaagtcagtaatctatcactgggtaaccacactaaaacttaatggctcagaacggccatgatgtattgtttctcttgattcagagggttgactgggtagttctgctgaccttgtctgatgtcacttatgtgactacatgagcttggctaatggctgactagagctgttggttcccaggccatcttggttccttgatggcctttccacagcatggtgatctcagggttccaagagggtgaaaacagaagtttccaagactcttgaggtctaggcctgtgatttccattggtgaaggcaggtcagggccagctcagcttcaaggggaagggaaacagtctccacgactttggtcgaagaaatgaagaccatgaggcacaatcaatggaagaagcctaagatgcaagtcacttgtccaagcctgactccaatggagtgaggagctaaatttgcccatagggaaggataatgaatacagtgttccaaaccacgtcctgtgttttatagatagatactctattttataaatgaatgaatgaatgaatagaatgcaaggaagaagcataagatgaagtagaaggaagtacaaaacaatataactccattgaccatggagcacagaagttgggacaattgttggcagccatctttggaaaagatctatcacagagatagggtttccttcatccaaacagagaaagtacttcttttcaggtaaatttctgcccatttggtgttaagctctcagggagtagcctcaagcgtggggatttgtcaggagtgtcctcttgtttcctgggtttctcccaggatccttttttttaagtaagttgaaatacatattttgttaggctcctactgcaactgtgggtgaaatttgtaagggcattcattgcccacccccaccattcccagcattattgaaatataatttatatacaagaaaatttgccaatctgaagtgtaattgctgaattttagtaattgtttactattatgtaaacacctctaaaatcaagttacagaacacttccatctacccatagtttcctcaagtcccttacggtcaatctgctcccctatcccctggccccagatatccactaactggctttctgctattatagttttggctttcctagaatttcatataagcagaatattttgtgtttgacttactccacttagcataacattttgagatttatccattttttgtacgtatcatattttgcttatttgcactgtgcagtggtattccatactatagatataccataatttgtttattcattcagagttggtagacattttgtatttttttctaattttggttattatgcatatcgctgctatgaactaccatgtagaagtctgtgtagagacttgttttaatttctcttgattaaatacatgaaagtcatactgctggatcgtatgataaatatatgcttgacttcatgagatattaccaaaatgtttccaaaagtgactgtaccacttctatccccactaacaatatatgagagtccagttgattcatattctcaccaacagttgatattgtcagtctttttaattttagccattctagtggatatctaatgagacctcattgtggtttcaattttgcatttccctgcttagtaatactgagcatctttaatgtgtatatgaaatgtctgatcaaatatttttaccatttaaaattgggttgtcttcatattgaattgtatcaaatctttacatattctggatataagccctctgttggatatatacttcacgtatattttctctcagtctgtggcttgccttttgttttcttaaatgtgtcttccgaaaaccaaaagcttctaatcttgataaggtccagtttatcaatatatttcttttatggctcatgttttctacatcctgtttaagaaatctttacctaactcagggtcacaaagattttgtccaacacttttttgtagaagtttcatgttcttagttcttatgtttggagatatgatccattttaggttaatttttgtccatagtgagtcaagggtgagattcattttttccatgtgcagatatctagttgttccaactacatatgtcttttgcccattgaattaccatgacacctttgtttaaaatcaattggccatgtaattttaatggcatttgaagcagctgaagtactgctgttgtatttgggtttcccccaaactactgaacatcccaaattgattgaaagagctgttgttattttcttgtcagtatatgtaaatgtcaaaatcgattttgtatacaaataatatgttggggattttttttaagtaaaggagcatattgggcctcgtaattccctggtttttactgctgaatgtagaccctcaaaatgaggatttacaaaataatttgtgtttagaaaacaattactaaaatgaaataaatacagtaagattttatactctaatttttctatattcaaatatttttcaaataaatcctcttttgtgctacatgtttatgtaagtttgtcatttaccttcttggaagagattgtcctttatttccattgggtccttcatattgtttgtgtatgaaaatactctctcttatacaaaataatagttattaatagcaagtttcttttctttcaaaattcttctttagcaaagttaaaagtgaaagcttaaagcatgacctatatagtttgtttttaaattttgctgactcaagaaatctactggattaagtgactggtacaaggaaggtcacatggctagtcaccatgatgtgcagactccaaacccagatccttcgcttcctcactaggattttttcccaaaacgagatgtgtgatacatgcatgtaactaacatagttctcattttgcatgtagaggaaatgaggttttgtgaagtgtaaaaaacttcaagagaagggaaagaactttaggattatttgtttacaagataagttccttgtggcaatctagggagttacaattcaagatactgattctctgcctaaaagtttctcagtctttgctatctgttgatccaaggatcaagataaaagagataaaacttatcttgtggaagtacatgacgccatcaatgtcatagtgaattcccttaaatagctttaaattgttcgtaatttgcatggagcacttcctctgagcaaattattttgtcctgtgttgtacatatggtaatattatctcagctattccacctgccagcccagcaagttgagaactatatttgtaaggctgagagaggataaataacctttgtaaattagccaaacttaaatgggagtgggggtttcaaacccaggcttcatgactgcaaaatttgtgcccttaaccactattcatactactagcccataccatatacaagaagtcttcctactgtatgacttttactaaacctttttgagcacaggagccatgtctgtttcatctttgaacccctgtaactgtgagttttggtgaaataataccatggtaaataaacaaacaaccccaaatatctcagtggcttccagcaacagaggtttgtttctctttctcatgaaagccattgtggattacctgtggctttctaccttgctgccttcactttaggtatcacctaaaataaaataaaaggaaagaagaaacactgagtctgcttaaaaaattttcctaggaagtattctgtcacttgcactcatgtttcattcgccaatgcaagtcacttgtccaagcctgactccaatagactgaggagctaaatttgcccatagggaaggataatgaatacagtgttccaaaccacctcctgtgttttgtagataatactctatttattttataaatgaaagaatgaatagagtgcaaggaagaagcataagatgaagtagaaggaagtacaaaacaatataactccactgaccgtcaaatttgaaccaggacattattttcctaagaagaacagaatggataactttttgtatttttttcatatggaaacttaaatattgaatctttagggaatttatggactctgccctggttgagttccttatatttgaccacaggattagtaactcatcattaccaactttatatagttacagatcctttaatgcccttagagaaaatggtcaaatatttgcccactttccatattcccatcattcaataaacctaactagacaaaggtatgcttttaaaatggagttttcccagtccactgtcaaatctaggttccaaagagtgaaacatttaagtatacatctattagaaaatcaaactgcaggcaaggtgtggtggttcacacctgtattcccagcactttgggaggccgaggtgggacgatcacttgagcccaggtgttggagaccagcctgggcaacatagtgaaaccccgtctgtacaaaaaattttaaaaattagccatgcatgatggtgtgcacctgtagtcccaactacttggaggctgagctgggaggatggcttgagcccaggaagttgaggctgtagtgagccatgatcataccactgcactccagcctgggcaacacaggaagaccctgtcttaaaaaatcaaattgctgttaaggtcatatctaacaatcatcaatggaagagcagtatatatttttcctaccatgttgctattgtggtaagctgagggaggatgggtagggtcaaaccccaaagtaccctttatgaagaacagacaaaaaggaattctttctacaaatttaatcagcagaggaaaaagattggagaaaccactaagaggcctgctctgagactgccatctcatggttcccttgttttgagcagggcgccccccactgtcactgttcactaaatctgagggtgtgtgtagactggctttttgtagagttttctagagggactacttgaaaaatacatgacttggagtcagctccggactactttatcaatgccaatttgctagccagcactctcctccctagtctgtagcccttcatgaaccagatatgttcctttgcaatacttcctttctaaaataaatgattatggaatacagaatataaaggttatgcaatttattctaatgccagaatgagcccaggtcctgaagttgctgcttcatcttaattatcattttctagtaagcattcgttttgaccagggcaccaaagccagtctatagtggatcacatcttatcatgcatgcttccttcattacttctgtcaacagacattgagtgggtgcctgtgcctcctatgtgtgtgttttttttttgtttttgttttttttttttaacagagcatgaaataagggtgtgagggcaggtagtttatttaggagatgattccaggaagcaggggtaaggaagtaggaaaaatgagaaaagaaagaaaaataaaacaaaagattgtgtaggttagaagtagggacctcaacccccctagagaatttctaagaaattatgtagaacaaatgtccccaaactatatcctgtgggccgaacctggcctgtttttcatgaataaagttttattggcacagggctgcatccatttgtttacatgttgtctatagctgcttttgtgctacaatgacagagttaagtagctgtgacagagaccacatggcctaaaatagctaaataaatatctggcccattgccaaaagagtttgctgacccctagtatagaacttgcctgagacttgtacttctgaaggatgaagctgaagtatttattcactgaccccttcccattgtttcccaggagcccacctggactgaatttaagcaacttaacgttctgagacagaaaagtggggagacctcatagccaggcctcttgatgtgagactgccagtggacctagaactatccaccatagctacatgactagcacaggttggccaataaggaagcattaaagcagctgctacaatacagttattctccaagtactgtgttagcctcttctcatccaccaatatttgtttttctttgatcaacaaaaaatctctactgttgtccttttaccatcatctggaaagttctggttataatagacatctattattaggagttttgaaagtttggatgcatgaaacagattttctttgaagttaattttataaaatgaacttgacaattttcccaaataggaacatctattcatagccactgactaagagacagggctaataggggatccattctaaccatttaggtctcctaaatgatggtatatacatgacggcaagggcaagttatatggaacttaacatttccttgaagaacaattttccatttgatgttgctttagatgatcattatgagtaattatgtgtacaactgtaatgatttcatatcaaattaagaggtactttgaaactggattatataagaatgacaggtgggttaggtgctacaatgctgtactgggagtagaaatagaggtggtcagaataggaaaagcaatggagccaaaatgaaaagacaaaatggaattaaggaaattctatttttccattccaatttaggaaatttagagccccctccattacaattacccaaagtgagactttaagaccaatgatttgtttaccatatcctccaccgcaggtaataaccacttatttctctaagtgtactatatattcccagtagttagagagtattttgagtcattatggacagcattttttttcaagtgattgcctctgaaaacagaagtcagaaggcaaggaatctggagttagaacaacactgtcctgtactcaaactttccttctaaggcaggagccctgtctacactatttctggttgatgagcatggcccaggttggataaggtgctcatttctttgtcagaatctccatgataaaatgtcattgatttggaaaatttacataatcccaagccaggaagagtttccactcttagaattgctgattgaagagaagtatcttcatgtgttagtatcctaatggccacttggctcccagctcatcagcactagggccaaatgtcttggtggcacaatctaagtgaggccagattttcttatacaacagtccaaaacagagcctttccaagccctaagataaatgtgtcattccattggttagaaaactctcaacatttcaccactgccctatgtgcctcaaaacaaatgctttgttggatttcaaatgaggtttcataaattcactggaattgtctttaatgctacacttttaatatttaaagatcagggttttaataagcatttgcttgggagagttgtgagctttaatgttgaatgaagagatatattaagcaataaatgcagtgcccagaatgcatgattattgcaggttgtcattattgagaacaagccaaaatcaggaaaatgatatttaatgtaaaaaacaacttctggcaacaaaattattcttctcaatgtaatctgccacatctatttggaagtatagaaagggtagagactgtggataacttttgctgttagactggaaccctgggttccatgcctgggtacagccatcaatttccctgacctgtgttctcatttcttctctggagaatgaccattatacagctgagttttctttctaccaggctttgggtatctataaaatactttgaagttagattctccatgggactgttttttgactttttattcccaaaagagatgacggccctagctggaagaggtggaaagggaggggagcaagaatggtaaaagtgtatttccagcctgagtaattttggatttatcagtataatctcattaatgcagatggagcattagaactgagaatataaccctttttctgagaataagctttttcggtttatgttctcagaaatgcctgtgagaataaacaagcacacaaaatattatgccaagaaaaaacagagctgatacattttccagtgctgcttttgttcctgttagaaatgcctgcaatggaaaacaaaaatgacaaggatcatacttttacactgtgtgattaagagactcttttgcctccctgaatgcatccatggtcttcactcagcaggcctaacagattttcctgtgttttctttttgatttctgtcttgcccagaagtttttttcctatgatctgttcttactgttctcttctgtgatctctgaaaatacattggtttctttagaactgaacaagagtcaaaggaacattcatttttgaatgcttgcagtcctcaaatcacagaggaagaaagaaagaaaagagggcaagaaactctgttagtgagggacacagaaaagacgttcttctgcactgcctgaagaccatgctgaatggaatacacaatgagtgctaaatccatttgcaaaactagctcctgcttcctaaaagaatagcaagggaaagaatggctagagttgagcaagaggtagctaggttgacatattgagaaaggtagaatcaatggaaggaacgtcgaaattctggtttttaaccagtgttgatatgtatgaactaactcatatttggagacttctagttagctccaccttctctctgttcctgaatttacaatggtctcccacaattaggagaagtgtgtgtatgtgtgttgctacagaaactgtcatgtgtgtctgctatatgagtgcatgcttgcttgctcagaaatactaattatgctcagaaatactaaggcagttgttggaaataccagtgaacaggcaattgtgtttcatcatgacttccaaggcttaccattaatgtagtctcaaaaaaaaaaaaaaaaggcagtttatgatcatagatcttggctggttcaaggagccacaagacagctttacctctgacacatgctccattgtatcaggtcaacttgtgctatgcaatagagcttgttaatcaaatttccaacacggtttctttttacagctgaagactggatttctcctcaagatgaaaggctcaaagcacagatttgggttgtgtctactaagaaagtgttcatttctggcaattgtttctttgcattttagtagaccactctgattgacattttaactgcctatccctgttgggcaagcctcagtgctgggaagttgtcaaaatgttgtggcttcattctcaacatgatagtccacagtacaaaagtgcccaatccaatgtgtcaaaatagattaagagaaaattctagcttatgaaccatcaggaaaaattatccattttacttttaagaaatggaaagtgctttttgaggctcagccaagggatatagcactactgtcttttaattaaaatgacacttcacttattttcatgcaacattaagttaatctgttccaatttaatgcaaatacggggaaaggaaaacatgcatgctgttctacataagatcctttctatgagtaatatctcatggagggatttgattttatgtgaatgaagggtttaaattgacactaaatcagagctacatttttaaaaaaagatcaaaaatattaatagaacagagtaactcctggtttcatctgggttacaggatactgatttctaacttattggtacttttcccatttcttcatgaaaaggtccattttgtccagggcatagagtaacaaatgacaatcaaatctaaaaattcaatgaccaaaataagtgaagaagtgaatcagtgaatttgcaggaattactaagttttgtgaattagtgagaaatcttatttattagacttaccctacacatcatgggatgtgtatgaattttatctctgcatattgaatgaattaaaggaggatttgccttactttatttttagcagctgtgtgtaaattttttgtcaggaataaataagtggtttacatccagctgtatctacttgaaatggtgtcaaagagctagaacaaattatggttttataagggaagtatttttgaagagaacacaaaagagataccatgcaaaggcagcaaaaactatgagcaagattgcataaaatgaaaatttaacaaaggaacatgtgaggaggtgtcatatcccaatttgatgttaccatgattatggctgtgctgatgggagtattaagcacccgacactccaagcatattttgtgtctgtattcaggccctatgcagaattaggaggatggaagttcttacagaaaggaaacttcatttgggtgaagttatttaattttcagaaacaccttgtctgttgtggtacatgcataatttgaggtttacaagcaacagatatacccaaaaggggacccaagtagagagaatattctagctacatcacccccttactatgggattccaagcataagtcaccatgataccctggatcagacaggtgtctgctcttttattcccttgaaagcacacagaaatttttggagagatgctcaaagagagtgaaatgtcctaaaaacacatgttgatcttacaaggaaaggaacattataaagaagtgttgtactgtgccagtttcacattgtacagggcacattggatgtgagcatgatcaaatttaagttctttaacatttgatacattctaatgaacaactgcaacccaaatttggaaacaattaagagttctctgataccttagaaaaatgtcaatttggaaagtgattgtttttaaaagcatggtggttcttttccaccttaaaatgaaattgagtcatttcatttgcttagaataacttggaccttggggtagagagttaaaatataaaatttcgatcatctctgagaaatcagaaagtagaacttaacggtttggacatatgaaactaacaggggcccttcccttccccttctcttcttttttggttttttgtttgtttgtttgtttttgagacagagtctcactgtcacccaggctggagtgcaatggcgcgatctcagctcactgcagcctccagcttccaggttcaagcgattctcctgactcagcctcccaagtagctgggattaccggcgcacactgccttgcccagctaattttttgtatgttttagtagagatagggtttcaccgtttgcccaggctggtctcaaattcctgagcttagacaatccacccacctcggcctcccaaagttctaggattacaggcatgagtcaccgtgcccggcctcctttctttcttttcaaattaccttggcaaactatacttctacagaaaaaatgttattcccagaaggttgtgatttttcaggttgaggtagaatggcttttataattaccttcttgaagttaagcactggcaaatactcaagatgaagcaagatgatgagtatttcaaaggcaaccttaaactaaggctaatgaagagaagaataaaatctttgaagttatttcaaatgaattatccatagttgttttataaatggataccctatgtaaagaaatatgaaggcatctattaggtaaaaacatccaaaggtgtctcacctgttattgagagactattctctcagacagctgacatacagcaatgaggacactgctgcccctggagacaaaaactatcagtcattttacctgggacgagtttattatctctgaaatggaaatactgatttcccctccttagtccagtgattaggatcagatgaaatgactggtgtgaaaacactttgtaaagggaaagctgtgaccccagatgcagtattataagatacaggtattacaaaatccaataaggagccagtcagaagggagccacagttaaaatcagtatattggtgagaataaagccctcttcagagtttctgaatgaccagtaaaaatcattctttctgagaaggtaggactgtcagcctgtctttctgttcaaacacaattggaaattgtcgttaacatctctatattctgtactagctttccccccactgtaagaacattctacataatgaccaaaatgtcatttttttcacatttaataaatacagttacagcgactgatgagcccctgttcaggagtatttaagacccaaattttacctctgtatcacccgccttcactgaattgcccttgcattgggaaaacatgaattattcactaacgaacattgctgattaactagatagctatgatgtttttctttcagcaaaaagggtaaatgtactgacgtctttgtggctaggctcacacatattaaacatgaattagttgtgtttgtgaatgaacataaacatgctttaattctggtgccattttataatcatttgtgttcatttcagatataattataacaaataagatagaaaattctctccaaaattccctcgggacaatatatttatattttcctgagaccctgtatgagaagatcaagctcacacatccctccctgaagctgttaaatgtatcttctacatttatcacattagaagtcttctcctcagcaatatctttctgtagctccctgttaatactgaaaacaaattcagaaacctagctttaggcttctaagccctcattggttacctctctcatatgtgtgtttatctagtcatccatccatctatccaagcaacaaatatttatttattatctaatgtattttgctagatgcttcaaaaaacacaaattcaaggcttccttctcctgttgatgttttgttcatgcaaacttttctcctgcacttttcattaaataagctgctgttctcccaatggacagcattcaaatcagcacctagaccttcacaacattctcctcaaattatctttaccagtttctgtgagcatttcaggaccccagctgagtctgccatttctcactatgagatgaaatgcccgacagaaacagacatgtcagtgcttgagtggtagccattctctgttaacaaaccacattccactccaaggaaagaggctcaaaaattaaacacaaagcctgtttttcaagtgcttataagtaatggagcaaaaataaatacaataagaagcacgaaaaatacactcacagaaaatacctgaagtgaaactgatacagttttaaagaacttcactaaagtttaaggagtagaggtcagggggattctatcaagctacgtgactggatacttgggacaaatcaaaaaagacttcacaaggagggtagtgtgagcacggtttggaattgtcaggcaacaggatgacttgatttggcaattcctaaagcaggcatgagaattttagcaaagtcagaagtgcacacaagccccaaatttgccttgttggtattctggccagggaacaaggagatttgacgacaatgagttttagatgctcactgttgtactttcatggagggtaactctgcaacttgtaacttcccattctgtctacttttccatgctgtctctttatagcagggtttcacaaccttggcactcttgacaagtgtctcacatcatgtctgccaatgcttccctggccaagcaagtcatgtgaccaagtgaaggggtcagaaagttcactctgttcaccatgaggtgatgacaaaaatgtggatatataatgcaactcccggggagttaaaaattgagaacaataactcaatctactgctgaaccctagtgcacaaattagccacagaattgcactgtcacttaaaactgtgctgggcacaatttgtgcccacaatttgggcacaaaacagagacaagaaattaggtaatgaaaaattaagacccctatattgtatagatcaacatcaaaaaatattgctactactggccattggtaagctgcaaagataagttgcccacaaaccctgtgtttgccatgatgaatcctgggggtcagtggtatctggtcaaatctacttgccatcactaatggtgagaagctaggtttgtgacaagtccagtttcagctgcacttaaaactatgcaagagaacccagtataaaagctaaatatgtgcaattcaaaattcttaaggcaatcatcttgttctccccaaacgtaatgattaaaacttggaagtgctcttaaacaacgacttgttccaagtaaaaatatcttgttgtggggtcagcatggagctcaagaactctggtcatggagcagagatacgcataggctcatcctggggttttctctcacagaatttaagaaagtacagctaacccatggcaaagaagttaaaaaccttgaaaaaagattagacaaatggctaactagaataaccaatgtagagaagtccttaaaggacctgatggagcggaaaaccatggcacaaggactacgtgacgaatgcacaagcctcagtagctgattcgatcaactggaagaaagggtatcagtgatagaagatcgaatgaatgaaatgaagcgagaagagaagtttagagaaaaaagaataaaaagaaatgaacaaagcctccaagaaatatgggactatgtgaaaagaccaaatctacgtctgattggtgtacctgaaagtgacggggagaatggaaccaagttggaaaacactctgcaggatattatccaggagaacttccccaatctaacaaggcaggccaacattcggattcaggaaatacagagaacgccacaaagatactcctcgagaagagcaactccaagacacataattgtcagattcaccaaagttgaaatgaaggaaaaaatgttaagggcagccagagagaaaggtcaggttacccacaaagggaagcccatcagactaacagctgatctctcggcagaaactctacaagccagaagagagtgggggccaatattcaacattcttaaagaaaagaattttcaacccagaatttcataaccagccaagctaaccttcataagtgaaggagaaataaaatcctttacagacaagcaaatgctgattttgtcaccaccagccctgccctgccctacaagagctcctgaaggaagcactaaacatggaaaggaacaactggtaccagccactgcaaaaacatgccaaattgtaaagaccatcaaggctaggaaggaactgcatcaactaacaagcaaaataaccagctaacatcataatgacatgatcaaattcacacataacaatattaaccttaaatgtaaatgggctaaatgctccaattaaaagacacagactggcaaattggataaacagtcaagacccatcagtgtgctctattcaggaaacccacctcatgtgcggagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaaggaatcaattcaacaagaagagctaactatcctaaatatatatgcacccaatataggagcacccagattcataaagcaagtccttagagacctacaaagagacttagactcccacacaataataatgggagactttaacaccccactgtcaacattacacagatcgacaagacagaaagttaacaaggaaatccaggaattgaactcagctctgcaccaagcggacctaatagacatctacagaactctccaacccaaatcaacagaatatacattcttttcagcaccacaccacacctattccaaattgaccacatagttggaagtaaagcactcctcagcaaatgtaaaagaacagaaatgataacaaatggtctgtgagaccacagtgcaatcaaactagaactcaggattaagaaactcactcaaaaccaactacatggaaactgaacaacctgctcctgaatgactactgggtacataacaaaatgaaggcagaaataaagatgttctttgaaaccaacgagaacaaagacacaacctaccagaatctctgggacacatttaaagcagtgtgtagagggaaatttacagcactaaatgcccacaagagaaagcaggaaagatctaaaatcaagaccctaatatcacaattaaaagaaccagagaagcaagagcaaacacattcaaaagctagcagaaggcaagaaataactaagatcagagcagaactgaaggaaatagagacacaaaaaacccttcaaaaaatcaatgaatccaggagctggttttttgaaacgatcaacaaaactgatagaccactagtaagactaataaagaagaaaagagagaagaatcaaatagacgcaataaataatgataaaggggatatcatcaccgatcccagagaaatacaaactaccatcagagaatactataaacacctctatgcaaataaactagaaaatcaggaaaaaatggataaattcctcgacacatacaccctcccaagactaaaccaggaagaagttgaatctctcaatagaccaacaacaggctctgaaattgaggcaataattaatagcttaccaaccaaaaaaagtccaggacccagatggattcacagccaaattctaccagaggtacaaggaggagctggtaccattccttctgaaactattccaatcaatagaaaaagagggaatcctccctaactcattttatgaggccagcatcatcctgataccaaagcctagcagagacacaacaaaaaaagagaattttagaccaatatccctgatgaacattgatgcaaaaatcctcaataaaatactggcaaactgactccagcagcacatcaaaaagcttatccatcatgatcaagtgggcttcatacctgggatgcaaggctggttcaacatacccaaatcaacaaacgtagtccagcatataaacagaaccaaagacaaaaaccacatgattatctcaatagatgcagaaaaggccttcgacaaaattcgacagcccttcgtgctaaaaactctcaataaattagctattgatgggacgtatctcaaaataataagagctatctatgacaaacccacagccaatatcatactgaatgggcaaaaactgaaagcattccctttgaaaactggcacaagacagggatgccctctctcaccactcctattcaacatagtgttggaagttctggccagggcaatcaggcaggagaaggaaataaagggtatgcaattaggaaaagaggaagtcaaattgtccctgtttgcagatgacatgattgtatatttagaaaaccccatcatctcagtccaaaatctccttaagctgataagcaacttcagcaaagtctcacgatacaaaatcattgtgcaaaaatcacaagcattcttatacaccaataacagacaaacagagagccaaatcatgagtgaactcccattcacaattgcttcaaagagaacaaaatacctaggaatccaacttacaagggatgtgaaggtcctcttcaaagagaactacaaaccactgctcaatgaaataacagaggatacaaacaaatggaagaacattccatgctcatgggtaggaagaatcaatattgtgaaaatggccataatgcccaaggtaatttatagattcaatgccatccccatcaagctaccaatgactttcttcacagaattggaaaaagctactttaaagttcgtatggaaccaaaaaagagcccgcattgccaagtcaatcctaagccaaaagaacaaagctggaggcatcacactacctgacttcagactatactacaaggctacagtaaccaaaacagcatggtactggtaccaaaacagagatatagatcaatggaacagaacagagccctcagaaataatgccacatatctacaactatctgatctttgacaaacctgacaaaaacaagcaatggggaaaggactgcctatttaataaatggtgctgggaaaactggctggccatatgtagaaagctgagactggatcccttccttacaccttatacaaaaattaattcaagatggattaaagactgaaatgttagacctaaaaccataaaaaccctagaagaaaacctaggcaataccatttgggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagtatgggagaacatttttgcaatctactcatctgacaaaaggctaatatccagaatctacaatgaactcaaacaaatttacaagaaaaaaacaaacaaccccatcaagaagtggacgatagatatgaacagacacttctcaaaagaagacatttatgcagccaacagacacgtgaaaaaatgctcatcatcactggccatcagagaaatgcaaatcaaaaccacaatgagatacgatctcacaccagttagaatggtgatcattaaaaagtcaggaaacaacaggtgctggagaggatatggagaaataggaacacttttacactgttggtgggactgtaaactagttcaaccattgtggaagacagtgtggcgattcctcagggatctagaactagaaataccatttgacccagcctgggtatatacccaaaggattataaatcatgctgctataaagacacatgcacacgtatgtttattgtggcactattcacaatagcaaagacttggaaccaacccaaatgtccaacaacgatagactaggttaagaaaatgtgacacatatacaccatggaatactatgcagccataaaaaatgatgagttcatgtcctttgtagggacatggatgaagctggaaaccatcattctcagcaaactatggcaaggacaaaaaaccaaacaccacatgttctcactcgtaggtggggattgtataatgagaacacgtggacacaggaaggagaacatcacacaccggggcctgttgtggggtgggggaagggggaggaatagcattaggagatatacctaatgttaaatgacgagttaacgggtgcagcacaccaacatggcacacgtatacatatgtaacaaacctgcacgttgtgcacatgtaccctaaaacttaaagtataataatagtaataaaaaaagaaagtacagctttagtcatcaactatgtgaaagcctctctatgctgggcatctgagaactgctgggcagacatcggtcttttcagctgggttgtttccagctgtctcattgaatacaaaggcaagttatgaatattgaaagtgccttgagattaggaacaatgtgttagacagtgagatttttaagaataattcatatttagcaacaaatgagtttgcattgcaatcatttcttgacaaatatttgttacatgctcattacatgcaagtataattttgtaatgtgtgtacatacctattcaacattatgactgttttgatgagctatctacaaaatatttttgttactacatttgtttatagattaaaagggccaaaaatgatctggaggaacttacagttttgttttctttttcctatctccaagtagaaatgttaagaactacacatttggattcccagaattctaaaatagttttagggttcttgccctagggaaccccatgaaaaattggagcactcaaccgcctgtggcaagatagggacaggtggcatgggaaagtgtctccaggctctcagcttccactgtgcccttgcaacacctggcccagtggaaacatgctggcaacaccatcatgccccttggggacatgtattttaattttaaaacaaagtgatgtatatggcatgtgcctcaattggcaccttctgctcccaggaagaaggaggtctctggagtaggccaggatgttggtttccatgtagagagcattccaaggacaggaactgacagggaaggacaggccctaagaaaccagagtaggccgggcgtggtggctcactcctgtaatcccaccccttgggaggccgaggcaggcagatcgcatgaggccaggagtccaagaccagcctggaaaacatagcaagaccgtcctctctgtaaaaaataaaaataaattagctaggcgcatggtggtgcgtgctatgcctgtggccccactactcaggaggttgcattgggaggatcacttgtgtcctggaggtcgaggctgcagtgagccatgatcacaccactgctctccagccttagtgacagagcgagaccccatctcaagataaaagaaacccgagtaaagtatgtatagtgggggtaggggaaaatcctttttgtctttaatgtgtcaagagagaagcagttttttaaaaaagtgcagacacaagatttgaattagacaaacctaagttgaaatgctggctacattggcttaatagctggatgactttgagcaagtggtctagaagttttctcatctttgaaatggggataggaataatgaccttgtctgcttgtttagataattaaatgtgataatttttataaaattctctttaaaaggtgtagactgaaaagtcataagacttagcttataaggctaatttggacactcaactagcttggccacatattgaaagttttgagaatcaattgcctcatctattacaatggagtgggggaagagagtcataacattaccacatgccataaatgaaatctaagtaagactgttaataacacaggattggaaaaagggaaacagttgcagaattctccaaggaaccaataaagcatatgaaacagagagtaaacttgaaaataaagcataaaccaaatttatgatttttcccctttatgcctcttcaacatgggacagtggcagatttaaaagtatatttatatgaaggaattactctcaagggataagagccatccttttgtgtttggtaaaaattaaggatgaggtccagaagaaaggaataggagaagtaaaatataacagcctggacctattgtgatgtaaatgagcaacagtctgtatatatatatacacacacacacatatacatatatacacatatatatatacatatatacacatatatatacatatatacgtatatatatacacacatatatgtatatatatgtatatatgtatatatatgtatatacatatatatacgtatatattatatatatatatatattttgagacagggtctcactatgttactcaggctggagtgcagtggcacaatcatggctcactgcagccttgacctcctaagctcaagcgatcttcccaccttggcctccaaagtagctagcactacagttgcgccatgcctggctaattttttttttattttttgtagagataaggtcccactgtgttgcccaggctcgtctcaaactcctgggctcaagtgatcctcccaccttggcctcccaaagtattgggattataggcatgagccactacaccaggcctgttcctagttctttttaagtctcaggatgcagctaactttaccctctggggtggtgtctctactaggaaatgggtccctcctttgcagaggctaggggagattgatgagataatgtctgcagagtagcctaatctccttgggagattaaggctccctctgcaagtgtacattttgatcattatgactatctgtgcctctgtgaaatactgccaaagagaacaagaagagcctgccagaaagagaaattttccgagggtgagagatgaaaaagaaatggaatgaaaggtgagattttaaaaaataggaaaagaaggaaaagtaattgcaagaagaaaatgagaacaattatataaacagagattggatccaaggacacatggccaaaatcccagaatcagaggaaggctggtggtggttaagaagaaaaacacaacaaaacctttgagagttaaaatgctgaattctccaggggtgatcagagaagttccagaatagaagcttcaggcagacactacagaaatgaaaagaaatgaaaaaaaaaaaaaaaaaaagcaaaatttccaataggtctttgcatttttgcctcttttctctcctaggagagatttttctatcctaaaatattggatatcactgggagaaatgcatgtggaatataaatagtaattatgaatttctgagcctattaaaaatgtttatgtttcttgtacacaatgcccttccttttcaatgcattcacctgtgctctagacaaagccactttcagagtactccctcttttcactaaaatgagattggcctggaccaggttgtcttgtgcatcacagctgatgaatggcatgcatttctgtggataaggcaaatggtcttagttatttcaagagtccacatgggaaacatttatcacagcagtggagctaacatagaccgtttgcctgcaaatgttgatggattggacgatcgcgtttctatttgctcagagataggtagaaataatttcatactgtctaagattatttttgagttaaaacaaaaagtagcctaagaacaaacatgaactttggtatggatattttccctaaataaacttagcggttgatcagttttgcacttgtttgttgtgaatataaattaggattgtcttttttctaccagaagcatcttgagatccacagaacaggtgacttggggtcttgacacactgttaaggaggtagagagtcaactcaggtagtaatacccaatacctttgggccagcccttcttgcttcctccttgttgcctggaggaagaaagggaggatgtgtttctggaacagtcattcctggatactggttcattggaagcttcccagtgatgtcgcatgtgaggcatttacccaactgctttagggagcttgccagccctgctgtggccagcttttctattgtcaggattcatagccaccactccctctacttccccactctcccacctaggcccccacgcctgcctttagcttttcccctcctagtaaagagtttccacatttgtacctattttacgaagtgtccaactaagtcaaatacttattctcccacatcagacccaccctgtaaaacatgtaagcaaatacttttagcttaccatttgttgactagatgatgacttttaagtacaattgacccttgaacaactcaggggttaggggtgctgactttcatgactcaccaaaactcaactatgaacggcctactgttgaccagaagccttactgataactgtaaacagtgggttaacacatattttgtctgtttcatgtattatataccagattattcttagaataaggtaagctagagaaaagaaagtgttattggggcccggcgcggtggctaatgcctgtaatcccagcactttgggaggctgaggcgggtggatcactaggtcaggagctcgagaccatcctggctaacatggtgaaaccccgtctctactaaaaatacaaaaaaattgaccgggtgtggtggcgtacacctgtagtcccagctgctggggagactgagacagcagaattggcgtgaacccgggaggcggagctggcagtgagccgagattgcgccactgcactccagcctgggtgacagagcaagactacatctcaaaaaaaaaaaaaaaaaaaaaaaaaaaaagaaagtgttattggataatcgtaaggaagagaaaatttatttgctattcattaagtagaagtgaatcatcataaaattcttcatccttatcgtcttcacgttgaataggttaagcaggaagaggaagaagaggggttggtcttgctgtctcaggggtggcagaggcagaacaaaatctgtgtataagtggacatgtgcagtttaaccctatgttgctaagagccagctgtattcacagagccctgaggaaactaacaaggaaaatataaaacatttgtttcaccctgaaagaactgtaaacctgatgcggaagaagagactcatttaaatgtccaagttagatatttacagtcaatgaaactagaagggctggtagagacagcccagtttaacctccacattaactgtggcttagggagatgagctgacttcctgattcttaatgtagttcttgtgttcatttaacaaatatatgtgagtgcctactgtgcctcagatatggatgtgatccctagttaagtcagctaacagagcctagaactgatagacaagtcaccaggcaaattagcaaaaggaatgggggttgtaaagaaatctgtgggaagagcacctgactttgccccaagggtatagaagagcacagtccaataaaattataacatgaaccatgtatgttattttaaattttctggtagccatattttaaaaacaaaaacaaactgctaaatttttcttttaatatgttttgcttaacccaacgtgtctaaaatattatttcaatatgtaatcaatttatcaaaaatattgagactttttatatttttttcttcctactaagccttggaaatctgctgtgtatttcagatttacagcacatctcaattcatacttgccacatttccagtgttcagtaactacctgtgatgagtggctaccatattgagcagagcaaattgacagaaagtttcttggaggatgaacaattaaaccagaataataagttgttagttggcagaatgaatggagaagaaagagttggagaaatctaggcctgagagaccagcaagctgaaacactctaaggttaaagaaggcagtatcttgcagaaaatgcatggaattcattgtggcctctcttgaagaacagggtggccatttataaagatgaggaagttaggcagaggagtaggtttgggggaatgaacatgagttcagttttggatgtgttgaatttaagatgtctacagacaacgaagtggaggtgtaaggtggtaaaaactacaggaattcagagatcccactgtgaattgggctatagcacagaagcttcataagggaggtcagcattttaaaggatgggtagccaatgtcatttactctagaggggctgtaggttatattgggttggagttctcagtttttgccattcaacatggagaaagggagacaacaaagttaagtattaaaatcatcaaaactttatggatcccaatttagcctgtatgtatcattcatacctcatcatcttctataaacaaagtaggagttcttgttatagtttcttgttatgctagaatggcatttggatatagaatggagaccttttattagtatattatattctaatccttcatgaaaccatggttctttttgtgtgcattaggggaattttataaattttaggctgttattaggaaagatcattcacaaaatgcagaagttttactgtattattttgtgaacccatgctgaagtcaagtaaattaattttaagcatcacacttattagtcatttttatccaaattgtttctaagtttttaaaacaccctctaaatttatgtacaaacttcttatatagaatctaggtatggaaaaaattaaaaattttagatttttttttactggggaaaatcaagtgaaagacaatgctatatccctaagtattaactttaagtaaatttaacatttcttctatgaaattaacaactagtaggacgtgtacgggcttacgggactcacaactgcaaaagaatggaatttgcagggctggtataatgacagtaagtgaatgaaatgctgagcattagaatatacaatggatgaatatgatcgtccattgtaaaggaaaggatttgacttagtctcccttctagaggcaatgacagaagatatatctttttattccattccttaaaagatacacatataaaggaggaaatttttaaagaaagaaaaaaattaattgcttacaaaatgcaattactgcctctttttcctgctgggtctttagagcccagctaagactgtaaaataccagatgaatgggattgctggagcagaaggagaaatacacagcccataaaccagcatgccagtggctgtgccattgggttgtatgcattggaaagcacagagactgtgctctttatctctgctgcagtaaagattcaccaaggattggttgtgctaatatcaagttattttatggctgcagttcattatggagcctcttgcaaaatccctgtcaaacaaaatggctgtcagagacacttttgttttgctgccaaaagcaccatttggtttctgctcatttagttacaggtacaatcagatgtttgcttcttgctctcggtaatttcactgtcctcaatataatggcttcagttatgccctagaaaaacctctagagttcagtttcattccaccctgtttattgagctccaagtttagacaaatccctaaactggtggcacatgacttaactcaaatgagtaaggaggctcagaacctcgtaagataactagtataacttataacacagtaaatgaagccacatggagttgtgcaaatggtggccctggagataaatcagtcatttaatttctctacctacctatgtatgtatctattgttgactgtaatataagatgcaattgaagtgctgtgaggcaggtacttactactcgatagcaggggttggcaaacttcttctgtaaaggtccagatggtaaatattttaggctttgcaagccatacagtctctgtcacactgctcaattctgctgtttttgtgtgaaagcagccatagatgatacttaaacaagtggacactgggccaaggccaccggatgtagtttgctgggcactgatgtggagagtggagggaggagatgccattattggatgtgagagtcaagcctttgtgaaggaagtagtacaagaaatgattctaacaggatgtgtaatatttctgtaggaatatctatttgcaatctagtttattcttggttgttctcaaattattgtgtgtataatagttttctgtcatcaacttttgtacatgttcttcaaatagtggggccaagtgatcattttgcattcctactgagtttagatgagttccaagatatgatataggctcaatgaatctttttggagaagaataaggtaggggcttcaagggaagtttcccagaggtttcaatctgatttgctaaagaaccaaagccgtaaccaaagattaaggacaagctatatcttttgtattgtatgcggagttgtggatgctgatagaccttcttaaataaatgcttaacccaggagtctgcacagagaagggaatcctagactacaagggaggctctccgttaatgttagaaggaaataaattagagcttcatttcactggcggtcaccatggtcgtgtataaaaatctgagatcaagaccaggagtttgagaccagcctggccaacactgcaaaaccacatctctactaaaaatacaaaaattagccaggcatggtggcatgcacctgtaatcccagctactcaggaggctgaggcatgagaatcgcttgaacccaggaggtggaggttgcagtgaaccaagatggcgccattgcactccaacctgggtaacagagggagattctttctcaaaattaaaaaaaaaaaaatcagagatgactattaatgtgaagtgcaagttttgttcaggagccatattttgttttgtgttgctatctattgtcaaaccagtgctcattaactctcttgccttgacctgggtctcccaagatcagtatcaggtaatgaatgggtaccaacttccatcttggcaaatccctgccaggccagggagccccaggttgaaatctccaacagggatagttaacatcctgtttcaggaatgtataaggggctggcagagatttgccaggatggaagtcagcatccactccttacctgacactgaccttgggagactatgctcagactgtgctccctgagccagcagcttcaacaccacctgggagcccattaaaaatgctgaatcctgagccccactctaggcctacggaaacagaacctgcattttaacaagatgctcaggtgattcttatgcacactaaagttggagaggccctgctataaggggcacttttcattatgaaaggcttttctgcacttttctaataaaggtaacagctagctgctaaaatctccttcctggaaacattcacagttgcagatacattatcattgtcagctggagaagattttgagaacttgtctaaacttagcaagtcatacatggttacaatatagctgtttcccacaatttgtaactctgtgctctttgtaaataaatgtcttccgtactgtggaaatcattattccatgatatagaaatattgagagcttattgtcttcttagtgttttcaactcatttcctcttcataacacatctcaggaaaatatatgatggtttttgtcctgattcataaaatgattatgtttggacatgaaaaggtagcagggctcacttgagcctattatgtgggttagggcaaggaatttctggatctttctctgtgttcagtgataacatgcctatcattggagcagatggattgaaaaaatatcaatgaactccaaatggaagctgggaatgatggatgaaaactaagaaaccctaatatggttactaacagcatcacttaccttgctatagattttttattataaatgtcataataaatataattgttattgaaattgttatggaaatgtgagaccagaatgggaaactatgaaagttataaaagaatgtgggccttctctttcacctccagagtttgaggtaagcaccagctcttagagattttctaaagacataaaccataaatctgttttccctatatgcagcaaggaggcatgatggtcatattttcagctcatactcaacactacctcttcctctctctctactttgtattaggttgttcattcctttcagggcggggacttgtcatctgtgtctgtcacagttctactcataaaattgtgctcaataaaagggtttctgtatgaacaaaacaaaaataaataagtgcagagtgatattggatgggaagtatctgcaaattggtttccatcactactggaaagtccccacattatccttatttatatcttttctaactgcaatgtttgcagttgtttaaagacaaaaaaagaaaaggaagaagagaagagagaagagccgagaaggagaaagagaaagagtagtagggaggccctgagtgataaatatctattttcaagtgtatatgtttgtatgccctatgaggcttggtgcactttctattcttacacatttttgatgaccttggagatgtatagatactgagaaatctagtgaaattatatattttcctttaacatctaagctgggagtattaaaaagaatcatttcaatttctacacttcaaatacacatttgttccttctatattaatagcttcagaaaattatgggataccatggaaatgcatgatgaattcagggttgggatggggagagacaatggtcatggtaaataaatgcaggaacaaagctgtgaatctcttcattaaacaattttaaaagaaaagccaccagaaatcttcctagaattagataaaaataaagtacactaggtttatgtgttttgtttacattatatataacccattaaaaatattgcaaatgcattctaactctggggaaggaagccagacaacatattttagcaccagtgcatttaggtgtacctaagtgggctgtaactttccatcttaccttcttaattatgtcagcaggtttactataaacacctgctctttagggattataattcagcagtaaagaaagggtctccagcagacactgagatagcaagccaaactcaaacatgtttttgatagaaaataggcactttagcttggagaactaccagcctttggtagtttaaaaaaatgtgagtaaggctaaaacaatggtggacattattagatatcataccacttgatagtaaagctatcttacaacatcacatttgaaaacctttaaatatcagcttgtgatactgtttccacaagccccaaagaatcttgatttgaattttggaaagcagccactagagtgagtttttccattattgttttggactgccagcatattgcatatttgaaataccattcctccaaatagtggccctatttacaagacaagatcaattgttcagagatttaaaactccccataaatatgcaggtatgtgatgggttgaactataatgttctatctttgggtcaaatgctatggaaaatagaattttttttttcattttccctgagtggtgaactgttacttcagtgaaaaaaaagttttgcacaatttgtgtatcagagtctcttccagtcctgttgaagattacggcctttgagaaagaaacctggttagtcaaccgaggtgaacattttggagcttgaagggacttctgaaatcatgtagtctagccccttcattctaaaaataagaaaatagaagggcagaaaaataaatgactttctcaaggtgacactataaatcagaggtcagcaaactatggctcgaaggccacatgtggatttgtttttgtaaatgaagttttgttggaacacagccatgtccgttagtttccacattgtctatggctacttttgatacaatggtggagttgaatagttggtacaaagagcttatgactcatgaatctgaaaatatttagtatatctggctctttacataaatttgctgatccctactatcaatggtagacttagaacttagcctcctcagaatagtttttaggaaatattttggtttccttactcagaaagaatttaagaacttaatggaatgggagataattattaaatagatatacttttaggattctaagtttttaggcaaagtcaagaagattaagtaaactacagtctagataaatataggttaacccataaaattcaaaaataattaaaatacatgcccatgtccccaacaaacagtgagaatataatcttcacaatgaatagctaaatcggaaaatgtttgaatatttcgtatacatgttcaagggaagccagttggatttggctaagcttggtgagtagcagtattaggttatgagtcatccataaataagtgaaatgtgaagatgaattttatctcttaaaatgatgagtgtttgcaaaagtgttttaacaacacatttgaaaattagattaggccatttggcagattcaacaatgctgtgtttcattaactctgtaatcactgtcaagttctatgacatgatgcatttggtgggtcctgagagcaatacacaggttccatattaccgctaaaggcaacagactgggtcctaaatgaagcaagaaaaagcatttaatgattggtatgggttaaactgttgtctgtgtgggatagtttgaggaatgtaaggaagatttccctctctcctgaatttcccagcatgaactcctaactgagaagtttcaattaaagctcaggattcaggggacaacccagagccaggacaacgtccaggttgggtgagccatgatgcctgccttcttcaacaatgttataagtcccataagtgtccaggaaagcaagcaccctatctgcttgtcacagctctagtcctacaaaaggactgatacaagagtcctcaatgaaacgttttgaatgagtgaatgagcaaatgtaatgtcatgagggcactggatgcttgaaaaagagaaatagagctctcagactacattctatcccacacagcgggaactgtatagtatagggttgctatatgcagtacgagactgaccatggaaccttgcaaaatttacctctcacagttctggggccaaactcccccttttataataaaccattcccacgataacagcattaattcattcatgagggtggagccctcatgacttaaacacctcttaaaggtcccatcacctcccaataccactgcattggggatcaaatttccaacatgtgaactttgggggacacgctcaaaccattgtagatgctaggctagaagaaaaaagtctaagttaggtgatcattggtgtttattttacgtgtcaataactctggttttgtctattctgttcactgatgcattccaagcacctagaacagcgtgtggtacaaactaggcattcaatcaatatttgttatatgcattaaagaatgtgtgcaagtaataatgatagcagcttttgatcacctatgtcatacagtccttacaacaattcaacaggatggtcggtattagtcctagttttcagaggagaaagctgatgtttggacaaggataaggaacctggttaagctcacacagatgctatgaggtggcatcagtgttcaaatgcagctctgtctgaatctagactccatggtttggcttttttttctactttattcttccctgattttacacaagtagtagcaggttgtacatatttctgcatattgattttttttattttaatgtatctgcagagtcttcccaaatcagtacataaagaatttcctcattccttctttttacagctgcatagtattcctttgtgtggttgtgccatgttttatactgatgaacacttaggacaaaatgtatgctcctttcagtttggatagaggttgctaaattgccctctatcagggattgccaaaatgcactctgggcaatatatggcaatgtgtttccctagagccacaccagcactgtatgttttcacaccttcagtacttcctctctacaatttctccagcgattccaccaagaatccacatggaatcataaccgttttctagtttcatttgtttaaaataaaatcctaagtatgaaagtaatatatattcactataggaaaaatatacaaaatttaaatacacaatataaaatacacaaaatttaaatacgcaagaatttaaaaaaccaccttaatctgacaacccagatttaaccacagtgtacccattcttccagactgtttttcttgcctatgcacacagattttttttacaaggtggatcacatggtgcacaccctttttgtaaccaactttgttcatttaactacatcctatggcagtcggtcttcatctacaactttggtttaatgtctgaatgctattccatcattggatgagctgacgtagtagcaaacaacccctcttgttgagctgttctaaggattaaaaagaaagaatctgtgaaagtgcctagaacagtgcctgacagcagttattcaacaaatggcatttcaacacacatgtattcttacccactcaaaggcagagaactacaattttaatcctaacatcctgtgccagtatcatcatgtagcttggattcatttattaattcaattcccatttgaacatctatcatgtgcctggcactagtctgagtaatactgatagaaaggtaaggacattgtccatcccctcaagggtgagtgcccagcctaccacctggcatcatatgcttgggaagtataataacagctacaaactcatgaacaggtacaacagcattctagcagaaggagctcaagacttgacctgttgacggttctcacatttagctctgtgatgcctctctgagcaatgaatcttagccattctactatgctatctcctcaacaatatcatgctaattatattgtccttccacatttacagagttggagaattcagtgaactaagagatgcaaatgcacagtacaaaattcaaatgtccaattcggggcagggctgcatctaactttaatggcaaccactgcatgtgatgtctggggactctatagatacatggcctcagaccctgaagacatctggattctgtcactggattgttcacaaagtgaggctgaactttgtaagtagaaacttttggaagaagaccagttaacccagatttaattatcctaataattctccctgatacctaattaagaaacataactaactcaacaagctgtgagaggcttgtgctgaaaatcatagatgtataactacataattaattttattgtgtgggttggtaaatcatgtaatgaatcagatgaaaataatcagaaaagtatttcaatttggttgttaaaatatacagtcaaatgtcttttaccatagtgaaactcttgattaataatacatttcttcttgattaaaatcattttgtaatgaatatatttttgagcatctgctttcatgaggcttggcattaatatttaaagtagtttttaactgtgtgcttttccccctttactatattttcctgtcctccttgtcataacaaaagtgacgtcttaaaaatagttggtgggatgatttttacttctatctgtggggctttgaagttattttcaggctattaatgtagctttcctcacatgtacctgtgccaaaacctgctaataaggaacagtagaatgaaaagctgctacctgttgtatgagatcaaaatactttgactactgtactgaagcttgatttaatggagaaagttatgttctgagggaaaagagaaagcagcctgattcaggacctatgtgtgtctacagcacgaataaatggaatgaaaagacctggttagccggttccttactgattcatgggggcaagaaactgtacaggacagtttctccctgagggtcatgccagggaccctctactaaccccaatgtgacatatcaagctgggcacaaaagaaacatggctgtcttcaaaacttggagcttgttaaattcatccagaaccatctattatcattcattttcctcacacctctccacttccttaccttaacccacattgcatgtcaacccaaaacataccttgaataccatctgcttgcaaatgtaaaatactatcttaggataccttgaggtatctgtagggtttggggttctataatccaaccaccatttacagcaagctaaatgagaatgctatataaccttgggttagtctgaaaataatctttgtgagtccacaaagataagaatgataaaattctggatcgtgttttattttgttagacctgtatagtatcatgcaatgtcaccgatgaatgaccgaatgcatagagctttagctttggttttcccatatctgaaatgaagataatgcattcctcaacaccaagtctcaaaggatgcagcttattcctggctacctgtccaaaatattaccagatacataagaaagctgataagttgttatcacacttatttgtggcacagtgtaagtaatatggagtttggagtagaaagtctcagggctcagtagattgctgtccctattaggctagttatacaccctttctgtgtctcagtttcttcatctttgaaagggaaataataatgcaggcgcctgttgcgtgctgaggcaggcctgtgagtatcctaagcagttatatccttagaaatgctgcgtgctactcttattagtatgaccattactgcttacaacacaatgtaccatttgatgagactattctaaatgagtcaagcattgtactttagagctttatgtatctcatttatctgcataacatcactgtgagctagttgttattatttccattttacacataaaactaaaacccagaaaagccaacctgttaagtggcaaacctggtatttgaactctttccctctgatgtaaagatatgttgtatttatcactattagactctaagcagaaaccttgagaatgcttggttttatgttttattcaactaaggtttattgagaacctgctatataccaggtactatactaagaattgtgcattaattacattatcttcttgtaacagtcctatgagctaagcagggttttttcatcttggctctattgccattttggccagatagttctatcttttgaggggctgtcctgtgtgttgtaggatgtttagcaatatacctagtctcctcctcccctcagttgtgaccaccaaaaatctctagatattgctaagtgtcccttgggggcaaaatcaccccagatgaaaaacagtgagttagaataattctactttacaggtgatgaaaacaaggtacagagagtttagagtaaattgcacagggtcacaaatctagtaagtggcagaatttgaatctgactcgggactttggaacctgacctcacattccttctcccctacggcatccctttttctgatactgccatgtttctaaggaaactcaaataccaaagaggcctccaggtggctcctgaaagcctgccttctcctagggcgagctggccatcgagattttgtccaggacttagaggcatgaacgcaggaggaaaccatgggttgcttccactaatggttgcaatacaaatcgttccacaactttgtctgtaccattcatagctgctctcatttcctatcaagtatgaagacattttttgtccaggaaggtttcaatctgttgcaaacaatagatgggtaaagcacaaagttacaaaccagttcagtcagtcgctgggagtttctgaagtgacttaaatagccctgccaatgtaggtcgctatttttaaggctgagctaagcgtttgaaagtggttcacacagccatgctctcagatagaagtcacaggacatcagaattgcaagaactctcaaggccttgcctgagcccggtggaaatggacactgtgcacccaggatcacacagctgggatttctggtaaaaaactttctgatgtttccttccgccttgagaatggctgaactcatcaccttctgacattctgggaaggtgtgactgcttggttaagacccttcttgccctgctcttgccagaatggagaagaatagatgaccaagcctttcactgtctttctgttctgaggatggattaaagccattcatacttgcaaaaccacccaaagtcctatattatagttatttagcaaagactttatagcacatactgagtgctttacaaaattcacttagtattctcccaatgggtcctattgtcatcattttaccaaggagtagctggaactgagggggttagggagatgaagtaacttgttcaaggtcgtggaaaataaacggcagagcctggattgaagagagtctggttctaacccagtgtttctcaaacttgagtgggcatcagcattgtgtggaagcttgttaaacacagattgctggatcacccccatcaccccagagttttggattcagtaggtcttgggtggtgccccaaaatttacatctcaaattcccaggtgatgccgctattgctgctcctgggactatgcttctcaaactctctgctccagcatatctgctcttgatcaccacatccttcctctcctaccttgtcagctaaaaataaaaaataataataataaaaaaaaaggtagagttatgtggagcagtgggtcgccactttggctgacctgggtagtataaaataccaatgcctaggccctatccccagatattcgggctcagtggcttggctttggttccaggcatctgtagtttacaagttcctccatgggggattccaacgtgcagtaaggcatcacactggaaaccactgatttgggtgatgcctcacaaactttccagggtatataaattccatagggatctcaagaaaatgcagattctgcatttctaacaaaccacaaggtaatacccatgctaccagatctcagccgaagcttggggtagcaagaactagtatttcccaaaccccatggttaccagttaaaaaatacagaatgcctacttcaatttaaattttcaataaataataacattactttttggtataagtatatcctatatattacaataaaattatactaacatttatactaaaaattattcattgtttatttgaaattcaatttaagtggatacttttgtttggctttgctttttggctaaatctggcaaccctacctgaagacaagaatcatctgaattacttgtttcaatgcattcacacctactcatggatttcttgttctaatgcagacctactgaatcataatcatcatttctgggacctggtaatctgtatatttaacaagtgctgccaggtgcttcttttcagctcaatttgggaagtacataaaaccctggattatgcctgcctgaaatcctcatactggccgttgtcagggctggacttgtagtcatcacactgcataggaaccggagccaaatccctctgcaattacgacctgtgtcgttaacttttctcaaggttgttatagataaatacttacaaagggtgttttttttttctacttgcacttttaatttgctaaatcatactaaggcctttcagatccatgtattttttttgtcaacacattaacagacatgtagccatgtttgatcttaattattcaattatttgttttgtatcaggggatactccttgagctagattcagttgatttgcatttgtagagttttccagtattggcacttcatttggtattttatgacaagaggctttatttgaaaacatcttgctaaatggttgttagctgcttcctgaacatactgtacaggaaaatgtagtttataataaaattcagccttcctccaactcgttattataatgctatattttacatgtaaattatattaggaagcctgtgtctttcctttagtgattaagatttcatggaggggaagaagaatggaaaggaaaggaaaaggaaaaggaaaggaaaggaagatagtttatttgttttcaataagttagcctcctctggggaagataaactttctgacaccgaacataattgagtaagccagaataaattgttgcattctctacataggcctcctttcactcacaaggatattctttgtgccatttctaactgtactattacttttggaaacatttttaatagaatagactgtgttcatacctgtaagtacttttcttgataccaccttagaaagcattcaaatgcattctctactagcgtagagaaattggtgggtttttttggttttgcgtgtggtttttttgttgttgttgttttaatagtacctcagggtagcaaattcatgtgttctctcactgcagggaagcagcacattaaaaaaaaaaaaaaccaccagaggaaattgccactgctgacttttgtgcaaagaagaggaacaaaatgcttgccatgtcttttagtagtcaatgggccacagataatcctatggtggcattctacatttaccaaaccagtattaaatttgtgaacactttttttccaacagaaaaactgttcctacatcctttatgaaggctgtaggaaaatggaaaggaagttaagaaaaaggaatggaggtggttaaaattatgcaaaatagttcatctgcagaaaacatgcaggaaatgggcttgtttcacttgagaggtgttggaagggctgggctggggagggatgagttgcccagtatcctggggaattaaaagtctgaaaggccgagacccctgctttggatgtttgctgcggaagagccaccacatgaggttgttcagggtgcacctagtgcgagagtgcccagctgtgttagcccctgccacactcactagcctgggtgggcaccaggctgggggaagggtgcctgctctgcagtcatctgactgcagggggtgctgtttcctctttgcaaagggctcacgggtagctgagactgtgagtccctgaaagcatcatcactgctccctgccaccagcttcggtggtgccagcctgggatttggaaccacccaaaggcttttacaggctatgcagtgaataacttcatctgaagtgaaaggaccaagtgatgagggatgttgagccatcctaaaatagcatcatttacttccttccgaagtatggttaaggtctgaggaagtcttgggcatacatgagggcaaggaggaatttctgcaggtcctgggctgaggaggcttagccaggattcagtgatgcttcagaaactggactcaggcctctggttacagactgtgactacaaggctgcccattgctactgcttgtcacatggagttacttcctctttcttcttgatcttggaaaggcaggcacctagaaaattctccagaacctaccctttcattttgctgctgaattgaagttgtaaactagaaattgtaaaagataatgtgtcgatttttgttgcaacgttaattgggggtttgcccaatctaagaggagcaagtcacattctccttccagagtttgtctcagaaggaatgttcaggagtcaggtgtaatgatgcttttttttttttcttttccagccacaggacgaagtcttcaggctggccgcctccctcgggaacctggggcttgagccaggtgccgccctatggatgggagatgacggcaaaccgagatgggcgagactacttcatcaagtaggttaaacagatggcatgaacaatagaatccttggccaatggacttctttatctttgtttatgagaatgaacatacttaaattaggcactcataggcatttggaggccattactaaagcagctggatctcttaagccagctgcttatatttctatatatttatatatttatttctatacatttatatttctatatattgtgatgttgggttgcttcattcttcgacaggcaccatcttcgaatgacaagtcactgtgtagcatggtaagcctggctcagagcaaaagtttccaccgttaaatattaggccaagttgtattcgttgtctgagattaacaaccgaagttggacatgcaagaatctcatttacaaggttttctaggagtggtcaagacaggaatgctactttctcatctgtaattttttaaaaatcagctaaaaggattatgtacattatttgttttattgtaaatttctcacactaacgttggcttaggttttggatttttgtggtgctctggttttttgttaattgtggtatagagagagagagaaaaagagagaaagataacatgaaatttaccattttaaccagttttaggtgtacaattcagtggcattaagtacatccacaatgttgtgcaaccattcgctactatccatttccagaactttttcatgatacccgaaagaatctttgtacccattaaacaataattgccagttcctccctccccttaccccctggtgacatctattctactttctgtctccataagtttatctgctctagggacctcatacaagtgaaatttatatattttctgtccttttgtcactgacttctttcacttagcgtaacgttttcaggctcatctatgctgtagcacatgtcagaagtttttcctttttttatttttcctttttaatgttcccttgtgtggataggccacattttgtgtattcattcatctgttaatggacatttgggttgtttccaccttttgtctattgttactggtattgttatgaacatcggtgtacaagcatcaatttgagtccctgctttcacatcttctagacacatacctaggcgtggagttgctgaaacatatggaattgttgggtcaaaattaaaggctgtgtttaactttttgaggaaccaccaaactgttttctggagtggctgcagagtggtttttttgtttcgtttttttgtttgtttgtttgtttgcagttttgtgaaaagagcatttctatttctcaaaatggcaagggtccatactgccctttttctccaacctgagcaaaatatccttaattataagaaattcatgaaacagatttgaaatcaggaagtgtggttgggtctatcctgattataatagaggagagattggaggccagaaaaaaaaattatttcacaaccacatgctacattctttgttccagccaagttgattatggactgattagccaaacaccggatcaccgtgaggtgaggggtcatttttataaaaaatatctgccaagattgtttctaggggatttggtcttttgtaccaacccccgcgcaccaccacatacaagtgaggattgttggaaagtatcaacagggacaacacatgtgagtgttgtggacagtttctcagtctctgaagcccaaatctctctccttccctagaattgctgcacaggggacaggactcccaccccttcagagcacagtttctttctgacgtacttaactcctgggtccatcccaggaagatccagtatgcccttgaacatgactggaaagtggccccctggcttcccaaggctttcctaaggatatgctcacagagatactatcatagaaatggcagtgggagcagggcctcccagaaacctcaaagattagaagaaaggccaatagtttggctcaaaccccagagtttgaattcataatttcataccgtttgtccaagtcccttaggctgctaggaagacagtattttttaatattatattgtaccatctattttgtaacatggctatgattgtgtgcaattggctcagttaaggtgaactagatgctttgactcaaaacaataaaaattttgggctgaagaaatataatttttaaaagatatggatgatgggtttatgaaggtatgcatcagacttctctgattaaaacaggtgtttcttttcccctggttggatttgggttcccatacattccaggtcattccatcaataggtggaaacccaaactgaggccaactggttagaggttctgggaacgtcagctagctctgccttcatgcattaccattagcatcgctgacatttttaagagccagcctgggtgtcagtttaacatttacactggcctaatgcccactgttaaaacataagagcaaatcagcagcttaatagagaaacctgcactgattactaaatggcaagttttaaaaccaaagtcaccagtgttatttttccaaatccatgtggtttcattttacttgaaaagtaagtttctacagtcctctcagagaaagttttaagatgtcaagaacagtatttcttcggaaagtgtttgttctttatcactaatgagttttataaataatgacaatcattcttttcctttccttgttttttttttttttacttactaggtaatgtttattacaaagaggtattctaattatcagagttctcgggagcccaggtttgcagtgtggaatatttctgtactcattagttttagaagttaaaggtacaatttgaaaattaatctatggttgataattagcacctttgcattgaatttttcactctcttgcatattttttgaaagagaaatttagatgttttcttttttttatctcgtcttaggatgtaaataacccccatcagacaattgtttctgatggaggtacaagtattccaagtgacagacaaagctatgggaggaagttggcttttatgtgttcaaagttagagtctaacaactaaataatgagataattctaacataatgagtctttcagaacatggcccaggagagttcaaaatgtgctcaagtttcatcttccctcttccatacccaattatttagggtagggctgggtaacctgttatctatagagttactgattcacggggttaaatgaaggatgcaataaacacatgctaatatatgtttttataataccgtataggctgcaaactaatggttctcaaccttggccacacattggaatagactgaggatcagtaaaaaatcctgatgcctgggtctgggattgagcctggaaatagtgagtttcaggagctccccaggtaattctaatgaacagctatggttgctgctgtaaagcacttgtcaacacatgatctcatttatttggcttgaacacagaaatgattaactccatttttctggatggtagaactgagactcagcctatgagaaggaacaacttttgttgatattcttggagaaatatgaaatgcagttttaaggaacagaaaacattgtttaagaaatatgatagatgcaaatttaaaatttctcagttccttactattaccagttaagagagagcagagcaggggaagggaggaagacagatggaaagaaagaaactacaaggaaaaggaaagagtcatgggagagggagtcccaatgagaaatggataaaagagggagagatgaagagaaagagaaatgaagagaaacagagaaagtgagatactctaaggtgattgttacaataacagcatcaattaataataactttagatgtaggtatagatggagagggatgtagatatattatagatccaatcatagatacagatataaaaatagatatagatgtggacatacatatagatgatagagaatatagacattgacgtaagtattaatacagagatagatgggtatagatacatagatggatatagactataggtatagatgatagagctatagatatggatatgggtatagatgattagatacagatatagactatagatgagtgactatacagtcacattcacccaggagagtcctggtttatgggtatcattctgaagtaattacagacagcacctccttttgctctcaaagtgttctggtttggataacacaagataaggtattttaaaaatacatgtttaaaagtcagagaatgaggaacaccattttttagttaaattgggtaaaaatatgcttgtttgactgcaaaggtagggagagttaatgcaaagtaacatgattcataaatctggaactttggttttgtaaattacaggaaaaaattaaaacatgagcaaaataaatattaaaatactagctggcaaaatagattattatgatgagccaagttagagtctggggatagagatgggggttggagaggagactggagggtcagttccgaagcacatggcctgatttttcaagttataaatttaagaggctttttcttgttggcctgctggcttcctggccaccttcatcctgtgtacacaaaaagtagccctgtatgaggattggacaagacatgctgttctattattctaccagcaattcccacagtgggcaattaaactgagttactatctccttaatgcagaataattcaactctgaatcctgaagagtagagattagtaatgagatgtggaaacttccactttgttctgcagtatgggcttggctcaacttcggagtagtttagtcattcccatctgccaatctattccatggtcaatgtaaaatgtgtttttggcttatctatctatagaaaataataatctgaataaatacaagtaatttgtatgccctttcttatcaaccacagcagaagacagtcaagtcaacatgataggattctgtcatcatggaaattagaaatagaaaagccttacctcattcttctgtgtgagccccaaagtatttacccagtctaataggttatcttcagatattatttggtagttctagggctattctttggatatttttttcttgatttttactacaagatttcatgagacttttactgttattctgtggagtccctttatctgttactctgtggtgaattcccttaaactttttctcctctaaaaagttttttaaatgtcaagaagagttaaggtgtaaagttgggatgtggatattgtggttgtgcccatcatcccctgtgatatttttatatttggagcagacaccaatttcctactttatcaagcctacgttttaatacacacccaacaaaggacaaattgatctgagagattacacaagttgttatcttttgtctctgctaataaaatgctgcaggtctttgtggaaattaacagttgtgcccatgaaggaaataagagaaatctcttggtgataggttactctgttattctgtgaggtgtataagcatccaaagagttaataactagcaatatgttagaaaacaggcagtttgcctcattttttgtgggtgtttttgatgaacaattcttaaatatgttgcttttgagtacgcatgatgggttctgcataaaaagcaaatacttgcctcatggcaagagcaaatgtcatttggttcaatgagttcctagatcccaagcatccagtcaaggggaggaaagtatattgtaattttggaatgggggaaacgaagtcaatatgatagtatcattacatgaaatgaaaggtaattatgccctgttaatacaaaagcttcccaggctgaacattaggagctgtttattcccttcattggagcagatttgttttcttttgaatctgacaaagcacctatctgctgagttaataatcactgctcccagctggaaggtaagtttgcagagttgatggaagggcttttaacaggaaagctctgaaatgactctatcattccagatctaatttggcatatggcacaaagagctgtgctaggcaaacttctgcttcagaggctgtttcattttccctatgtttcttcttgaatgtttcttcttgaaactttgctggcttacttaatctggccttcactctaggacaaatccctgagttgctctccttatttgtccagcaggccagagtatctggagggattgtaattatctaaagttccttgggccacttgactacaacagagttggggcatgtacattcaagccaagctgtggacagcaggttagctagtgcactgggtcgcctctttcttctcctatgctgtatatagcccctagggatgtacaggaggtgggtcacaaagtccattcagtatcacagggatggccaacctgtgcaaaggagaagcacctggaggaccaggtttccatcacagcctgtaattgaaatactagcttggggctgcctgccacccttgatttttttgagtggcctctggacctcttctttctagattgagccaacccttgcagagagcaattttgatgttattgcctaaggctggggcacaggcagaaattctggcctgtgccaaatgccacgtgggggtgtgggtgttgctgccaagtaaattggctgagcttaagaggacatggaatcaccttggaggcaggtgccttttcagtattgtctgcactccagcataaaagaaggagagcagggccaggagcgatgtctcacacctgtaatcccagcactttgggaggctgaggtgggcggatcacctgaggtcaggggttggagaccagcctgaccaacatggagaaaccctgtctctaccaaaaatacaaaattagccaggcatggtggcacatgcctttaatcccagctacttgggaggctgaggcaggagaatcgcttgaatctgggaggcagaggttgcggtgagccaagatcgtgccattgcactccagcctgggcaacaagagcaaaactccatccgaaaaaaaaaaaaaaaaaaaaaagggggggagagcaactgagacgggagggctggtgacagaagtgccatactgtggtccaccaaaaggtgggaaactgcagttcctgccaagcccttatcctgtagttcctctcaaagcttgaataaagccttgttatcaatggccaatttctggtgaagagctccttcaattgcaaggatgataagagatcacactactcttggagccagtgaacactcggatcaatctgagtcacgagtagccatgtcacatatttgctgcacggagcatgccctccggctgctccataaacacaggtttggcattaggtgttcaggttgagaaggctgggagaaactcagaaatgctttttgaacttaaagggtgccgctgagcacatggggctggctccatgatttttaggacctgttgcaaaatgaaaatgcaggccccttgttcaaaaagcaggataaaagtgctggaaaaggtatgaaaatgtaaagcttttccccttcttctgtggtctctctgttaacatgtcatagagttttttatttcctatttaatgactttttttttaagacaaagtctctctctgtcgccaggctggagtgcaatgacacgatctcggctcactgcaacctccgcgtcctgggttgaagagattctcccacctcagactcctgagtagctgggattacaggtgcacgccaccacacccagctaatttttgtatttttagtagagatggggtttcaccatgttggccaggatggtctcaatctcttgacctcgtgatctgcctgcctcagcctcccaaaatgctgggattacaggcgtgagccactgtacccggcctatttaatgacatttcataataagacacatgaaaattttaaattattagcaggaattttactaatcatccttgtatgatgaaagtttcagatgaaaatataagagcattaacttgtctgaagaatcactgaaatgatacaatttgtatttcatagcttagacatgcatatgtctttcattctaatcagaacagtagaaatgctgcacacaactaactcaattgttttgattgtacttcttaatatgagcacatcctactaacactccctccctttggcttgctggtgagtaagggagaactgaaagaaaaagaacagtgggctgccctatctttccctttccttctgtcatcattttcactgtaagtggttggctaatacagggaagtaacacaagtaagaaaggatatggcagggttccttggtcattcatgtttcttagaaggccatgtctgttaacaactcattagcctttcaccatcacctcccaacctcacctcttgactctttttaaaaaagcatttctcacatggccttctcaataaaggcttagcaaagaggaatgattgcttttagctgttgactccctcacaaagcaatccccatgccctgtcaaggataggttttctcataaaaagataaatacttttcttcccccaccccaaggtaatcctctaagccaggtcagcaaaccttttctgtaaatggtcacatagtaaatattttaggctttggaggccatgtggtctctgttgtgactcaacagtgcaagtctgccatggtagtgttaaagcagtcataggaaacatgtaaataaatggacatggttgtgttccaataaaactttatttacaaaaacagactgggggccggatgtgacccatgagctatatagtactttgccaatccctactctaaaacatcatccatttgagcccattcttatatttttaattcactaattgataaattttcaaaaccctcccatgaaatgaggagctgacacatgttttatgtttgaaagaaactagggcagagattagtaaaatgacttttctgaggttgcagggagctaaaaatggacctcagagccccagtttgtcctacttgttgccagaaagctctatgatgtgtcttctgtcagcatgcagttcttgcatagctctgacacctatgacctaccttaaaggttgttctaggaacaatgtcaacattcaccagagaagtacaacttttaatatgaaaatgccatgactcctcccttccttttggtgggtgttcacagggaggaggtctgctaatcaatcacagggtttgcatctgctctcccactctaaccagcacctttgtgggaggggtacagaggacaggaaatgatagcagggggcagcccagtcacaatggaatgctgaatacaagtgcaaataattattaggaaggtgaaaattacatagcaatttgcgcttactaatggtcgacagaaaaacagccccattgtactttcaaaaagttaattgtccatagtgttttggaaaaatgttgcttattatcattgtggaattttataaggcttctgtgtaaatgtccttaactcatttttggtgatattctgttctagattgttctctcagcttctcctttctctcaccattctccttttgctccaagctcatgagaggttcctcaggtggttcttttttttttttaagctcaacatttaaacttcagtttcccacattatcaagcccgcattcctacataaaacccccaaaagggtaaaggattaataagttgaatatgttggtaccatttggttttggtccagaaattactggagactcatggctattctcctacaggagataaaggagaccaacaaaaatcagtttgcactgcctagaatattgtctgggaaatagtatgcagttaataagtatttgttgaatagatgtttagatgtatgtttgtatcagtagatgggtggatgaatggatggatggatgaataagcctgtttctgaagccttatattcagtgggccataagggaaaatgctgatacaaaaatcagtgagtatctcttcttaaattactgatgtagaaatgtcactagaagaatttaggcattagccaggtgtggtggctcacgcttgtaatcccagcactttgggaggccaaggcgggcagatcatgaggtcaggggtttgagaccagcctgaccaatatggtgaaaccccatctctactaaaaatacaaaaattagccaggcatggtggtgcgtgcctataatcccagctactcaggaggccgaggcaagagaatcacttgaacccaggaggtggagattgcagtgagctgagatcgcaccattgcacttcagcctgggcgacagagtaagactctgtctcaaaaaaaaaaaaaaaaaaaaaaaagaatttaggcatttagtgggatacaccttactcctgcaagaatggccataatcaaaaaaccaaaaaatagtagatattgatgtggatgcagtgaacagggaacatttctacactgctggtgggaatataagctagtacaaccgctatggaaaacagtatggagattccttaaacaactaaaagtagaactaccatttgatccagcaatcccactactgggtatctacccagaggaaaagaagtcatacgaaaaagatacttgcacatgcatgtttacagcagcacaattcgcaattccaaaaacatggaaccaactcaaatgcccatcaatcaacaagtggattaagaaactttggtgtatatatatacgatggaatactacacagccataaaaaggaatgaattaatggcattcacagcgacctggatgggattggagactattattctaagtgaagtaactcaggaatggaagaccaaacatcatatgttctcactcataagtgggagctaagctatgagaatgtcaaggcataaaaatgacacaatggactttggggactcagaggaaagagtgggaagcaggtgaggaataaaagactacaaatagggtacaatgtatactgctcgggtgatgggtgcgccaaaatctcacaaatcaccactaaagaacttactcatgtaactaaacaccacctgttcccccaataacctatggaaataaaaaaaaaattataagaatttaggcatttaggtaaagcctttattttataataagacactaaacgtttatcaaaaccttgtcaccaattcataagttagtgtggctgtttatcagaaattcaagatgcaataaaattatctttctggaaatagtgtcgttgcagtgtattttagcaacaagtggcatagaataataaagcacagaaataagagtaaaaaaacttggggtaaaatcccagctctttcagtgttagctctgtgatggtggattatcactaggacactgtgggcctcacttttctcattatacaacaatgtgtttggactagaaatctgtatcatctgggaatcctgtgaggtacaagcaacaaaaaattctaagtcaatttggcttcaatgataaaaataatttgttggtttatgtacctaaaaaataaatgataaaactgttacagccaaaaggagtctaaggatacatgacaactcaatgtaatatgctatactggttggaattttggaacaaataaaggacattaggtaaaacctaaagaaatctgaataaaatgtggactttagttaataataatgtatcaatattggttcataaattgtgacaaatgtaccacactaatgtaagatgttaacaataggggaaactgagtgccacatatacaggaatgctctgtactctgtaatttttctgcaaatctaaaagtgttctaaaataatgtcagacataagaaatacacaaaacaggataatgtcagcaagatggcggactaggaagcttcagttcctcattctcccacagagccacaaaattaacaacaagttattgaccagaataactttgtgagaattctaaagaccagttgaaaagttacagcatctagaccaatgtaaaaccaagaaggaattccagcaaaaaggaaaggaaacttttaaaaagttttgcatacctgttatcaatgcttctctccctatctgatttaggatagtgcaactaacaggaaacctcccaccttgggaatcctcttttaggatgaaaacaaaagagcggaccatgcatctagcatttgggctagtctggaggctgtctaaggaactggttcctgagttacgttactcagagcactgatgggacttggtgaagcactggtggccttctttggaagctgctgaaaacaagacatgatcctcagggcatgttatagctgcagttccaaaggcagacaccagcagaatgttcacaggcttctaagaagaaacaggaacaacaagcttcttaggaaattggagatgttttaaagcatagacacaaacgcagagaagacagcatatccttagaaaaagtttggagaggtcctagaatctatcgcggagctaatccgtgaagatttttccctgcacaaagtcagactataaagactaggagaggtggttgtttctcaaatgcccaagtctcaacaacagcagtgacaaatcccaaggcatactaggagagaggaaaaccaggcccaatcaaagtgccaaaataaaactccagaaactgaccctaaagaaacacagatcaattctccctcacaaagaatgtaaagtaactgtactaaacatgctcaatgaactaaaatggaacacagataaacaactaaataaattcaggaaaatgatgcatgaacaaaataagcatatcaacaaagagacacaaactataaagaagaaccaaacaaattctggaagtgaaaaatataataacagaacagaaaaaaattcaagaggtttcaacagaagactggatttgacagaaaaaaaaaacaaacttaaagacagattattagaagtcattattagaagtaatcaagtcagaggattaaaaagaaaaaaataaaagtgaagagagcctaagagacttacggacactgacaggtaaaccattgtatgcatgatgggagtcccagaaggaaaagagagggagtaagtgttatttgaaccaacaatggccaaaaacttttcaaacttgaggaaaaaaaatgggcatgcaaattcaagaggctcaaagaactacaaccaagataaattcaaaaagacccacaagaagatgcattgtaatcaaattgtcaaaagtcaaagacaaagaatcttgaaagcagcgagagaaaaataactcatcacatacaaaacagcttccataaggttatcagtggaattaccaatagataacttacaggccagaaggaagtgacaaagaatactgtatccagaaattgccacagccacccaaccttcagcagcccccaccctgaacagtcagcagccatcaacaccgaggcaaaatcttccgttagcaaaaagattatgatttgctgaaggctcagacaattgttgccacattttagcaatgaagtatttttaattaaggtgtgtacattgttttttaaggcacaatgttattgcacattcaatagactatagtatggtatgaacatattttttaagttctgggatacatgtgtaggacatgcaggtttattacacaggtaaacatctgccatggtagtttattgcacctatcaacccatcaccttggtattaagccctacatgcattagctatttatcctgacgctctccctccccccacaacccccaactacaggccccagtgtgtgttgttcctctccgtgtccatgtgttctcatttttcagctcctgctggtaagtgagaacatgtggtgtttggttttctgttcctgcattagtttgctgaggataatggctttgagctccatccatgtccctgcaaaggacaagatctcattcctttttatggctgcatagtattctgtggtgtatatgtaccacattttctttatccagtctatcattgatgggcatttagattgattccatgtcttttctattgtaaatattgctgcagtgaacatatgtgtacatgtaactttataatagaatgatctatattcctttgggtacatacccagtaatggcatggctgagtcaaatggtatttctggttttaagtttttgactaattgccccactgtcttccacaatgtttgaaactaatttacattaccaaaagtgtgaaaacattcctatttctccacagccttgccagcatctgttgtttctagactttttaataattaccattctgactggcatgagatgatatcttattgtggttttgatttgcatttctctgatgatcagtgatgttgagcttttcttcatatatttcttggccacataaatgtcttctgttgagaagcgtctgttcgtatcctttgcccactttttaatagggttgttttttcttgtaaatttgtttaaattccttgtagattctggatatgagacctttgtcagatggatatattgcaaaaattttctcccattctatatattgtatgttcactctgatgatagtttattttgctgtgcagaagctctttagtttaattagatcctatttgtcagtttttgtttctgttgcaattgattttgatgtttccatcatgaaatctttgcctgtgcctacgtcctgaatggtactgcctagattttcttctagggattttatagttttgtgttttacatttaagtctctaatcgctctggagtcaatttttgtataagatctaaggaaggggtccagtttcaattttctacatatggctagccagttctcccagcaccatttattaaatagggaattctttccccattgcttgtttttgtcaggtttgtcaaagatcagatcattgtaaatgtgcagtcatatttctgagatatctattctgttccattggtctatgtgtccgtttttctaccagtaccatgctgttttggttaccgtagccttacaatatagtttgaagtctggtagagtgatgcctcaagctttgttctttttgcttaggattgtcttggctatatgagctcctttttggttccatatgaattttaaagtagtttttgctaattctgtgaagaatgtcaatggtagttcaatgggaatagcactgaatatataaattacttcgggcagtatggccattttcaaggtattgattcttcctatccatgagcatggaatgtttctccatttgtgtgtgtcctctctgatttctttgagcagtggtttctagttctccttgaagaggtccttcacttcccttgttagctgtattcctaggtgttttattctctttgtagcaatcgtgaatgggacttcattcatggtttggctctctgcttgtctgttattggtgtataggaatgcttgtgatttttgcacattgattttgtatcctgagactttgctgaagttgcttatcagcttaagaagctttggggctgagatgatggggttttctagatatgggatcatgtcgtctacaaacagagacagtttgacttcctctcttcctatttgaataccctttctttctttctcttgcctgattgccctggccagaacttccaatactatgttgaataggaatggtgagagagggcatccttgtcttgtggcagttttcaaggggaatgcatccagctttggcccattctgtatgatattggctgtaggtttgtcataaatggctcttattattttgaggtatgttccatcaatacctagcttattgagagtttttaacatgaagagatgttgaattttattgaaggccttttccacgtctattatcaaatggtttttgtctttagttcagtttatgtgatgaattatgttcattgatttgcatatgttgaaccagccttgcatcctggggattaagccaacttaattgtggtggataagctttttgatgtgctgctggatttggtttgccagtattttattgaggatttttgcctcgatgttcatcagggatattggcctgaagtttttcttttttgttgtatctctgccaggttttggtatcaggatgatgctggcctcataaaatgagttagggaggagtctctccttttcaattgtttgcattagtttcagaagaaatgacactagctcccctttgtaccttaggtagaattcagctgtaaatccgtctggccctgggctttttattttttggttggtaggctatttattactgcctcaatttcagaacttgttattggtctattcagggattcagcttcttcctgattcagtcttgggagggtgtatatgtccaggattttttccatttcttctagattttctagtttgtttgcatagaggtatttatagtatgctctgatggttgtttctatttttgtggggtcagtggtgatatcccctttattatttttattgtgtttatctgattcttctgtcttttcttagctagcagtctgttttattaattttttcaaaaaaccagctcctggattcattgattttttaaaatgtgttttcatgtctctatctccttcagttctgctctgatcttggttgtttcttgtcttctgctagctttggggtttgtttgctcttggttctctagttattttacttgtgatattagggagtcaatttgagatctttctagcttttcgatgtgctagaaatttcccacttaacactgctttatctgcgtcccagagattctggtatgttgtctcttttttctcattggtttcaaagaacttcttgatttctgccttaatttcattatttacccaagagtcattcaggagcaggttgttcaattttcatgtaattgtgtggttttgagcgagtttcttaatcttgagtcccaatttgatggcactgtgatctgaaaggctgttatgatttcagttgttttgcatttcttgaggagtgtttcacttccctttatgtgatctattttagactaagtgccatgtggcactgagaagaatgtatattctgttatttttgagtagagagttctgtagatatctattaggtccacttgatccagagctgagttcaagtcctgaatatccttgttaattttctgtctcgatgatctgtctaatattgacagtggggtcgatagtgggagacttctcccactattattgtgtggcagtctaagtctctttgtaagtctctaagaacttgttttatgaatctgggtgctcctgtattgggtgcatatgtatatttaggatagttagctcttcttgttgaattcacccctttaccattatataatgccctcctttgtcttttttttatctgtgttggtttaaagtctgttttatcagaaattagaattgcaatccctgcttttttctgctttctatttgcttgataaatttttttctatccctttattttgagcctatgtgtgtctttgcatgtgagatgggtctcttgaatattgcaagctgatgggtcttgactctttatccaacttgacattctgtgtcttttaattggagcatttaggccatttacatttaaggttaatattgttatgtgtgaatttaatactgtcatcatgatgctagctggttactttgcagacttgttgatgtagttgcttcatagtgtcattggtctttgtacttcagtgtgtttttgtagtggcttgtgatagtttttcctttccatatttagtgcttctttcaggaactcttgcaaggcaggcctggtggtgacgaattccctcagcatttgcttgtctgaaaaggattttatttctccttcacttatgaagcttagtttggccagaaatgaaattccgggttggaaattcttttaagaatgttgaataatgccccccaatctcttctggcttgcagggttcctgctgagagatctgttattctgatgagcttccctatctaggtgacctggcctttctctctggctgcccttaacattttttccttcattttgaccttggagaatctgatgattatgtgtcttggggttgatcttctcatggagtatcttactggggttctctagatttactgaatttgaatgtttgcctgtcttgctaggttggggaagttctcctggatgatatcctgaagtatgttttccaacttggttctgttccccctgtctctttccggtactcaatcagtcataggttcagtctttttacataatcccatagtgctcagaggttttgttcattccttttcgttctttttttttttttttttttcctaatcttgtcgacctgtcttatttcagcaagatagtcttcatgctctgaaattctttcctctgcttggtctatttggctattgatacttgtggttgcattgtgaagttcttgtgttgtgtttttcagctccgtcaggtcattcatgttcctctctaaactggttattctggttaatggctcctgaaatgttttatcatgattcttagcttctttgtattgggttagaacatactcctttagctcagcaaagttcgttattacccaccttctgaagcctacttctgtcaattcatccatctcagcctctgcccagttctgtcctcttgctggtgttctgatcatttggaggagaagaggcactctggctttttgagctttcagtctttttttgttgattcgttctaatcttcatgagtttatctagcttcaatctttgaggctgctgactgttggatggggtttttgtggtgacttttttgttgatgctgttgttgttactttctgtttgtttttcttctaactgtcaggcccctcttccgtagggttgccatggtttgctgggaatccactccagaccctatttgtctgggtccctcccacacctggaggtatcaccagtagaagctgcagaacagcaaagatggctgcctgctccttcctctgggatctctgtcccagaggggcaccaacatgatgctagcaggaatgcccctgaataaggtatctggtgacccctgttgggggttctcatccagtcaggaggcacaggatccaggacctgcttaacgaagcactctggctgccccttggcagagggggtgtgccgcactggggggattcacactaatctggtgtgccgggattcctccgagccagcagggggaaagactaagtctgctgatccatggagactgtggcctcccctcccccaaggggctcttttccagggagatttgagttctgtccttaaacccctagctggagttgctgaaattcctacaggtaggccccgcccggtgagtagagaggggtcagagtctggcctaaagaggcagtctggccacgatctgccacagctgctgtgtgggctatggggtattccccctgggtccaaaccatccagtctccccagcctcagcagactggagctgcagcgatggtggccacccctccccctgggaggtcagtcatcttaggcagcaggcagccacagtgatggccgctgcccttctccatgggagctcaatagtcttaggcagtaggcaaccagagagatgacagccacccctccccctgtaaattggtagtcttaggcagtctccagccgagtggctgctgagaatctgcacagctatgtgcttgggacccaaggccctggtggcatgggctcaagaggtgaatctcctgattcccgggttgcacagattgtggaaaaaacctttggctgataccagacaaagacattacaagaaaataaaactagagcccaataaccctgatgaacactgatgcaaaaatcctcaagaaaatactaatatactgaattcaacagcacattaatgcagaaaaagcatttgataagattcaacaacctttcatgataaaagaaaaaacactcagcaaactaatagaaggaaactacctcaaaataataaaggctatctataaaaagcccaaagttaacattatactcaatgctgaaaaactgagtttttcctctaggattaggaaggtggcaaggacacccactttcaccacttctattcaatgtagattggaagtcctagattaggcaagggaaaaaaataaaacatccaaattggaaaggaagagctaaaattgtctctattcacagatgacacgagcttatatgtagaaaacactaaaaattacgtgcgcgcgtgcacacacacacacacacacacaaactgctaaaacaaattcagcaaagttacaggtcacagaacagtcagttgcatctcaaaaggaataatcaaaaaggaaattaagaaaataattccatttacaatagcactaaaataaaatacttcagaataaacctaaccaaggagatgaaagacttatacactgaaaactgtaaaacattgctgaaagaaagtaaagacgacaaaaataaatggaaagacattccatactaatggattggaagacttaatattgttaaatgtcaatattgcccaaagcagtctacaaattcaacacaattcctgtaaatatgacagtgaaatttttttcagtaagaggaaaacattatcctaatttttgtatgacagctcaaggaatcctgaataatcaaatcaattttttaaaagaaaaccaaattggaggattcacattttctgatttcaaaaaatattataaaagctttggtaatcaaaacagtgtgatagtggtataaagacagacatatagtccaatggaataaaatagagagaccagaaatataccttcacatacatgattaaatgatctttgacaaggctgccaaactgaaaaactcttaaaagagaacatgggggaaagctttatgacattggatttgacaatgatttcttggatatgacaccaaaagcctaatataaggcaacagaggaaaaaatagacaaatgggactacattaaatttcaaaacttttgtgcctcataaaacatgatcaacagaatgaaaatcatgcaacctatggaatgggaggaaatatttgcaaatcatatatctgatatgaggttaatattcagaatataaaaagaacatctacaactcaacagcaaaatgtcaaacaactcaatttaaaaatgggcaaggaacttgaatagacatttcttcaaagatgataaatgaccaacaaacatgtgaaaggatgctcaacatcactattcatcagggaaatgcaaaccaaaactacaataagataccacatacgttaggatagctactctcataaaaagaggaaataattagtgttggcaagaatgtggagaaattggaacccttatgcactgttagtgggaaggaaagtggtataactaatgtggaaaacagtatggcaagtcctcaaaaaattaaaaatataactactatatgatccaacaatcccactagtgtgtatacatccaaaacaattgaaagcaaggtttcaaagaggtatttgcatacttttgttcataggagtgttattcacaatagccaagaggtagaagcaacccagatgtccatcaacagatgaataaacaaaatgtggtctttacatatagtggaaaactatggaaatactgttatatgctacaacaaggatgaaccttgatgacattatgctaagtaaaataagccagttccaaaggacaaatactgtagattccactcatatgaggtatctaaagtagtcatatggaaaacaaaatggtggttaccaggagctgagggaaacagatgaaggacagttgtttaatgggtataaactttcacttttgcaaagtgaaaaagttctggagatctgttgtgcaacaatgtgaatgcacttaacactcctgaactttatactttaaaatggctaaaattacaagtgttttttccccacagttaaaaaaaaaaatacacaaagtgcatgccagtgccactgtcagaagaagtagtttaaagaaggtcccagaggcatcaggactctgtttcatccctctgagctctcttcactttgccttactctttgagtttcatccctgatatctgcatccctttccatcttcacattggccattcagaagagaaagagaacctgtgtcccagcattctcagaatcagccatgctactcactgattggactggtggaagccacacacccaaaactgaaccagttactatgggcaggagagatgggaggtgtgggttggcttaagccaagtagggcctgcctctaaaatggaaatggaattgatcccacccagaccacttggggaagagatggttttctaatgggaccaggaatcagcaaactttcccggtgaaagaccacacagtaaatattttaggctttgtgggtcatacggtttctgttgcagctactcaactctgccattgcatcatgaaagcaaccagagacgctaagtaaatgaatgagcatggctgtgctccaaaaaaactttacagacactgaaatttgaattttatataattttcaggtatcatgaaatattctttaaccactaaaatatgtaaaaatcattcttagctcataggtggctgataggatttggcccacaggctatagtttgcagactcccgttctagagaatatatccaaatgcctttttagcttggtgattatttttctttataattttaccggggttgccttcaatcctcctgcaatacctataatgagaccaccctcagctggtgtatttgctcagaatcctcaacccaactagcaacaaggcatttggaagatcgtgcaatctcttctcctttccccatctgcaatggattgtcacaatatgtttgttatcatagcacacttgggatatacaagataatacgctgttaaatattaatgataataattctcctcctccaccattattggaaattaaagacatgacttcaactccataggtacgatttatagagttaggtttaaactctgtcatgtggctaagcaattgttcttctatttttgttcacctttagcagtgacttttttcctagcttaaatatttagtagactggaactgtcttcaggatgatatatttcttaaaggctttattttccagtcattggacagagttctattatgtaaatgattaaagcaagtattcaaaatgtgagtttaaagatcttcagaatcagagggtgaccctggagagagagagataggaggtagagctgaacaataaagagaaaagggagaataaagtcaaggaagcttttaaattcctataaggagcaggtttggttgaatttctgaagaaagataaaaaaaaaaaactggcttgggaaaaagtaaaattcactggaatacccatggggctataggagggcaatgatatgttttaaaatgaaaatggaaaactgtggaattatttggttaaatgtattttggcagcctttggattttagttcaaatacctttagcacatataatgactttgttctttatgacctacctagttacttcttcaaaaaaaaaaaaaaaaattctgagcctcaaactagcctgtggtgcactcacaaaagccacccctttggggccattttgtcccagccagtggcatctttgtgctaagtttcaaggttctatgagaagactagatttcaacccccatttggctccttggacaagccccctgcatagccatttgcactggccggggtctgaggtgattcatgataaatgacatatctgattgggtagcagtgcacttgagttgctgttccccaggtagactttccaaacaaggtcaaaaagccattcagggtacagggctttgaaggaccacatagaattcacctctgttgacactaatgcatgtattgaatagaggacttagttgtctagctctttacaaaactaaattgtcctaattctggaagattacaatttataaactccagaactttattatagtgattgctttaatggcaattgattttcttttcctttttttttttttttttttttcttttgagacagagtctcactctgtcacccaagctggagtgcagtggcatgatctcagctcactgcaacctctgcctgcctgattcaagtgattttcccacctcagcctcccaggtagctgagactacaggcacacaccaccatgcctggctaatttttgtatttttagtagagaaggggtttcaccatgttggccagaatgggctggaactcctgacctcgggtgatctgcccacctctgcctcccatagcgctgggattccaggcgtgagccaccgcgcccagctggcaattgattgtctaatgcctattttacaattgcttccttctatgctctcttaagccctcattgtgaggcccactcaaggttaaggaggaacctctgactctttctctgagtggctccataatgcttttgctgtttactttatctgttttctccagggactttgttgttgttttatttttctttcattttctaaaatttaggactgccaaatgttaaactgtccccctgacatagcttttagctttaaatgtggcttctaatagcagccccttcataagatatcctgctgcctgatttccttttaatttgtagtttataacctcctgccaaccaggtaacaacaaactgaggttgttagaactatttataagataaaagttaataggctctaagtgagagcctcatgggctctcatgaaacattagcctgaggtttggtgctcaggttgtatgctgtctccttgacactcattcttttggtttgaattccccatatcttttccagtgcttgattgttgtattcctgacagttgcatttataggaaaatgacctctaaataatgttaaggtggaggctttttattatttttgaaataaaagctaagctgcaggaaagcctggtggttaggggtgtgaagtctagagtgaagctccctggggttggatcttctgtatcactttccagccacttgagggtgggcatgctgcctttctgtagtttgctttattcgtctgtaaaatgagcataattgtacttactccactgaattgtaagagggtgtcaaaagacaaaattaaaacaaagttagttatagatctaattggcttttatttgcaattcatgaaaccgggcagcctccattctataaaatggaatgagagctccactgggcaatgacagaacagtgagttttgtaaggtggcaataaggaaacagaataattgggaaaaaaaaaaaaaaagaacacctgctgagcatggtagctcatgcctgtaatctcagcactttgggaagtcaaggtaggaggatctcttgaggccaggagttcaagaccagcctgggcaacatagtgagaccatcatctctaaaaaagtttaaaaattaggcaggcttggtggcatgcacctgtagtcccagctactcaggaggctgaggcaggaggattacttgagccccagagttggaggctatagtgagctatgattgtgcccctgcaccccagcctgggtgacagagtgagaccctgtcacgataataacaaaagaaaaaaaagtttaaaaactgattggttaccttcaggttacttttatgggagggttaaagcaaaggggacttccttattaggctgactcagatggactggaatctcctgttttcaggaaaaactggtctattttggaatctatctccttccttaaaacttcagtttgattatgtgacatttagcatgagtgacttcattttggtttacactggtctgttggggcctactgcaggagctcagtccaaaacaatggcctcctataatttttgtttaacaagggttaaatgacttattcatatgaagtgctaagaacaggaagcactcaagtcttagcttttaatcaccattaatatgatgatgatgatgatggagagaaggaagaagagaacaagtaaggaagcagactctccaaacagacttcaaattaaatatcattagtgtgcctggtgtcttggaaaagatgatgtgtagtgtccttttctgctacctgtcgctctgaaatatataaagttgtagatatggcaaattttaggcttatcatgtttgaccttgatattctctgcctcctcttttagcccctgtttcctacagcatcatctccttgatgcccttcttcttctccaatgagaacctgcattgagaaatggatctgatagagtcagtcacactagagcaagcttgtccaacccgcaatccatgggacatatgcaccccaggacagctttgaatgtggcctaacacaaattcataaactttcttcaaacattgtgggaaatgttttgcgattctttttttgttttgtttttagctcatcaggtatcattagtgttagtgtatttcatgtgtggcccaagataattcttcttcttccaatgtgacccaaggaagccaaaagattggacacccctgcgctacagtctgacggaggagactgtgtactactcctcctgggggtatttgcattttcttaaaggaaaatgcctttaactagacaactgattctaatagtaaaagttctgataccaaagactaccccatcccccctcgccacttttctgcccacctgccaacctgcattcctataaacatacaaacactctgttttgaagtttaggcacaactgaccagcattaaggttaaaatagagatcataagactgacaaagcagactctttgtggcaataagataccaaattataaacatggcctatggtcatgcaaggcaacgttaagtcacaccctacaaaccataatatctcattaaacagatttttttattcaccaggtaaaatatggcttatgttccaacctgactctggcatagcatctcatgacagagcagatcctgaaggaaattatttcaccccaaaatatatttctttgacatattttgaaatggccatgcaaagctgtcttttgtggccgtttctactgcttaaacattcatgtacaagtctttgcatgtgaacatattcttttttatttttcttaagtagatacctgggagtaaaattgctggatcatatggttactcttttaaaagaaactgccaaatgttttccatttgacgttcttaccagcaatatgtgaatccagtttctccatatccttgacaatatttgtggttatctgtctttctgattatagccattctagtgagagtgaagtggcatctgattgtggttttgatttgtatttcccctgtgattaatgatgttgataatcttttcatatgcctattgaccatttgtgtatctgtttttggagaaatagctaatttcaagtcttttgcctacttttaaattgggtcattcatcttccaattaataagttgaaagagttcttcatattctggataaaatatttctttttatttcctgaaatattttgttataatctttttctcaagtctgagagtgctacagggtaggtaatttaaagttgagggccttcgaaatgcctcctcacaggagcagcactgattagcggttcccacaagcgtatagccatctgcaggctcccctggtgggtttgttcccttggtgtgaccaattcatcaaagtatagtctgtctgtgtcactctctccatagcaagagctgggtgcagtctgacatcagccatcatctgccctgaattttaattttaagcaccttcggtactgatgttcactcctgaaatctagagcagccagagtaagtgacaggagcctataatgagaaccttttctggaatattattcttaacacatgcatagatttgcccctctggtcacaaagagccccttggggcaaatcgcgttgttagcagttgacggagtgcagaaactgctgactccagagatttccatttctaaaggactttagagtaatcctattgtcagtttcactcatcacacctccctctggatccttttcccttttccctcccatgccaacctttataacacattctctaaatcttcctcttgcatgagctgtagccatctggtggtcaaatgggcattaaaagtgcctttgacagcatcgtggaaattgtaattcttgtgttttcaagacagatagctaacaggtgacaacaaaggttttcaacttccagaagttatcatatgagaaaatagtctgatattttactaagccaaaactatttcttatgctttaaaataatgttgtcttatacatcagtgtacatatcaacgagaaattactcacaggtggtgcttgttaaattctcaatctttcacaacacatttagttttaagtgctgctcttaaaatgcccaggagtctaagccctagaattacaagtttaaaaaaaaaagtgctttttcttatctacagtctgtcttcatctgctgtatccaacccagtttcatgggttatcatataaccaaatcaaattatggaaagctggaaaaaaaataagcaattcctaaagaaaacaatggctttagttgatcattttgtctttgagattgtaaactcataattggtatgcctcttgagggataaatgtttgagtgactgtgggggcctcacattcctcatagtgcttaattaaagcttttactgatttttcaattgttggagaatacaatgttagtggcatctttttggctgagtcctcacctagagaactcactagaggtgtttccactcatgttgcttggtatttagcctcatttttcccttcgttaatttacatctctgtttattttattgtcactgcttctgttaatataaatgatccttgttaatcctttgggtttaagacttgcaatattaattggcccttacccaacagcagagatctgagttacagtttttttttttttttttttgtcttccttctttgtgaaacataagcaaatcaccacacttttagaatctggctgtttttttgttggttggtgcattctgctttgcatttctgagaactccttcactcaggctaaatatccttctcccattttagacatctgcatggcaaccagatgtagacaaaagtgtaatctacactgggtcaatatacctgaaaacacccttgtaaacgttagttcctatctggagctcaatgacgacaatgcctatgctactttcatatgttaagtcctactagtgaaactttcttacagagatgggatgccgttgttggaatttttcctaagatgttagacagagcttctcaaattttcaattcaaggacattttaaggcataagaagtctttttggcttaatggggaaattgaaatgttctctcatgcaataacttctggcatttaaaaacttctctattattatccatcaaccaaccaattaacagaaatttattgattaattgccatatgccaaatgatgtagtaagtaccatgagaagtaggaagccaaaatgtgaccctgattttaaggagcataaatttgttcatctattcatttattcatccattcattcaactaatattaactaaatgttcagtgtgtgccagacacataatctagttaaggcaaaataagcatagcaaaaatatgtaagaactgtgtagcaggatatcagagataagacaaaactcccaggagctagtagttggcagagctaacatatcttatcttcctcacagtagccagtctgttagtctgtttttttttgtttttgttttttttttttttttttggagacagagtcttgctgtgtcacccaggctggagtgcagtggtacgatctcggctcactgcaacctccaccttctgggttcaagcaattctcctgcctcagcctcccaagtaactgggactactggcacccaccaccacgcccagctaatttttgtatttttagtagagacagggtttcaccacgttggccaggctcgtcttgaactcctgacttgtgatccacccacctcggcctcccaaagtgctgggattacaggtgtgagccactgcacccctggcccagtctggtaatttctttcacttctgatgcagttgcaaagcctccatggcctgacccagcctgcactgggctcctcatattaaaaacacttgccagagtgaaaagaaagataacagcattgctaagtggaagactcctctttgaatcatcttgaccgttgttccaagggagtattgtttgtagcacagatgtactctgtaaaaatccagtgttaggagtcattaaataaatctcacctgaaaaagccttctttgtattgacatttaacctggtattcaagattatccagatctatccttgagtcacttatttatcaacctacccagactggttctctcattctgttagttatctattgctgcataacaaatttcttcaaaacttagtggcctaaaacaacttacagttattctctcccatgggtcagaaatttgggcctggctaagtggatcctccaccccagggtctctcacaaggctgcaatcaaagggctgactaggacttggaatctcatttgaaagttagattggggaaggatctgcttccaagctcactcagtagttactggcaggattaggtttctccaaggtcgttggactaagggtctcagttcctcactgacagttggcctgaggctgccttcagtttcttgccatgtgggcctccccagcataactgtttacttcatcaaaacaaacaaactgagaaggctaaaaagagtttgctagcaagtagcaagatgaaaatcataatttttgcaatctaatcatagaagtgatatctccccaatgttgccatattctgttagttagaagcaagttattcaagggaaggagaatcctctaggtagttactatcaagaggcaggcatcattggaggccaactcagaagctgcctagcagatgcataattattttgttcaacaaacatttatccattatccaacatgttagtcactgaggtacaactaggattaataagtggctcttattctcaagatactcacagtctgcctgggaacatggatcaaccaatctttaacatggaaaatcttatagtagaggcagattcaaaacccaaatgagagcacagaaaagagagatgccttttttcatgaaggatcccctgaccagaatgccatttcacagtttaaaacaaacttaatgtgttctagtctattcaggaggctgggaagttcaagatcacaacaccagcaaattcagtgtcagctgaaggcccatttcctggttcagagatgacaccttatagatgtgtactcatatggttggggggtgggggtggggagcacaccagttctcagagatttcttttataagaaccctaatcctatgagagttgagcccttttgacctagtcatctcccaaaggccccacatcttaatatatcaccttggaatttaggatttcaacatgaattttaggggcacacaaacactcaggccatagaacttcttctgttggacctcctttgacactcttgtttccttaactacatttttaaaagaggtgacattagaggtggttcttaagaaatcaagtaagtagaaacagctttccaagtgtaaaacaacaaaatgaaagatgtagggatatgatgcaatgtgacacatgctaggaatgatggaattacaatatgaccagattgcttggatgtggtcagggatggagaattatcatggcaggcagtaaatctagaaacatgaattggagtcactggagaaaaggaaagtgaatgctatgtcaagatgcttgggctttgtcatttaggaagtagagagccactgaagatctctaattagtggaataatatggtgaaatgcatgccttacaaaggaactgcagaagcagggtggagaatttactggagttactagataagaagggagagataatatttcaaggagaattgacaacaatgaaaaagaggataaatatttttcaaaggccatggagatgaaaatttcaaaatcaggagatgttttagggctggaattgacaggattatcagatccagggaagagttgtgagaaatgagggggtgatatcaaagagccaaggatttccctgaaatttctatctcaggggaatagaagtctcttaaaagaaggaccatagcttagttgacttcagaatattaacattttaattgtgcttaggacttgtttggtattcactggattgacaggaggatggatggatggatggatgaatagatgaatggtggatgtatggtgcatagttggatgggtaggtaggtgagtcagtgggtggttagatgtgtggatggatgtatggataatgttggcagtcatccaaggaaatgcaagagggaagttagttttagggatagaggacagaacggatagaaggaagtaataagaatctcagatggctaagataatggtggaaagaacaaggagagcaattagaaaattaatctagttttttatggtaatccagtggctttgatatttctcaatggcaatttattgtttcattagattcaacaaatttcaagaaagagtagtttctttggagaacaaaactaattatttgtgcaaatcatattaacattgtggaaattcattcaatttctcggcactttgtcttaaaatgttatgcaaagtctggccatcaaagccatttagcatcccttcagttttagtaagggacgtgggaatattgatttattttcccagaaacgcaaatcaagaagttccctcctttcatatctcacactaaccttacctttaactttctaccagtggcacaaccataactcttggcaatcctcaagtttcttggacatcagattttctgaggcagtgcttctcaaactttaaagtgcatcatctggagatttaaaatgtgaattctgatttttgaggcctggctggggcttgagattccacatttctaataagcttccaggaagtactgatattgttgatccatgaaccacattttgggtggcaaggttcttaaggtatcattcaatattggtgacttggctgacatcactattgttgacacagttaggctgtcaactggctttcaattcaaaatttcatttacctcctacccctgctcataatctccctgggtgattttatattatctatcccttctctaatgcctccatttgctccaacttaataataatatgcatgggtagctccaacatgctgtcttcccctcctccagatccctaatgaagctgtcaaataggaccttcttaccactccctcctgcttttcctcactatttcttagcttaatgctttctttatagttcttatatttagtccttggtctcttgttccttaaagtcttcaaacactcacaatcgattaaggttcagaggtaaaggatcaagccccattttttgagtaagaatttggtatctaataacttacagtgtttggaaggtcaacaatgtatgtgagaaaaacaaacgacaaaagcagcaggcatgggtcactggggaatgatgttttcactagaaacaaggcagctcaagtatcaaccctgctgctgaacaattgcatgaccttgaggaaatcacttaccctacctgagccaacattttagcagctgtaaaatagtacattaaatttagatgatctctatggtcttttaaaattaattatgtagaggccaactcagcctcatatcttcattatatgtttaaactagaagagaggttcctaacatgaggttcatggatctccaaggactctgtggatagacttcagagagtccatgaagttggatgggaggtgaatttcatgttactttcactgacctctgactgtaagtgagcaatttcttcaataaggaatataaactatagactagagtagtattagcagtatctgtgacttggttaccgagacgcaacaaataaatattatatcacattaaagtttgtgtagatataacattcatgctcaccactacttcgaaaatttggtgcttattagactctccactacatcttcttgttgaacatgttagtgaaggagtacatctatttattatagcccagtggctgtcaataaggggacgttttgccccacaggacacacctaacaacatctggagacatttgggattgttgtaattggagaaaggaattctattggcatctagtgggtaaaggcaagggatgctgctaagtatcctgcagtacacaggacagcttttcagcagaaataattacccagtccaaaatgtcaagagtgctaagattgagaaacctgcgacagccttttaaaaatattattttgataattatgttttagtataataaattttctttgtaatcctgtgtattttattttatgcatttacaaacgttgttcttaaaagttgttcccatggccttgctagactatcaaaggaaactgatatggttgggctgtgtccacacccagatctcatcttgaattcccatgtgttgtaggagagacccagtgggaggtaaatgaatcatgggggcaggtcttccctgtgctgtcctcatgatagtgaataagtctcatgagacctgatggttttataagaggagttccctgcacaagctctcttgtctgccaccacgtgagacctgcctttcagcttccagcgtgatcatgaggcctccgcaaccacgtggagctataagtccaataaacctctttcttttgtaaattgcccagtctcaggtatgtctttatcagcagcgtgaaaatggactaatacagtaaattggtaccaggagagtggggcactgctgaagatacctgaaaatgtggaagcaactttggaactgggtaacgggcagaggtttgaacagtttggagggctcagaaaaagacaggaaaatgtgggaaagcttggaactccctagagacttgttgaatggctttgaccaaaatgctgataatgatatggacagtgaaatccaggctgaagtagtctgagaatgagatgaggaacttgatgggaactggagcaaaggtgactcttgttatgttttagcaaagagactgctggcattttgcccctgccctagagatttgtggaactttgaacttcagagagatggtttagggtatctggcagaagaaatttctaagcagcaaagcattgaagagatgacttaggtgctgttaaaggcattcagttttataagggaagcagagcataaaagttcaaaaatttgcagcctgacaatgcaatagaaaagaaaatcccattttctgaggagaaattcaagcaggctgcagaaatttgcacaagtaacaaggagctgaatgttaatccctgagacagtggggaaaatgtctccagggcatgtcagagtcttcacggaatcccctcccatcacaggcctggaggcctaagaggaaaaggtggtttcacaggccaggcccagggttcccgtgctgtgtgcagcctagtgacttgatgccctgcatcccaactgcgccagccttggctgaaaggggccaatgtagagcttgggctgtggcttcagagggtacaagcctcaagccttggcagcttccatgtggtgttgagcctgcaagtgcacagaagtcaagaatcggggtttgggaacctctgcctagatttcagaagatatatggaagcacctggatgcccaggcagaagtttgctgcaggggtgggacccttatggagaacctctactagggcagttcagaagggaaatgtgggattggagcccccccacagagtccctactggggcacctcctagtgagctgtgagaagaagcccaccatccttcagaccccagaatggtagatccactgacagcttgcaccatgcacctggaaaagctgcaggcactcaacaccatcccatgaaggcagccaggagagaggctgtgccctgcaaatccacaggggtggaactgcctgagaccatgggaacctacctcttacatcagcatgacctggatgtgagacatggtagtcaaagagatcattttggggctttaagatttgactgccccactggatttcagacttgcatggggcctgtagcccccgtgttctggccaatttctcccatttgggatggctatatttacccaatgcctgtactcccactgtacctaggaagtaactaacttccttttgattttacaggctcataggcagaagggacttgccttgtttcagatgagactttggactgtgggcttttgagttaatcctgaaatgagttaagactttggggaactgttgggaaggcatgattggttttgaaatgtgaagccatgagatttggaggggccaggggcagaatgatatggtttggctgtgtccccacccaaatctcatcttgaattcctacatgttgtaggagagacctggtgggaggtaaatgaatcatgggggcaggtctttcccatgctgttcttgtgatagtgaataagtctcacaagatctgtgaataagtctgacaagatctgatggttgcaaaaaggggagtttcccagcaagtttcttctcttgtctgctgccatgtctcttgtcttctcttgtctgctgccatgtgagatttgcttttcaccttccatcattattgtgagccctccccagccacatgggattgtaagcccaataaacctctttcttttgtaaattgcccagtctctggtatgtctttatcagcagcgtgaaaatggactaatatagggcctatggcacaaaacatgttaaaaacccctgagtgaggagataataaaggccatccagatttgaatctttttgtttgtagactaggaaactgaatctcaactacttgacccccgaagtcagcatgacacaatagaaagagcaaggttgttggaatcagataaggttcaaataccaaggttcaaatgtcagctccatacttactgcttataggactttcccccaacttaagtttccttggaattcatttttcaactgcaaataagggtaaaactgtctttcactgaaagcaggagtcagcaactatagctcacaggccaaatccagtttgcagcctatttttgtcaataaagtttcattggaacacagtcacacccatttgtttacatattgtctatgtctgcttttgcactacaatggcagtttggttacaacatagaccataccatacagcccacaaagcccaaagtattatcttgccttttatggaaaaaatttgcagacccctgacttggagtatagctgtgaggataaagggacaaaaggtatgtaaagatgtagctcattgcctggtacctagtaaacattaaataaatgtagtcattctcccctcttcaagacagagagacttttgtgggaagacagaacattgttctgggtccacaatgtatgatttctttgaactagagaggagcctaacagaaaatatataaggatatatatatatatatatatatcatatatataatacaactggtttataagtaagttctaaggaagttaaaatgagccagtagtatatttaaatatgattatatcctgcatttatccaagaaggccttaagatgatttccaactcaataaataacaatggattgaataaaatctaattgctccagaaggtagcatagtgcctgtaagtgaactttatattcagcattgagcttccaggcagccatggtaaaaagaaatcacgaaaaattgtgtaacacctgttataaggaaaaaaaaaaagtctacttgattatcacaggacaaaaggtttttatcctgacacaaattttaggcatcattacttacagaaatgtgtatagacacagtttagagtttaaaacaataattgaaactaacagaagaaatgacttttaagaatatcaaaattctccttgtctacgcacaacctcttaaacctacttgaacaataagtaaaaattgctgcaaatattaataatatggtaaaatagctctggaaagtaaagggccagtgtttgggtgagttaatacatttaacacagcagaacagttctgtgtgtttcggaaagaaggattgtttagtaggagagaatttgatgtctgagaaaaaggcaaaatgtttgtgcatttgatggttataactaaaaaatcattgtgccctcattcctctgtaaacagatgctaggaacacaagttaaaaaacaaaaaaacattgcaaaccagagccagaattagcatgaggcaagtgaggggggtcgtgtaagttcagagtcatatttgatctttatttaaaattttgataattccttcatggtggattctatgcattgattttgattttaaaacaatactgcataaaaatattatttatctagattactgagctttttatatccccttaaattttatgtccaaggcaatggcctcacttcccttctcctattcctggcccatatattcacgctactaagaaataattttaataaaaatatgtttaggaaggactcttccccaggctgagccaccttataggattcctgtcacctttcacatgttgatataaagtctttgtgtgtctaaagcagctttattcacagaaaagactcttcagggttgttttgttaaaatatttatcatttgatacattaaagttaaaaactccaaattcattgctctctggcttttaatttcagtttctaagaagagtccagactattttagcaacctgtttttaggggcctttaagtaatactggtccaatttacacacaacattatttaaataccttcaaaaattaaaaacatttttatgaagtatatgtgtattccaacaatatatattttttttttcctttttttttttttttgagacagagtctccccttgttgcccaggctacagtgcagtggcataatcatggctcactgcagccttgacctcctgggctcaagtgatcctcccacttcagcctctggagtatctgggactacatgtgcatgccacccgcctggcttatttttgtattttttgtagagactgggtatcaccatgttgcccaggctggtcttgaactcctgggttcaagcaattccccgccgcatccccccattccccacccttcacctcagcctcccaaaatgactggcctatatagtttttctattaatatttattctttaagcacgcctattgtctgaattaattaacaaaacttttccaggttctaaatacattttacaactcttgtaaaccaaacttataaatatggtgaaaaggtggttccaagatggccgaataggaacaggtccagcctacagctcccagtgtgagtgatgcagaagacaggtgatttctgcatttccaactgaggtaccgggttcatctcactagggcttgttggagagcgagtgccaaagcaggtcgaggcatcacctcacccaggaagcgcaaggggtcagggaattccctttcctagccaaaggaagctatggcagacagcacctggaaaatcaggtcactcccaccctaatactgcgcttttccaacggtcttagcaaacggcacaccacgagattatagctcgtgcctggctcagagggtcccatgcccacggagcttcactcattgctagcacagcagtctgagattgaactgaaaggcagcagcaggctgggggaggggcgcccgccattgctgaggctttagtaggtaaataaagcggccaggaagctcgaaatgggtggagcccaccacggctcaaggaggcctgcctgcctgtagactccacctctgggggcagggcatagctggacaaaaggcagcagaaacctctgcagacttaaatatccctgtctgacagctttgaagagagtagtggttctcccagcacagagtttgagatctgagaacggacagactgcctcctcaagtgggtccctgtcccccaagtagcctaactgggaggcaccccccagtaggggcagactgacaccccacacggccgggtacccctctgagacaaagcttccagaggaacgatcaggcagcaacatttgctgttctgcagcctccgctgatacccaggcaaacagggtctggagtgggcctccagcaaactccaacagacctgcagctgagggtcctgactgatagaaggaaaactaacaaacagaaaggacatccacaccaaaaccccatctgtacgtcaccatcatcaaagaccaaaggtagataaaaccacaaagatggggaaaaaacatagcagaaaagctgaaaattctaaaaatcagagcgactctccccctccaaaggaatagagctggagctggatggagaatgactttgacaagttgggagaagaaggcttcagatgatcaaacttctgcgagctaaaggaggaagttcaaacccatcgcaaagaagctaaaaactttgaaaaaaaattagatgaatggctaactagaataaccaatgcagagaagtccttaaacgacctgatggagctgaaaactatggcacgagaactacatgacgcttgcacaagcttcagtagccgattcgatcaactggaagaaagtgtatcagtgactgaagatcaaatgaataaaatgaagcaagaagagaagtttagagaaaaaaacagtaaaaagaaacgaacaaagcctccaagaaatatgggactatgtgaaaggaccaaatccacatctgattggtgtacctgaaagtgacagggagaatggaaccaagttggaaaacactctgcaggatattatccaggagaaattccccaacctagcaaggcaggccaacattcaaactcaggaaatacagagaacgccacaaagatactcctcgagaagagcaactgcaagacacatatttgtcagattcaccaaagttgaaatgaaggaaaaaatgttaagggcagccagaaagaaaggtagggttaaccaacaaagggaagcccatcagactaacagctgatctctcggcagaaactctacaagccagaagagagtgggggctaatattcagcttttttttttttgagacggagtttcactcttgttgcccaggctggagtgcaatggcacgatctcagctcaccgcaacctccgcctcccaggttcaagcgattctcctgcctcagcctccctagtagctgcgactacaggcatgtgctactacgccaggctaatttttgtatttttagtagagacgggttttctccatgttggtcaggctggtctcgaactcctgacctcaggtgatccacccgcctcagcctcccaaagtgctgggattacaggcatgagccaccgcgcccagcttcaacattcttaaagaaaaggattttcaacccagaatttcatatccagccaaactaagcttcataagtgaaggagaaataaaatactttacagacaagcatatgctgagagattctgtcaccaccaggccagccctacaagagctcctaaaggaagcactaaacgtggaaaggaaaaaccagtacaagccactgcaaaaacatgacaaactgcaaagaccatcgatgctaggaagaaactgcatcaactaacgagcaaaataaccagctaacatcataatgacagcatcaaatccacacagaacaatattaaccttaaatgtaaatgggctaaatgcaccaattaaaagacacagactggcaaattggataaagaatcaagactcatcagtgtgccgtattcaggagacccatctcacatgcagagacacacataggctcaaaataaagggatggaggaagatctaccaagaaaatggaacacaaaaaaaggcagggattgcaatactagtctctgataaaacagactttaaatcaacaaagatcaaaagagaaaaagcaggccattacataatggtaaagggatcaattcaacaagaagagctaactatcctaaatatatatgcacccaacacaggagcacccagattcataaagcaagtctttagagacctacaaagagacttagactcccacacaataataatgggagactttaacaacccactgtcaacattagacagatcaacaagacagaaaattaaaaaggatatccagcaactgaactcagctctgcaccaagtgggcctaatagacatctacagaactctccaccccaaatcaacagaatatacgttcttctaagcaccacaccacacctattccaaaattgaccacatagttggaagtaaagcagtcctcggcaaatgtaaaaaacggaaattataacaaactgtctctgagaccacagtgcaatcaaactagacctcaggattaagaaactcactcaaaaccgcccaactacatggaaactgaacaacctgctcctgaatgactactggatacataacaaaatgaaggcagaaataaagatgttctttgaaaccaatgagaacaaagacacaacagaccagaatctctgggacacatttaaagcagtgtgtagagggaaatttatagcactaaatgcccacaagagaaagcagggaagatctaaaattgataccctaacatcacaattaaaagaactagagaagcaagagcaaacacatttaaaagctagcagaaggcaagaaataactaagatcagagcagaactgaaggagatagagacacaaagaacccttcaaaaaatcaatgaatccaggggctggttttttgaaaagatcaacacaattgatagacggctaccaagattaataaagaagaaaagagagaagaaccaaatagatgcaataaaaaatgataaaggggatatcaccaccgatcccacagaaatacaaactaccatcagagaatactatcaacacctctatgcaaataaactagaaaatctagaagaaatggataaattcctggacacacacatcctcccaagactaaaccaggaagaacttgaatccctgaatagaccaataacaggctctgaaatcgaggcaataattaatagcctaccaaccaaaaaaagtccaggaccagatggattcacagccgaattccaccagaggtacaagaaggagctggtaccattccttctgaaactattccaatcaatagagaaagagggaatcctccctaattcattttatgaggccagcatcatcctgataccaaagcctggcagagacacaacaaaaaaagagaattttagaccaatatccctgatgaacattgatgcaaaaatcctcaataaaatactggcaaaccgaatccagcagcacatcaaaaagcttatccaccatgatcaaggggacttcatccctgagatgcaaggctggttcaacatatgcaaatcaataaatgtaatccatcacataaacagaaccaaagacaaaaaccacatgattatctcaatggatgcagaaaaggcctttgacaaaattcaacagcccttcatgctaaaaactcaataaattaggtattgatggaacatatctaaaaataataagaactatttatgacaaacccacagccaatatcatactgaatgggcaaaaactggaagcattccctttgaaaactggcacaagacaaggatgccctctctcaccactcctattcaacatagtgttggaagttctggccagggcaatcaggcagcagaaagaaataaagggtattcaattaggaaacgaggaagtcaaattgtccctgtttgcagattacatgattgtatattagacaaccccattatctcagcccaaaatctccttaagctgataagcaacttcagcaaagtctcaggatacaaaatcaatgcgcaaaaatcacaagcattcttatacaccaataacaaacggagagccaaatcatgagtgaactcccattcacaattgcttcaaagagaataaaatacctaggaaggaattcaacttacaagggatgtgaagaacctcttcaaggagaactacaaaccactgctcaatgaaataaaagaggacacaaacaaatggaagaacattccatgctcatggatagaagaatcaatatcatgaaaatggccatactgcccaaggtaattcatagactcaatgccatccccatcaagctaccaatgactttcttcacagaattggaaaaaaactactttaaagttcatatggaaccaaaaaagagcccacattgccaagacaatcctaagccaaaagaacaaagctggaggcatcacgctacctgacttcaaactatactacaaggctacagtaaccaaaacagcatggtactggtatctaaacagagatacagaccaatggaacagaacagagccctcagaaataataccacacatctacaaccatctgatctttgacaaacctgacaaaaacaagaaatggggaaaagattccctttttaataaatggtgctgggaaaactggctagccatatggagaaagctgaaactggatcccttccttacaccttgtacaaaaattaattcaagatggattaaagacttacatgttagacctaaaaccataaaaaccctagaagaaaacctaggcaataccattcaggacataggcatgggcaaggacttcatttctaaaacaccaaaagcaatggcaacaaaagccaaaattgacaaatgggatctaattaaactaaagagcttctgcacagcaaaagaaactaccatcagagtgaacgggcaacctacagaatgggagaaaatttttgcagtctactcatctgacaaagggctaatatccagaatctacaaagaactcaaacaaactcacaagaaaaaaacaaacaaccccatcaaaaagtgggcgaaggatatgaacagacacttctcacaagaagacatttatgcatccaaaagacacatgaaaaaatgctcatcatcactggccatcagagaaatgcaaatcaaaaccacaatgagataccatctcacaccagtcagaatggcaatcattaaaaagtctggaaacaggtgctggagaggatgtagagaaataggaacacttttacactgttggtgggactgtcaactagttcaaccattgtggaagacagtgtggcaattcctcaaggatctagaactagaaataccatttgacccagccatcccattactgggtatatacccaaaggattataaatcatgctgctataaaaacacatgcacacgtatgtttattgcggcactcttcacaatagcaaagacttggaaccaacccaaatgtccaacaatgatagactggattaagaaaatgtggcacatatacaccatggaatactatgcagccataaaaaagatgagttcatgtcctttgtagggacatggatgaagctggaaaccatcattctcagcaaactattgcagggacaaaaaaccaaacaccacatgttctcaatcacaggtgggaattgaacaatgagaacacttggacacaggaaggggaacatcacacaccggggcctgttgtggggtagggggaggggggagggatagcattaggagatatacctaatgtaaatgacgagttaatgggtgcagcacaccaacatggcacatgtatacatatgtaacaaacctgcatgttgtgcacatgtaccctagaagttaaagtataaaaacaaaatttttgagagagaaaaaaaattatggtgcaacaaaactagttttgttttatacatttctaaatgtccacataaattatttagatttcaacttgaaaagatcactcaattatatactttatctgggagtcacaagctattgtcttaataggctatatttctcttaactattcaagcatatacaaccccaagtttgtgcagatgccttaaccaggaaacatcgatacaatgtttttaagtgtcttggttatttctgttctcatttttaaagcttcccagagttgaaagctatgtgggcattcgggaagtgaaaggcaatctcagttactgagatgacttttaattagagattttaactgggtgctgagacttggaatggtagacatctaaggtgattcttctcataccaactgtgattttatcccatgaaatttggggtttgccttctcagtatcctgcaggttttgaacaatcagtgatttcagccaagagctcatcaggtccttctcaggaacctaaatgggttactctaaacctatgtacctagctgctactggtaaacccatagctttacaggggtgcaatcatgctgcccaggtctttggaggtgaattatatacaatacccaatcctttcttcttctacaaaaagactgcaaaccccacgtaagttaatcgtttgactagattctgcatacttttgtttctgtatcagtgtaaatgccccttctgtgtgagtttaagatcttcgaactaggtagaatattgcttctttcagattgtcaggccccaccctgttcgtggacagttatttccactcctattgaattctctacctggctgtctagcctgtcaccacaactggtaagcctcttctgttagcacacggaattgcagaattttgttgattctagaggaaacttgtccaacccgccacccgtgggccacatgcagcccaggacagcttcgaatgtggcccaacacaaatttgtaaacattctttaaatattatgagatttttttttaagctcatcagctattgttagtgttagtgtattttatgtgtggccccaagacaattcttcttccagtgtgacccaagggagccaaacgactagacaaccctgttctagaatgttctccatggctgctccaaactcagccgcttgctctgtattaactgcagaataagagcttttctcatttatgcctcccagtcatcaggaccaaagtgtaagatgcatcaaagtttccctggatggttggtgccctagggcagttgccatgaaccaagtacaaaaagaaaaacagacttttccaaaattaattcaaatgggcataactcttttggaaattgtgtagcacatgttgccaggctggggggatgggctgtgtgtgctattttaatgagactgcagactggttacatctacagcttcccatattttggcttattttagaaagagccagaaaatgatgtttaacggtaaactgcaagaagacaggcagggaggaggggcagatggcatgaagtaatctttctgcatttcaaggcataggccaactctttgttaaaatattctttccagtttggaagcccttggcttaagggaaatttggaaaaaccaagctcatgtcccaaccagcagctcatctagaaagtaaaaatgaaaactctaattatcagtcagtcagtggtttttatcgtgcaacagttaattgtttcacttaaaaccactgctggtaacagctggaaaggaaagtgactggagaacagggtcatttaaaaccattattttgagctacagtttcaatgtcaatgaaagagttgtccaaattttggcatatcactttctaacgaattttagttttatgagatagccatcatttagtgaaatatatcccaaatcgtgagaactgtatttcttgccaactgtctttttttttttttttcttttgagatggagtctcactctgttgcccaggggtggagtgcggtggcgtggtctctgttcactgcaacctccacctccaggattcaagcaattctactgcagcctcccgagtagctgagatcacaggcatgtgccaccacacccggctaatctttgtatttttcgtagagaccaggtttcaccaggttggccaggctggtcttgaactcctcacctcaaatgatccacctgccttggcctcccaaagtgctgggattacaggcatgagccactgtgcctggccttgccaattgtctttattcctcttctcttagtagcccatgggagactattgtagtgtgtccttatgaccagtgttttccaattatttgttagccagaaattggaacactgaatatactcttctataatgttaaaaatggtggcaaaatttcaggccaacctataagaggtacctggttaatatataatatagctgtagttgggaatacaaagggatattttttccccagtagtctttccatctggcagtatattatgatccattcatctcaatcttgctacctcaaaagcagaagtggcagatgaatccacccagcaaacgccatagaggtgggtccagctgaggctttacctggcactgaccgtgtcctcctccattaaaacactggtaccaggctgggtgagtgactcatgcttgtaatcccagcagtttgggaggctgagatgggaggatcacttgatcccaggaggcttcagtgagctatgactgtgccactgcactccagcctgggtgacagagcaagactgtctctttaaaaaaaaaaaaaaaaaaaaaaaaaaaaagcttattaaaacactgatacctgacatatatggctgttatggctgcggtggggattacatgtaaatatggcaagacctataataaaaagttaatatttattaaatacttatgaggtacccttcactaattaagtcgctcctgcaacgatgccacagaatggtgcttccctatgtcacagacaaggaaccaaagcacagaaatgtcaagtaatcggccgaaggacacacagctagcaaacagcagagccaattcaaacccacacagtctggctccagaagccatgctttggtcactatagtccaggggtcagcaaaccatagcccatcacctgttatggtctggcccaaaagctaagaatggttttaccaattttagagttggggtgtagggagagagaaatatttcatggcatgtgaacaaagatattaaatttaaatttcgatgttcataaatcgtctcattggaacatagctactcctattcatggaacacagctactcttattcccatacatactgtctatagctactttcacaccagaaatatcatgacaaaatgtttatgacataatggcaagggataaaaaagaatacagaaagtatgattccactaatttacaagaatgcttaaacaaaaaatactttaattattaataatggattgtagaaacatgagtaatttttttcatctgcatttcccaccttctctgtgatgatcaggtatgccttttgcattaacaaacatcaaccttaaaattaagtaagttggcaaaggatcggttaatttgtcaaagaatagaagggattctaaataacaaaagtaaacagacatttggtgaaagactctaagatcgggagttctaactatcatgtccattttaatgacttttggttgtaaatcattcttgggtacttaaaaatatcaaagatacactgcagacattttagaaggctcccgtataagtatggacttaatatatttttatgtatctttatttcccatatatatccttgttaattctcaaacagggaaaaatgtaaaccttaacttttatttgtcacatcattagtttcttaatgtagatatcctgacatgaaattttgccccatgggctgtactccccttctatgttattactgaagtgtgagatgtctgaaaagtatcttaactaaagatgaaggaatttcactgatatctgggcattataggaaaggggaaaaaagtgagtttaaatgaaatgattttctgagggattttaaaatccttaaattgggtataaggagggccttcttttattagtgtacaaatccagccctctacattgtgctttcacaccctatgccattcattgcagcatggtaacttactgctttctgagctctgaggttcagaaaagttttacttgcccgaagttacatagctgcaaaattctggtctggcattatatctggttctgctgaaactgtacttctcaactctggcttctcaactgcctggcaacatgccaacatgatgacatccagtttagaattccaccctctactgtcccttggttctcactacaaggtgtcactaaggcacagcattcatttccaatgtttttttccatctttctgtggactgattaaatgagaatattcttggaaccgatagagaactgggcagctcattggcagcatggcagtcaataaccgaaggggccataaacaaggttaggtcttatctagttgggccaggcagcagatgtaggttttaatcaagtcaggccacacatgggttggggaagtagctaactctagctaagcctgtgttgggaagctaaatctaggctggtgaaggaagccaatagggcccaaatagctaatggggcttgatccttcataatgagttcctcccagaggtggctcagcaccttggacagttaccaggagagtcacagtttctgaaggagcctgattccctcccaggtcgatttttttggcacaacttctacttctttgaaaaacttcctgttctcccctcttttctcagggttcttatgtgcagaattgggagaatactgatacaactagcaaaatgagctgcttctgaggatatccacacacataagatttccctgattattagacagaaaagtcaccgcttctagccagaagtgtgtctagttccatcagattggcttgtgtcacgaagggaaatatctagttattgtcttcccagaactcttctttcctgggccagcttataagtactaacaacacagactcttctttgcaagttattgagaggaaaaattgtcatttaattcacagagtggattcctaaaatgtgcacactcaaatattctctatttcttatgttgatattgactgttctcactttcccataaagttagattattcaaatcatagatcttcatttacattctatagctgaagttaatgtaccttttcttgattaattctcaaaacaagtttatattttgtataagatctctttaatatgaaagctcatagtgtatctttatagataggtgtatgttttctctgtaaatttgccaacctctgcatctggttcagaaaatggaagttctgaatcagagctacaaaaagatttaatgggcttcatgctgctgttagcggcagtatccaggcaccaatagaccagtatttcccaaactgtgttttgctggacactagtctaacaaaagctctgtgaaaggaaattcttccaaggaagagaagtttggaaaactctgccttactttctacctttttggagaatcgcagtgctcattagcattatgtgtgtaagtaaagaaagctttttcatgctcccagttcagcattttccaaatacattggacaccataacagtttttaaaactagtagtactctgatctactatttaccataaaacccttttctagatgtagtcaattgtcagaatgtcattgaggcaaccaacatatctaatatacaaagttagtgagatttatgtctcctaacctgagaatctatgactttttgttatcctagcttaaatatttacatatgtgacagggtcaatcctagaatcaaaagaaatcatatttatgtctttcttaagtacacactttggaacttggagaaatacttttctaacagagaagcaagtaattaggtgtaattacacattggaaagtggcaggtatgtagatagaggcctcaaacacacggatccttttaaccataattaaagtatataaaattgatagacaataaattttattataaagttctgtgttgaatatggaaaataaccaagccaaaatgtaaaaaaaaaaatccttggactgacatcataatgaccttaaagatgttagcatgctctttgaagagtaaaactcttctgaatatttaaaaagatcatgatatctatttatttttcccaggaaagagtgtaatgatttattttggattcactgaggtatactgctactgaatatttcagaatagcatgccaagtgcaaaaactgtagtactgtttgcagcttcaattttgaaagcacttttccaacccatttattaaagagtatccattttctgagccaaatgatgtaacaaaaaaaattgttctctgtatatacacagcacttttttttcttttggaccttgggtacaaaagattgatttaataatactcctcaattcatagaacataatcatacttgatcctcataaggctttctgatacacgtactcatatatacatttatgtacatctatgtgtacttactttctcttttagagtgtatataagaatatagcaaatatattcatatatatgcatccatattaatatattcccttttatattgtaaatatatacgaatacataaaatatgcatatgtatatatatatcatacatatgcatttatgtgaatacatatgcatattttatttttctgtctcctggagaaacactgtttcatatatattctattatttttatgtgtccttgataaatatgtatagttttctgagcatgttgtcttagtttatcatgtaaacatatttacatatataatgtttcttttttcattcaatactatagttttagaaataacttttgactttgaaaaactgcaaacataaaccaagtatgcaatgagagaagagtacactgaactcccatatgcccatcatgcagtttcgacaattattaactcatgactaatcttatttcatctatgtccccacacacttctctcctacctatactacttgacacaaagcttagatatcatgtcattttatcaagtatttaaatatatatatccaaaacatataatgacactgaaattatcatacccccaaaagacagcaatttcttaatactacgaaatttcctgtccatgttcaattttctcccagtggcctcatggatttgttgttgtttttgtttgggtaaatcagcatccaaataagagctatacatagcaactgattgatatgtctcttgaatctcttttgatttctggaatttaattttctttccatatatttgttgaaaatctatttggtttgttctgtaggtttttatctctggattttatctcatacccatggtgttatttagcatggtcctctcatcctgtattttctgggaattggtggttatatagagagatttaattagtcttctgttaatttttctttctgaggggagaatatttcattggtggtattgagtacttccatttggaagcatagggggtgtctgtgtgtgtaatgttagcagccattgatgctcagtgcttaaacattaagttaccaggtgatgggaaatagtgatatgctaattctatcattccattttcacttagtaactgaaaaactccccctcatcaactctttgttacattgactacagtttgtatgaaaggtagaataaatggttgagtctttccctttattcagtagttttcaaaataatgagttggttccctagcatcccccaaaggtggccaatgatgttttcctacgttattgtgaatttgctttctggtataacaagatattccaggatcatttgtgcatttcctatcccagacccaggatcagtcatttctccaagaaacccgttgcttgtagtagcaaatggtatttaaatccaaaatctgggagctagcagtatttattactactgagttgttcactgttcttcaaggtctttttagtaagcagtgttaggaaatatatactttttacaataaactacattatgatttcatatttccaattcaaattcaggattgtaagatttttatataacctcattgatcttacatctgtatctatttttccaatatctctcagcaccaatataagtattattttgcttccatcccctaaatcatccagtctcaacataatacctcaacaccaataacaacaatatatattgaaaatggttaaatatattttgcagttcttttgtccttagggtatattccactagggatgtttattcaaattgccatgcttcaaattcacttgaaatgtttcctttctttatacttatgttaccagctcaattcacagattcttttcacttagcttttgatttctaaaaatgtgcttcttaaatttaatcttgctctataactatgtaaagtatttacctggttccaaagtgaaatctataaaacgatatttattcagagaagactaacttttatccctgtctcttccccataggtaatattgtatttttaatttttattctgtcatcccattatttttaaacatctatgaatatgtctgtgtatatatcctttttgaaaataagctgagtgcaatgcctcgtgcctgtaatcctagcactttgggaggtggaggcgggaggatcgcctgagcccaggagtttgagatcagcctgggcaacatggagaaaccccatctctccaaaaaatacaagagttagctgggcgtggtggcatgagcctgtaatcccagctacttgggaggctgagaggtgggaggatcacttgagcccagggaggttgaggctgcagtgagccatgattgtgccattgcactccaggctgggcaacagagtgagaccttggaaagtaagtaaagtaagaaagaaagaaagaaagaaagagagagagaaagaaaaagagagaaaaacaaaagaaacaaaagtatacaaaatattctttgctctacgttgcctttcacttcacagtatattctggagatagcttgccaatggtatatagaagtagtcctcactctgttttgcaactgcagagaatagcaatgtacatttgggttgtttctagtcttatgcaactacatatagtgccatgtgccactagttttgtgagatctatccatatgcctatatatatatatatatatatatatatatatatctaatccactaatttatttgcaacaacatacttcatgtagcatttgcctctcctctggccccctccctttaacaaccttcaactcccctgctacttactcaggtccccaggtctttacaccagtcccccaccccagccaaagctgtaggtggcactgtccaaacaaggcgaggtcctgctagatggcataaaacaccagctctgtgaaagctggagtctttgtggggtctgtggttttgccctgattctcatgaagcgaaatcttctcctgaagcaggtacttcagaagaaactatgtaatttcagtatcaaaaatagctgtgcttctcataaatgttgtgagtttattttatacacaatgtgaattatgtaaatggctagaattttctgcattgacttcaagaaagtttggtgcctaatttatgacccactcataacaagtatatgaaattttatggttgtattttttcttgttttcttaaacaatcaacattatggtggacataggttttgtttttgtttttaactgttaaatcaccctagttctacaaagcgcaagtcttgctgcaatgtacccattttgtatccagcctatgtcagcattctagaacatatacaaacattccatgttattccattaaagtgaatatttacaaacatcattgcccttgaaaaatgtttgtctcaataaaaaatacaacctaggaaaatctgcatatgtatagtatagtgttttatatagactattgtttatatataaacataatttcattatctagcaccactaacaaattatatatgatatggaagggagtttttctgggtacctggaactaatatccaaaacataatccactaatgcattcaggagctactgaaatgcagatgatggtggttcatatgcagagagatttccaaacaatgtgccttccaaggctgtctgggtcattgtttgtgaaactgtagccatgacctattattgacttatgaagtcaattcaataagtcacaaccagctttaaaataccacctagattaaaatagaaaatacagtacattgtgtataagtattcttttggaaaacttttgtttcactcttaacaaatatagatgtatatatgcacactggatcagaaaggaaaattcatatctttgttttttttgagatagggtttcactctgttgcctaggctggagtacagtggcacgatcaataactcactgcagcctcaacctcccagggctcaggtgatcgtcccacctcagcctccagagtagctggaactacaggcacatgccaccatacccagctactttttgtactttttgtaaagatgtggtttcaccatgttgcccaggctggtctccaactcctgaggctcaagtgatccaccaatcttgattgccgaaagtgtagggattacaggtgcgagccaccatgcctggtcatgtatgtcttcttgtaggaggcagttaagaatgtcggaagggtcctgctctggggggccgtaggtcccaacccatctcaccccctgaccactccactctgcttcatctccctgtgggctcctttcattctttttggtaccaaaactacattcagaatagccaccttcttcttcccttttctttttgttacttttcctttttctttttaaaattatgtgtgatgactctgcttgtcctcttagtttgggacaaaaaaaaagagttctaaaatagtctcctcttgtcaatggacctctacctcaccttcagctgccatataactggtgagtcatagaatgtcagggtggatttctggcccctgcgtcttttctactgtgtttatctgtccacacagtccaaaggttgtttttctcctgcttttttgtttaagttgggttttatgctcttatagctgtcaagagacttaattattcttttatatatttttttgagattggatatataaattcaataaaatagctatcactctttcttttactgttattaaaaatcaaattgagatacatcacaaaaatatattgtggatagcttaagataaactgatggattcagaagcattcctcttgtctaaaactttgcagtagacaactgaccttttaccaccaaaatccaacaagagagatggaggaaaaagtaggtacttagaggcagacatcgccatatattaactaaatagtccctcaggtcaaatcaagtgcagtcttctacaaaatactcaaaagctgtcggctttacagaggaatttccagaaagcagtaagattctggcatcctattaaaatacctagagtactctgtggatggcttgaaattaagcctagtctaatgtatcattttaactatactgtaattggaaataacaaaattcacatgaaatatgccatgcaaaggtttacccacttttatatcaaattaaacatgccatttttttctttctttttattttttagtgatggggtttcactatgttgcccaggttggagtgcattggttattcaaagatgcgatcatagctaactgcagcttcaaactcttgggctcaagcagtcctcttgcctcagcctcccgagaagatggaactacaggcactgtgcctggcttgaattaaacattctagtttgattagtgtggtgggtagaattctgagaaggcacccaggatccttgatcctggtataaataccctgtataatcccctcctgctgaatatgggcaggaccttgaacatgataggatgtcacttctatgattatgttacttagcatggcaaaggtggaaaaattgtgagatgtaatcaaactcctgatcaactgacattaatttaatcaaaatggagattatcttgggtgggtctgccctaatcagatgtgtccctttaaagagactccaagcagcagagaccctcttgctgacctcaaagaaacaaaaagtaatgttatgcactgcctacggaggggggtggactctaagagctgagggcttcactcctacagtcacaaggaactgaatccttccaaaaagcactgagcttagaaaagaaaccaaactccagataagaatcacagcctggccaaaaacttgattttaatttcatgaaactctgaccagagaacccagttaagccatgcctagactactgacccacagaaactgagataacagatatgccttgttttaaagccctatgtggtcatttgttacagcagcaatagaagactattacaattagaacctcgttaactctcaaagggtcataaatgttagacccaaaggatgcatgtgtaggagccaatggaaaacttccccttcaccctctgaaggttctctgcaaaaacagctcacaaaagacaaattaataagagaaagggtatacaagtttgtttgtttatttgagacagtctcgctgtgtcaaccaggctggagtacagtggcgtgatcatggctccctgcagcctcgacctgctgagactacaggcacacaccaccattcctggctaatttttgtattttcggtagacatgagattgtatcatattatccaggctggtcttgaactcctgagctcaagtgatccgcccacctgggcctcccaaagtgctgggattataggtgtgagccactgcattcagccagggcatataagtttattaatatgcatggggagaaccacagagtgattaccccaaccctccaatggggttcagaagtttatataccatcttgaggttacagaaagaataagggcttggatcttggcgaaacaggttatgggagggagagaagaggtagcaaaggtggtcttgttgtgtagatgaaacctcacaggtagcagctctcagagagaatagatggtgaatatttcctttagacctttgaaagtgtcagactctcaattaatcttccctagatccagacaagggaaggcttcgaagaaagcctggcttcatcaatgaagatttttctctacagatgcaaatctccccaacaaaagacagtttttcagctattcttgtatttccagcttttctgaatagccatcttgaaatatgtcaaaggagtatattttggggtgaaacattttggtttccttctccctcttgggtttcccaaaatactgaactatccccattggaatatgttgaaaatgtagcacttagaaaatctctcccaaagtttaaaatcaactgaacatttccaggaaattctccagtcctatctccatagtgccccatctctctaagcacgtgatttattctaagtgttacatgaatgctggaccccccctccccaggtgggccctgacctttacctggctattgtgcacaatcccttggtggatctcatgaaccagggattttacctgttcagaagggggcaggacttagaaggagaaggcaacaaattggaagccttctagggatctgattctgtgacacagagtgaatttatttcattttaacagcatcttctgagttaggcatcttttgccaattttgggaatgagacaacagattcagagagatgatgaagtcaaccacagcatattgttagtatatggtaaaaacaagatatgcagtaggtctgaaggattccaaaaagcaagtctcttgccaccacatcatgtccaattacaaatgtacagcatgtcaaacttcacacattcttccccaaaatctccaagtaaatcattcacatgtgatagtaaggctaccatttgcacatcccttcatgggctgcagtgaaaactgtacgtgtttcatttgatcctcacaaggttgattgcgcatgcaaaactgtcatatgcttttcccttgagaaacaatgagggtacattatctggaagtgaaaaagtatagggtcatgcctaacaagtcattgataaaaagaaaaagaaaagaaaatggcctacagacatttagatgaccaatgttctttttgtaaatgcaacaaatgcatgcaaaagaaagtaatgcatatattatctgtctctgcaactgtaaggttacaatgaaaaccaggcattttgtgctttttaattcaagacatatccccaggaagtgatctgactttaaaacataaactatatttgctaaatgatatctgttacagcatcatagatgttgactcttttcagaagtcattttgcattcaataggagacagcagggggaatgcatggattttttttttcccctccacatgaaaaggctaagcaaaagcagtatctttcaggagacatcagtgatagttactaaatgagcttattcaaacaaacattaaaataacctccagctgggcaggcctatatttccagctatttgggaggctaaggcagaaggattgtgtgaggtcaggagttcgaggctgtagtacaccatgatcatgcctgtgaatagccactgcactccagcctgggcaatacagtgagatgctgtcccttaaaataagaataaataatctctaagttccaggcatggtactgatttatatgtgttatgcttgaattttatattggtgtccacattttaactaggaggaatcagttaagtgtcagaccttcctattttgaaactgccaaaatttgcctacccattacccaagataattcttgagcacagaaaattgatttgggctctatactgtgtcagatttaggttaataactttcattggctgatttagaattaaatatgccttctagcaaatcaggagtacatttgagaaaacaaaagcacaagagaaatattggaggagtagaaagaattaattgtagaaaggattaggtcaaatggaaagagtgaacaagaatatgggaggtgtggggaagtgacaaaagatttttctagttagggcatgatcatacactatgtagaagtcttcatataactcttactggggccaggcgtggtggctcacgcctgtgattcctgcactttgggtggtcaaggcgggcagatcatttgaggtcaggagtttgagacaagcctggccaacatagtgaaacgccatctctactaaaaatacaaaaattagctgggtgtggtggcaggcacctgtagtcccatccactcgggaggctgaggcaggagaatcgcttgaacctgggaggcggaggttgcagtgagccgagatagtgccattacactccagccgaggtgatagagtgagactccgtctcaaggaaaaaaaaaaacaaaaaaaactcttattggagaaagaatcaaccttccttaaataaatattaacataataaaatatttttatttaataaaacaataaaataaaaattgtgtgacaaggggaacttgtgacttttgcctggttgaacaattattttaaattgtcaatttagggaagagaagaaagttgatgtcttcaaattatattttattctgtgaagaataaaaatgtctactgtattttcaatatgccctctgttttcagtccagaaaactcaatgttttgtttagagatgcaataaaagacttttcttttacaaatgtcttacaattacagactacattcagatagatgatttattgagttcgggaagtgaacagaatctaatggtaattcatgacacttttttcaaaacctactgaaaaaatattggtttagctctcacaataaaatattagacattatatacacagttggaaagtgttctcatttaaatataaaggtttgtgattccataattaatatttttcctttgttcaaacctgtattcaaatacttctgctttctcatctgaagcttttttctttaattttagagttgcccaaactacatgaaacagagttaagaccccagaaacatgcaaaaatgaacagccaggattgatggaggggaaagaaatcagcaagaaaaaatttagaagggaccaaaaaaaaattagttgcctgagggcctttataggtattggctagactttacagccatttgacttcataatgacacttaattttaagaaaaatttaagtaatgcattctttctttaaaaatgaaaaaaaaaaaaaaaaaaaaacccagcaaccagcaatggtgtaacttttggaaaagcctgctagccaaacaagaaaataaaattttggagcttaaagttttattagcttaaaatgtttatttccaacagtccttaataaattattgctgaatctttataaatttggcatgacatgtgtctggacaattggcatgtgtatattttttcatcacttcctagcatctcagagtaagggttctccctagtgtatgcacctcccctcatctttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacgggttttcaccgttttagccgggatggtctcgatctcctgacctcgtgatccgcccgcctcggcctcccaaagtgctgggattacaggcgtgagccaccgcgcccggccccctcatcttttttgacagctctaccaataatttctaggtccagtggaaattttgaatgttatttatctatttttacttttcaccgacattgtggaaatcagtacgtccaaatgtctaaacatctctccagatatttccactttttcaatcaattgaggactgataaaattcaatatattcccaataaaaacaataaaaaaagttaaaacatgttttcccattgaatcccatgttcaccttggatgtgtattccttagaaaaattccttagctataagtcataataaattacaaacttcaaaatcttatatttcaccttaaggaattgtctgcctctatcaagtgatacttagttatatttaattttcctacaaggtgctaaatgaataatcaagtcacctgatttttaacacaaccactttgaacatatttatggacacttattctatgaaaagcactattctaggtcccataaaagatttttaaaactacccttcattctcaaaaagcttaaaacatagttatcataaccataaactaaccgtataaagtagtttgtgatgtgtaccaaatgcagaagattggcaaagtgttgcgtgtgtttgaataagggatcgttacaatagttaatatttatctggtacaggcaccatgttttttccaccctgtcaacaatcttatggcatagttttattagttaggagtctcctggttgcaagtgacagaaactctgactcaaactggcttaagcacagagagggttttgttggctcatattcggggatagcaatagatctaatagctctcactgactctatgacaattagatgttaggcagcaattaagccaaagggcgagcagacatctctaattgtagcaggtgtgtggaaactggggagatttttttctgctagacatcagcctacccaagtctacagatgtcaatcctgcattcactcatcaaatgttacttgggaccaattcagtctcttgaagtaagccaaatttattcaagggattctaatttcatttaccactacagtttaataattatgatttaggcttaaaaacctacatcctgcttagatgaacctgtgtatataagtcagagcctgaggtgggttgggtattccccagagaggtttgaaaataaatcatattctttctgtaacttaaaaatacttttttcttaaagttctatgttcttatgaggatttcctctatttaacaagggtaggtcctaattcacatgatatagtcagcctttgtgaatattctccactgtggtattcaataaatttacctatattgtagctttttggtactggccatagtgaacctgtcatttatggcctatttccctcatccagacaattatgaaaatattggcagtctacctacctgagaggcttccttttcatgatctctgaggaactcagtgtgaagtaattttagctccttgagaggaaaaaatgtgcaaaagaagtacaaagtgctatgattaattctttcattgttttcaaatggtgttagttgaaagcagaaaatgaataaaacacaggaaattgacttgaaaactcacataaacgcacactcagtgaactgcccttgcatgctgagacccagagcgctttctactgaaaacatagatttggctaaaatctgtcatgaggcttgtataggcagagacaaatcttagtctgctttctatttgcatccaataaaataaagacatttaaaaacattttttgttttaataatagagagggcattgtcttgccgtgttgcccaggctggtctcaaactcttgggctcaagcgatcctcctgcctcagcctcccaaagtgctgggattacaggcatgagctaccgtgtccagctggtaaagacattttttcccagtgaaaacttggagctcagtatgtttgatgtttctcattaggggtgatgttaaaaatattttaacaacagttacaatatgggcacagccaagtcaggggagatatctagcaaaaacaaagtaaaccagtggttgcccatggaagcataggcctgatttccttggagcatgggctgtcaatgttgaaactgaaactgtgaagggtctgaaatgttaacctagtttcaagctaacaaattgacctgtcacaattttatgcatgtaagtgtgtacacacacacacacacacacacacacacacacacataccagacctctgaatcagagacagactgctcacagagcttttcccaaagccctggttcctcccagagcaactcagtgagatgtacaggagaggatctctggaattatgaaacccagagcttatataggaactgctggaccatctgtccatcaccctttgtggagaaagagggtgaccgctggtctgaatcataaacacaaattctctctgggaagtagaaggaaagatctctactcaccaccctggaagataaacacaaggctccagggaaaggtaggactttatattactgccaagggctcagtctttagggttgctattcagttgcctattaaccaggtgccagtactgttttcttagaaagtctcaaccttgcagaaacgtgaaaatattcatgatgcattatttctcaacacacaactttacctgcccattggaaacccttggaatttggctttcccctcaatgctgactggtctggaatgcttccagagtatttttaactctaacatgtccttataattgggttgagaaacactgctctaaatttcaaagtaatgttagatatcattagggactgaattggtaataacagcacatctttaagatgattgttggaggacatttgctttatgtcttagttcagactgttataagaaatacacactaaactagggtgacttaaacaatgaacattcacttctcccaactctgggggctaggaagcccaagatcaaggtgtcagcagatccagtgtctggtgagggcctgcctcctggtttgtagttggccatcttctcattgtatcctcacatagcagagagcagagagagaagaagcaagctctcccatgtctcttcttatgtgggcactaatcctatttgtgagggctccatactcatgacctagtcatctccctaaggctccacctccaaattctatcacattgaggattaggcttcaacataccaattttggtggaacacaaacattcaatccatagctctctacatgagatttactttccagactggaataggtatgccgctttaaacatttatgtaaccagagattaatcgacagtttttaaaatctaaatgactcagatttttattttacaataaaataatgacaaatgatgacacataagccagtagaatttattccatttggcaatgaggaattcttcagccacatgttattgtataaggacactattgagctctacacataagtgcaacatttttccccaaaatgactctgatctcagaacctgaagtttcacaatttaatagttaatttcaacaacaggtacttagtataataagtgaactttatactcagtaagtcattggaattgtaatcaataagcaggatcaacttccaggttaaggctcgtgattcctattatagccctgattaaattgtaggagtcattctccaacaaaaggaagcagagatccctggagaaatggctgattatgaggctggaactggaaaaatacaagatgagcctacaacatctcatagtactacaaggtaaggaaatgcttgagagagagagagagagagagagagagaatgtatcagagggacacagaagccaacctgaaaagttctcagtggccaaacttggaaattttgagtaacaaaatagtagcatggccgggcgtggtggcgggtgcctgtaatcccagctactcaggaggctgaggcacgagaatcgcttaaactgggggaggcagaggttgcagtgagcggagatcgtgccactgcactccagcctgggtgacagagagagactcagtctcaaaaaaaaaagtagcatagtattggattataaccaagtgtaaaaattaaatatacatggctccatactgatataaataaatgatttgatataaaaattaataagacagagggagaaacaaatcttgcagaaaaattccaaataatttatgtggctactcctcccctccaggaggtggagcttaggcccactcttgagtgtaagctacactttgttacttgattccaaacagtagagtatagaaaggggtaaaaaatatatatagctttacaactgagaaagctggcaagcactaccttagccagggatcaaagtcaacatcaccagtgataagtcatgttgatagcagacaccactgacataatataacaagaagggcacatcacctctgtgatattctttacaaaaatccataacctagtctaatcatgaagaaaatgtcagcccaacccaatttgagagatagtctatcaaatatctgaccagtactcctcaaaactgtcaaggtcacaaaaaatagggaaagactaagaaattgtcacagaccagaagagactaaggagacatgactactaagtgcaatgtggcacctgaaatgcatcctggaacagaaaaggcacattaatggaaaaactggtgacatctaagtctggaatttagttaatagtaatataacaatgttggtttcttagttgtgacaaatgtaccatgccaacataagacattaacaatgggggaaacggggtaaggggtgaactggaactctctgtgccatctttgcaacttttgtacaaatctaaattttccataataaaaagtttactaaaatgatgaggtgaagctttaactcatttgttctaaagcacaattttcttcatcatattagtcattttagggccgggcactgaacaattagtggtaatgatgatgaattggtggcaggaaggatttctaagaaacagttttaaatataggggacatgaaaagaacaaaatcttctgaacacctagaaggtagaaactgaaaactgtgtgtcctatagtaaggcccagtgtcttctacagaatgtctggctacagaaacgaattatgattaaagagataatgtgaatacaatgggcccttgagaactgaaggaaatggaatgcagcaaaagcggaaaaagaactgtgacaggctccacctcctccatgatcttgctcaggttcaagtttgcttgtcctagaccacccctagactctaacaaaccctagggaagactcaagtcttccagtcaatttttaaattcttgtcaccatgcattttgttttctgtatatcatttctgatgttaccaccatgactgccccctgagtactcaatgttaatatgcttacatttctcttacaaaaaaaagattcacttcatagcatcacaatatcacaatataaataggattttctattgtgtgattattttcatcaggccaacagaaatgaaatgaaggcagaagaaacattgtccccatgtaatttaaagaaaacaaaaagaagatcactgaaatgaactgtcttaaatttctaaaacttgaaaattaaaagagctaagaaattatttatcgaaactatttattttgcttttctctgaggagtgcaagggtgaattttttgcataaaagattacgttaataactgcccactgctttttggttttaaaaccatgactctttggggaacattttttgaggagtttttgggggtcatttagaaagtagcaaaaaatattatttccccaagatcacacaccaaactggccctcacaactcagctctcagcgaagagaaaactacctttcttttctcatttgtactataaggatactctattggatataactcaaagttcagtgatagaaaagagaaattaatgttgttttccttcattccatttcaatataattttcccacaaagataggtaagtcattatacattttcctctttgccctagtgtggggaaaaaaaacactttttttccacactaaattctcctccctcagtttctgccatacacagccatattctgaaccactggtgattttcattgtctaaattaaattattgtaataaatacctgctgtattcctaccattctgtacctaaggctttgggagcaacagatttgcacaatacttattttctaagaacccctccaatgctggttgtcccagagccacttggatttaagataagagttttatttaaagtaacatatctgtgtccctttgtgatgtttctgtgacatggcattcattttccaggaagatctaaaaatctcagctctctgcaagcattcattcatgcatacatgcatttatctatttcttaaacacttaggtgctactttgtggtaggtgattaggattaaaaaatgaataaccaatgagccctatactgaagaggcagatagataagaagataatcacaatcaatgtggccaatgctgaaccagagaaatgagcaggaattgaaatagttgggtagatggggtgatgcctacatggtgagcaggggttcactttctgtagataagccaaggactttggggaaagagggaacagcagggatgaccaggcttctgacaggccttagatgtttcctgcactaggattgatgaccctggatcctagtgaggtgctatgcagaatgatggtagagaggacagtttgaggcaggttctgaagagccctgtatgctaccagaaaaccctgaacttttttcctatatgcattttgagccaacagagatgtttaaccaagaatgttacgtggatagtctcaggttttggtaacatctgcattccattgactgtttcaaggatagcctaattatgtgtattttttaataatatcaacatttctagaaaggtttactgtctaaaaattatctaatgacaatcacaaaatggaaaggtttctttgctgccctctacaggcttccagggctcagtgctttgaaaaaaatcagccttgaatgggcaaacacacatctcattttgtttggcaagaaaacgctaacagtaggaaaagtttaaaatagccaaattaatgtatagcaagtagaatgacaaatacagaaaggtactgtgtgctattggtgatcccttgcatttcaaagtcttttaacttggagttctatagttcaaataattttccagtatatttatctaaggctcataatactttataaatcttaagttgacaataattattgtgattaataattgttacataatttaaacagattaaggtgcaaataacaaatttaaaaggccaattgataaaatattttcattacatatgactaacaaaaggcttgctttatttttgctttgttctattaatctcgaagagctttccatatcaacacacaaagagctcttcctcattctttctcagtgcttcataaaattccattgtatatgatttttaaatgataaactttttatgtcattaaaatatttatttaaggatccaccagaaatggtaagcattgatatcttgtgggcaatgggcctggggtttggggtactgggacaagacccttattttccattttattgtcttctacagtatttgaaattttctcctaaagcatcttttacttccataattatagaaagctgttctaggattataaattagcagtgaaaagtatggaattacttgatttctagtctgtgactcagactattgaatatggttcatctacaaggaagatacgcatttcagagttacatgttctataaaatcacatcagctatggtttgaatgttccttccaaaacatgtggaaatttaactgccattgtgatcgtattaagaggtaggactgttaagaggtgattaggccatgagaactgtgccctcatgagtagattaacgttgtcatttgggagtaggttttttattactagagtaggttgctataaaagtgagttcttccttctcttcctagctcactcttgggccttttatcatggatgactcagcatgatggcccctttcagatgctgacaccacgctcttggacttctcagcctctagaaccatgagtcaaataaatttctgttcattataagttacccagtctgtggtattctgttacagcaacataaagcagacgaagacaacatctaattttcaaatttctaagctattagagagtgaaatttcagaaaacttcaaataaaaattttgataaaatttcagtatagaaaattatgctaatacaaagttgtaattaatattaaaatgcttttaagctgaaagtcaggaaacccagagttcagattttttctctccttaggcattaagatagtttcttctctatggctcaggttatcaatcagtaaaatgggaattattttattcacctatatcaataggagatcaatattttttacccactattcaaagtcagtaaaaaattaacttggaaacttagaaaaaatagttttaaaaaaccacactctgtttctgttttctgttaacttttactaagagtttgtgcttatagactaacacataatttaattcaagtatgctttctttcagtctagttacacagaaatttaatttaaaaacaaaagaggtatcagtggaaacagctgagcgctagtaaaagtgcttaaacctgagaaattttagaaattgctttaagtggttcaatctggaggtaaatgtcttcagttcgggaactagcattttagtgtatctacagcagtacttggtatagcattagtgtgacaggactgccaggttcctaaatctagcacctcctatgtagttctgtggttttgttcctccttccagctgccttgggttcaaatcagaaggtgtcttaaaagagctcaaatgtggaacacactatgcaccaggtaaatttaaatggctttcattaccctctgtttgagtgtttgccttatattcttcattaattgaataactttgtagttggccaagcacttttatgttgatattgtattggagtacatgtaaattacccaacagttgctgggaggtgaagcaacctgcctgaagcaaggctagaattgcagcccaaggcatctcctgtaattcctttgccctttcccctgcattgccagtgcctcagggcagcatccagttcctaatctccctgaaaagacagaactccactctctgaactttacatatatttattttattttattttattttattttatttttctgagatggaatcttgctctgttgcccaggcaatggcacgatctcagctcactgcaacctctgcctcctgggctgaagtgattctcctgcctcagcctcctgagcagctgggactacaggcacccaccaccacacatggctaattttggtatttttagtagagatggggtttcaccatgttgcccaggctggtctcaaactcctgaccttgtgatctacacacctcagcctcccaaagtgctaggactaaaggcataagccaccatgcctggccacatgtatttattttctaacaccacagtatcagagaagtactgttatctcagtacagtagtccccctttattcatagcaagggttatgttgcaagacccctagtggatgcctggaaccgaggatactactgaaccctatggattctgttttttcaatttaataactgagaaggccactaagcgacttaggggcagggagtgtatacagggtggatctgctggacaaaaggatagttctccagagcacggtagagcagaaacattgtgagatatcatcacgctactcagaatggcaagtaattaaaaatttaggaattgtctattttctggaatttcccacttaatattttcagaacttggttaatctcaggtaactgaaacctcagaaagcgaaacagtgcataaaaggggattaccataaataaaaataaatgttatttttgttttaaatgtctctaagtgatctgcatcgaaacctaaactttgaggtaagattctctacccaatctttaagcctgaatggaatttattaaactactgagctcttttctcccacaatgaataatttactcttcagccaggcatgcctgtgaaatacttaagtgaaagctacacaaatgatcacaacaataaaattcttattaactcacatataaaacatattatggtatttgcagctaggtgttgctatggcaacagttaaaaaaatttttttaaacatttgtcacactaaatgaagtatgggatgtacttttttgttaactgtgaatttacatgacctgcaacacgacaatggcttaatgggagctaaacaaagggtgcagtttcccctccctcttcctgcctgtttcccctttctcctaggagccatttcaggctttctatcttgattaactgtgtcttagtaattggagcttacagctcagaacagtaattctgtcccataattgtagatgttaaattttaattctactctgtaattggcaataatcaggccatgttctggcttttctggagtgctcaattagaggcctgtggcctcctctttcttccccttccagcaaagcatctattcttgactcatccccatctgaatgattgtgtctatagttaaaagatatgataaatattcttagatttggaagactttgaaaaggagtatcctaattactattgttcacttgattgaaaatttcccagctctaaagctacattctgttaaacatggggtcactgaagctttcatttgcttcaaaaaaaggtcattttatgtggtcagcagctaacagtataaaataatagtaattttatttctatttcttttaaacaaagagaactttttctaaattaaagaaaacagaaaaggaaaacataagattaattgggttttcacttagcatatttctgaagcaatttgccttcccttaaaaagacagtttctccaagtgtgttattattcaaaatactcctacccaaaggtttccctaagaaaggagcccctgtttttaaaatgccctgcattatataccgctttgggaggtttgcagtatgttctagacatttaagacctctgatgattcctgcaataacaaacgctatttggtttacttttaacttttcaaagcttagattaacccattgcttcccagataactgtaagacactgctttcttgtgacttacattgaactgtgcttataattcactcacccatttttaagtccagagcttctactgtataaacatattaaggtaatcatgttagggttctaaaaattcctgaaaatgcataattaaaggggaaatgattaagttcctttttaagaaagcaaaataaatgctgcctttagaaaaagacatgctaaagcttgtaagattaaaattaaaaataaaatcattttttaatagcagagtttctcagccatggctctattgacatttgaagccagatgctttttgttatgggggtgtctatcttatgcactgtaggatgctaggcagcatttctggcttctacccattacatgcagtaagggagggaaaaatggcttccctccacccttctacattctttgactatactacgaactaaactgacataagacagattaataggagaaaaaaataggtaattatgtacatacgcacaggagtcccacaaaatatgagagtctaagaagagccaggtaattgaagcttatatagcatcctgagctacagaaaggaatagtggcttggggcttctctggggaggtggcatcaagtcatgggcaggtgagaggaagaaatgtgtggtgaatgaagcttgtcttgctgtacaaataaaaagtctctcaggtataaaacttgtctctaagcagccctctttctgacacagatactttgactaatgtagatttcctttatagatgtaattttttacaaaatttttaccaaaggacagtttcatcatagcgactcttatgtctgcagtttttcagaatagccagctctaaatatgctaaagaagtatatttaagggtgacatattctgatctcctatagtcattttttgagttgatgtatcctgagccccaatagttcttaacgtaattgaggggcaagtccaagaaattttcaaagagaacactgatcaagtgctttggctttgtacctttaaagcacaacagagctctgcctgtcttattaaaaaggacttaaaaaggaaatttgacttttattcttaggtcactggttaatagctgctcaaaaactcttctagtttgaaaactctcagaacaaaatgaaggataaaaaagtagaccagacctatgtagaaggaatcttagagtgaagtgggtagaccagcatgccagagacttcctcagagaccaagtccccaaaactgtgattgcttcttaaagactaaattcatttacagtggtaatatggagccatggaggaaaatttcacttttcaagacactttttccctgactccagtcccagtacatattctcttgcgtttataagtttgtcacttaacgggggtccatatagtcttaactccctggttgagagacatactagagcagtgattctcaaagtgtgatctagggacctctgggaatactgaagatccattcaggagatccagaatgtcaaaactattttcacaatacaaagatgttagttgtccttttcactcacattctgtcacaagtacacaatggcgttttttggatgtgtgatctcacaagagactgaatgcagaagcagatatgaaaatccagctatcttctattgagccagacattaaagattttttttttaatgtaaagcagtgccactcttctaaattttgttttggaacatatattttataaatatgttgcttatgttaaaatataatgagtttatttatttttatttatttttttgagacagtctcacgctgtcacccaggctggagtgcagtggcatggtctcagctcactgcaacttctgcctcccagcttcaagtgattctcctgcctcagcctcctgagtagctgggattacaggcatgtgccgccatacccagctaatttttgtattgttagtagagatgggtttcaccatgttggccaggctggtcttgaactcctgacctcaagtgattcacccacctcagccttctaaagtgctgggattacaggcgtgagccaccacacctggcctattattgttattttaatgaattagtaagtatttaaaattttttctcagttttaattcccaacatggtaaatatcaatggatataacccatttataagtgctatgctagagaatgagaatattctgttagacatgtgtggaaagggaaggatcagactaaactccatggaatctttagcatggtggagccttttatttttttattttctattttttgaaacaaagtctcactttgttgcccaggctggagtgcagtggcgtgatctcggcgcactgcaacctccacctcccagactcaagcaatcctcccacttcagcctccccagcagctgggaccacaggcacatgccaccacgcctgaataatttttgtagtttttgtagagacagagtttcgccatgctgcccaggctggtctcgaatttctaagctcaagtgatcatcccacctcggcctcccaaagtgctgggatctgaatgggatcataggcataagcactgtgcccagcccggggtattttaaatacacattgaaaggtagatgtaaatttcagggctgggatttataaacatcttcaacccaataaaatgccacattgaaaattaggcttttcctctgacactctcctaatctcctgaggttgctcattaaataagaacatctatgaagactagtctcccttcctgacagcttttgtatcagtcttccccttccatgaactcgttaaaagaagccctaatttcaggagagagactgccagtcccttggccatctgctggaaatgacagatcagggaggtcccttaagtgatgccattcatagagaacctatttgatgtacatgattatttgaatgctattaataaaagaaataaaaagtgtactttatcctgaacatcataatttattgtcagtcttttcatgaatctataaggtcaactatcctcttgttttcctcatctgttaagtagatcataaaaaaaataagtagtaaattcacatttataagtaaaggtcttttttttttttttccagaaccgtatcttatttcccctatgacctttgctgttgctcggtcctaataaaattgaggcccaggtggatgatgctaacattcttagaatcaagccaagttagagcttcaaggaaccttttagcattgaattcagtggttcttgaattcccctttgagaacctgttgacagctagtagccctttcccccaggaagatgcatattgtaggcagaatgatagccctccaaagatgtctataccctcatgccccaaatctgtgaatatattacattacatgacaaaggacagttcagattgcagatggaattgaggtttcttatcagctgaccttaaaacagggagatcatcttggatcatctacacagattcagtgtaatcacaagggtccttaaatgtgcaagagggaagcagaagagtcagagcgatatgaggtgaaaaagacttgatgggccattgctggctttgaagatgaaaggggcccatgagccaaggaatgtgagcagcctctagaagctggaaaacacaaggaaacagactcccccctagggccttcagaaaggaaccagccctgccaacaccctgattttagcctagaaagacccatttcagacttcggataaatctgtgttattttaagccactaagctcatggtaatttgtcatggcggcaatgggaaactaacacaatgcataaccatgtctacatatccaactttgtatacagttccagggaggactgaccccagggtaagggcttcatgatgtgttccaaaatctcatccgatggatgtcagtagaacccaaaccccttgacttctgatcgccaaagctctttgtatataaaagaaaaaacactcaccttcctacagccaagttcagagttaaaatgggctatcgttagatgctcttctctaataataataaagcctttgacttcaagttggacccaaaacatttttaatgaaactaaaataagaaaaagaggtttaatccagacttgtaattgatcatgctgaagttggagaggaaacatttaaaaaattctgaacagagcccacattaatgcagatccctgagatatgtctgggtctgtgaggacacaggaggcagtcatctgtccagagaaatttatatttataccataccacatcctcatctgcttaaggcctgctggctccatttgtgaaacaagaaacctgccagtcttttctttcaagacagtaccctcaggcactcttctgtgagaattcaagcaaggaaaacaaatcttttctcagggttgcagaaggcaggctaatagtaatggcaagataaagtggatgttattgctcagagggcaccttcctgatgggatcctggggtattcggatggggctctttccacaccccatggtaatccactgctatgagtatcattaaaggcttagaaattatctttagcacattgtttataaacaaaaaaggaaacagagatcattgagggtagagtattcaccattttttagccattttctctctgccgtagggaaaggtgtaggagtgggcattcactctgaggacagtttaatgagctgtgtctgtcacctggactggtcagaggtctttgagggaccaggaattcctgaattccatgatagttgtcaatttaaggctctgattactgttacattgcaaattcatggatctgaattctgaggcccttgagaaaaagaattatgtgtttttcatcatcccacagtagcaaaagcctcatatatagtgggggctcagtaaatgtttattagttactggggagagatgacactttagttttaatccacagctgtttattaattccaaccattgcgttaggtgctctggatttctaaaataaatcaccaaaagaaccttccctcctggagaaggctacggtccagagtagatgagagaagatccttatgcaggcaatggtaattgatcaaaatatgatacatgcaatgggagaagtaggaagaaagtgaggggggattatggagtggggagatgctatttctagagtgaggcttaggaaggcttttgggtagaggcttcatttgaattggtgtgggtggtctgtaggattttttgagatgaagatggtggaagagttatgcctcaagaagagggcagtgtgggcaaggagatgagagtgtgtggggagcctgaagccagcaagcttggctaaatctaaagtgataggaagggtgaggaagagtgggttattagtcatttaaacccagtgcaacctaagagagtagcttggatgggaccaagggctaaggacaagaggccatagctgataaggaatggaggaaggtgcccaagaaggcagggcttgaaagctggggaaccaaaagaaatgtgcctgaacataagctagacctcagatggctggcaaactggagtggatgcaagagtttcagggccattgaaaagaaagttctacatctgtccactttggaggctgcatgcaacactcacatgcctacctattggggtattattggggtcttagtcaacttgggctgccataacaaaataccaacgattgggtggcttaaaagatagacatttattttatcacagttctggaggctagaagtccatgattagtgtgccagcatggtcagttctaggtgaaggcccgctttagggcttgcagatagctgccttcttgctctgtcttcacatggtagacagagacagcaagctctctggtgtctcttcttataagggcactaatctcatcatgagggccttcccctcttgacctcatctaaaccttattatggcccaaaggccccatctccaaatatcatatttggggttagggcttcaacacaggaattttaggggtcacaattcagtccacagcactgggtcagaggattatgcctgggaggtcccaatctagctgcagtggcagcagagagtaggactgctcacccgctggtgttgccagtaagatcagattgcagtgagatctttctaggatgtgccttggtgactagttttatgttttttttatccactgtctacagtgggtcattatcagatctaagttggggcacagttttttgaggtgatcatgatattgaactgacagactcacacgaaaccccaaatggatgtaaatgtagatatagatagaaaatccgtgtctattgtataattataaatgtctacacctaacttgtattctgagatatatatatacatactgtatagtgtgtttgtgtgtttatgttactgttttcgaacccttttttattatctataccaccagcaaaagaagcctttttaagtattttctattaattgcactcgctaacattttaatatcgcaaatatgctgcatataagtttatatactgtatgtgtatctgtgctttacatatagaaagaataaaatttttgccccccaaaaaacaattttcatccttgttggagcaatgctgtccctattgagaatgcatgatatatatatgtagatgtgtatctgtgtctatgtatgcatgtgtgtgtcaccttactgcacaaaagagtttaggatgccaaattagatgttgtttatgcattcacaatggaaaatgtaactttccaaaggaatgaatattcctgtcttctatccaggtatcaggaaagttgaagtagtaaatgggggtgaaaaaaagaaactgcttaaagagcactgagtcaaaagaaaataaattggatagtcatggagaatatttcatccaaggtatagaaatgcctggaataactatctcccaccctaacactaaaacctgactttagtgaaaaaatctatgtagctctgtaatatataaaatgttgctgtttgatagtgctaaatgaattctcaaaatcggttttttccattctactttttctagacactcttcagaccattcttccaattttataatacaactattgtctcagacttcttacaatgcaactgagtagcttatagcccttgagaacatcttagttttcttaattggattagactgcagactctagcctatcttcagggacacatttcaaagccatctactaaggagagttacttcagtagatccattatgtattgttttgagtcatttcagcttccgggacaatcggtttctgaccttgtctctaaatccttgtggtcccccagtggagcccacgtgcagggatcgtgagtcagggaccggactgggcatgctctgttcagcttgctagcagatgtttagctttctagctccattgtaaagtagtaatgcttttcatattttatttttttaaacccatagattttttttagacaaaaatcaatttcttgattcatcagaagctgattattgagttagtaccttttctgaattcttcctggacagaaagttgaatccagtttgcttcatgaatgcttttttacagtccaaaggtattgacaataaacaaaagaaaaccgaaaagactttcttgtcacagctccagaaaatgatgagattgaaggaaagaagacattaaaactaagggataaaatgtctttggaaaataaaactttactccattagaaggaaagctattggaataggttaaaagttcagattacagatttgtttaaaaataaaaatgaatttccacttccagtatggccaaagaagttcctaccagactgatcttgcataaaacaactataaactctggacaaaataaaaaatatttaaataccacaaggcattgaaaaatgaacaaaagcagttagattcaagaggggagttgacacttggaagaaaggaatgacaagaggtaagtttaccagtttttgtggcttttagtctaaggcatgtcacagttggccccatgtccagtggctaaaactctaatagaaaacctatagtttttctggcctgaagaacaaggggccagagtttggggcaaccagtcctgctggaaaataaagagagaaatcccataaaggagaaagccaaagaagatgtacccttcattctctgtacagtagtctccccttatctgcaacataccaacatcccccagttgatgcctgaaaccacagatagtactgaaaccctatatatacaatgtttttcctatacccatgataaagtttaatttataaattaggcacaggaagattaacaacaataactaataatgaatagaccatttataacaacatactataataaaattatgtgaatgtggtctctttcttgctctcaaaatgactcaccccttctcgtgatgatgtgagatgataaaatgcctacgtggtgagatgaattgaggtgagtgatatagacgttgtggcatagctttaggctactattgatctccttatgctacatcaaaaggaggatcacctgcctctgatgctcctggattattgagccatgacactgttgaccctaggatgtcaggagcagacaatgtcaatgactaatgggtgtgtagtatatatagtgtgaatacactggagaaagggatgattcacttcttgggagggatagagcaggatggcatgagatttcattaggctactaagaatggtgtacaggttaaaacctatgcacagttcatttctggaattttacatttaatatttttggactgcagttgaccacagataactgaaactgtggaaagcaaaactgcaaataaacgtggactactgtataaactctgctcaaatctctggctaactcctgaaccacacgtgtgcaagcaagctagaagcagtctagctaaagataagaaaaccaaactgaaattttagctaatgcctaaaagacagtatgcagtttgagtccaaccaaattagttgattgaaattctgttatgtttctctgaaacagtctccacaatataacatcacaatgtccaggatataatccaaaatcacttggcatataaagaaacaggaaaattacatgaaccattcttagagaagataatcaatagagaccaggtgcagatgagcataaccatcctcaatgacctaaaatatatgtgtaataaatgaaaagataggcaatctcagcagagaactagaaattatttttcaaattgaaattttagaactgaaagatatctgaaaagtaagtataacatgattaagattcatataacaatatatactagtgcttgaaaaacagtcaagaagaaattttgcttaaactaatggccaagaatcatttataatctgtttattaattttaagcaaataaattctaccagagtggtatccagtaggtacttgagtgtttgaataaatgtcttaccaggcctcgtgtagcctgtctctctgtcctcatgtcctgctactctccctcggctcgtcctcctcccgcccactgcctgcttgtgattccttgaacatgccaggcaccctgcagcctgaggcctttgcatttgcagttccctctgccaagaatgcccttctctcaggtatccatgattcactccctctcttccttcagattcttgctcaaatgccattttctcatgaggcctttcctgcctccacctcccaccctgccatctgacacttctttattcatttcctatgttattttcctccatacttctcattagcctctgacttggtgtatatttgatctccatattttactatgtctcactagaatgtaagttcccatgagtgcagggatgtgtgtatgcttgtctgctgtctctgcagtgcttagaacaatgcccggcacataataggttatcaaaaatattaaatgcatgcatgcaagaattaatgaattatcttcttacatctaattatacaatatgctataatcatgaattaattgccatgctttcactatatgcccttcacgcagatattaaagtagatccctgaagatggttgctttctctttgtattggttcctttctgagacagaaaatgtaagtaataataactgcctgatgaaaatagtcttccagttttcttcagaccatccatgtcaccagcaaattcattttccaaggcttaaaaactttcatggcttcccctattcagaatgtgcttcacatcctatcttccaaagctccatgatatcgcccttgtctcaggttgcatacctgagacaaggatttctggcaaagtgatttattaggaaatttcgctggcaaactcccctgtgggaggagggaggcaggacagggaagggaaggagactgagcaagggtgcaacatccagaaaatcccatgaagaggacttctgctcagccctgcaggaaagcactatggacagtgaaggtcacacttcataggtgtctccatctctaaggacaagaagctggagtcattccacccccttatcctcctacaggctcctttcttttcattgtaaattttttccagctctctgtgcacacaggcaaagcagcccagtgctgtcagccaaccaagagacacaggtgctggctgttgggagtgaaagccccagaaggcagcatgtagtgaaacagtaaagggattctgggaatacgggcgtgcacaaaacactgacagcatctgctgcctttttaactggattcttactacttcccggttgcaaaagtcactcattgctcttccttctatgcctttgcttgcaactcgcctgccttccctctcccaccatccaactgatcctttaagattgatttcctatgctccctcctcaatcaagcttttcttggatttcaaaaccctgtggcaccctcatttctctgaatcttcattatgtctttgaccctggcatctgccaccacctctattactaatctgctattggtcactatgagaacatatgctcatctgtcaagagtttgcattctgattactcagctcccttccagggcaagaattctgcaattgcatgacttacaatattctaaagtgtattaaaatcatgaatacatttatcaaccctcatcaaattgtaaacttctcaaggataagaatattttgtcttttgggggaaagggatgagagccccaggccggctgagacggccggtccagggaagctccgccagtactgggcacactcaccgaacatggcttccagcagccgcgtctggacctggaacacctctggatctttcaggtcttcgggaactttcacccacggcagaatatttctacgtgccgggagcgttcccatattatgatcctcataaccaaaaccacgctccagcgcaagccaggcctaaccgcaccagctgagcctcagtgctggtaaagcctcgcacctggcggccccgcccccggccctggccaggaccctgagtctgcgcgccccgccgccctgtctgcggtccagctggttgccatctctgccgcttcccgcgacctcaagagagcctcacccgggcccagctgtctgcaggttaactagggtttccacctgcattgacctgtgtctttcgcaccagaatctcctgggcttgggaatggctgggggcggggcgctgttgactcttctagggaacaaccggtggggcctgaacctcagaaagcgggcgtccaggcttgagggtgcgaggaccacccagtagctgccgaatcgagttcctgcctcacacgttccaaaggagggtccgtatcccctcggccctaaggagcaggacccgcggctccactttgctggcaacctgggcaacgtcctgggaactctggaggaactcctgccattgaacaaagaggaaaccgaaattcggaaattgattatcttacatgaagggattagcgttcctcaaagccccttgaacctacccggattttaaagctcacctgtgccctgcctgggcactcgggccaaaaccggtccagccttctggctcgtctctaaataaatttggtttactcgttttttaaacatagtgtttggagcgatgcactggattcactagttgagagtgtgatttcactgttttatggctttacagatggtgatgaagctggcatttccagtcctggtaacatctaatatcccctcagctgtccattattgacggcttcttaaggcggacctcttcacacacacaaaacaactatgggttctattgcaaccaccagtgtagttaatttagaaaacgatcatcactgctaaaactatcagatgaagactgttgaggaactagatagtcacaaggtttggaagccctagcccacatattatgaattacaaaggaggaaaaaaaaagaacgttcctttacaatagagacttggaagaagccaccttaacccaagttagcatcaccaataatgggaaaaatggacttctgcttcgtcaatatctgaaaacaaaaagaggactgttttattacttgactaaagagactaaatgctgtgtgcatggttcaaataattctgaatcaaaggtgaggggttgcatttcaggaaaaggaaggaaattttagtataccctatattgcaaagtagtattagaaacttctagagtggaataagtgtactacaattatgtataaggtcattattctcaggagaaacatgctaaagtatgtggagtgaattgggtttctctatttttatttttttaatttaatttttttgaggcagagtctcactgtgttgctcatgctggagtgcagtggcactatctctgttcactgcaacctccgccttccgagttcaagtggttctgcttcagcctccccagtagctgggattacaggtgccagccaccatacccagctaatttttgtatttttagtagacacggggcttcactatattgaccaggctgatctcgaactcctgacctcaagtgatctgcgcacttcggcctcccaaagtgctgaaattacaggcgtcagcaccgcgcctagccaaataatcaattttttttttcttgaggcggagtcttgctctgtcatccaggctggagtgcagggcgcgatctcagctcactgcaacctctgcctcccaggttcaagcaattctcctgcctcagcctcctgagtagctgggattacaggcccctgccaccacacccagctaatttttgtatttgtagtagagatggggtttcaccatgttggccaggctggtctcgaactcctgacctcctgatccacctgccttggcctcccaaagtgctgagattacaggtatgagccactgtgcccgaccataatcaattttcaatttcccatctcccattccacctgcagcccaagctccatttttcctgtcacccagactcttatgaaaaataaccctcgcttctacttctgtataccttacttattcctaaacacatcattccatggtaccttcctttgcatttcagcaaaagtcactctggacttgctccgtccaatacagaagtcactagtcacatgaggactggaaatgtgtctagtctgatttgagatgtgctgtaagtgtaaactacatgtaagattttgatgacattaataccaaaaaattaaatattaacaattttagattgattatatgtttaaaaaagaataatattttgttctctgaactacagctatgtctgctgaaaattgggaataatatatctaaatctatttcatgaaatcaggaataatatatgtatagtgtctgatacatagaagactcttgaaatagatcgatatattggcatatctttgtacttcaggaagagcctattcagagcctattcagccttgtacattagaagcattcaagaaatatgcattgtagaaacagaaactaaaggccagatgctagttagtggcaaaggcaagcctcttcacactgcatgctgtgacctttctattcctccatgttgccagagccaagagttgattaaatactggacagctggctttggccaaatactaaaagagctaaaacgcacatggaagttatgttcaatcacttaggacctccaccaaccacctggttccaagacagtccacttttagtctcagccactcctaaagcttgttctttgctgtcattaaacacataaagtatggatctaatgccgaggagatagtacccagtggtcctccaaaaagtggcagctttaatatctgatgtttgcatcttgctgttattatttattgcagagtttaacattcatcatggttggttgcccactgcaaggtttgatctggatcagtggctgatcattcttaatttagctattgaaattaataagcggaccatgcagacataagctttagctgtcacttgtttgctcactgctacacaaaagtgtggagaccggaagctaattctacagcaacgattctcctgctcagaatcacaaacacaatttattatacccagaacctgcccaaaacattattataaaaccttcctcaagcaggtgggattaattagatcttcctttctctcaggctcttcctttatagacactcttccttctccttccttttcccactcctttccttggaaaagatcatgtgaataatggtacaggaaatttgatcattgtactttgcaagggagctttcgtttcctttaaggattatccttactcccaggcaatgctccaaagaggcactgaagaaaatgagggagattcagagagaaaattagcccctcaaagggaaatattttaatgctttttttgtttttttttttgagacggaatctcactctgtcgcccaggctggagtgtagcggtgtgatctcagctcagtgcaacctctgcctcgcgggttcaagtgattctcctgcctcagcctcccaagtagctgggagtacaagttcgcgccaccacgcctatctaatttttgtatttttagtagagacagggtttcaccatattggccaggctggtctcgaactcctgacctcgtgatccaccctcctaggcctcccaaagtgctgggattacaggcgtgagccaccgcacctggcctttaatgcattttttattgtggtaaaatatacataacctaaaatttactgctagttacatttaatacattcataatgttttgcaaccatcatcactatctagttccagaacattttcattaccccaaaatgaaactttataatcattaagcatttatttcccatcccccttctccccacccctagcaaccactaatctgctgtctccatggatttgcctcttctggatgtttcatataaatggaatcctgtaagatgtagccttttgcatctggcttctttcacttaataacatattttcaaggatcattcatgttgtagtatgtatcagtacttcattcctttttatggctgaataatattccattatgagtgtgtgtgtgtgtgtgtgtgtgtgtgtgtcactatttgttcatccatttatccattcatgcatatttgggttgtttctacctcttagttctcatgaatagtgttgctgtaaacgatcatgtacaattttttgtttgaacacctgttttaaattcttttgggtatatacagtacctaggagtggaattgctgggtcatatagtaactctatgtttaacttattgaggaattgccaaacttaacacatttttaaaaaccattctggcctggcctgtagaattcttcttatgtctttaatttgagttcagtggtgcataaaagatagcaattaagataattggttttttgtttgtttatttttgacacggagtcttgctcggtctcccaggctggaatgcagtagcatgatctcagctcactgcaacttccacctcctgggttcaaacgattctcctgcctcagcctcctgagtagctgggattacaggcatgtgtcaccatgcccggctaatttttttgtatttttagtagagacgggatttcaccatgttggccaggctggtctcgaaccctgacctccagtgatctacccaccttggcctcccaaagtgctgggattacaggcgtgagccaccacgctcagcctgagaattgttaaatgatgaaggaaacttcatgaagtgcaaaatggcagggcccaggatttcctccctttgggtataaggtaagaatctagcaaataccacataatacacctcatgatgctgttactgatcaggatggctggtccatgtctgtgaagatctgaattgaaaacgaaagttttttatgttcagtatgtaagtcgataaaggtgacattatgacaagaatcttaagagtgggatatataaaatgttttggagtattttacaactatatcataggtttgagcatagcgacagagataatgagcctttccaactatatttcacatttcaatttgctttcttttccacctagaaataatccaaatgattttgcatgatatagacaagccaatatatttccaattcactgtatcccttttgtaatgaaatctcccacgccacaaggaatgccaatttgcttaaaacatcagttgcttatcagtatatttcaaatgcctcttaatttaaaattctttttctgcctatttcaaatgtgtacgtgtataaacacatgcacacacatacatttttttctttttttccagtgaaataaatagaaaaccaaacacatacatacattttaaaggagaatcatatgccacttttaaaacatcctgacaccaattctcttatgaattctgtaagaatgtttggggatcattatttatcttcagtttttatagaataaagggtttcctaagtcgatattatgtaaatatttgattgaagacacattgaaataattcagatgactttctgaatattgtcagattatgttcataatataaacacaggcattttagtgtcactaatatttgatagatttgagtcttagagcctttgaaaacaattttattcaatttgttttaaattaggctaatattgagcttgattttttcctttaggccaaaaccaggtggctcacttgtggcttctattgtctaatgatcatattcaagaaagtggaaataccattatctgaggatcaagctactgttcattcaatcacttactaataaattctcagaattcaaggaaaatgctatggagagagaaactgctcacaagtgggaacaatctcagattttaatatatccgaaactgaatccagaaagctttgcattctatttagcaataatagtcacacacagaaaaggtttatcttttcatgtggcatgggtaagattaaaaatattagcaattatattattatctataaacacctaaatttgatatctacagaggacaagtgcctaaactctgtctatccaacctgcattttcatccactttcaacatattaaacacgttctgagacatgcctatgaaaagtgaattgtggcctttccatgcttaatttgctgcttaattgtgcatgattttataatgcccataaaataatacttataggcataacattccaaggcagcctttttcagaaaaggagagttcgatttatctccagatgtttctaccaaacattttcttttttctttccttcacccttcattcccacttcattgttgtgattaacagcgcaaagctccgtagcagaaattcatcaactgattccttccacctaccaaatccacatttttcaggtctcaatttgagacataatgaaagtctactttgcataattatcatatgagactatctataattaaatgatgaaatgtggttatgctccagtgtgtagacgaggctttatatgaactgaaactgcaaaggtttatttatctgctttaactttcatctggtgtttgtggaagaaaaacaaaaacaagcaatttatttccaaaggagtttaggtccccagtggacaccttcttttttaaaatttcaggagagaaggtgatttcttgaattgaggaataactggagactttaatatgatttcctcctcagcgtcaataaatattgctcacaagctttaaaaaatgctaattatcgacattgcattttgagttttgccttaaaaatattttctaaagattttaggatagctttttaaatacctgtagaaaaacccttcttattatcatgcaaatttaaagcttggaaaaaagcctttcaaaagtttctcaccttcattcatagtcttgattgattgcctttccatttcttctaactagacaaagtaaagttgactataccaagtttaatatgaaaacaatgattctaaaatttattcaaggcagggaatagcatctctgagattctttgtgaaaccccatgaagtattgttgaattgaaccttaaaaacaaaataagtaagcttgtctaaattatatccttatttgcgaagtattctttgcacacaattatatgccatacactgtcagagactgaaaataaagagatgaatattaaacaaccttcaaggagttcagaatccagtagtattccattctaaaagtgccaaggctgcctctatcagtgattcactaggacaaattctggagtaaagctccaatttaggtatgtttcatccactggcctttcccaccctaaatgttgggaaaaggccaccaacatgaagcatttgtgctattgacatgactctgaaaagagagaagcttcctccaagagccaaatgaagaaggaagtttaagtattaatctttaatatttccctaataatattttggaaaatcatgctctatcatttttgcaaatgtgatgatttcacatatacagttgacccttgaacagtgcaggagttcagagggccgacccccaaaacagtcaaatatttgtatataacttttgacttcctccaaaacttaaatactaatagcctactgttgaccagaagcctcatcaataacagcaacagttgattagcacacattttgtatattatatgtgttatatactgtgttcttacaataaagttagctagagaagagaaaatgttattaagaaaattgtaagaaagagaaaatatatttactattaattaattggaaatgagtcatcatagagttcttcatcctcatcatcttcatgctgagcaggctgaggaggaggagaaagaagaggagcggttggctttgcttttcaggagtggcagaggtggaagaaaatccatgtatatgtggacctatgcagttcaaactcatgttgttcaagagtcaactgtacatctatatctgaggtcagcaaactatggctcaaaagccaaatctggccctctgcctgtttttataaataaagttttatgagaacatcagccatgttcattatttatacattatctatgtctgctttgtgctacaatggcagagttaagtcattgtgatcaagaccagatgagctgcaaagtctatctgggccctttacagaagaagtctgccaaacctcgatctaaataacgtgcttaattttgtatttctaggcttaccaattttagaccttatctactgattacttactctgcaagataagggctagctcagctgcaccataccctacctccttcttgcacttgttgaggctcaggacttgatacctcaaagtatggtgccttggcatgctgagtactttgaactaaagaagattggaaggacctcagaagcaaggtctctctgactttatcctgcccttctgtgtcctgcctctctttctgtcccgaagagagtcatagaaaccagatttcctcttctccaagacaggtcgtaggaaccagaacccatctcccacaatgcaagccataaaacctagaaaggtcactgtctcccttctcccttgaagaccttcattttggaggagtcctgccccatactccaaaggaaggaaagctacagagacaggtcaagaagtatctggacagacaggccttggtgggtttttcccttagtctattaccattagatcatacccttttgtctaatcacattgctacatgactctctattcttcgtcgaacctaatcataaaaatagacagtattccctgggtctttgggtcttcattaatgaaggttcccatgtaatataaaatgttgattaaatacatttatgtttttctcttattaacctatctttggttataggaatgtcagccatgacccttatgatgggcgaggaaaggtatcattacctttctgcccctacacacttctctttctccagtgtaattctgtaactgccaattagctttgtaattttaaatgataaattatacatttctttctttttctttctactataaatagcatgtcctgatattagtaattccacttagtgagatgaaaatataattcttgtacccttcttgcttacttccccttatcctttctttttccaccttttgtcttccatagttagtctttaataatacaatggttgaaaacattcacaattgttccataaccattacgatgtctttcatgccttatttataggttgatttaaaatttttaaactcactggagggtttttattcttagtactaaggaaatattattcaccgtatagctaattattgctgattataatgcctctattgaaaagggatttttgttgtttttctagcagtctctgacagtttttcattttctcccttgcatgtcctgtgttaaaaatgctttgtccttcttaaaaatagagtcaaatctctggaaccaccttctttcccaggcacctttctcctcaattcttcctcccactctaacctgggttgatgacttcctaggcctcgttcaagactggcatccttgattttgcttccttctcctcctgtgttggatccattgcttccttaatcccatgtctttctatttcttgattttgttagagcacatcttcagatcacttgcttcaaaaagatgtgtgggaagtaagcgttctaaatttttgtgggtctggaaatgtctttattctgacccctcacttaacctagaaatctagattgaaaatgatttttccacagtagcttcagggcaagctacattgcctttgggtctccaggtcccacagtcaaataatgatctattctcattcatttatcctcaatgtatcttttctctctactgttttaaggataatttatttatctttggtatattaaactttcattgtgatgcttccaggtgtaaagacatttttattgtcaagctctcaggctgagttttcagatcattcagctcagggacttttcagattcttttttaaaaataattcctttctcattattgttctctgttttctgttttagaaattcctatcaattgtttattggatcttctgaattgatcatctataaatgttttcttttctctcgtgttttgatactttgtctttttactcaactttctggaagatttttaaaatttttatccttcaggctttttattgaattgaatatgaaattgtttaatttctaagaatattccctcggtctcatgtttctttttttttccagtgaagtgctgcagtacacaatctaaggcacatggctctatccagttatcttatacaatttaggcctagaaatgagtttgctgagacacataatatatgcattttaattttgaaaacttatgatagcccttcagaaacaggttgcagaaacttacacttctaattctagggaagggaaatgatacatcagaatttttgctttgcatttattaatgagaatgagtgtcattcagaactaccatttgtattatttttatctatgtgcctggtcatgtacttcattttttttttaattgagttgccttttctttttgaattctacaagttctttattgtgtatattatgtatttgtctgtttcatatgttgcaaatattcccttctaatgtgtcatttgctttgtaactttgcttatgcttttgatattttaaattactgtgtaattgaacctgtttgtgttttcctttgtagcttctgggtttcacattatgcttagaaatgtccttcctactcctagactctaaaggtattctttagtagtattttcttctagtgctttcataggttaaatgttttacatctaatacatacaggaaacttggtgtatggtatgtgtgtgaatctagcttattgactttccacatagatactgtatttagttaaccccatttatttatttatttatttatttattttttgagatggagtctcactctgtcacccaggctggagtgcagtggcggggtctcggctcactgcaacctccgcctcccgggttcacaccgttctcctgcctcagcctcccgagtagctgggactacaggtgcccgccaccacgcctggctaattttttgtattcttagtagagatggggtttcaccgcgttagccaggatggtctcgatctcctgacctcgtgatctgcccacctcggcctcccaaagtgctgggattacaagcatgagccaccgtacccggccagttaaccccactttaaacaatagtttattctttccctgggatttgaattgccctcatgctttagtttgtgaccatttctattccattgcactatttactagtttcttttagagaatgtattgttccgtaatgtaatggttcagtggggactcccttcactgatacttactaactgtccaaagtccagttactttaccaatctgttcctcaactgtaaatgactgtaagaataacacccacctcataggttcgttgtgaaaatgaatgtgctaatacatataaataattgagagtagctcttggaaggctcagtaaatgttagcagcagctgctgctgttaaggtaatggttcttttctccagggcctagcacagtgcctgattaaacaaatccaactgaaaggttagataacatgaacgtcaattattgaagagaattgaatgtcttccttgtgaggaagacagaaaggcataaagagctataatgccctttttccaaaagtgaagatggatggggcaaaatctcccagagttttatcctgggtcattgatttgttttccccacggcttgtgtggcccagaaagtaagtcacactaataaaggtcgaaagcagttttcagcctttaaatggaattaaatgaatactattatgacaagttaattagatacccataaaactgctaaacatatgtcattaaaaagtccatgctccaaattttgttaaacatcaattatgatcataagaaatctgcatctagtaaagtggatactgctgacacatgttaattattctggaaaataattgagctctttaaaaattttactatgctattaagcatgtatggcctctgaaaatttgagctattgtgagcttatccaaatgaatctaacaatataaaatgaagtaaaaatgttctttgagttctcttagtatgacaaaaggcaaacacaaattattattttgaagggtccataaaataaacttggtttgaactctaaatgttcaggtaggaaagttgcagagtctcagcaactccagtctgtgttagagtggccacagcaaaatagaataaaacaatgaagagctgttttctttgtccacaagatgacggtacatcacttctcaacagtgcaacagaaggaaggagttttgaaatgcatgcctctaatctatatgcattccaattcttgacagtggtcttgatttatgccaatgtaatgggaaatgttaattcaagtcatcaaattgtttatcataaagaattgctattgctgcccataaattgcttcttatctgggaactcagatgctcaagaaaatcaccagggaattaaaaagatataagaggctggtgagagtgactgcaaattacaggctatatgagggtcggatacctgattcatctcttgagctctttctctgggtgtctctcactgaaccagtgcttttccaagtgtgatcctgaattctgcaccagaatcacttggaatgcctattaaaacagattcctgggtaatgctgggctcactggtggggagaatttcagtacgatttaggtaaactgggcctggaaaatgaaatacttttaagcaaatagcaccaaaattgatgtcagggatgctattaaggaaatagcatcaaaattgttgtgctttctttaattactttcatatttgtattttgaaatgaatataggtaatgggaaattcataatcttggaagacagtgctcattctactctcagtgactattctcttctccctgctgaaatagaaagccttccctgcttgagtgggtctgaacaactaagtcctctggtttcctcccagttcactttctcttgaggttgaccttgcttatcaacacctctagcttctagcgggagtgcactcttgaaatcacaagactacctccaagtgtccaggaaagaccattgacatgatctgaagatccctacccctggatcctacccagtatctcagaagtcagggttgagaatacaaactttagcttactgctacatagttttccaatgtggtcataccatttattctccaggaacagattttgataagggtattcaaagtgtcctatagcatctctagaattcaattcacagtggcttacactcatgtggatagcatactgtttacactgattattataataccaaacagagcatataattcagggtatttattgtctctattacttgtctttttaatttataatcactgataagtctcaatctaagcttcagtgttccttgggagcaatgcctatctggggttgatggtaggagggaaggttgagagctaccagctctgttcagcatctctatcaacccatgggtgtgacttgattattattgcctctgacacattagagtatcattaacataaaagtcatctcttaaacacattaaactgaactcaattaacagaattgattaccagcctaactgtagggattttgcagctttagggaaactgacaaacatcttgcccttttagatcctacaatcacattcacaaagcacggtcaataaacattttgccagctctcaatttatcgtctttaacgaggacaaaaatctctctgggtggatgaactggctgttgataaaagactaattgtggaaatggttttcagtagtggtattgacaaatagaactgagtccttgaaggataaatttgaccatgaattaatggaacctgtcttggatgttaatttgtacaagccctaatagatctttgatttattgcatctcattttctgaagtggaaagcatgactggaaaaatgtatcagtctagatgtataaacctcatggtcctttgaactgtaaccctcaaaatgaataatattctgattcataaataacattaataacgtgtgcattccatttaatgtttaagaactccattaaccttagtttctaagatattccactttttccattgataatctctgtttagaaattatcttctaaaacctgaaggcatttgccaaagtcccatctagctctcaaatttggtgttcttctctctcataaattttactataggtctgttggttttgctatgtggtaatgttgaacaaagataaaagtttactgtgaaaactttgacagagagacaaacaaagagaatgtctcagttgagataaaaagagatctcatttcatttaaattaggcaacatcctcattgtatttcaaggtccgtatgtggaaaatatgtcttatccggaaaggaatgcttatttaataggtatgtgtttttcaggttttgtttttaattttttgagaatgttggtgtatatattagttggtatattataaacaaatcctagttgaataactgatctcagtgctgtttttaatgcaaaagtatttattgttcttggagaagaatcagaaaagaagctgaaatgagatttttcactggaagccaggaagaggggactccccatcagtgccatccaaggggcaggtttgtttcacggcacctactagatttctccatgaaagagtgagatatggtgtgtgagtgactcagagtcctgtcaggaaacaggtggatgtgggcacagataaggaaactagtaagtcacactgaggcaccagggactagcagcagctgggacctgttagcacttcgaggtctcaaaaggaaggagtaagaagaataaataacccatctctctctctctcttcccatcctcattctctcctgccagcacctcccattgttttgcccgagcaggaagccagaacacaaggatcccatgtgatgcaatcataagcgtgaagctctcagggcaccaatgctgctggtggggttgagggcagggagatgagattcagttcacatgtacaaggctcagaacaagagaaacacaagcaaaacccaaaacagaaaagatgtgtaaagttggacagtctaaggaaactgaactctttaggtaagggctagaaataacaatttcaatgcagaaagatcaagagatcacaagttcttaattaaaacaactgttagctcaaacctttgattctgtaatttccttaccagccccttttaacttccatcagaagtttttagttatcaaaaaatgagcctttattatgtaatcacttcttaaaattatttacgtaaagattatagaattatgaaattttcaaagtgtggccaatcaactctccaaaaatatctcttttatcaaaattaattcgtgtttgactcgtgtcttagatcgggatttctgtaacacatattcttgtagtttatatttaccaaaaccatggggttcttttcactttccgagtataaaattataacgtaaattttcaaagaatacatgcggactgggaggacatacaacagccccttaagatggggaggagacctgccgtgtcttcagccctcctcctcaactactgccctaaaatatggatacaatccaatttgatagagacaaactctcaggcctaaaatgattattttaacatgattgataaagactttgctcattgttatcaagcttttgttcaaaaatgtattttcctgcaggtaaaaaaaaaacatatgagtaatcaattaagaagaaaaagcctgcccagccatgcaataattatgttctctgtaaacaatggatgttgacacctgagaaaggtttggggtggttacatttccaatccccaaaggattcaatctatcagagcccaaacaagagcacatgtaagaactatcaaccagtctgtctcttcatcactcaaacctggggctactctgtttcatcccacttgctgtggtaggattaaaccagcaggatggaaatatgccattccccaccagcactctaacttcatttttaggtttctaaaaatgccactgaatatttctgaatgtgagagtggggcttttcaagggctgtggtgagctttgtgatatcaatgactctgtccatcacatttgaatatgtaaaacaccttttgggctcacaccagaagttaggaaccctctggatcatacagaacagaaatccttacattttttttgcttttgtagtcctgtcactaaaaaaagttttgaacatgtactgccccaaatgtgtattaatttattcataatttatatatctgtactactgtaaataatatattatggagaatataaaatatatgttaagaggtgttgaaatgaaggtaaaatatacattttaatcactcaaatattttgctatcactgctgcattaaaaaatcaatattttaaatgataaagtggtcaaggatgctgatttatttttgaacatcttggtttaacatttcattgagtaaaaatgtgaaggtctggttgcaagttcagcttatttctttatttggttttaatcattgtcattggaggaaaaaaagaactgcagaaacatatgaagaggcaaacggacaaagtatggctccaacttgcttactagatcatgaaataccatttttcaatcccatctatgcaagagattttgttgacattcgtctggaaagtttccatctcctttgatgtccgtcagctgttcttacaaaccaaatggaagatattgcctttttattatatttaacaagtgagttcacaatccactgaaatgcttcatttggaagattgttaaacaggttagacaaatccattttcaagttttcaaagactgcagtttttatctatgcatatttgcataattttcaataaaacaatcaaataactgttgttatgtctaaacatctgtttccctacattcagaccacaatccaagtttattttgacaaactaagttgctttctcactctttgctgtatcttctttaccctgaaaagacaactctttcagttcattgtcaccagcaaaccaacaacccctttgtcagacaaaagattttcatagctgctcgactttattttaatcattttgtttcaaaacaaccacactgttgatatctaaagtacttcaattaccctggaagcctcgttttgttctagtcaaagctactactccattgttgtatattttgctatatttcgtgccagtatcataggattctaagaattgtctttttataataagttctggtatcctgtagggctagacaaccatagcatttttcttgtttagagtgttcttttatagcattatgtaaaatttagaattctcattgttgaattttttaaaaaaggactattgaaatatctttattggatggcattaaatttgtaaattaatttggagaaaactaaaattatcacatttattctacccattaaaaagaagcctcatttatttcaaagcctcctaaaattctccaacaagattcttctaaacattttgtgattttaaatttaattgttctggattgtctcggcttttcaagtactatgtaagtttccaagcttgactaaacagttctaaatctttaaatgctcctgacagtgttgtgggaattgactgacagtggcctgtggaattgattagcggaggttaaattcttctgaacccacagtatgcgtatttatgaaggcaaaaagcatgcaattcaccatgttatgtgagctgaaaacacacgatgtgcagttatgtgtgttcatataaaatttaactcatttctagtgaagggatttgatttggctcttttgatcccaaaggacagaggcagtagttccagatgcagagaaggtttaggatcctgattagtgagggttcctggatcttctgtcctgatattgctccacagagtggtctctctccaagtttagtaacttctcttccaactcccatcttcgttccaacaaagatggtttctgttttctcatgtagcacatataaatcttattcctaaactcatgtgtgcgatcgtattatattcctgctggttggcaattcaaatgtaatcatgttgaatattcacaagttctgggaatcttacacagagaagaaatttgagcagggctttatggtttcaacccacattacgtgctcctaagataccctgatccaaatctgtgtgatcccctgaagttcactgactgccgtttcttaggctcagacttaagtcgtggtgccttgccgggcatcccaccaagctgcttctcctgaagttgctgccacctcacaggggtcttctacccttgcttcctcagccaagctgctcagactttcaggaaacaaaagtaggaaagagttataagcagtcaacttttgctttgagccctgataaatacatcacccctaaggcaagagtctgcaaaagacctgtctactttattagacctgggagtggaaaaaacccaatgagaacaaagcgaaaaaatatatattttcaatatattactttaccacacacaatatcatcattttgactcactggaaacctagaactaggttctaaaatgcctcgtgacctctctccgttgtaacctatcaactttaacaatccatactttgctttcttttattcttcctactgaaattcttgctctgaggaactctggtttacatagatgagcacttttggtcaaagctttccatgttaggcccccttccaggccacagcagggattacgaattttgcagccctactgtgcccaagcccaaatccagtcagggatgtgggaagatgctgaagaatagactgtggggttcctgtggctgccatgccaccaaggataataaggggagaagtttcctttggaggtgtctgtggtgtttgtccaatgtaacatacttagtcatgaatgacatggggaatgaagttggtggagaaaatccttttgacatgtggaacttcagggtatttattaataaatactattttaagcactatttacagactagatgcatgagcttttggtacataccaaacatcccccaaattcagtgtcataaaaccatcatcatgtcttatcccttattcaggtagctgatctaggcttgggggctgggcagctctgctatacttagcttctcactgaggtgcaggctctggtcattctagagaacaggctgaaagggcagcagctaccttgagaaggccttcttgtgacgctggtgggcagtaagaacagatgcccaaacaaactagcattttttacttgacacgtctgggctccatcatgggacatgcttagggcaataggatgttagcagagccaaggggcagagaaacatgtactgtgtatagtgggaaggtactggaaaggaatgtggcatctggtggcaaatcatgacctagggagcaaatcaagactaagtcagtctaccacacagaccagtgctaccaagataagagcatatattgatgcttggtcctctcttgtaatcatagctggtcatccctgaaacctaacaccaacgatgacctcaagcataccttaggcacaaaaatgtttatactccataagtagttatacctatctgtgatccagtcttaactacccaggtagcctacctgccattatcttcccagattctttaacctccgcaccaaaggtaacggcttctaaatttggattttccttccagaatccttccactcagcacatattttgaaaaggactttgctggctttaatgagtgcatcaaaaactggaatgacttcaggttttcacacagcatgctttctactagtcaaagcaattatttgtgacacattgggtgtatcagtgttttatttctgctgagaaagaagggctccaagagttcaaggaaagccctttccttttgttatggggagttaggcagcaggatttctgtcattccttttgaaatgaaatctgtcagaaacaggaagattgctcactttatcttgatggacatattttccatttcaattaatatactctgtattttttgggtcacagattcctggcctatctgtgtgttttttagagaaagttggggacagaggatggaggtttgaatagctcatcagttgtatacttctagtctcagcatcagaattcactgacgcacgttcagcaggtaaaaaaaaaatgttgctttttcagctcattaaacaaggactcaagtgtctttattaaaaaaaaatattgcaagtacagggccaaaaactgcttgccttgttacagagggtcaaatgatgtttcatggggaacatgctagtaggcttgcattcttactggaaaagagacgggggttgattatttttaggtaatttattctgaaaacacaacctgttgagagagaagatgagaatgccattggaaggttatcctcaacatgcaagcaaaacaaaaataataaaaaaatcattagcaaagatgacaacactagaccaagcagtgaccacacagtacatatttggttgtgtttcaagccttatttgggtagaggaaaaaaaaaaaaaaccaatgaagaaatataggccaatgtaagactctgttgacacagagaatggcagcatctgaggttgaaaggacgtatgcctgtatcgcccctaattatagaacatcatcagtgcttcttatttccctcaagactcaggcttgcccccggcactatgttcaatggtcacttaatggtctagaaacatggttgagaaaaaacatattaacagcaatccagtcaccagagcacctggattttctcctaccttcttttattctttcgtgttctggtacagtcttgccttgtgtatatcaatgtatgtttgtatttattgtgtcattgcatttgataggatttttcaaattgaaagcctcagagcttacgtaggatttgtgaggcattttactaagaaagttgggctgcaagtattttaaatgttattgagtttattttcaaattttaagactgactgagttcataatgtctgaaacggactcctttctattcattgatctccagagaagaaaataacaatcaatactttgtttttaacttttattttaagttcaagggtacatgtgtaggtttgttacataggaaaacttacgtcatgagggtttgttgcacagattatttcatcacccaggtattaagcctagtacccattagttgtttttcctgatcctctccctcctcccacccttcaccctcaagtaggcccccgtgtgtgtcgttcccctctatgtgtccatgtgttctcatcatttagctcccacttataagtgagaccattccagccaatgctttttgagtgcttactatgtgcttacattttgctgagtgctttatgtttattcattcagttttcacaagtatcttatgaacttgttatgatcattgtcaccattttacagataagaaaactgaaatatagagtgatggagtaatttgtgcaggtcacgtcaataagaagtaggggagccaggacttgaattcaggcagtctggctccaaagtctctcaccaaacgatcatatcagttctcacgttcacactgcacctgggcatttatttgtttcttgtacaaactagaaagtgtcacctacttgaagagacaaatgtctcccataatgtggacacatcaggacacgagaactgcatgctcataggcaacatgctcataggtatctcctcactgggaacgtctgctgtgtgcaggaaaatggttccagagtagaagtcccactcctggtctatcagggtggcctccaaatatattaaaagcacaacaatttctgcggcttctgccactctcaccctggtccaagccaccgccatcaggggttgatgtaatggcccctgaaatgcttctaccagtaccctctcctgtcatcagcagggcagctggatcacatgtctacttgttccactcagaacaaaagacaaagtctttccaagagcctgtgtgatctgtgtccctccttcccatcacttctttactcctcaccaccctgcctgcaaccccacatccttatctgcgccactagccttcagattgttcctgggcaggttcacgtcaggcacgttatgcctcaggacctttgtgcttcatggtccctgtgttggaagtgctccccccgaaacgtttcctgttccctgctgatcattacagcaccttcacccacccactccacccactcagctctctatccttcctccctgccttatttttctccctagtgtttataatgactggctcttccatctattttactaatgtgttagtttcttctttgtcgctgaacactagcgtgaacactttcttttttgtctgctttctttcccagtgcaatcccagaaatgagaatccagtgggcgttttacgaattgactaaatgaacaaatgagtgcattgtggagttgttttggagaattaagtaaactagcatatggaaagcatttggaacaaacaatgcttagcatgaaattaatgtttaataaatgtcaggtatcaataaaagaataacataatagttattgaatgaatgatgcattagatactattacttgttcctgtggtaggaagagggtaatcaagctccagaagttttaagtatgttaacgtacatttacaatggttgctagaggagataatcagggacatcatttgtgtcctcttttcctattgtctggagggcgtactataatccatccttctctaggcaagagagtggctctcaaacttcattggacttgggaatcacctgcagagttttaaaaaattgatcctggttcccatcccagatattctgatatggttagtccggagtgtaactcgggcattaggagttttgaaatgctccctgagtgattctaatgtgcagcaaagtttgggaatcactgccttaagcttttcacagagctaacagcagcagaaggaaaagccttcctcagtccctctctatgcttggaaccgagagttgcaccaacctcggttctaaaacacgtgtgaccattagcaagtcacctagcttcagcaagctttaccttcctcaattttatgtctgctgtggaaaatggtgaaaactcagaattcagggccaggttccaaaaatgtgaattttccttcttccctctctcccttcctttcattcttccttcctccctcccttcttttcttctttctgtcccctctttcatctggaggtaaaaggacagaattgttttcagatgtggctcaaaaatggcttgctctgaaatggtgctttcttacagaggggaccagagaaccaaagtgtccaccatgcctagctggccccattcttccccaggcatacccagccatgcctgtttcagcttcaggagggatcaatgtctgaaggtcaagttcccacccattggggtccactgtgggagtatcagaggtcctactagtgtcctgggttccagccctggcctccccacttcttccctgtgtcttagtgcctcccagcctggggccttgtctgaggctcctaccctggtcactggggctcacactgcattggttttgctggctcactcagggtctggaattctgtcctctgacacccaggcctctccgtctgatctcctgcccacctgagttctgcccacctctcttcatccatcccaagcatataccatatcatggtagctgcgtctaatctctgggtcccgaaaaacacctgcacccaccctatagtgccaccaatctcagcctggacttttctattaatagaatggtggtgagacactggggatagcacaatactggggccagcatcacgggtgtgtgacccattcagtgacacaggaccctgggctgggtttcatgttctgctgtcttgaaattagtcatgtttgaatgagaggctccacattttcattttgcactgtttctgcaaattatctaatgtgccccacacttcaaatcagaagacctggtatggattgcacctggcttacacctgagaaaagcgtgaccttggccaagttatttttcctatcttggcatttgcaaagaaggaatgagtggggtaaaactgtctccatcgtaggggaattttaagaatgaaataaggtaacagatgagtgttagcacatggtgcacaacatgttagttctcaactaacacttctctttttcctactgttccacctcccaagaagctaagtcgaaaagacacttcctttctgtttaaaatggattttaaatgtttgttttcctagatagtgatatatacctaaaggaaagatcttaggagttgtcattgatcttacctcattcttattaattatgcagaaagacaacaggattccttctttgctatctttctttattacattgaacaatatgttgtccagatggcatatagagtagcatcttccaagatatttttaaatgatcttcttttacttattgaagaagattacagggagagaaatttgaattaaacccgtgtcattgaaataatcttagcttacattacattaaggagatttctattattcagactaataacttttccccaaaagaaggctgccttgaacaatgtgcatgagtgaagacttcatcaagagtcatgggagtgagtctttggcccaaccctctggcataccagccatgggcccttagtgacaataaactagtattttgatctcagttttcttattggtaaaatccacaaaataataccagttctgccctctcattctcaatttgtgtatcaaattaggtatttgtggaagtattttgaaaatttttgaatgctatacaaattttgagttgggattattgataagacttctgaagtttaggtgttaatgaaaagattcatttgaaccacttgaaaatctttccggagaacaaatgccaagagttaagttctcaacttctttggaaatggagatgtgtttgacaacaggatagtgtgtcaccaccaaaataatccacttcaattttactgcggccagaagccataggtattaccttctaaatgtctgaaaccctctgaggctgtttctaagcatatcagttataacttaacagcttttcacaaagaaatctctttttctctacttattaattcaagtactaattgagaatgtactatgtgccagatacagttctaggcacctgagataaatcagtgaataaaaccaagttccttgccctcatagagtgtatgttccagtgtatagagcaaaacaacaaaaataaccataaaattaagtatactgttgacccttgaacaacatggggcttggggcgccaaccccacatgcagtcaaaaatccacgtataactttggatgccctcaaaactcaattactgatagcatactgttgaccagaagtcttaccaataacataacagttgattaacatatattttgtatgttatatgcattatactcatatactgtattcttacaataaagttagagaaaacaaaatgttattaagaaagtcatagggaagagaaaatatatttattaatcattaagtagaagtagatcatcataaagttctccatcctcattgtctttacattgagtaagttaagaaggggaaggaacaacaggggatggtcttgctgtctcaggggtggcagaggaggaagaaaatctatgtataagtggacctgtgcagttcaaacctgtgttgttcaagagccaactgcattctacagcacgttagcatgtgattagtgctgtggggaacaaagaagtagaagggcataaaggggatcaggcatgttggggagcagggttgcatttttaaaatgtatggccaggacagtcctcttcaaggtcatatgtgagcacaagcttgagcgaggtgaggctgggccatatgcatatctgcaggataggcattccaggttcgaggaacagccaatgcaaaagcctgaagcaaaactggcccaagtaggccacgaaagaagcatgactatgggtctccccagatctttctcactctctaccaaaaaacaggttttgaaattaaagagaatatgattgccaggccaatgcctaagacatacattgatgccttgtttctcttgtatgtgctttctccacagtcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtaagcacccaatcccagttcttggtttcctgggaatgtctgccacactctgccagaataactactgttcagtttcataagtgtccaggctgtgaaagctggatatgtttttccaaaacctggatagagtcacttcaccagaggaacagaaatgcttcctcaaactaggttttaaactgccaaatccatcattatcaccagactcaggaaaatactgagccatcatctataaccatggaaatgaatcacttcttaacttatgaatgcagacaagaagaggcaggccctgtactgtattacagtaagcccatgatgaattccttagtgaaaaaaaggaggaagtggttacagtaggatttagtcataggggtagttggattatttcacaagtatgcactcccctcccttctcattagaggcaaaataaagggaaaaccatactccattgctgttgggctggatcaggtgattgacaatggccaacggcatattagcaaagatgacataagcaaaggcttgagacgtgcttgtgcaattgagcttgtttcctgagcttctgccatggctataagaagagagtttttggctgggtgcagtggctcacgccataatcccagcactttgagaggccaaggctggtgggtcacttgaagccaggagtttgagaccagcctggccaacatggcaaaaccccatctctactaaaaagacaaaaaattagccaggtgtggtggcgcttgcctgaagtcccagctactcgggagactgaggcatgagaatcgcttgaacccaggagggagaggttgcagtgagctgagattgtgctactgcactccagcctgggcaacagagtgagaccctgtctcaaaaaaaaaaaaaaagagttttccccaggtagctgtgatctcttccatatgagccccataatgaacacacgaggcagcaagcctgcagtggggagccaagtacagcctcatctgcagtttggtacacaactgtccagctaagcctagctgaaatcagccagcctgtggttatcctaaagacccataagcatgagaagaaatgatcattggtcacctgttgagcttgggggtgatttgttatccagcagatgctgactaatacagtatatgtcaaatctttaaaattctacaatatgattagataattaatgtactttccctcaatcttcgtattacagtatacagatgttccgctgtcaacacagctgaatacagtggactatgatgcaatcgcctgaagtgggctgcctttacctttccagaaacaatgtgcttttattatttatttattatatatgtatttatatgcttactgtaatggactcatattggatttattttcagaaaaaaaggggaattatcttccatgccctttcttcataggattttgcaaatcagtaacaggattcagcagtaaagtactacacttaggagcacagactctggcatcagactgcctgaatctgactcctacctctgcccctttttagactttttagcttccatgttaaattccctgcatttcagtttgatgtaacttctctacatcttctgtataatggggatcagagtagtatctaccttgtagggctatggaaaggatgcaataaattagaagagtgccaggcacatcctggtcattccatagatgtttacttttattgttattgttatttaactctaaaatgtttggccagttgagtgtctcaattaagggaaacgaaactcaagtagcgtcctggtatagattttaaaatttggtttcatttttcgtttttcattattttgacataatatgccccagggcaagcaccacaaataattaaccactttagacttgtgctatctgctaaacttttttatttcattaaatgtagatcatattttagttctctgtgtaagattgttgagctcgacacaattgagaattctcaaaacagatctgttgcttcttatgataacatgctttgtaaaaaaaaaaaatagaaacaatgtagatagtatagaggagaaagtaaaaaaaaaaatcacctaaattcctactaccaagatatagccattattgatgtagacagcaataatatgtatagtagatataattccgtgcatacacaaacacacatatgtaatacatatgagatcatatattttacacatacataatacatatatatagatgtatgtatgtatatgcagacacattttttcctaaatggaataatatttggcatgctgttttataatattgggataatctaacatctctgattatgagattctccgaagtatgtgtcttcccaggagctgaatgaagattcaagtcttattttttattttttggtatcatctcactgtttctacaacctctctccttcctggccctcaattctccttagcttcaaagacactaatacctactcttacacaattttgagaagagtagaaaaaaggtaaaaacaaaggtcaaagagtactatttccagttattgttatgagtgaaaacattggtcaaacaagctgtgtctatcataaaaatgactctacagaagtcccaagtgatttcagtgcgtgactagattttctgtagtaggcaatccagacttcaaagtaaaggccatgagacagttctcttgaagtgtgccactgttttgtattttggatgggacagtgtgtctcttctccagaattcttgattaaagttgcttgattagacaagaatagtttcatttgatcaaaaagcatgggtcaaatataagagtatgttaatctgagagtggttttcttattagaatagttaacattcgtccttcagttactttgaaagtttttctgtatttgatcagcgtttgattgctacccatttgtttgactgaatttgagtgattacttgcacataatacttataataagtttcccaagtggtttttctgagttccttatgtgtgcaaacactgaatcccacatctgtaaaatgaatattttgtatcagtaatataaggacatgttaagtttctcctactctcttacttcccggaaggaagacaaatttatgctacagcttgaatgacacatatgcctcgtatctgggtgggtagagaacaactgaattactttcagttccatgttctgggtatgaagtgttcatttcaattactaaatgaagtaatagcaataatatttgaaagatagcgtttcagctgcaactatcacccagagtcagacctgtggaaatatagttaaaattatagtaccatatgctaccgtatcaatatttgggaggtaattgcacatgtctagagcttaattcaggtaattgtttttatatcttacttaaatatagatgtatgcttcactcagatgtggttttaagtttatgtgtcaagaaacctggcagtgactaggttctgaattataggaacaaattcaaaagggacattcaccattctgaacttggaagagtccaagctaagatctagtccgtccttcaagtcaattctttaacctgtgtaagcctcaattatctcattatatggaaggcattatagtattcagtgaagttactaggccaagaatttaacccattgcctggtgcataataaatgctgaacaaatattagtttcctactcccttcttggaaacaacggaaagagaaaagggccaggcacagtggctcaagcctgtaatcccagcattttgggaggctgaggtgggaggattgcttgagcccaggattttgagaccagcctgggcaacacagtgagatcttgtctctacaaaaagtaaacagggccgggtgtaggggctcacgcctgtaatcccagcactttgggaggctgaggcgggtggatcacgaggtcaggagatcgaaaccatcctggctaacacggtgaaaccccgtctctactaaaaatacaaaaaattagctgggcatggtggcgggcgcctgtagtcccagcttctggggaggctgaggcaggagaatggcatcaacccgggaggcagagcttgcagtgagccgagatcgtgccactgcactccagcctgggcgacagagcaagactccatctcaaaataaataaataaacaaacaaacaaacaaaattagccgggtgagtggtgtgtgcccatggtcccagctactcagcaggctgaggtgggagggttgctggagggatgcacatggagctgtgagggaggaaggggacacctgcctagccagccagatcagctgaatcaaccctggcgatcaatggggcaacagatgacacagccagatcaccttcacatccgaacacccttttactgagatatcttacgattccccacagtatgctgtctccctacttgtaataagtacataaatgcacctttgtttgaatccagctgtgccgaattgttgcagctttggccacagggtatcaacacaactgattggctacctgttgagagaatagctccttctaggggcctcaccacacacacacacacacaatatggcctgttgaccagcagcatcagcagcacctgggagcttgtgagaactgcattatctcaccccgcacccccgcatggtaacaagatccccaggtgattcaccataaagtgtgagaagcactgctagactgagtctcgaccttgcttgcaaagttttagaaaaatgtggatgcctgggtcccatcccgaaagattctgatttaactggtcagggtaaagcctgggcctcagaattgtccaaagaacacccaagtgtggttgggtttcggttttgctgatagcaccatttgctcacagtgaatcatgatcaggagaggaggcttgggataggttgctaatggtcttctcacctgtgcttcattctatttgtctccaggtggcccctctgaaggcaagctgatcccgggagatcagattgtaatgattaatgatgaaccggtcagcgctgcacccagagagcgggtcatcgatctggtcaggtgagtgactcattcacctgtgtcctgttctgctttgaaggctgctgcacagctctgaggtctcaattagcagaggaagagcctcctgtgggacaatttaggatggaaatgcaagccaacacatacacatggttgaaaatgctgctgacactgacctgtaatatcaaaacacatactccataaacacaaaactcctaattgtccactctctgttaacattgaaggtacatatgcctcagtttaaaatttttatgactcctatatccaaaggttcattttttccttccagaattactaacacattgatttttcataatcagggagatcaaaacacaatacctgaattcagcacaaagtgatgagtaattttatatacataatcccatggatatacaaacatacagttcactgatacttcatatttgactaagtgcttcattactgaaatttgagattatcaactgtggcaataggataattaggtcaaagctaagagtttacaaaatacaagtggtttattggtttagttttattgtaaatataagtagtttgttatgtgatattcttaatggggcaccagaaaatgtattttatgttatgttaaaaaatattggtcaagaatccctttagaagcccactggagttatacctccttagtgaatttaagggaaaagagttctttagaagttttttaaatgaagaagctgggcctatcatatgaatggatccattcattctatgggagtgttgaggaataaggagacatgacatttgtcttttataaactcatattttcaaccaagattgaagccaaagctgaggttatcagaacacttttcactgaagaggggatttcctaacatttatgctcactcattacggaaagtgttaggttggtgcaacagtaattgctgtttttgccattgaaagtaatggcaaaaacttcaattacttttgcaccaacctaatacatctgtactttgggaaaggcactaagtggagtatttctggggtctttcagagaaagtttctttctcaagcctagttcagcttttgcttcacaaagaggttctggagggtcaagcactcttggaagaactgggagaggagcaaaaagagaaatagaaagagaaggcacttaagagtaagcaaccatcctagttttagcatgtaaaaggcccatgtcccagggaaactctggaatggttggtcactgctatggtctgaatgttagtgccccctcaaaattgttatgttggaacctgatacccagtgtgattgtattaataggtggggcctttagggaagtgattaagtcatgaggtctctgcatcgtgaatgggattagtatccttataaaaagttgaagagaattgccttgctccttctcccatgtaaagacacagtgacaaagtactgtctttgaggaatgtggcctttaccaaacaccaaatctactggaagatcttggacttcactgcctccagaactgtgagaaataaatttcaattattcacaaattacccagtctaaggtactttgttgtagcagctcaaacagactaagacagtcactctacttcagtctgggcttaatggagtcttcccagatggctagaaaagtcatacttgtactcctggggcatccagatctccaaggaatggtcttacacaggagcagacactgagacttgtgtcatattcactatgcatcgggaacaagacctgagaatgtctccaatctttctatggacaaggggagccagaatatagaaagactctgtatgtaagagcccttgggaaggagctgcagtgttcatctggaataacttctctcttgagatgtgtgtgggtgtcagcaggggcataccttatctaggcaggctctgagccttctatcggcttgcatcctggaatgccatgtttgggcttgatggcagaagttgcatggatgttttgttttcccctaggtgcgcacctctgtgattagtcctattgatttttgtgcctggaggatgatagaagaaataaaatatctgtgtttaggttggctgtgacttaattgcctgctgcagggcagtgacagagaaaaacctatctgaaagtgtgatcacttcctagcagttgttccagggacttttagaaagattatttccaagaaagatattttatttctggtttaacgcttgtagaagaaaatggcatatctgtaaaaaaagcgctctctatagaactttacatataacaaaatgaaccagttaaaagagaggatggcaaacagctccaagttcaaatccagcctgccacgtgtttttgtaaagtccatcagctaagaaaggtaggtttttttatacgattttttaaaagttgaaaaaatatattttgtgacacatggaaatcatataaaattcagattttagtatccataaatattttgctgggtatagccatgtttgctcatttgcattttatctatgtctgctttcctgctacaataacagagttgagtagttgcaacagaaactgtctggctcacaaccttttcactcttactaaaccacaatgttaaaataatgtatgtctcactaatgaaaatgatcacacattacaaaatattcctgtgccttcccataagtttagtcatctgtctgccataatgtgtactaacctaaacacttagctcttgtaaaataatcccctttttactgggctcctcagctgatatatgttttaaggtctatatcttacacaagataaattccctttctgtataataaaaaacatcccgttttcttagccactaaggaaatttggaaaaacactcatcattttgataacactgtaaaattctctctttaaaaattggcatccatttgctggctttagtggtgtagtcttgttttgttccttttcccccattgcagcatgtgttcatggatcattttttgttcccagatccatttgtgtttcttggtggattatttttcttatcatttagttactctattatggaaaattatttttttcttgagaaaatgaaagagttttgcagagaccaatttactgctatactaacaacattttggttttttcatgtagtctcaaaaagctataattgctgcactgaaattagatgaattctgttcacttcatagtcttctaagttgttaactctaactcagactgtataatggtgtttgaggactaaaatctttgaagaatccatgccctttacaaattaccatatctttcttctttaaaagtatctaaggataattttcttttcacaattagactaattaactgaaagcagtctccaaaattttatttttaaaaagtaaggagtattattgcccatagaaacattatgaattgtgccttgccttcccactcccacggctagccagcccaattaaattcatttgacttcaacaaagaattattgaggattaacagacatcatataaggcactgagcatgtatagatacgtaggcatgattcttgccctcaaggagaagaattctaattaatttccatatatttatgactggacaatgctgttggcgagggtagtatttggtaggaatgtttggtggagatggatggtgtattaagggatattattgatgctggtaaagagtagccatcaacgcgaagtggaagggcaggtttatgcatgagaagggagttgtaaagtagatctttcctttgaccctagaaaccccagaccttcttgatggacactcactttccaacctgcagatattgaaaaaaaaaccattgcctaggtggctgtcccgaatcacaacctcaaaatttggtccttcaaggcagcaacataaatctactaactcctgttagaatgggtgcactagattttttggattagagatgcaactgggaacctgataaatgccatagacttttccctccatccagagaaacccacgtgtatacaaagttctgcatacaatattagaatggtttttgactccctaaagttagtcccagttttagagccggggcagcagactctaagaatgctgtctctcttcctccccttctcccccttcctcagtaccagatgctaacattgaagagtcaagcttataaacaacttgctcttatccttttctatcaaagcagttgaagtggaaaattgcccatcccataataagaaggtacactggtcaaactggagactaattcccctttctcccaacatctgtaatagggcagctaactatccctccatctgcccttctcccactatttatgttgattattcctactaatctaattgatgagcagtgttatagttatggctatttatctacagagggttgctcacatctgtcagacatgtcaccccttctatactaataccctgggaattggagagctttcctgggtagcggtagtgttctttcaataagaaagtaactgtaataagaaataagaataaatgataggggagtgacattaacaaggtggcaaaatgaggtcccccactggtatcccccatagcaactataatttggcagccacctatggacaaaagtggctttgtgggagttttggaatccaagtaggtcactaaaccctggtggagcccaagactgaggagggccattttgagaaggcagacccacccaggccttggtggcagactcactgactatgatcccaaatacagacccagaaacaaccacatccccccgtggagttggctacagccctgtttggccttagtcctaccactggcattatccatcaagggacccgggaagagtcatacctaccttggccttgggtaacagatctgctgaccttggccccagttgtggaccctagagtggcttgtgaccaagctccagcctctctcagccattgtctgcgagcagtcccacctgtcctgggacctgctgggaaataggccagttcatacccccagaggtaggcctaatgaacttagttccacagattttgaaacagccccataattcagctccagcctctctcagccataatctaggagcagtcgtgcccacccagggacaccctgtgtcccctcaggcaggcctactgacctccatctgaatgtggatcctgaagtggccccataacctggccctagctcctctcagccatggtcagggagacaggcttctctgtgccctagaggcagacttgccaaccttgatccaactgcagatcctgaaacagccctgaaactcaattccagccactctcatctggtattcaggagcagtcctgattccccgactccacctagggacctgttgagtgacatgcccatttgtgccaccacaggcaggcctgctagccttggtccaactacagatcttaaagcaacactgtgatccagctccagccctgcacagccacagtccttcccacccaggaaaccacgaggaagcatgtccatctgtgtccccagaagcaggcctgcggatcttgatcttgactgtggaccctgaagtagccctatgactcatttccagcccctctcaaccacagtccaggaccagttatgcttactcagaaacctacccaatggtccagcaataaccctcccagggatcaggtggaagctacaatgatctgtgtacctagtaacaggccgatgatctgtggaaccttgtcccagcatcagcccaattaatgaagatcctagaagcattccagtccactcaggaatgagataggatccatgctctcccaaggctctggaaataggcctaccccccattgcaagaccccattgcagatctagcagtagtcacatgatctagctctactgtaattgcagaggcaatctcatcagtcaacaagagaaggtctttacctgctgaaaccagtctataaagaccagtctgtaaaaactggaaatctagcagaccccattgcaaatacagcagtagtcacatgatctggctccactacaattgcagaggcaatctcataaatcaacaagataaggtatttactagctgaaaccagtctataaagaccagcctataaagactggaagagggccgggtgcagtgactcaagtttgtaatcccagtactttgggaggccgaggtgggtggatcacttgaggttaggagtttgagatcagcctggtcaacatggtgacatccagtctctactaaaaatacaaaaagaaaaaaaaatagcctgctgtggtggtgtgtgactgtagtcccagctacgccggaggctgagatgggaggatcgcttgaacccaggaggcagaggttgcaatgagccacgatcacaccagtggactccagcctgggcaacagagcaagactctgtctaaaaaaaagaaaacaaaacaaacaaacaaaaaaaacgactgaaagagatgtttgccctctcaaatgcacagataccaactcaaggctacatgaatcacgaagaatcaagcaaacatgacaccacaaaaggaaactattaaggcttcaataagcagcccctaagatatatcatttgagatatataaattacatgaaaaataatacaaaataatcaccttaatgaagctcagtgggatacaagagaacacagaccaccaagaaaaacaaaaagcaatacataaacaaaataaaaagtttaataaagaaatacaggtcaggcgtggtgattcacatttgtaattccagcactttgggaggccaaggcaggcagatggctttgagcccaaaagttcaagactagcctgggcaacatggcaaaaccccatctctacaaaaattagccagatgtggtggcccgaatctgtagtcccagcaacttgggaggctgaggtgggaggatgacttgagcccaggaggcagaggtttcagtgagccaagatcacaccactgcactgtagcctgggcaacatagccagaccctgtttcaaaaaaagaaaagaaaagaaaggaaaaaggaaaggaagtaataaggaaaggaaaaaggaaaggaagggaagggaagtgaagggaagggaagtgaagggaagggaaaggaagggagaaagaaagaaagaaagagagagagagagaaagaaagaaagagaaagaaagaaagaaagaaagaaagaaagaaagaaagaaagaaagaaaggaaggaaggaaggaaggaaggaaggaaggaaggaaggaaggaaagaaggaaagaaagaaggaaagaagaagaaaagaggagaagagaggagaggaaaggagaggagaggagaggagaggtgaactataaaaagaaccaaacagaaatcctggagctaaagaatacaatgacaaaactaaacattttaatagcttcaacagcagactcaattatgcagaagaatcagcaaatgtgaagacaggctatttgaaattacccagttagaggaacagaaagtaaaaagaataaaaaagagtaaaggaagcatacaggtcctatgagataccatcaattgaatgaatatatgcattatgggaatattagaaggagaaaaggaaaaaaggggaaaaagcttatttaaagaaataatggctgaaacgtcctaaatcttggaagggatatggacatccagatttatacaaatcaaagggtctcaagcagaatcaatccaaagactactctaagacacattataaccaaatttttaaaagccaaacacagacatagaatattgcccctaagagatatcatttgagatatataaattacatgaaaaataatacaaaataatcaccttaatgaagctcagtgggatacaagagaacacagaccaccaagaaaaacaaaaagcaatacataaacaaaataaaaagtttaataaagaaatacaggtcaggcgtggtgattcacatttgtaattccagcactttgggaggccaaggcaggcagatggctttgagcccaaaagttcaagactagcctgggcaacatggcaaaaccccatctctacaaaaattagccagatgtggtggcccgaatctgtagtcccagcaacttgggaggctgaggtgggaggatgacttgagcccaggaggcagaggtttcagtgagccaagatcacaccactgcactgtagcctgggcaacatagccagaccctgtttcaaaaaaagaaaagaaaagaaaggaaaaaggaaaggaagtaataaggaaaggaaaaaggaaaggaagggaagggaagtgaagggaagggaagtgaagggaagggaaaggaagggaggaagaaagaaagaaagagagagagagagaaagaaagaaagagaaagaaagaaagaaagaaagaaagaaagaaagaaagaaagaaagaaaggaaggaaggaaggaaggaaggaaggaaggaaggaaggaaagaaggaaagaaagaaggaaagaagaagaaaagaggagaagagaggagaggaaaggagaggagaggagaggagaggtgaactataaaaagaaccaaacagaaatcctggagctaaagaatacaatgacaaaactaaacattttaatagcttcaacagcagactcaattatgcagaagaatcagcaaatgtgaagacaggctatttgaaattacccagttagaggaacagaaagtaaaaagaataaaaaagagtaaaggaagcatacaggtcctatgagataccatcaattgaatgaatatatgcattatgggaatattagaaggagaaaaggaaaaaaggggaaaaagcttatttaaagaaataatggctgaaacgtcctaaatcttggaagggatatggacatccagatttatacaaatcaaagggtctcaagcagaatcaatccaaagactactctaagacacattataaccaaatttttaaaagccaaacacagacatagaatattgaaagcagcaagagaaaagcaacttgtcacatgcaagaaaacccttataaaactatcagtggattgctcatcagaaaccttgcaggccaggaatggatgatatattcaaaatgctaggaagaaccgccaaccaagaatacttagccaggggcagtgacacccacctgtagtctcagctatttgggaggctgaggctagaggatcacttgaacccaggagtttaagaccagcctgggcaacacagtgcgatcccatctcaaaaagagaatactatacacaacaaagctgtccttcagaaatgaaagagacggaaagatattcctagacaaaagctgagggagttcattgccagtatatctgccttagaagaaatgctacagtgagttcttcaggttgaaatgaaaggatgctaagtaactacctgaaaacatgaaagtataaatctcactggtaagggaactacatagttaaattcagagtactctaatactgtaatggtagtgtataaatcacttttaactacagtatgaaagtcgaaagacaaaagtattaaaaaataactacagctacaacttgttaatgaaaatacaacatgtaaagtattacatcaataacatataatttgggggcagggagagttagacgtgtagagttttgtatacaattgaaattaggttgttatcagcttaaaattaactattataactataaggtgttttatgtaggcctcatggtaaccacaaagaaaaaactattagtagatacacaaaagataaggagaaaggaatcaaagtatatcattacaaaatattaacaaatcacagaagaatacagcaagagaggaatgaagtgacaaaggcactacaaaacagcctgaaaacaattaacaaaataataatagtcaaacaatagttagtttgttcaatagttagtttgacaatactccaacctttgtataataggaatcgcagaaggagaagaaagagaaaaggggccagaaagtatatctttaaaaataatggctgacaaatgagattacatcaagctaacatcttctgcacagcaaaggaaacaatcaacaaggtaaaaagacaactcataggatgggagaaaatatttgcaaactattcatctgacaagggattaataataataatatataaggaacacaaacagctcaataggaaaaaaaagaataatccaattaaaagtgggcaaaagatctgaatagacatttatcaaaagaaggcatagaaatgaccaacaggtatataaaaaatgctcaacatcactaatcaccagagaaatacaaatcagaaccacagtgagatgtcatctcaccacagttaaaatggcttttattaaaagacaggcaataacaaatgctggagaggatgttgagaaaggggaaccctcataccatcactgttggtgggaatgtaaattagtacagctactagggaacacaatatggaggttcctcaaaaaactaaaaatagaactaccatattatccagcaatatcactactagatacatattcaaaataaaggaaatcaatctatcaaagagatatctgcactctcgtgtttattgcagcactattcacaatagccaaaatatggaatcaacctaagtgttcatcaatggatgaatggataaagaaaatgaatgtagtatatatacacggtagaatattatccagcaataaaaaaaaatcctttatttgcagcaacatggatgaaactccagttcattatgttaagtgaaataagccagacacagaaaaacaaatattgcatgtttttattaatatgtgggagctaaaaaactggatatcaggaagatggagagtacattgatagttaccagtggctgagaagggtgcagggaagggagggataaagagaagttgattaatgggtacaaaaatacagttagatgaataaataagacctagtgttttatagatcagcagaatgactacagttaacagtaatctattgtatatttcaaaatagctaaaagagaattactcaagtgttcccagtataaagaaaagttaaatgtttaagatgacagatatcccaattaccctgatttgatcattacacattatacgaatatatcaaaatattacatgcacccccaaaatacacacatctcttatgtatcaataaaaaaagtttattaaaaaataataatagtggaaaacttttctaatctggggatagatagcaacacttagatacagggagcgtatggatttccaaatcaaatttaatccaaaggctgggcatggtgactcacacctgtaatcctagcatttttgggaggccaaagtgggaggatcacttgaggccaagagtttaagaccagcctggtcaacatagtgagacctggtctctacaaaaaaattttaaaaattagccaggcatggtggtacacacctgtagttccagctactcgagaggctgaggcaggagaatcacttgagcccaggagttgaggctgcagtgagctatgatggcaccactgcacagcctgggtgacaaagtgagatcctgtctcaaaaaaaaaaaaaaatcaatccaaagaggagtacaccaagacatatattaatcaaactaccaaaaatcaaagacaaagaaaaaattctgaaagcagcaagaaactagaaacacaccatattaaaaggagagccaatacaactatcagcagatttctcagcagaaaccctacaaaccaggacctagtggtccaaagtgggccaagtctaaccatgtggcacattaagtttttcttacttggggggcccagcaaatgacagagctgtaactggcctttagaacctgagtcttatcttgtatgccccatagacacactcccttttttggattatacacaagtagtctgtctcctatcccaggactgctaagcagttgccttgattttagtagggagttgtcaggagtacctgcttattgcagtcgatgggagattggcaagactattcagagcaaaataggccatttagaagggatccatccaaaaattagatcctagcacacctgtcttttcatcagtcccacctcatcagaattataatggaaagtcaaatcagatcatgttccaggggcattctgtctgcagaagagtatattagaaaggtcatcttcctgcctaatgttagatggacttaggtgcaccatgatgctgcttagtaaaataacaaagcagggccgggcatggtggctcacgcctgtaatcccagcactttgggaggccaaggcaggcagatcatctgaggtcaggagttccagaccagcctggccaacatagtgaaaccctttctctactaaaaatacaaaaattagccgggcatggtggcgcatgcctgtagtcccagctactcaggaggctgaggcaggagaatcgcttgaacctgagaggtggaggttttagtgagccgagatcacgccattgcactccagcttgggcgacagagacttcatctcaaaaaataataagaataataataacaacaaagcaaagaacatctgccaagtatctgacacataaaatatgcacaatgatgtgtaatataataaggccttattaagaccagcaagcaactccagtgaaaacacaaaagaaacagctctatggtatgctgacactacaaattgtaatctcacctcatacacacttgcagcatacacgttttctgataattgcaaattacagagcctgaggagaaagaggttggtgattctagaaaatggaaagtgtgggaaaacattataacaaggctgaagtagaaaaagggatttgggagcatagttcataaaagctataatgatatataatgacggaaattaataagaaaaatgacttcacccagattatcttaatgtccttagattttgttaatgaccatgtcccacttacttattaagtctcttcactactctagatgcttttatgcaactcatgtatggaaaatgaatgttaaagattgaagaatcagaataaattttaaattagggcatgttttcaatgatctcatatggttgacactactgaatgtcttaacatcttactttattaagaaaaaaatggaaggagataattattgaaccagtgccatgttctgttcttcctttggaactacaaatttgcaagtgattgcctgccttttctataagtagatgaaaagacaaaaaaaaatcattttggtgaggctgtgtattttccctgtggtcagaacatgcccagaaccaaagtataaaccttattgcctagagagaacggagagctgtaggagcttacagcgaaatctatttttacaggtaacacagtgggtgggtgtggtgggcaagaatctcaggccacacactcagatgtgagagaagtgtaacattatctatatattatctataataatctaatatttatttcaaatccctattccagtgtatgatcagttcatcctgttttccttagagctgagtcgacctgtagagggttgttttaatgagaggaggcattgggagatgtgaagtttacccactcctgggtcacatcatctgtcttaccagaacttgctgagatatatttgtacccatttggtctgtctttgactactcacctagaaaggaagccaacatgtcaccccttgttcaccattgtcaaccctcccttagccacttctctgtcatcttgcatgcacttgccactcctgagccattatgggacatagaatagcctctggggctaatttcctccagaatcttgtcaccttcccagggttctgactagaaaagaaggcacaggttgctgtgctctttaattcttcaaggctatctgggggttcccagttggttcttcctggagaatcagcttctgaaaagacagggagcatgcctgccctttcacaggcaactacaagtctggacccgttgcttgtcctgtagttcaccccattttccccatcctcagactaatccccattctggggaggactaagctttactctggtttatgtaataaccatctgtattagtccgtcttcacactcctaataaagccatacctgagactgggcagtttataaagaaaaagaggtttaatggcctcacagttccacatggctggggaagcctcacaatcatggcagaaggcaaaaggtacgtcttacatagtggcacaagggagaatgagagcaaagcaaaaggggaaacctcttataaaaccactcgatctcatgagacttatttagtaccacaagaaatgtatgggggaaactgccctcatgattcaattattttccagcaggtccctcccacaacacatgggaattatgggagctacagttcaagatgaaatttgggcggggacacagccaaaccatatcagcatcctagcttacagcttttaccctcagtttctaaaacctagatatttctttactttcttctgtaacaatcctttcctgaagtaatgagtgttatatgatctggctgaccaaatgggcaaagaaatagagctgctggaacagagtaaaggaatgaaaggtatgggggtgggagggaaactttggtgactatttcaaaatattgtcctgctgtgtgctacccagtgaaaagacataggggggtagaagtcagaaaaatctgagttcaagttctacctctgtaatgtattagctgtttgtgacttgcacaaggaacttaatttatataatcctcagtttcctcacctataacatgaagacctatcttatacaattgttggaagaattaaataaaacagagtaagtaaagctcttagcggagtaagagcacatagtcagctcttaatacatttgaattatcattgtcctcatcaaggttattaccagcggcatcactatagctgaatgatcatgagcaaattacttaagtctcagggtcttagtctcctagtctataaatgtggctaagaatttgtacttccaagcctttgtctcaggatggaatgagattatgtacatgaagcactttgtggcctgtagcaagttaggtcactgtgtcagatgctgtcattactgctctggaaattgcagggtaggagattggagcacaagcctgggtatccaatcaaaaccaaagagaggaatctgggtggaaattcaagactttcaggatgaagataacttgaaaagcagttaaaaagctctaagactcagggtttgtaaacatacctagactcagccttgcggcactgaaactgagagtttggcagtgaacttgactttggggacacataggtgtgcagcagtgtgacatggtgacaggaaccagagtgacttcactgttctgtcatatatgagtgaaggggatgtgaagaaattcaggggccactggcatgtgccctgcttgggtcgagattaggttaggaatgacccaaatcagggatgaacaaacttttcccttaaaaggcccagatagtaaatattttacgcattgcaggccataagggtctctgtcacaacttaattctgccattgtagtgcaaaagcagccatagatgatattaatacataaacaaattattatggctctattccaataaaatgttatttacagaaatggggatggggagagggcaaatttagcccacaggccttgtttgttgccctttgacctcaaccaatgaagcttaaagagaccaacctgaagataagagtgtatagaggaagagaaatgaagcagaggcttttagctagaaataataatgacaataaagcaaacattatgaactctgtagccacctaaaatccttttcagaaagtggacagataggaaaaataataagcaaacaaacaaatgataaacatcacagacttttgtgatggcttccatgaccctttgtaatccaccccccagggtggcttgcactcatatttttacccactgaaagggatttacaccttgcttataatctatacaacacaatgttgtcactatttgcaaacttgtctttctttgtcacaattctgtgtgtttcctaatgataatggccaatattagggtagctctatcttgtaaaaaacccaaaactatacagagtttccatcacaataggagtttgtcaatcacataaagtccgtaatgggtcctcctgattggtagacagctctccttcagagggtaatccggagaaacagcccagaccttcttcattttatggctcttaaatcttcaacacagagctcccagtttgtccttgtcaaactggcagaaggggaagatgatacaagggtgcatggaagggttttacaaaagaggtgtacagcgcttttcctccccttcctttggcaagaaaccagccatatagatggatctacctgcccaggaagctaagcatggtgtagctgtgcacccaggcagtgcagggagcagtttggctgagcatattgccagtctctgcacacattatgttttattaattatgttagccttcaggcctaccactgtactcagaatagaattggaaagaaagaagtgtttgccgaaagagccataaaagggaatttaatactacccacctttaaaaagattactataatttattattcttgtaaccaaatctaaattaattgatagacttttttatactttaagttctggggtacatgtgcagaatgtgcagctttgttacataggtatacatgtgccatggtggtgtgctacacccatcaacccatcacctgcattaggtatttctcctaatgctatccctcccctagccccccaccccacaacaggccccggtgtgtgatgttcccctccctgtgtccatgtgttctcattgttcaactcccacttatgagtgagaacatgcggtgtttggttttctgttcagcactgtacctgaagcaggttcattgctcatttcacgcttttccatatgcattgattttagccttgacctcatatttttcaaatgtctccatcacttcgtcagtgttgttaactatattatctccatctgcctcacttttactaacctctgggttctcaacctcttcatgtcaccttaggcttcattcatgaaatgaagtatttgctaaattgttcaaattactattctggaattaacctgcatttaaccttcccccatgctgcctaatccagtgtcagatcatatacccagcataatcagagccacatttatgcccaccaacctctaatttcacattaaactcaataacctgtatttcccctggggaaatgcagtgtttattgcccttttgtgtggagttatatttatgcattatgtgcatgatttacatgtgaacttgcagattaacagcctcctgtctcctgactgaaccagcatccaagctatgtagtctccctgcgtccccttcctgtccttaagatgcagagatgtggtagcttgaaagagacatgcatctgggagagacaagatcatggctttacaccagggatttcccaacttgaacctgtgacaccttcagggtcctcatccccgcaaaaggtttgaagggaagactataggcattctgtgagagaccattcttcattgtacaagtctgtccttcaatggaaggacatttaacttctgtgaccccatccactaatcctgatggtgatccccaatcattgagggatgcttccactccattgagaaccatcagagatgatcattataaaagctttacagcttaaatatactattaacagtagaagatgcacctcactgttttctcaagaggatacaattttcaaattcctgtagatgaatggttccccaatggtgggaatgttccaaaatggcagctcatttatgctattgttgagaagagaggaggtggtaatgaggcaagtccttatccctgttcccaagcaatggaacagggagcagggaggtagcaatgatcaagatctactctctccctaccaggaatccagataatgtactagcagagaccatcatgttcagaaatgaaatactaaggcagtagagtttagttataaatgggatcttcaaaagggtcttggcaggatgaggcagaaaaggattccttgaacaagaaagatacaaaaaaaggattttgtactcccttgccacccttttgctagcgtgttttttcatgcagtcagaagctgctgaaagaaacacttgaaccgaattttttctaaaaagagaaaaggaagcagccaccatttattaagccctcctctgggcagcatacaccaaatccttacacatctctgtgaggggcgtaattggactgattcgtagttgaggaaacaggattagacaagtgctgactgtgtacaggattctatactagtgagctctgtaatttgctgaaggtcagttgagcaatacttgatgaagccaggaggtaaacccagtgtctatctgtatatgtactttctcttaaaccatgctgccactctgggtgagaggaagtgaatagagggataacaaggtgagttttaggaaagaaactagtctcatctcttttcccagatgcagctcagggaaagaaaggccctagctatgatgttaaaggtccaagttgactttcaggaacccttaaacccccttccaggaatccttagacaatgtgtgggccagtcttcagtagctggtgtggattaaccaccagaggacccttttgaatggcgagagctgagtagcatcccctaaaaccttgtatgacctgggcgagggggaaaatgtcccaagacataactatgtttcccatcagcctgttgggcaggggctcagagtagagatacattatttagaaaaaataagaaatgagatatttcttacaactagtgttatggataaacattttgtacacacgacatagttttgtttggttttttaatgttagacaaaatacagaagcctggaaagtagtgccctttttcactctgaaatttgttttgattccacctacaaacataggagctcatgtctgtcaaatcagacttattccaataagacttcatttttatttcaacatcttcacttattcacatttgatgtagtttaaatcagtctttattatgtgcaccaagttatttaccaccgtgtagtagacaataaaaagcagtttaaaaaccacttgataacaacttaaagataaaatatagattcatttcttctatgtggtacatatgttagacagaaaggtacaaaaaatttataaatcttgtcattagacagaaacaattgtaatatattattattccaaataagatttcacttttgtatcaacctctttgctctttaaaaaaattttgagtatttcacacttaaacaactaaggcaaaatttcttaccaattctgggtcaaataataaaaagaacctggaaaacaaaagatttgttatttttcccccatgtaagaaattatcaccgttaaacatccttctgtctcttttagctccttgctgttgttctatttatatttttatgaacaaaatagtctatatgtctgtgtctaataaatgggatagctttgtgggctgagcattcttcatttttataagaagcatgtcagagctgaattgatcacatgctctgaaactctcccccagggtgttttcatttatatttaatgttaaatcaacgatattagaggtggaacaggctgtttgccattgaatgcaatcagcagtatcagctcactttgaattccataaatgccatttggaatgttctttttggtagagcacttcagggtatctgggtaacatgcagcttgataatttcaaaactgaataaccaaacacagtaacaaaggaaaccactcttaggatttataataaaaagtaccaaatttggagaaagcttctaaaagtgtgataaaaattttaaaaaccacacatttcttgccccttgaacgctacatgtattatttttcttaagcacagtgagctactggtttccattatttgacaaagtaatacaatatgtgagaggcccttaaaggtagccttcccctatagttttcttttctctatgaagtccatctctctttttttttttttttttttttttttttgagacagagtcttgctctgttgcccaggctggagtgcagtggcacaatctcggctcactgcaacctccacctccagggctcaagcgattcttctgcctcagcctcccgagtagctgggattacaggcacgtgccaccacgcctggctaattttcgtatttttagtagagatgggatttcaccatgttggccaagctggtctcgaactcctgaccttaggcaatcctcccgccctggcctcccaaagttctgggattacaggcgtgagccaccgcacctggccaaagtccatctccttgggctctcagatatacagtatgtcttaaaagtagcatagccgtaactagtaagagcctttcagatgaaagtgaaagaaacacaatgcaaaatggcttaaggaaaaaagtgaatttcctggctggcagaactcaaaagagtgtcgggtggagctggtgaggcacaagggaagtggggtgttgaggcctgatggtatcaggaatcctttgttctctgtctctgcccactttcctgtgttggcttctttttcaggagagctttctccaagtagcattaagaatttacagaagctctaggtttgcgtgctaccagcctaacaactcgaggggctgaaaggccatcatttcccaatgagtccaactggacttcccaaacagagcttatactggcccagtatggtgactgtctacctctaaatgaatcactgctaccccggggggtggaatatgctaggaggggccaggtctgggccgtattcctgcccgtgagaaaaggagatagggtgagccccatgtggattttcagcagctgagagtgggaaaggttggttctgcaaaagaaattgggtagccgttaataaatgaatagactgaagcctaatcaagcagaggaaacaactgccactacagctggtcattcttggctacaggttgttttagagaaatttcattatggaaagttgtgaacagaatcataggttagagaacagtatataaatggtcaacccatgttcccatcacccaacttcagtagtcatcaactcatgaccacacaccatactccacatgccaaggtactttctcacccttagatgacattgaagcacatcccagacatcacattatttcatccatagttcagtatgtgtctctaaaggataagcattctttacaaaaaataaaaacccacaatgccattatcataccttacaaattaacaatattttcttaatagtatcaaatatccaatcagtagtcaaatctcttccatggtctcataaaataatttctcattatagcatatttgaatcgaggtccaaatgaagtccatgtattgtgatttgtggatatgtggatattaaaagactcttttaatctatatttttcctttcatctcttttttattgtctttgaaaaaatttatttatagtttttttaaagttttttgtcctatagcgatttccacagcctggattttgctgattgcatctctgggtgtcatttaacatgatcttctgtccttctgtatttcctatgagagtttgtttcactcccagagtggaggaagctgtgcactttcatcctctagaggtgtacggtatctggttgtttctctttctgtgatataagcagctattgataactttgccaagatttattaattcattaatgattgcaaaagggtgatgctctaattccataatttcctcttcaattattagctgaataacgttataaagaaaaactatttggctacctcaagacacagtttatatgaaagacaacaaataacttgatcctgtctctttatttaccacttttcaaaccaatgagttgtttcactggcattcccactggggaaaaaaatagtatatttttaagtatcattatcataaactcatggatttaagtatattggatatatttatatccattgatgatattattcttattgaagctcaactcatcttatctttggtaatgggagcccattcaagtgagatatcaagtcctctcaacataaacctaatagtctttgttagtttcttggctttctgatatgataagatgctcaaggcttaacttgtatgtttgttgctccaaatctgggatgagtaatttctccaaggagccatgattccttttagtgggaaatgatatgtagtaatctgaatgctagtgtgctcattgataaggacagaactaagaaatatgtgtacatttttaaatgataaaatacatcatgagctcatactgatatgtccaattcaaatgcaggacaaaaggtttctatataacctcatctatcttaaatctttatctcttctttctcaagtcgtaaatcccaatgctcagtgacatcaccataatccctcaactttatcccacagtgcacatgcaacagcctcagaaaaacaacactaccacaaataacatttaaagatatttttattgcagttccatttgtctttatggaatatccaaccaatatattcaaatgactgtgttaaaatcactggaggccaggtgtggtggctcatgcctataatctcaacactttgggaggctgaggtggaaggatcacttgaagccaggagttcaagaccagcctaggcaacaaagtgatatcctgtctccacaaaacatttcttaattttttaaaaaattagccaagtgtgatggtatgcctgtagtcctagctacttgggaggctgaggcaggaggattgcttgagcccaggagttggagaccacagtgagttctgattgcaccactgcactccagcctgggtaacagagtgagactctgtctcttaaaaaaaaaaatcatttgagatagttcccctatgtgacactctgctactaactggatgatcagatgcaattatttcattttatgtataattcttagaaatggctttttaatttaattatgttttaaaattaagttcaactgtaatcatgccatcaactggatacacaggttctgcatttcattttacatgcaatttttagaaattgctttttagaatttagagttttataattatgaatactatttacatgatatctaagtcaaatctacaaaatgtatattcaaagaagtatacacgctttgttctctccatcctatttcctcccccatagataacacttatttttatattctattttatggtccattcttctattgtttaacgtgagcacatactctgatccctctccattcttagaaacagtattacactagacacacttttattcattttgcttttttcacgtaactgtatatcttagcattcattgcatcatgttttctcaaacacacaagtgagaaaaaggtgagtaggcacatgtgtgtaacatttagaaattagatgtatatttttggtttgtttttgtttttattttttgagacaaggtctccactctgtcacccaggctagagtgcagtactgcacctgggctcaagagaccctcccacctcagcctcctgagtagctgggactataggcatgccccatcatgcccagctaattttttttcttttttagagatagggtcttgccatgttgcccaggctggcctcaaactcctggactcaggcagtccgcccacctcagcctcccaaagtactgggcttatagacatgagccactgcacctgacctggaagacatacatttttattctagtggttgtcattagatcaatgcctttgtataatagcttagtccacccacccacccaccacacctgcccaccttttgttccctggctattgtctattggtctccttctatgaacattattgaaattagctaagtaataacctcttagctctctttgctctctccttgaacacttgacttgaactagtttctttctactgccagttagtattaatacctataaggcaagcagctacctaactctgttcttcatacagccagtacgagtgctacctgtctcccagatagcatcagagtcatagttaataccggtaaaaatgtgcttgatcctcaccactctacttcggtggctcccacgctggccattatggctgtccgcagcttgttttcttgtagattcccaggatgaggaatctcccacttcttgtgaggacctgtaggcaattccagggttcttctggtctccaagtcatcagaagccctttttccttgcctccatttccttccacatggatactgttggtatgaatcatattctggcattcatgggaatagctcaccacttatttttgctggtgatgttgtccatggggttttggctttaatatctgagttgctttctctcttttttatgggagaactcaaggagatccaaaaatgattttgccaactttccataatcctccagtggctgcagaatttatcaaaaagttttgactgaagaattatttataaatattcaatatctcttgtggtcatgtagcactttaatttgactaattaaacttgaattaatcctgaagtcctggcagacaaatacaaacaaatggtaattttcacaagcttaggtaaaattctctcttttaatgaagaagaatcaatcatctattatggaaatataaaactttgttgtcctgctgaaagcaaaacttttttccccttgaaagtgaatagcaggccactttttacgatacatatgtaatttgctatatacattgtaaacgttgaaaattttatacttatggacatcaaagaaagcctaatttttaaaaagtacctatttataaggtagtctggatatatttgatctattgaagttattgttttgccagtataattttcacactatgtgttcttccatgattaatatatgtgagtatataatgcttcacaaatagtagactcacaaatacttcagaaaatagtagactcacagaaaaggtcttctttcgagggtgaagaggctcaaagaggtgtagtattttcccagagttacacagccagtagatagcagagcccagagtcaaatacagaagccaagtgggacaatggactgggaaccattgtagtagaccacatgaaaaccataacgcaatattttcaacagaagaagggattctaaccattaccattggagaggaacacttacacttttcatttgtttaaaaggtaggaatgtggccaggcacggtggctcacgcctgtaatcctagcactttgggaggccaaggcgggtggatatcctgagctcaggagttcgagaccagcctgggcaacatggcaaaaccccatctctactaaaaatacagaaattagccaggcattgtggctcacgcctgtaatcccagctactccggaggctgaggcacgagaattgcttgaacccaggaggtggaagttgcagtgagccaagatcacagcactgcactccagcctggacgacaaagtgaggctgtctcaaaaaaaaaaaaaaaaaaaaaaaaaaggtagtaaggagagaagggggaaggaggaagtagtcgaaaggcttatacactctaagcattgcaatttaatatattttaaattttttcttccaagttttataagccataattcacagaggcaccagggtggtatctgcccacctctagattgaaaaagaaatgaggaatcaaggctattttaggcatctgtcaagctgtaattacctctttgctcagagaaacctttatgtaagactaatgtagattggcatttcttctgtttaaaagaacatttccagtcattcttttaatagaaggatccctattatgatggttatttcaatatgttttggtagagggaatatgttcccagtatggccttgacatagaaattacacttttaatctggtctgtttcttatttacttacaagcttcaatacttcttagagtcttctttccctaccctttctagttcagaaattgttgaatggcttttatttaagcttttcaagtaagctgggtttgtttaccaataagtctatgtataccttccactaaaagtttacccaaagtatgaccattaaaaggtgggattgagccaggcatggtggcgtgcacctgtaatcctagctgcttggggaggctgaggtgggaggatcacttgagcccagcaattcaaggccagattgggcaacatagtgagaccctatctctaattttttttaaagaggtgggattgaaatgacaatttatagaaagaaaacaaatttttcatcattaggcacttgttcattgtcttaggttggactcccagaaactgaccctgaaatgaagatccatatgtaagtgacttaatagggagagttctcaggaaagataaatagagggatggggagtgggacctggaagaaaaggagggcaaacatagatgcagtatcaggcaaagccccaggagggtgactttggctcagtgcacagggaagctccagatactttttaagaccacaccttaagttgtcctatcagaggcagagggatagagtgtttatagtcgccagttaagaactgcctcctgggctcacgttccccctcccctccatgctctcaggcagtttagactcagtaggctgagggtatttcaaagagccaagtccaggtgctggatgctgagaatgaaagcacccagcatcaactgttgactgcctctggtggtttacttttcttgcttctatcagcacatcctggagttcccaaggatatcttaagcagacaagggtgtgtaagaagttcaagttctgttgtgttttctagaaacttaccaaatccaaaattggagaccacctatacgtaagtccagtgtttttttctagcccaacattccacatttattaatgattatctctagagaaaggacttggcagtgaattaatttaactagaaaaagatcattgctgtaaaggaaaactatgcttttctaatatttaactcggattataaatatgcaaccaaagtagccagaatgttctgactagggtgatggatcaccagccactgaaatgccatttcaaagaatggatggtgttttaaagaaattatcctattcattaagactgtatctatgcagaggagaaccaagtgcaatgaaaatgtttgcgtcccaggcacttccttgggtgcttggcatatttaatcattacatgagtcctctaaggcaagtaagtattatttttcctgttttagaagtgaagaaactaaagttcatagaggaaaaaaaaaagtatacatttaataagcatttagtaggcatccgctgtgtgttaggcatgatgcaaggcactgattatgggatggcaaacaaaatggacctggtcccttccctccttgagcacacagcctagtgagcaagaggtgaaacaagcaaatacataggttataaatggtggtaagaaaggaaaggaaaagaacaggacactgtaaagcataatgatggcataggagtagaagattcagtagaagattctcattgtctcctcaatgagaaagtgacatttaggttgagacccggacgatgggaaaagctaaccaggcaaagagcgggaggagagaaagagcttagagtgctttggggagtgaaacaagagtgatattgcagttcctggccagccaaggggaaagaggtgtgaaaagactagagatagaagcaggagcaaggtgattgagggtcttctagagtagcagttggcaaattttggcccacaggccaaatctggcctactacctgtttgtgtaaatcaagttttattgaaatatagccaccactgggcatggtggatcatacctgtaatcccaaaactttggaaggccaacgtgggtggattacttgagcccaggaatttgagaccagcctgggtaagatggggaaaccccatctctacaaaaaatacaaaaaattagcagcgtgttgtggtatgtgcctttagtcccagttgcttggtaggctgaagtaggagaatcacctgagctccagaagtctaggctgcattgagctgtggtagtgccatttaactctggcctgagtgacagagtgagaccctgtctcaaaaaaaggaaaaagtaagaaaaaagaaacacacattacctgtggctgcttttgctctatgactatagagtagagtagttgcagccaactatctggtccacaaagcctatttactatctagctctttacagaaaaagtgtgctgactcctggtctacaccatgaaaagaagtctggattttactctaagaaagagaaggagccattggagggttttaggaagtagattcaaataattcagtttttttttttttgagatggaatctcactctgttgcccaggctggagtgcagtggtgtgatcttggctcacagcaaactctgcctcctgggttccagcgatcctcctgcctcagcctcctgagtagctgagatcatacctggctaatttttttgtatttttagtagaaactgggttcactacgttggccagtctggtctcaaactcctgacctcaagtgagccacctgcctcgccctcccaaagtgccaggattacaggcgtgaggcaccgtgcctggcaaataattcaatttatattttaaaaatatcaccctggccgtgctacatggaaaatggaatctaggagacaagagtggcagtaagaagccattagaagtttttgaaagagtccagataggaaataatagctagaggactggacagagcagtggttctggtgttagagaaaagctatgtgtagaggaaggatcagtaggatttagcattgtatttgatgtggagattgaaacagggagaaatgaagtataactcccaaatttgtagcttgagccctgggtggatgacagtgccagtcaatgagatgagtcaactggaagtagcggaaataacgtaggtgagtaaataagtttaagttcctcagagttctccattattaaatcttaggacctgcattggagaccaagtcttcatgcttttccagtaaacagcatggtctcccattggaatcatcacatgagtttactgtcaattgacacaaaaccaccaacactaaattttttcactgccaataagaccacaaagaaatggtcaaagtgatctgttttaggtagatgtgcttgtaattttgtagccttgtctttacattttacagactttatatataatttgtaatatgcataagcatgagctaattttgagctcatcttttttttttcttttttctttgagacagggtctcactccgacatccaggctggagtgcagtgacatgatctcagctcactgcaacctccaactcctgagctgaagtgatcctcccacctcagcctcctgagtaggtgggactacagtcatgtgccaccacacctggctaatttttttttatttttagtggagacagggtttcactgtattgcccaggctaggagctcatctttaaaataaaaaatatttcagaccattgattaaaatctttcacagttaattaaatatgtatctgcattggctatgcagagagcatctttagggacatacaatatagggcttcaaatagttgggctcttgtcaccgtagcattcattttgtctcgggcagctgtgaggcacccactcagcaacatttctgaggtcctaattgaaaatgaggagattctagaactgtgcttaaccctaaacttggaagggagtgtctctgaagcaagacctcacatgtctgtggttcaccttcccatctaggtagctaagagggcagaaaaaggcttctctgaatagccccactactctgcccaggctgaatggaatgtcaagctctaggccaccccaacacaagtctccttaagcagcagacccagcccaggttggaatctggcataacttggaagctgaaagatgacctaactagccacatttcaaattcaagctgaaagtaccactcacatttaatcagtttctggagatctatatggaagccttttatttccacttctttaaatgaacagcagttcatttacctggagaaactgcatgtgaataacagcaaagcaagtcgagagtgagttattaactatgcaaactgactacttaacctgttcttttcagacttcccctaacagttttattgaggatatgcttaaaaacatatttagatgatacattgcatgagtttcaaagagaccattaaggtctcatttgggcagagaaaaatgaatttttaaaggaaccattaatgtgtgtttttataattgtgtcttatggtatttttaatattgctaccatttatcaaatatgaaaaataagactttacaatattatcaaaataatattcatacggtagtagtctcatacccattaaatattatctgctaatcctttaccattgttcctaacatattatgattcattcagatctcattagattttatttcatactgcttttcatgcatagtatctcatactatgcatcaggtagtttttaacactctcactctttttttttttttttttttttttttgagatggagtctcactctcgttgcctaggctggagtgtaatggcacaatctcagctcaccacaaccttcacctcccgggttcaagtgattctcctgcctcagcctcccgagtagctgggattggaggcatgcaccaccacgcccgactaattttgtatttttagtagagacagggtttctccatgttggtcaggctagtctcgagcttccgacctcaggtgatctgcccacctcagcctcccaaagtgctgggattacaggcgtgagccaccgcacctggccaaaactctcactctttaatgcaatttttatttgccttttcttatccccttacctccctataggacatttttcctctcttacctagttgaaaattaatcttcctcggacattaaggaaactcaagaaaaaaatacttagtttaagaaacaaaaatttgctcatatttgtaaatagattttcgcatgcattttggtttgcacccttttcaattctgaaactctgaactctagttttggacatgagattaagcttccatttgatggcaggagtgaaaaatacaggaacattaaaaacggaaatcacgatctccaccaaccctgttcttcatagccttgagagtagaaagagtaaaaggcaaagatagtgttaaactccaatctgttattattttagaggatagataaggaattagtctaagctatgttctcaggttctgtaggaaggaagcttttccactaattctgtttttcttgcttttcctttgtttctaaccccaatggatacatacttttgaaaagtaatctttatataatgtttcatgtagtaattgaatagcttgtatgagtgaaacatttttcttttttatatagccagcccaaatgcagactgtaagtcctattaatataaaacagaaaggtctcaaaattcagttgcagggttagtgtgccccaagttcatcttcaaagcagtatttcccaatagacaggaaaatgagatttctctctgctttgccatggataaagtatcactattgatcaatttataaataatttttctaggttgaggctaaattcaaacatgggaggcacacttcagaaatttagtataaatcccctaacctctttccctcagagaaaattttatcatggttcactgaaaatctgtcaactttcagagaggattggaacattgctaggttttctgagatttgaggtgccatttcaaaatagctgtgtttgaactatgtacctatcgttccttaacctaatttttacctgcagtaagaaggtatattccatcctgtagctgtttataaacagtctctgcaaacattgtcttcgaattgaagcttcttcggggatatcatctctattccttgccaacattaaaaatagtatttctctgtttacatttgtctcctcttcccttctatgtatacgaaagttaccaactggaaaaatagtttatggtctttaccattgccttattgttaatattcaaatacatgttcaatcctggtaaagctctatattgttccaattctgatacatctaaattgggaggtagtggctatgaccactaacccctaggaacaactgggagccccagctccttctggctccaggataacgttatacataggctccccttagttaatttcacctgaatctctcacctttttattcttgaaccgctcaaaatgtgaggcctcaggacacagatttcctctggcacctgcttctctgtgacacctggttcttccttctccatgacttaacacgttccctatgactaattgatcttagttttggttccttcacaagccaactctgacacaaggatttgtgtgtgtatagataatctagggcgtgatcccaggaaacaccagccagagactagagatgtgagaccaaaaaggaagacaaccaataaaatgtaagttatcaaaccaattgccactgtgggcaactggagcttcatcctcttggggagttccaggatcagtgtagaaaacatgccttggagttattcagttgagtggtgagggagtggaggtatttatactctaattcttgtcaggtattgaatgaggactcctctgtggggtcattccccagaacttccagctgattatgtgtggtcagggtggactttagcagccagagagagcccccaggcaggtggaaatgaagaagcctcctcaattgtctgctgtaactcctaactaaccatttctactgcaccccttgaacactcactctattgcaaatgtaatggccttaacaattaacctctttttaccattttctgagcccttgcccttctcttgtgaccacgttgaaaggaggcttagtccttctcgtgccacttaaatcacagggtaaagaggtagtattggcattctcctggcttctcatgattaatttataagtcattattctctcaacctagtgcaaaacttgctcctttttttactagttatgccctccaacaatatgacttcagactttctctgaatttcatgccattccttacatatactgaagactttgacaccttccaagaatcctaccacactctggataaaaatcagcattcaaatatccacatggatgaaattaccttcttagtttttctatctcctcaactccaagtgccttcttgaccattccctttcagccaagcactcctgatctccacatccccaacctttttgacacccataactgaacctcctctgacaccataaattcccaatatcccaactttgtaattattctattactaaagagtgattctcactagaattattctcatcaatgctgtctttcccaactctttccagtcttccttcgtagacttctctcacccaaaagccactcaccactcatcttgtgtcctaattatacttgctggtatacttttctctaagcagaccccatgcatccctgcctgtagtcctcttttcacctacactgcccctggaaactgcattcctttcaagtgcttacccgttcatcaagatccaactcaaacacagctttttcagtggttctccaccactttccctcctatatctcgcatgttggagtcactctcttcttgttctgtatttccaagatatctatctgtagtcgctctgctttgcaactgtcaaattctgccctgccaggtgaagtgggtaaattacttggcctttcaatgcctcagtgtaatcaactaccaaatagagaaagtgatagttacctgtcaacgttattgtggagattaaaagaaacaatatgtgaacatgcttcagaacccaaagatgaacacaacatgtatctttattgggcagctgtaaggaacaaatagagaaaagcaaaacctttttatgggaactttgaatactgataatgactttaccatggatagaaggaaaggacattggtgcacatagcctgggttgtattcctggctccacttcaaatgagctgcatggccttgaacaagatgcttactcgcattggagaaagcccatttcctcatgtaaaaagtggaaataatgaaacctaccttgaagagttactgatgactaatgcatggaagcagacagagctctgataacttgaactgaaatggctcccgatattcccttatcatctctcacccaggccagtaaggttggggcacacaccccaggcaagaggcagtattacgtgacctaacaaggtctgagtgagggagtgactgtcagccccataagacgggattccatcctgggaggctgcactgctgacttggacaagtgtcaagatcctgctttaggaatgataggctcagacagaagctctgagtacatgcagcgtgcgtggggacagagagaggagcagttctttatgtgcccttaaagtgagccaactccatgtctgggctagcctctcctctgtgtcttctagaatgctttccctcatggctctagggacaagaattagtaattactgattactaataatttttaatgattgaataacaacagcagacaccaccatttatgaagatatgattcagggctgtgtatgtcacatctctcatatgctatctgcctactttatccttcccctcctgacccacattctaccccagagttgaacctgcaactcggtctgcagcaaggactatcctaggagtggataaatctggtaaatgagaagatatgaggatttcttctggcacctggattcaaagtattttaatttctggagcctgtgtatcttcatctctaagtgggaataataatacctaagtcctaacatactcggaagagttcttgagaaatattgagtgtgaagtactttacacggtgcttagcatacagtagacgtgaagtaaatgattgcttatactggcgattcttctgacaatgtcctggttgccccccatagatcctgaccatcccttgttcctctctgtattgaaaccttgtgcagagcagtcttctgatgaaaatggcccaagccatgtgaccccaggtacccaagcaacctgtttatctcttctcccaatttgttctctctcttctttaaggaaaggccatcttttcacccatctgcccctgcagagctgtttgtggatgttgaagggttgccatggacaccagtaggcctggaggcacgtgggtgaatctgggaagacttcaaaggggtgatctctggacagtgttctgaggaaagagattgaggtgccatttgttgaagaaaaggtagcaggaagttctagatcaatgacattgcacaaaacacgggaagtgatatacgggactcaacttgaagggtaagcgccttgggtctctagaggaaacccatgtaattttaggtccagttcagtttctacatcttctggatgcaaacagacagcaggagagtgtgaggggctccccacacttacttctagccacctgaggcatcctctgttctgctaccagagtctcaggtcattccatagaatggtggccccagacaggcagggatttttttctgttttcttcatcggtctatccacaaagtctagaacagtcttcgttgcatagtaggcacttgtcaaatatctgtttaatgaattccaacggtctttaaagttgaagtgtaggtgaagataagaggaggtgagtggagagctactggaggtgtttcctactgggggaaaatgattaggaaatcttacttgaatctgagctgcatttggaaatcatcatagtatttggagaagggaagtgatgtgatgaacattaatacctcagtaagatgggtcagctttcttccaaatagaccagaagagaggagacaggaggcacttcacttcttgctaaaaagttattttccccaaatacggttattgaatgaataaatttgaaaaacaatttatatatctgttgtcattgaaagccatatgcttcttatctcatctcacctgacaaagtcgaacataaccatggagtggaagataggaatttaacttctctcactataaattgcagcaagttgacattcagcctggccttctgaaatgctcagtttaaaataacagttgcaggtacccgcctttgcaggctaactcccttagagcatgcagtatcagtgtttgcccttgggaccagacatttgcagttgcctggggaaagtaatctctgtgtgtgctaaaaacacagaacacaatgatggaaatgataccaaaaagtatgccaacaagatggacatgattctcttagcaaaatgcttataaaatctagatgcttcacggacaagggcgcaagcagaaaacatcctcgcaaatgctccacatcctacgtagctgcatgtctaggcagaagtttattgaagcaaatgtaatggccaagaagtactttaaatgagctatttcttgcatccttgaattattttctctccctttcctccctcaatccctgctctcatccacccactaggattttttttttttttttttggcaatcttcaaggaaaaataataaaaagaactggaatttacataataccttccttccaagatactaaaagcagttcacccatctataatttgtccttacaacaatcctttgtacaggcctgttattattattattaacattattattatttcaattttgcagtcacattgcttgctgctgagaattttagctaacacctcatttcttgaacaattttagcccctcagcatatgtataaaaaaggcttcaactgccacctcccatttgtgattgtgccatgtattacattacagtctctggccctctgtttaattttcatttaaaaatatattaaattcctttattgtgagagcactgccggactgctgaacagaaggtgaagtgagcgttgaaagagaacagaatcaaacataaatatcttccaaactaaaagggaaatggaaagtaactgtcaaggcaaattgatttgaattgcataagaatgtgatttttttaaaaattgactcagaatatgaactattctttctaacagcttcaacttggcagatgacactacctgtctcttcctaatctcttgcagtctttcaaattccaaatttgtattgggttcaaaatttttcacatctcaaaaatgttcccagttcactgaattcctttagttatctcacatttcccatatgaacagggcctcccatgggaatgaccctgaaaaggcatgagccatttgccaatggtctttcttaattgccccagcaatcattttcttccatggccctctacctaatttatttttaacataaacaggtttcattcagcagaccagatgttgaatcctccccgtcttcttctcttactcatttacagtgttacatgaaaattccattcttctctctatataatagctgccctgctattagatagggctgtatcagtcagctgttgcttcataacaaataatcaagatctcagtagcttactgaatactttcttttttgcactgtggtaaaatgtatacaacacacaattttccattttaataattttaaatgtataattcagtgccactaattatattcacaatattgtgcaaccatcaccgttatctattttcaaaacttttttagtgctccaaacagaaactctgtacccattaagcaataactccccatttccccttctccaagcccccagtaacctctaatctactttctgactctgtgaatctgccagtcctagatttttcatacaagtagatttaatattttgatatttttccttctgtgtctggaaataagtgtttctttctcatgcatctgcaaactggatggggaagctctggtgatcttggctgggcttgcctggaaactacagattagtttcaaatctatttcgtatgtctctcctcctccttggaccagaaggctgcacaaggcaatacagagcaggagagagcaagcaggaacaggtggcaaggcctctgaaagattaggctctgaactggtacaccgtcactttcacggttcttccattggccaaagcaagtcattgaccaagcccaaagtctaaagtcaggcaagtaaacttcagctctagtgggagaatgcaaagctacatgaaagtgcatggatacagggaaggttaaagagctggggccatatcctacatggttaaaatgtaagttctgcagttgaatggaccctcctctaccacttttcagccacgcagctttatgaaaagggatttaatctttctgagccttgtttcctcatcagtaaaatggggataataatattacctatctcacaggctgctgtgattactattgaaatgctctaaatttgcagtaaaaaaaatgcgagcaatattattgtcattcttaaaacgtaaagaatagaaaaagcaaccaaagccaatagaacctttttatctttgcttttcactgaggaaaggaagttttaggttagaagaggatgctggaaaccatggaagttcagaaagggaattagaattacaaactaagacctattggtacttgaagaaccagtagcaatcattttgtctatttgttttcatattttcttttagtaatgtcactttttttgacataaacctagcctatgatctcagtgcataaagcagtagaggggttctggttgaaaagacaggggtattcagggctctgcccactggcaagagtccctgtctcagaagggttgcatggagcacaatttgaaaaccgctaatcaatcaatcaatcaatcaatcaatctgcaaccttagagactgacttttaaatcagaacctttcaattgttactgtcctctactacatattctgtatctatctgtaatcatataaaataactatgacttactaaaaaaaaaaaaaaaagaaaaccactaatttttgtttgtttgtttgtttttgagacagagtttcgctcttgttgcccaggctggggtgcaatggcacgatctcggctcacagcaacccccacctcccggattcaagcgattcccctgcctcagcctcccaagtagctgggattacaggcatgtgccaccatgcccagctaattttgtatttttagtagagacaggttttcaccatgttggtcaggctggtctcaaactcctcagtcacctcaggtgatttgcccacctcggcctcccaaagtgctggcattacaggcgtgagccaccgtgcccagccaaaaaccattaatttaatccaagcttcctcttcttccagatgaaaaaaaaatgaaacccacttgtgtaatgtgatttgcccccaaaatcacatacctaattgatgccagatctaaaaggagagtaaaacctctctttctaactcccttgcccataccatgctggcttctgtgaactttcaaaggccttgttggtaacagcaacctcttcggcctaattttatctcctctcttctttttcaatttgtccctcattcagatatatcacacttataggtaggtagtgctcatatattagccatgattctgcccatctgaagaatgcaaatgtgttactggtgaaagaaatgcccatctccatcagcaaaaaaggggaagaaggaaatgaaaaagtatatacagtagacatgtgatacaagaaatatgtgaatatgtatattcattctcctataaatgtactgatatatgtatatatatacacactcatacatacacaccattttgtgaatctgacacataatagagagtcatgagatggaagtcaaagttctaccatgtaatagctgtagggctttagacaaattattcagcatccctgagttcggcatcctctaggtaaaatgaggctaagaatcactgcttcccagggatgttacaagcatgaatacgtatgagaaacagaagtttaccaccttgggagtgttaccaggactgccaaaatgccaccctggtactttctaagttctgtgcttctagacccatttctgaattctacagaacaacttataaatacacaggctttggagtcagaaaagcacagatccatgtgctgattctgccagttactgaaatgtgaactgagaacattgaattgatctatttgatctcggttttctcatttccaaataagaatgacattaccttctttactggaatatcaggaagcttgaatcacacaagtaatttgtgtagtacactgtatggcacatggtaaacattcagaacacattaactcttaatcttgttcttatattgtgattgttactgttcttcaaagtttcccctagttttctacccactcaggcacagggaaatacatttggggaaatattgaaatagcagtactttgaatctttagaaatcagattgttttaaaaaatataatattttctttattttagggagaaactattaaaatcttttttcccctagagaatgactgctgtgacgattgttcagtgtggtttcatgtccctgaacaccatctctatccctgtgtgtgtgttccaacaatttaattcagctggcagaactgtccccctttagaataaggtagagattatgctaacattttagacgaggatcctcttgttggtttttggaaaagtacctccacatgagcatctctagatgggcagcattgtccaacatatcatgctgccatgatacagtatggtagcctctagttacatgtggctattaagcacttaaaatgttgctagtgcaactgaaggactggatttaattttattatgtttagtgaacttaaatttaaacagccacaggtctggagacttctctgcatgttctgggccaatgagaatgctgtttgaaattttgatatttaacttatcaaagaacacatccttgaagataaagacaaacaaaaagacaatggaaagaaagctttcatcctggaagcatgtcaaagcagcccaaaatgaatgagatgaaacgaattacccctttcctttcccaaatcttcatgatgattatggactattactaactgctcaccaggactttgggagtcccaataattttcatacagtttgtgctacttagtttgagtgagttgaatgtggcatgcttacaccttcttagtatccctcgctcaactgacaaagctttaactactttttacattactgtaagacattcttctccaactcctcctttgtgaaacataaatggattgcttattcaacatggtgtctttcagtcataatggcatttatctccacatccactcaagaatatgtgtttagatgacagcatgtattgatggactgcaacttattccagttgctgacagagtagaaggaactcagtcagacactaagaagagtaaaaaagtaaggtaaaggaagactaattgagttcatagagttagagatgcacatgtaataggattgtcaatgaatgataaagccaaataaaacagagtcattggttgaacacatgtataccctttgacctaccaattccactcctaagtatacaccaaacagaaatagatacacatttaatatattcaccaaaagacatatgcaagactgttaatacatagcagcactattatttaacagccccaaattggactactcaaatggccatcaatggtagaattgataaatgaatagtggttcagctacacaatggctactacacatcaatgagaataaatgatctacgactacacatcacaatttggatgaatctcaaaaacaattctgagtgaaagaagaaagaaacaaatcattgttactttacaattgtattcatataatgttgcaaatgaggtcatactgttctatggtattaaaaatcggaactgtggttatcctcaggaagtatatttggaaaggagcatgggggcttctgggatattggtaatgttttgatttcttatttggaccctgattacaattatctattggtacataacaaattacctcagccaggcacagtggttcacacctgtaattccagcactttgggaggccgaggcaggcagatcacctgaggctgggagcgagaccagcctgaccaacatggagaaaccccatctctactaaaaatacaaaattagccaggtgtggtggcgtgtgcctgtaatcccagctatttgggaggctgaggcaggagaatcgcttgaactcgggaggcggaggttgtggtgagccaagattgcatcattgcactccagcctgggcaacaagaacaaaactccttctaaaaaaaaaaaaaacaaaaacctcaaaacttaggagcttaaatcaacaacattattatctcacctttcctgtggatcaggaaactgtgtacagcttagctgggtgcctctggctcaaggtgtcccacaggggtgcaatcaagttattgtctggggctgtggtctcatctgaggctcaactgaaaaggaatctgcttccaaggtcactcatgtgtttctttgcaggattcagtttctcacaggctcttggactgagggcctcagtttcttaacaacttttggccgggacctcccttggttctttgctgtgtgggcctctccaaagggcagcttatgtggtatttggtttcctttggagcaagtgagcaagagtgtgagagagagtgagcccacagtatggaagccatagttttggggttttttttaacctaaccttggatatcacattctctcacttctgccatatttcgtttattagaaatgaatcagtaaatccagcccacatgcaaaggaagggaattatacacagtctgagcatcagaaagtgcagatccctggggatcatcttagtggctgcctactgcatgtgtgttcagtgtgtaaatttcaatgagctgtacactcaaggcatgtacttttctgtatattcattatacttaaaaagtgtgattgaataattaattaacagaatctctggatctcacaaaagaggcctttggccttcagatagactttactaaactgcaggttcttaaatttaagtctagcctccggaaacagaagccttttttctaactggtttctgccaaactgggcttactacaacatcactaggtctttgctcttctatcctgtacattatcacagtacacatagctgtagctgccactgcctctgaaaacccatgaaccctgaaagacagaggagttctttccagttggacaagcatggggcctggtgcttcttgtgtcatagaaaggaaaagtggctcggtcatgatgaggtcaagacctgggcttcctgtggcaaaccccacagtcaaattcagtcagagcaggaaaacctctgagatggtgaagaatggtaattgtattatttaaagtcagcctctagtactgacacacatttaaaatggaaaaaaacatgaagattccttgggcaagcatcagaacaattgctgtgggccaaaattcataaatatgctatacactgtccctgattttagggttggcctgtttctagtcactgtttatctttactcttacggaaatgtccccaggactgtggacatgcatagaggcaggaaagaagggaataaatgaaggaagtcttatcctaggtgatgagaataaaatagtgatcctgaaaaggcttgagaaatgttaataaaggagctgccagttaaaacacactctgttatttctcactataaaagaagccgttggcttcttctcaataaccaccctgtcatttgttctaaaccatggctggatggcccatcaacagagcacacaacctggtggcctgcttttgcttaatgtctgttttgttcatccatggcaaagtgtttaagaaaaacatccaccccaacttttttttttttagtactttttgtgctttcagtttactatgtcagttttttccaatggtatttacaagaagcgctcttaagaaccgaagttcatttagagagccattaaaaagtctgctactcaatgagttcatgactattgataacagccacctactgcctgcattgctgccttagcccttaactgggcccacacttccaccttgccctcctgcaatccattctcagcttagtggccggagtgacctttttaaaacatgtattttgtcattcctctgctccaaactcacaggtaaagccagacttttgcaatggcccatcaggccccaaatgatctgggccctggccctctctctgatctttctccctagaatccctccctactctgttgaagggtcgctgagctcctggctctaactcaaacttccctggcaggttccaccttagggcctttgcctgtagccccctgtgcccaggaggttcttccccttgacagcttcatagccaactaccttacttcctactcattgttgctaacttgtcacctcttaatgacatttaacttgtctaccctattcaaaatggcatggtggcctacctcccaacactcacaaatgtccatgtcatcttcagcatgctgcattatacatatggtggtatttgttatttattttttattgaatgtcttccctctttagacggtaagctctgccaggttaggtgttttattgactgttttatttattgatgtagctcaggattcctcaatctcagcactattgacattttgtgctgagtaattctttgttgtgggggctgtcatgtgtgttgtaggatgttttgcagcaactatgggttctacccattagcacttctcctaactgtgacacccataaatgtcttcagacattgccaaatatcccctatggggtaaaatcactctccactgaggatcactgatatatcccaaatgcctggccccaggtagatactcaataaatatttgctgaaggaatgaatgcagggagagctagacagcatcacagaagtgtgcaaaataatttaactattacctcatgaaaagctgctgccttttatacattttaaatagaagcactattttcatccattagtcaaataagcatttcaaaggccagagacaatattcattcagcaaaaaatgaattaaatggacaaaaattaggtcaaaccaaaaccagatacatatgcaaattaactctcttagcagtagtttccaaattcaaagtgccaaacctgaaattttattgcaaaggtttacaaaatacaataaaataaagagtttgaaatgatgcaatttcatcaaaatgttaattctgatcaccactgtatcaatgatgtagattttaaccataatagcctaatattaatcttcttcacaaagaaaatcacagcctaagccttaaatgcattcagtaaaatgtgaattagactttgcaaagatttctgatttctccctaggtttaaaattcaagtcgttggttatatgtaagcgagttaattctaagcctaaaattacaatgtactttaatcctttctctgcaattcaaatatttacttgacaatgccataccaattgtgccctccaaattattccttgtagtgaagcatttttagtccaagacacttgattgggtctgcttctcctctaagtttgtttttttcccctctaccccattctccacaagtccataattaatgttacaattggcaaatcccactctgagcagtaagaaaatctttttccacacttcaacatacgtttgtataagacaatttttttggtttgttttaatggaggtcacaaatacagtatactaagggagtcattggcttggacattttatcttccttgataagggagacatgttgaatttcaaaactgtttgactgttttaaataactgtttctttaaaaacatagttttcaaattctttttgggaagatgatgttctagttatctattgcagcctaacaaacgtaatggcttaatgtaataattaatataaataattggttatctctcatggttctgtaggttgactgaactcatccagatggttctcactggggtctgtcttgtggctgcagttcaatggcagctgcggctggagccatctgaaggcttgattgaggagatatccaagatggcttcttttgtcatatgttgttgcctggacttggacagctgccatagtgaaagctggccaggcatctctccctctctccacactacttctccacatggatggcttctatatgacatggtggtcacagggttgttggacttctaacatggtatccggctttcctcaaagtgagcattccaagatatccatgtggactttataaggcttctaggattattctgaccaaggcccagaagtcatacaaagctatctctatctctacaatattctgttaaaagtgagtcacaagattagtccagattcaaggggaggagactagacagaatgtgaatattagaaggtgtgttacttgaaggtcatctttagatccctagtatcacagacaaaaaaagataagcaatacaattatccagtttttaaggatgaagtctttaatacattgcttaataaggatcttttcttaaattctctttattttccctttggcttaaactggtagtctttttgatcagcagtgtaacgtctcactcaagggtgaaaatggtagtaggagaaacaatatctatagaattggtagaagccaagtccaatgctactgggcaagtggactctttaattcatctcctctatgtttctgttaccctaatgactatggtggcttcattatgcccattttcttccatagcattccctgaacatgacttagaaatgacaaatagtcccattcctcttctttgcaggtaccagggtggaagcaagcttcagcggcaatgagcagagtgtaaatgcttcatatagtccatgacagattacacttaactgtaatatgttgaccttttctgaatgcttggtcatttgctggacatttccactctctccagctaatggcttcagtgcctgttaggaattgattcagtggataattataatctctcttcagagtgttgcaaaggtcaacgagataaagcaataaacccccatttcaagtgcagtcctgtggcgacttttctgaaaatgaagggcaacacttcttccttcatctttgccagcaattgactaggctgacgctacgttatggcttgttatcaaatctgaaaaatctcagtgttcttttcacatctccaggtttaggtgggaagagaaaataaaaagcaagcaagtggcttcatcacaaaataccctaggattggggaaacgcccttctgagcaaagatcatcggagaaacactgttaatcagttcttattttcatgaatagtgactgtccaccagcagcgagtttaagggctgagactcactagcttgcagaaaacaattatttttttttttagttttcttttttaatatttttattatactgtaagttctggagtacatgtgcagaatgtgcaggtttgttacataggtatacacgtgccatggtggtttgctgcacccatcaacccatcgcctatattaggtatttctcctaatgctatccctcccctagccccccaccccccgacagggcccggtgtgtgatgttctcctccctgtgtccatgtgttctcattgttcaactcccacttatgaatgagaacatgaggtgtttggttttctgttcctgtgttagtttgctgagaatgattgtttccagcttcatccatgtccctgcaaaggacctgaactcatccttttttatggctgcatagtattccttggtgtatatgtgccacgttttctttatccagtctatcattgatgggcatttgggttggttccaagcctttgcaattgtgaacagtgccgcaataaacatatgtgtggatgtgtctttatagtagaatgatttataatcctttgggtatacacccagtaatgggatggctgggtcaaatggtatttctggttccatatccttgaggaattgccacactgtcttccacaatggttgaactaatttacactcccaccaacagtgtaaaagcatgcctatttctccacatcctctccagcatctgttatttcctgactctttaatgatcgccattttaactggtgtgagatggtatctcattgtggttttaatttgcatttctctaatgaccagtgatgataaactttttttcatatgtttgttggcggcataaatgtcttcttttgagaagtttctgttcatatccttcgcccattttttgatagggttgtttggttttgtcttgtcaatctgtttaagttccttatagattctggatattagcgctttgtcagatgcatagattgcaagaattttcttccactatgtaggttgcctgttcactctgatgatagtttcttttgctgtgcagaagctctttagtttaatcccatttgtcaattttggcttctgttgccattgctttttgtgttttagccatgcagtctttccccatgcctatgtcctgaatggtgcctggtttgcctctagggtttttatggttttaggtctaacatttaagtctttaatgcatcttgagttaatttttgtataaggtgtaaggaaggggtatagtttcagttttttgcatatggctagccaattttcccaacaccatgtattaaatagggaatcctttccccattgcttgtttttgtccggtttgtcagagatcagatggttgtagatgtgtggcactatttatgaagcatctgttctgttccattggtctatatatccgttttggtaccagtaccatgctgttttgctgttctggttactgtagccttgtagtatagtttgaagtcaggtagcatgacgcctccagctttgctctttttgcttaggattgtcttggctatatgggctcttttttggttccatatgaaatttaaagtagtttgttctaattctgtgaagaaagtcaatggtaacctgatggagatagcatggaatctataaattacttttgacagtatggccattttcatggcattgactcttcctatccatgagcatggaatgtttttccatttgtttgtgccctctcttatttccttgagcagtggtttgtagttctccttgaagaggtccttcacatcccttgtaagttgtattcctaggtattttattctctttgtagcaattgtgaatgggagttcactcatgatttggctctctgtttgtctattattggtgtataggaatgcttgtgatctttgcacattgattttgtttcctgagactttgctgaagttgcttttcagcctaagacgcttttgggctgagacaatggagttttctaaatatacatttatgtcatctgcaatcagagacaatttgacttcctctcttcctatttgaatacccgttatttctttctcttgcctgattgccctggcccagaacttccaacactatgttgaatagcagtggtgagaaaggacatccttgtcttgtgccggtttttaaagggaatgcttcagcttttgcccattcagtatgatactggctgtggttttttcataaatagctcttattattttgagatacattccatcaatacctagtttattgagagtttttagcatgaagaggtgttgagttttattgaaggccttttctgcatgtattgagataatcatgtggtttttgtcattggctatgtttatatgatggattacatttattgatttgcatacgttgaaccagccttgcatcccagggatgaagccgacttgatcatggtggataagctttttgatgtgctgctggatttggtttgctagtattttattgaggattttcgcattgatgttcatcagggatattggcctgaaattctcttcttttgttgtgtctcttccaggttttggtatcaggacgatgctggcctcataaaatgagtcagggaggagtctctctttttctattgtttggaatagtttcagaaggaatggtaccagctcctctttgtaactccgatagaatttggctgtgaatatgtctagtcctgggctttttttggtttgtaggctactaattactgcctcaatttcagaacttgttattggtctattccgagattcgacatcttcctggtttagtcttgggagggtgtatgtgtccaggaatttatccatttcttctagattttctagtttatttgcatagaggtgttgatagtattctctgatggtagtttatattactctgggatcagtggtgatatcccctttataattttttgttgtgtctatttgattcttctctcttttcttctttattagtctggccagcagtctgtctattttgttaatctttaaaaaagaaaaaaaaacgtgctgggtgcagtggctcacgcctgtaatcccagcactttgggaggccgtagcaggtggatcacaaggttaggagattgagaccatcctggctaacacgaagaaaccccatctctactaaaaatacaaaaaaaattagccgggcatggtggtgggcatctgtagtcccagctacttgggaggctgaggcaggagaatggcatgaacctgggaggcagagcttgcagtgagccaagattgcaccactgcactccagactgggcaacagagcgagactccgtctcaaaaaaaaaaaaaatgtgaaccaagatcgtgccactgcactccagcctgggcaacagagcaagactctgtcaaaaaagctagctcctggattcattggtttgtgaagggtttttcatgtctctgtctccttcagttctgctctgaaaccctacaagccagaaaagagtgggggccaatattcaacattcttgaaagaattttcaacccagaatttcatatccagccacactaagcttcataagcgaaggagaaataaaatcctctacagaaaagcaaatgctgagagattttgtcaccaccaagcctgccttacaagagctcctgaagtaagcactaaatatggataggaaaaactgataccagctactgcaaaacataccaaattgtaaaggccattgacaccgtgaagaaactgcatcaactaatgggcaaaataaccagctagcatcataatgacaggatcaaattcacaaataacaatattaactttaaatgtaaatgggctaaatgccccaattaaaagacacagactggcgaattggataaagagtcaagacccatcggtgtgctgtattcaggagacccatctcatgtgcaaagacacacataggctcaaaataaagggatggaggaatatttaccaagcaaatggaaagcaaaaaaaaaaaaagcaggggttgcaattctagttctgataaaaatagactttaaaccaacaaagatcaaaaaagacaaagaagagtattacataatggtaaagggatcaatgcaacaagaagagctaactatcctaaatatatatgcacccaatacaggagcacccagattcatgaagcaggttcttagagacctacaaagagacttagactcccacacaataatagtgggagactttaacaccccactgtcagtagtagacagatcaatgagacagaaaattaacaaggatattcaggacttgaactcagctctggaccaagtggacctaatacacatctacagaaccctccaccccaaatcaacagaatatacatccttcttggtaccacatagcacttattctaaaattgaccacttaattggaagtaaaacactcctaagcaaatgaaaagaacagaaatcattacaaacagtctctcagaccacagtgcaatcaaattagaactcaggattaagaaactcactcaaaaccacacaactacatggaaactgaacaacctgctcctgaatgactactgggaaaataacaaaattaaggcagaaacaagttctttaaaaccaatgagaacaaagacacaagacacaacttaccagaatctctgagacacagctaaagcggtgtttagagggaaatttatagcactaaatgcccacaggagaaagcaggaaagatctaaaattgacaccctaacatcacaattaaaagaactagagaagcaagagcaaacaaattcaaaagctagcagaagacaagaaataactaagaattgttttctaatttctttgaagaacgctgaagtacaggaagaataaagaatcctatgtgtgcatgtgtatacccatgaagtgagagttcaacactatgaagtgagagttcaacactgtttcactgcactttatcgcctttctttctaaataaaaatactgcacatccatctttcaagaagttacattagaatgttatttcactgtttataaaatgctttcatatgtaatcctaaattacctctgttttccttttaaaagcctaacatttcacccttcacagattgattatttacttccatttttgaaatttaaaattgtacagttaacttgtttagacttaatgtttctaaagcaagattctcgaattctgacatgaaatatcttcctacatatctttgttatttgagttttattttgtttggttttcccaatgtctgagcaaatcttgattcccatgatgactgttaaattagtatcagtgtctgggttcatcaagaaatctatttaagttggtctagaaagaaaatatacattagcacatgccaatatgattatatattataatttttaaatggtataaatataaaatgagaaaggcatttaaagaaacatgtcaaactatgctgctctaaaaaacagagaacaccagccttagcttcattgtttagagggattgtaatactggaaactctacctcattggaagctgggcttcttcctcacatagctttgctttctgcatcaaatgacatccaatgaaatcataaaatggtatataatgccaaagcatgctctaaaaccattgatgctggtgtcccaaacatgtttcaagggactctgcatcaaaaaaggataagaataaacctttgtcaaagaaatgaagagagaggaattgaaggcaagtttgacaggagtggtttagggtaggatagactatattcccctgcagagatgagcactgtgattcagggatgaaaatgatgtttttaacaaactcaaccatttaaaaaatattgtcacagcaatttgaaattactcttcaaaagtagaaaatttatgtggaatttagtatgaaataatacttatctaaatgtagttataactggattcttaatggtctctagctgttttaggccatcccagaaagaagttaatttgatggcttaaaagtgtcatcttctattcctgattctaatcattctgttgaggctatttttaaatggtgtagatcattgttttaaatggtgtagatcattgttttgttttgtttttcctcctaggatcgttgggttaggaattttaagggatccaaaacattatagagttaatttttcttgtttggcaggttataattacataattatagacgagaaaaaaagagaagaaaagcatgtccctagtcctggtgataaataacatattggaatattttatttcaattcagacaacttcatttattcattaaatagtaaaattaaagtcaatctagattatgtgtcagataatttacaaagcattactatagctgtaaagactttaaatataatcaacatattttgaaaatagttcccattttcaaattaataaagtgtgctgaggagtccttcttccagaatttcttgaaagaagaaattctgcatgaggttaagtcatgaatggaaactacttttttttttttttttttttttgtgagccagagtttcactcttgtcaccgaggctggagtgcagtggtgcaatcttggctcactgcaacctccacctcctgggttcaagcaattcccttgcttcggcctccagagtagctgggattacaagcatgtgccaccatgcccggctaatttttgtattattagtacagacagggtttcactatgttggccaggctggtctcaaactcctgacctcaggtgatccacccgcctcggcctcccaaagtgctgggattacaggcatgagcaactgcacccggcctgaaactacttttaagatacatatggattactaagctagaagtctctttatgcatgtggcaggcaaaatgtaagatggaccccaatgatctctccacttgtattcttagatttgtgtatttccttcccttttagtttgggtggggcctgtgacttgctttctaaccaataaaatgtggtaaaggtgacgggatgtccatccatcattatgttacatgagattgtagctttcatcatgtcagcagactccctcccttgctggctctgatgaagcaagttgccacgttggtgagatggggagatccacatggcaaggaactgagagtggcctcaagccaactacccacaaggaactgaggcccttggtccaacagcctaaagaggattttcatcatgccaaaaatcactgaagtgagtttggaagtgaatccttcccaaacgagctcccatatgggaccccagccctggccaaaacattgcagcctcaagagagaacatgaaaaagatgaccaagctaagccatgcttatatttctaactcacatgaactgtgagataataagtgggtattgttttaagcaactagctttctgggctttctgggaatttgttatgcaacactaggtaactgataaagctaatgtctatggtcggcagaataatgatcgcctgaaaaatgtcctcatactaatttccagagtctgtgactttctttgcatatatgattaagtcagagatgagatgattatctttgattatccaggtggacccaatataatcactagtccttttaagttaaagaggaagtgaaagtcagggaaagatttgaagatgatactgctggttttgaagatgaaggaagggaccatgagccaaggaatacaggcagcctctagaagttgaaaagtctttagaatgagtgcagcccagctgacaccttgattttagcccagcaaaactcattagagacttctgacttccagaaatataagatagtacatttgcatcatgtttaagccactaagtttgtggtaattcgttatagcagccataggaatctaatacagggtctatgcttattagcatcaaggatgactaacaagagtccttctccagggccttgcctgctcctaacagctactgcactgaagcggtgcatatcagcttccctttccagagtgaacaaataaattcagtgccactgagcattgctctagagaaaattagcatttgtcccacagccttatgggcctattcattctcccacccaacctaccaccttacagttttttgtctgacaattatccctcattctcttgtttactgttttattgtttcatctcaagattctaagcctccctgtcttagtcaaagggtgtttggactcaaataatatgatctaatcaaaccagttcatcatgctaactgacttcaaactatactacaaggctagagtaataaaaacagcatggtactggtaccaaaatggatatatagaccaatgcaacagaacagaggcctcagaaataacaccacacatctacaaccatctgatctttaacaaacctgacaaaaacaagcaatggggaaaggattccctatttaataaatggtgttgggaaaactggctagccacatgcagaaagctcaaactggatcccttccaccttatacaaaaatgaactcaagatggattaaagacttaaacgtaagacctaaaaccataaaaaccctagtagaaaacctaggcaataacattccggacattggaatggggaaaggcttcatgactaaaacaccaaaagcaatggctacgaaagccaaaattgacaaatgggatctgattaaactaaagagcttctgcacagcaaaagaaactaccatcagagtgaacaggcaacctacagaatgagagaaaattcttgcaatctattcacctgacaaagggctaatatccagaatctacaaggaacttaaacagatttacaagaaaaaaacaaacaactccatcaaaaagtgggcgaaggatatgaacaaacacttctcaaaagaagatatttatgcggccaacaaacatgacaaaagctcatcatcactggtcattagagaaatgcaaatcaaaaccacaatgagataccatctcataccagttagaatggcgatcattaaaaagtcaggaaacaacaaatgctggagaggatgtggagaaataggaatgcttttacactgttggtgggagtgtaaattagttcaaccattgtggaagacagtgtggtgattcctcaagggtcagaactagaaataccatttgacccagcaatcccattactgagtatatacccaaaggattataaatcattctactataaagaaacatgcacacgtatgtttattgtggcaccattcacaataccaaagacttggaaccaacccaaatgcccatcaatgatagactggataaagaaaatgtggcacatatacaccatggaatactatgcagccatagaaaaggatgagttcatgtcctttgcagggacatggatgaagctgcaaaccatcattctcagcaaactaacacaagagcagaaaaccaaataccgcatgttatcactcataagtgggagttgaataatgagaacacatggacacagggaggggaacatcacacaccagggcctgttgggtggtggggggctaggggagggatagcattaggagaaatacctaatgtaaatgacagattgatgggtgcagcaaaccaccatggtacgtgtatacctatgtaacaaacctgcatgttctgcacatataccccagaacttaaagtataataaaaaataaataaataaataaatagaagttgggaataagtagagcacgcaggtcttggagggtgcaatcataagacaactatattctttccccgcattgtccacttataacagctccccagggccagttcctccaagccctcaacaaaatctcaggtagttcccataaacatattgaacaggttcagaaagttatccagtcacttgtacacttgtaatcacaattaacacttgattgtcatgtaatagtcaaaacttccaactccacaaaattcctcctttttgcctagttcaggcctaggaagcctgcagtgggttaaggggcattgtcaatgttttctctactgccccagcattcagctccttccagattgaaatgaggccaagatggtgaggtaaaaggcaagaaagttctcacttgattggcaccagtgtaatccagcattactttcttctgtccgtggaaggtgatgttggtggactctttccttgtgtttgctttcatggattcctggaagatttctttgttgagttactcctattgcagcccgcttgtgtcaggcagaaaccaagggcgggctatgctcagtgctccttggattctgtatatttctgcgaaggccctctcatccctcaaagtagctcagttgatcaggaggtcccaggccaatgtttctactgcatcttccaagagtctcatactttgggcctgcctcagtgtaagggtagtaactgcacaaatgtagcctctgctctttgagcatgtgctgcttctgacagcctcttcctgctgccttttttttcagtttgtaatgaagatatgagtcagatcccaagatgagtaaggggtaagggttccaaactctggttttcaacacctttgaaaatcttgcggcacccttctttggcatgtgggaatgattggcatgtattggcatggggcctcagctgattctgtctcagttcatcttagcaccctgtaacatatgaacacatatggcttccatctttttttccacctaggtttggattaggagtcctaagggatctgtagtgctatggagttaattcttctctggaagatgatgattatgtacttaagatgagagaaaacaaaagtaaaagctctttctcagaatgatgatcgatatcctgctgagatcatttatgtgaatgattttatttctagcaaaatggtgaacaaccagccctcaggaatggtggaaaccaggactgttcaggggattactggcatctgtaatgtttactctggtgctcagtcgtgaatgtgacttggctcccaactctcttagtctctgtgtctctaagttctgattctggagaaaggatatctgattggctcattccaacattcaggtccaatgagctgggcccattgcttgctcctgaggactctgggatcagactcagacaggacaagccaggcagggcagatagttccactaacatggctaccacgctcacacattctttggtcaatggggttatagagcatttcttatctgataaacgtttcttgttgcctgtgaacgaggaaaacttgaacaaaaactaagaaacagtgctttgtttctgtttgtgctgctttccacatatttgtctcatatctgttatcctggagatggacacccagtttgcctctgacacttcacccccatgcattctgctgcaagtaacatcctcatccacctccccttaaaggctagcagcagaatttttggggggatataaaaccagagttgactggcttggtcatggtgcttgtgacactgaagttgacctattgaagctagattgcttccccaaactgctacacgtgtgtatattcccaccagcaatgcagatccttcatcttatgcactgaattctcatttgattgcactgttgctctgtccactgcagtcattgggctccctgccagccttggtgactgggaacttgtgggagcagactggccaccatcagcactgtgctaccttcctgcccccaccagcaccatcatcctaagtgttcagagtcttcctggagttttagttctattactcctttccctgccctcttgattcctctcttcccctaccccactccccaactacatggtccagcccagccagagtgagtgggccgagccacaaatcagttagtgctagaagtgtgatttgcagtgacttcttccagggaacagccttgcaaaagatctccttccccttacttatgtgggcaataaatcagaaaagcaggtaattaattacaacctaaagtagaaaaaatcagctcttcttcaacaaaatggcaactgacctttctcctagtcatgatttaaaaaagaacaaagaagggaagaaagaaaaactattataatccataatatgatttttcctcaagggtttgagttacgtggagggaattagataaaccattatattacattgttctgcttttagccatgaagtgcggcctattgtgagtaatatttcccaaccggtgcctgtctgaaatatttatcagcccagggtcctagcattgtgaccagggacttactaagccacacagtatgggaaccgatgtttgctgggatgctatttttttcataagaaacctacaataacatttttgtctctggatgctgatcctgagaggtaatgacgttccatgaactgacagaatttttaaaaatctcttcccctgacagaaaactacagagaaatttttaagcagcaaagaaaaataggctaaaggaaaatcagaaggagagaatcaattctgagagcagcaaaaaatatagagatttgggtgatgcttctaaaactgttcttcccttcctgggttttattttaaggtcctgctgtttgacagcacagataatattgcccaatgtaaacttactaggaagctttcaattgggcagtttgttaaactcaggaaacgcttcattttggcttttgtgtggtctgaaagcctacatctgagctatttggtttactctatcctgggagtccagggagcattcactaacgcatcacacattttgttttgaaagaaaactcttactagttagagtccgggctcagtgcatatcataaatatgtttgtttttctctcttacagaagctgcaaagaatcgatactcctcactgtcattcagccttaccctgtaagtgttctgtgaataaaagtgccacttaatgttctcaggcttcttgtttcttctgcccactccagtaaaaccataatgatgaataacagcagagaaaaataacatgcactcacaatatgggttcaaaaatcttgactatttttgtaatttatactccatgttagcaaagtcattcattgaagagaaaagggagtaatacattttctaaagttcttgaaagacaaccagctattccagtcctatgcaatggtcacatttgtaaatgacactaaattcaagaccttcttatgcttttcagcttaagaaacacaaatctcatgagactatctaattgtaggaggtcgatgcatgattgttattcttatccccatctatttggcagagaactggatattttagcaaagcctgctttaagaatagatgttatatgacatatggtgtcagaattcgatttcagctatcatggttaggagggtggaaagtgatttaaaaactggacagttcttgtgatttaaaaaaaaaaaaaaaaacgactttatcatggtataatctgcgtaccataaaattcatccattttcagtgtacagttctatggtcttcataaaatccactgaggtatgcaacgatcaccccatccagttggaggacatttccatccccccaataagatccctgttcccatttacaattaatccctgttgccacactcagtcctaggcaaccgctaatttcctttctatttgtatagacttgccactgcttgcaaatttcatacgttgtcagttgaactaaaaattaccgaggcaaattcctttagatttttcccaaaatggttcctgtcagtctggccttcgtaaggagtggcagcgattccagcctgcttaagctcctattttcttccccatagagttggagcatttctatatcaattaaagtgctctggtatttgctgatctccatcttctgaccaaactcttcatttcccctgtcccagaatttttcccctaagctctgtgggctaggcattttagacaggaaataataaggatcaggattctgataagaccacaaatagaactaaccaagacaacaaattatgccatcttactatgcatatttatattaaaagctcagtttaatattgactgtcactgttaactccatctctttgacagaacttacacacatacacatacattgggatttgaaaactaaggaggccccaggatgttagagaaccacgacttgagatctagctcacagcagtataacaaacgagtcagcagtgactaccatagctgctcagaaccttggtctccccaactgtctgattccgagattccttccatgtgcttctataaaaaatacagctgggctgtttttagattgttttggttaatcaaattgtcattttcacttacttcacatctatacacatttcttgatttatttgcagtggacaaattcatttgggtaaagccaatgtaaatgtctataataagcatcgaacaactataaattgagattgaacaactataaattcctgatggaacttcacgtttgcattgtcattcctgaattctctttctatattgtataatctattagaaatgcaagatcaggcaggacctttgtgttttgttttttgtttgtttgtttgtttgttttgcaatgtgggatactgttttacctcatgcagtaaacttagaaaaagaaagaagagttttacatgtaagtttatggttgtgtcttgtggctttacttgctgtttgccactggagtccatgtgacttgttattcatttgaatattgattactatcagtgaatcatggcacttccttttaacagataatctggaattttctaggagttccgatggctcttgccgttgtgctacattgaaaggcaacacttagccacaatattcaggaggaagtgtcacatgttcttatagccaacagctgtacctctgctccagagtcactttccccttgcccaatcaccgcagataaattctcatctttgactttcctttgaccactctcctttgagaaatgactccagtcccaccacctcctcggcctcgctaaataaatccttctcacctttcaagtctcaggccaaattataaatgctacctcaaggtttttcaaccttggttttgttgacatttgaactggagagttctctgttatggggacacgtcctgtgcattgtaggatgtttagcagcgtccctggcctgtacctactagatgccagtagcatcctctccccaagttgtgacaaaccaaaatgtctccaaacattaccaaatgtcccttgggagcaaaattactcccagctgagaaccactgtcccacctaaagtcttccctttactgttcaaatcccaaatggcttttctctcctccgaggtgtggaagttgaaattaaagaattaaaaccccaaagtttcttaaatggatatcagacatggagaggagagcagatgggaaaaaacaagactgcaatcttttacttatatttttgggtttggattttactacaagcaagttgctttttgtaaaaaaaaaaaaaaaaaatacttattgagtttcatttatttgttaaacatcttcttggcaatcaagactgacaaacagaaacggatgacccagcagaccaaaagaaagtccataagttctacttttattacagacaataaaaattagcattttaatttcttttgcaacttgctggacagcatttttaatgttgtatttcttctgcataaggtccagtaaagatagagagccaatgtttataccttccggccacattccacatgtgcccagggtacctcaacatgacccaactgcagaaattgatctccaatgagacctaggtcaagggggaatgggggtgagagtcttgggatccctgaaattctttgataagaagtaattcttaataggttgctgcattttttaaaaaaagtattatggtaggctttccccaccaccacgatttttactgtttttcttgggaaaaaaaatactaagtggaagtatagaaagaaatacagatgcagaaaaatgtgttggcaaacttttcccgcagagacaaccagtgtaaacattttgacctatttccttccagtctttttttctatgccttagttgagatcatattgtacatataattttattctgcctcttttactaaatatatcataaacatttcctatgtcatcaaaaactctttataagcatcacttaaatggctgcaaaacattacactgaaccaagatttccttaaccaacccccatcactgggcctttcacatcgtctttattgttttgctattataaataattccgaaaagaaaatctttatgtgtaagtcttaatctgtagttagtatttccccaggatggaattttagaaggggaatttctgggttactcatgggttttatttgtttggctccgatataccgtcttctttccttgtactgttacccttttttattatagatctttcattggccagctccttccttttttcctttgactctgctttctacagtttccaagtctagaattccaaagccaatcttacctgagacagagagtatttaaagagtttctacggctgggcatggtggctcacgcctgtaatcccagcactttgggaggccgaggcgggcagatcacctgaggtcgggagttcgagaccagcctgatcaacatggagaaaccccgtctctactaaaaatacaaaattagccaggtgtggtggcacatgtctgtaatcccagctactagggaggctgaggcaggagaatcacttgaacctgggaggcagaggttgcagtgagccaagattgcaccattgcactccaccctgggcaacaagagtgaaactctgtctcaaaaaacaaaaaagagtttctacaacttcccctcatgcaaccccaactcaatgggacttgagctaagtcattctctcagttctggtgtcccatgagctagcataattcacattcctttaggtttcttctagtccaaagagctgagggacccgctttcctgcctccaacttcctaactacattttactgtgttccacacagctgagagaggctacacacctcctcatggaaaccccagtgtagcacattctatcagagcccagaccatatgtcatgctgagcataccagcccaatttccaatggagaacacctgtgagtctttgcctgtgggctcttcctggccccagtagcatgctcatggagcaggccacaagtgctgaggaattatcattcccagaaaggctgtgttttgtgttctcttacatggtggtcagtcagatgtagccacaagaggggacacaggagacatgcgggaaaaagaagttttttttatactcacaggtcctagagaaactgcatgccaagaggaggggtcatatgagagggagcaccaggggagccgattcaaccaaccaggcggggaccagacagagaggttagagcctgtgggcaaatgcctttatcgggggtcagggtggaacacacaagaaaagtgcgagggaatttcattggtctctttaaatgttactaagtcacagtcaggggagggtgggaaagagtacttgtggcaggagctaactttatcacactggtgcacctggttgcctgggcagggtgctcacaacctgtatgtggggatgttgaggcagcaggaaaatttgaattttgaaaacttacaatacaaggagacactccatcaatgattgacagaaactggtggataaataccccagctccctctctcctcagacagtataactctgaggcatgtggtctaccttgtttcccagaggttcccagcaggagtaagctccagttgcctataatggtgccttagtaacagcgaatgctttactggtttattctcccttcctgcctgccttccccactcacctacctgggattcctgtgagcacctcccaaatcagctacctgtttgtgaatccttgtcttaggtctgcattttggagactccaaactaagccaaccagtgataactgtaggcgagtcttcaccaaatgttcactcaatacctgctatataagtaatactgtacagctctaggaattgcaagttcaagaccttgcccttcaatttcagaaattaatcttatttctgtaattttttcaagctatgttctagtaacttctaagagcattcaaaagcatcaggagcattccacacactattgtggccatcttagcaacagcaaatttggaaaatgtacaggggttgattaggggcctgataatcttaaaattaattaacagtaggagaatctgattattctaaatgataattacttgttatttccaccacaggatatgaagtgcttgtgatcaacacctacaggttgctcagaattaattcagcaggctttcaagtggtacacattgtatattttttgaaagcaaagataaatctgtgttaaaactatagtcatgactggtttacattaccccatataacacaagtaactctagccagtggaataagccagtattttgttgattctcattaagtagccttcagacttggagagcctatgtagttgttatccaaaagtaatttccaaaacatttgtcagttttatgaaatagtcacaaacccagaacaaaaaaagtacttgttatgaattcttagttagaagtttaccccgagtctgttgacttcaaattgtgtataaaataatatttacttaacaaccttggctatttagtttcctttctggtcttcctaaattaccatgtttctcattattgcatcgtaaataaatacaggaatgaagttacataaaatgggcatgctacatatagctagagagaggagatagtacataaggttatttgcccctaaagtaaatagccccacgtttactggcctcagcagggctagtaaatatggggctatttacttcaggggcaagtaaccttacgtattttcgtgatccctgggaacaccatggcactctaaggttatatcaaatgatatgcatccgaaaactctatatttgttattgaagcaaggaattagatggaacactttagaaaaatatggcaaaatataacatttaaaaattgagatgcatagaggaataaacctcagtatctggcacactgaacacacgtgaaacatttcattcccaaacaatgctggagaagtgaggtgtgactgcattaaaacatctcatctcatgagtagtgtctgttctgggtagctttattacagccgcttcacttgtgctcaactcattgtgccaatgtaaataccgcctgcctaaaatcattacgggagaataatgttttcccttcagctaaaaaatgaaatatcaaaagcaaatgcgctcaccgctgtatgatttgctcgttaatcattactaaagttggcctataattacaaagatactgatgagaacaccctgtcacatcacttcagctctgcagcaggacttttaaaagtcacgttgagcatgtttaaagctattctttcggtttcttgctgttgtctgtttgtttgtttgttttttaaagacggcagccattctcttaaaacatcttgcataaatggatgaattcaagctctgggagacaaatcatccatttatccagtcttctaagacactactcacagcaaaggatgggatcggtgtggaggggaactttagaaataacaggattctcctggtattaaagcaaaaactccatccaggatacacacacacacacacacacacgcacgcacacacacgcaccccacacacaccttgtatcatacttttttcaacagcttttttattacagtaaaatacacataacataaaatgtaccattttaaacatttaaaagtgtacaatttcgtggcattaagtacattcaaaatgttttacaaccattgccgctacctagttccacaactttttcatcaccctgaaaggaaaccccgtattcattaagcatcactcctcattccctcattctcctccacccccagcccgtggcaactactaatctactttttgtccctatagattagcctattctggacattgcctgtaagtggaatcatgcaatatgtggccttttgtgcctggtgtccttcacttagcaaaatattttccaggttcatccatgttgtagcatgtgtcagaacttcattcctttttatggttgaataatattttattgtacagatggaccacatttgatttatctatttcatcatattgctttttaaatttaattgatcttaagtatacttgtatttgacaaggatgagagtccttttttaaattcattttacttgaaaaccaaagtataggtcaccctagttggcttttgtatctctagattagtacaataaatagagggttaagcctctgtgttgtttctagagtcaattactagaattctttacgcaacagcctctatgtcttaagactacatagcatggaaaacgttagtttgaaccataggcaattgccaatatttgaccattttcatttataaaataacaattatatgattcaaactatttacctctgtattaggtttcatagagaatgtaattctttttaaaaataaacaaacaatgcctgcaacatagtagatatgtactaggtgtgagttcccttccccttaggcttctttaaaattatgcaacaatggtgattctcagataaagtgactttaccaagatcatgcagcaagggatgccccagtatcacagcacccttctaggcaggttctcccattgtacttccaatttctgaggaagaattgtgccacattgcccctctttctgataaaagaaaggagagaatcataaagcacaaagagcccataagatgaggaagaatatgaagtcaactttcaattgtaatgaaaggtctcgtctctaccctgcccagtaagatcacaggatcacaagttaccaagaagaggctaaaactcaggttgcaggtgcataaggcatgagtgcttgagagagaaagagagagagagggagagacagagtacttgtctgctcacatgcccatatgcccttaatgtgaataacaataggattatgaatcattttaggactatcaatggctcttctccacctcattaaaatagatgattaatgatcaattcatcataaacccaacattagatctgactaccacctcaccttgaacactgtgctcaaagctctctattaaaagcagagtttgtgtgcttttgcagccattgttttaaaacatccctggaaatgtgctcagttaaaacatggaacatagtggtggtagttctgatctggccactaaatcaaacttactaacttatagacatgacagtgttttgactgcatctataatttgcattttgtccttgaatcggacatgcaccaagcattttatttttaagcaaaattattgcatacctaagatggaaaacaactgttacaaggtttgcattatgttaccagtaatcagataaaatgttttcttttcttctagtctcccaaatcagcatttattagtgctgcaaaaaaggcaagattaaagtccaatcctgtcaaagtacgcttctctgaggaggtcatcatcaacggccaagtgtcggtgagtttacagtcacctgctttgtgactcagggagagtcaatgaggcagaagctttgcactcaaaacaaagtcagtagtcccactggaatgactgatctgaaattggttgttggtttttacagaggtgtcaaatctcaaggttgtaaagggcttgagagttcatcaggttgggcctgaatctcctctagcacggtcagaatatgtggtagtccaggatttcctagaatgctttcagtgtcagagacatcactactttgcaaaggagttcatatgatttgggatcactgacactgcctcattcatactcagtaaaatatgcgtctttgaaacttccacctttttcttcccattctgctaaataagcattcttccatatgatagtgctttatgtatttttgagaaaggtattgtgtttctcctttttacttccccagaaaagcctaatctttcaactaatcaggcaaagaacttaaaacgatggaaaaattttatgtaggcaaccagaactgaagaaatactgcccacatctccataaataggtcctgatagaaatcatgattactcaggcaattaactgaacttcagaatgaataatgcaactatcaacaggatgttttgactttttctcccaaaaatatactgaagtgttttcagtttttagaaaactatcatccaaggcactaatattttttggacctttgaaatgccagagcgttggtgttctgttggtattgtttaaataaatccacgaggataaaatctcacctatgatatattcattattgatcacaaactcttctctgaggttggttctggatctgaatctgaatctgaagatgtaggcctatacatcctgggcaaggcactcatgctccaactgtctttgaatcaaaacttactgatctagggctgctccacttggggtccagctattgtgatgcttgtggggaaggctagaggctgtggctgtgctgccctgtgagcatggtctgttctgtgcctctcaatgtgtcccatcactctggatgcacggtcactgtacattattaatttacaacaagactgtcccagctgaagggtggaaggtacagaggaatcaatatgtagcagaaagtcatctgaaacttaccttttctgcccagagctttcgagcgtgtaattgggcaaccaggtagtttatgcatctttagaaagaatatgattctagaagctgctacagcagtgtcagttcatccctggatatagcaggactcctgcaaggcagctgatgtgtaaggacacctctgaggataatcatctcctgaagcctccacagccctgccacaggcttgtggatggcagggatgttcggtcacgtggatgctcctcagacttcatgactgtcttcatttccagtttacccttgctcttctgagtcactgagtgcaatttcttctggactgggatccagatttattcagtgacttgagagcaagactgtgcgggaagtccacaggagcagaaaagagggggaggaaattcaggaaaagaaataggaagtgaaaggcaggaggcctattatggaaatacttagggactgaattctctctgacactggcaaattcctgaatatcttgccttcagttccttcatgtgcaaaacaagggatgtgtgcactcatgactgctgagttctcctcaactcctaggactttatgaccaactacatgtgaataactcagctcactcctgggacttatagaactcattcagtgtgcccccttcctccctctttcttctctctcatctctcactacttccaatgaaagaaaaaatgcaaagaaataacatttctattgtttgctttttgtcatgtttcaagctggcatctttttctgagttatttctagattatgatcttgttcattatagacaatgttttactctcttaacacactaagccattccttatcttttcccttggagttttgttttttgtttttgtttttgtttttgtttttgttttgcagttgcaacatttaatagagttcccttggagtttaagactcattcctaactgggtgaaaatactttcacaaaataactttatacttgaagcttatttatgctggtgactcaccatcatgacactgctaggcaacaacagtacctcatcaaacagcatcattgctggtcttttttctgctcaagacgtcctgccctgcttaggtctgggcttgtagttccaaatgtcaaagcctaatcacaaaagaatcacgtctgcaatcatgtttgccagtggggaatcttgagttaaaaaaacctcatctgattgattttctgatgagcaaatgtatttttctatgagcaacttaactcacatatcaccaaaggaatgccttgttggccttagagagtttgattgttttttaatgccatgcttagaataaagtatagatgtgctgctactgcaaagagaagagttataatttgatcaatttatgccctgcccttttttttgttaaacaggaaactgttaaggacaactcacttctttttatgccaaatgttttgaaagtctatctggaaaatgggcagaccaaatcatttcgttttgactgcagcacttccattaaggtaagatgacctggtaaactctgtccctggacgctttcaggtacaacatgcaggacactgtgagccattgtagcagcatcttctttcagaactatccctttatttctgcagttttgttgattgcctccatataatgtagtctgtgaatacttcaaaccaaaccaaagccaaaagcttaaaccaagaaggctctgctcttttatttctcttggtgttgcaaaacaatataatatgctgtcagtgaagaaacactagagctagtcattttgatgcaactacagattaattaaaatagtgtgactatcaccaagaaggcttggcaccctgcccaaggccagcatgatttctcagcaatatcagctgctcagaagattaagctgttagctgttaattgaatatttgctactttggtgtccagcaaaaaacaaggggtagagtaatgtaaaagtaacatttacttttaatttctgtaaccaatttcatggtaatgatgcataaagaggcagaaatgaggcctgcttcttagaagaagggctggaaaggaagactcacaaagcaatcctattctttcagagccacaggtgagttttagataataggtattatagcaaagcatatggtttttttccccacatgctttcttcctggaaaagaaaagtacagagtctcttccttttattggacaaaagtgtattcagaaattgattgctccctaatgcttcatcagcctaaaataggctttcttcccatggcacagtaaaaaagattttatgaaggtaaaagagtacctagtgattatctgtataataatctatcaagagaatatcaaccctctgttaaaaaatgtctatcaatatccgacctctaattcttgttggtttttttaattaatcagcatagacctcacacatagaagcatttctgcaaagacccattcactgtgtattcttattgtcacgataccagcaagcagctcgttttgaattgctataagtatgtagtggcttaatacgtcatgcagtggaaaatattagattgatgttggagcattaaatcatcctcaaatcattccagatgaaatattaacttccttcatacaagacttctaattttaaatggtgatgactggacaggtcttcttccctttttcctcattcattatcaatttgtggtgagatgttaatataattattgatcaactaacccaagagtaggcaaactttttctggaaagggctagatagtaaacattttaggctttgtgggccatttgatctctgtttcaactactgaactctgtcattgtatcaggaaagcagccatgaacaggtgggtttggttagtccttaagacaatgctcagtcttgataattcactcaaaggacccacagaactcagcaatttgttatactcacaattacagcatattatagcaaaagaatacagaatagaattagcaatgggaaaggctcatagtcagggcacaggagagattgagtggaaagcctccagatgtcctcttccagtggattcatacaggtaatgcttaattctcccagaaatgatgcatgacaatatgcatcaagtactgccaaccagggacgttcacccaagccttggtgtccagagtttttattgggggttttccacgtagacacagctaaccacctgcatggttgaacttagtatccagtctctccagagttagagctgataccatatggcccaatgttctcactataaatcaattgttagcgcagactatctggtatggcccaaggccacccagtaaacaaaaatactcctatcagacaggacagtccaagggcttacaggttacttcctaagagtgggagaaaaagagcaaatttttctttaggcaaggttaatctgttacttcacagtcaatatgtgaacaaatgggcatggccagatataacccgcaggtcatagttggcagacctctgaaataacctacagagctacattattacagccctttctgacaccatggccttgttttgtgttgccaactggtcaactccctgccattggactccctaccccacctgaagaccgaggtaaagacttgaatgcatttcttaacagaaataaatctaaattgaagaaagccctgttgtccattccctccagcctctttattacggaacatatgcaagactaagtttgatttccctgaggattgcagatgacaatgagaagacaggaagaaatgcaaagagttcacatcaaattcaagttatcttatcttatacctaacagcctcattattacaatagacactggctggtaggtgtaaaggagaaatagtatagttatgaaaggaatatgacactgtgtaacaaaaattgccaaaattcttgctgcagaattacaatagggaaaaactcttgctattgattttccaatgtcctccctggtggttcaggaaaatgctttataaagtatttgttgccacacaaaggctggttttgttttctctttcctgggctttaagagaaaattataaagcagggaaatctttttttttttttttcttgaaattcaacatagtcaaggcatttctcttgaatgattttttttcaggagtgggtggatgtggggatctttgatttaatggggcctgaagaaattgaaaaaggaccacagagaaggattaaaacatcagaaaagtcagtaaaagaaaactataagttttcactctaaggtttccggatcttgacactgttgagatattgggccaaatcattctttactgtggggctgtctctgcattgcaagatgttgagcagcatttctggcttctacacactccatggcagtagtgtccccaaccctattgtgacaaccaaaaatgtctccagaaatttccaaatgttgcactggggcaaaacttccctatagaatttttagcatctgagtctaaattatcttcgagggatcatttaccagttttcaagtacatgaaaaaagtataggttgaagagattagttttacattgtagtaaatgtgtgtgtttgtacatggaacacctttctgatcataaatgcttaatcctataaaagattgctgacaaagcttgctcattccaccttccccagagatgtaaaataaatatatgtatattattatggtgccctcactctgtgccaaacaatgttataataaacgctttgtatgtgtgaactcatttaatctttatatccgttctgagataagcattattattatccccagtttacacacagggaaactaagatacttagcgactaaataacttccccaaagctgcacagctaataagtagtagagctgggattagaagcctaactgttttcttagcccctattccttacaaccactacactgctctttcagaaggggaagccagggtcagcaagcagatatttcagtcttcacagtctctgttgcagctactcaactctgctgatgcagcacacaagagcagccatagattttagataaacaaatgggtatgaccacgtcccattaaaactttatttacaaaagctgatggtgagctagttttggcatgcaggccatgttttccaacccttggggcagaccactttcagaactggtttaattgctaccccatttagaaaaaaggagaattgaactggctacactgcacaatctattgacaacctttctatatcaagagcttacatgatattaagcttctcctccagctatttaccttgttaactctctgttgtgaactccataaagattttgaatgatcgaggaggccaggaaaagggcaagagaaggaaggcttcatttctgcatctttttggatatttggagcattaaatttcagaatcaaccaaacgtataaaatttcaagattggcagcctacatgtgtaacacttttcagtcatggtagactccacaagatggcagcttcgattttggtctcatcatgttcatgtttcctctgtaaggatgtcatcttaacccttcaagagaagctctccatcaaaggcattgaacacttctctctcatgctggagcagaggacagaaggggctggaacgaagctgctcttgcttcatgaacaggagactctaactcaggtctgtgaaatctcaccctcaagtgatgaggctgcaggttagagcagaggttgcccagtccaagatttctcccccactctaatcctgtaaatgtattaattgtatccctgggtatcctctgtaaaggaagtgctggcattcttaatgcattttacacctcaaggtcatgtttccctttctgcccatcttttgcagactgtcagtctcacaactagatttgtcattcaaagtctcaccagctgcacattgagaatacagctctgtaaaattatattttatgggattacagtgatctgttcacctgttttggtcaacaatctcttgaaaccattaaaaagaaatggtttctgggattacttaaattaatccaaaatcatatttagttgtctgaaattctgggtgcatacttaagactatttttggaagcctgaaatctctgccccagtcctgcccgctataaatatgtgatctaccaatgtgtcccagttcctgattaccaagatgccacccccatctgttccctggggagacaagcaggctgcttagctgctgaattcagcgcagcaccctgatttttcttgtgacacaagcaaagtctttgttgaacgtataaaagatttcaacaaatttctcttccataggagagatcaatgataacagaactttatggaaaggggtaggaggggacaccaggaggagaagcatcagatgctgccagctggatggagtggcaaaaagtgttgtcatactaaagtgcttcttccttgttgtatataaaagctggtgtcccacacattgggtcctgcaaatatccccgattctcttgattcagtccaactttttgtaatagattagttcaaaagttgccatctgtgatttatattcctctacccaaacttggcttattatttccatcaagttttttggggttttttttgttgttgttgttttgttttgttttgttttgtttttttgagacagagtctcactctgctgcccagagtggagtgcagtggtgcaatcatagcttattgcagtcttgaactcctgggctcaaacgatccttccaccttagcctcccaaagtgctgggattacaggaatgagcccccatgcctggcctctattgagtctaaatctacctatagatattttaaatcacttctaatggttattattttaacctgtgccaaacactcttggaaataaaggacttattttatgcttcattacaggggcacaacccctgatatacagaatctctcatgtgaaaggtcagtgtctggatctgagttcctccagaggcagaacttaaggatttgaatgcatgtagtttatctgggaagagatatctggaaatacccacagaggaatggggaagagagatgagaaaaattgagaggccaataaagaatgtattatcaaaccagtttctactgtgggtaactggagctcagtcctaccggagagcactgggagacagtgtaggacgcacctcagaggtatcccaccgagaggcgagggagctgggacatgtgcctactgacatgctgtctgttattgatagtgggctactctcttgttattggggtttgccttgtgctatcgaatggtcacaggtgtttgctgtaaatatccttcagcttatagcaataaatgccaaggggaaatgggcagacatccagttactacgagtctaatgaaaccccccacaacgttttgatctttctggttatactttctctctaaacttttatctactacatagccattataggaaagcttcatgctgatttagttggacaaaaattctctaaaagtctcttctgatgctaggtaaacacaacttcccgctccagttacatttcttttaaaatgttggaaggaaataaacttctaataatcattctttctttaactttatttttccttatagaatcagaactagaagtgaagtgctaaaaatcaagtgaagtgctaaaaatctctagaaaagaaaacggatttaaatatcctgaaacaaaccagctatatgcctttgaaatcaatgcatatgaaaaaatcgattgctaaaatatttgtaggcatgataaaagtggagagtaagaaattatattttttccaataataaaatcattttaaaacatttaatttctatgaaaacctcccaatggaacttttaagcaactttacctgaatttctagtggtttgatactaaacttctgctagaaaacattatttatatactacttaaagtttccaagaaattgtttctgtttgtttattttagaaagtgttatggactgccatttctaatggcttgaggcaacctttttgcattacgttaattcatttcccaaaaccagtgtaaccttctgatactaaaagtaaactcaagataagatggcttatggaaaattcaagaaagaaaagttgaaccagtaattaaaggagtcagagatatagtgattcctgactttctaacacaccaggacaaaccttctggcaaaatagctcatgaagtcgctgtgaaacacaacagcaaggctggccagcactagtggcctcttagtgtccccaatttctttattcctggtttgctttaccctcagccagtgataagtagcccatagccctcaagtctcaggaatccactcggctctgcaggcctgcccacagccagaaagctggtgtgactactcaggatgcccacatatgtacaagtagggtgtctttttccattggaattcttctgttcaacaaagttagcgaactgtaaatacatacacatgcatgcatacacacaccacgggactcaataaagctattttattttaaattttttaattgcagctcacatttttgtattgccagatctgtcccctgcataagagtattacacacaactgtgttggttcatgctgcatggttttcattttgttttgttgactccttgaagggaaatcgatgagctcttgccttctttcttagagtccaatgtctttcattcattcaagtgtttattaaacacctattattatttattaattgatttccttttgttgcaaaaggaattaagaaacgaacttctagtatgtgacacatattatgctgtataaaatgaaaacaaactgaaatgagccatggtccttaaccctgaagaacctgtggtatattttaagctccattgagcaagtggaacaatatcatcatgatatcagaagtttggagtagtttgaatacttgtagaatctggtgtactacatgggccaaaacttctgtcttcctactttccaatgtgatgtcatctaaggttgacactatcatgttttcattgcaatagtcagtctggagtctaatttggaaaaacaaaacaaaacacagcaatgttatgcaataataaaccatactggacaatctctctgctgtctctttggatcccctttttgtactccccaacatagatttggggtgctatcactaacagccagcatctgcagatcttcttccaaggactgccctcagactaccggagcccatcgtgtccaaacctggaaactcacatcccctgggacagctctaaatgaatgactcatcagtgctcctttggctgaggtctcagcagctctgtggtatagctaccactccatggtctcctgcaggatcaggctatagctactctctgctggggttccctgaggaggcacccttgcttggcttcctcttctttcctgacctgcttcccccactcccttactagcctcccctgggagcactttcttaataagtcccttgcacacaacccctcatctcagggtctgcttctggggaacccaacctaagtggcaaggttatgtgtagttttcagggaatgagtatctataaatactaaaagaatatccgctgattctttccttagtgtccaaaaaaagtcgactgcttcagtgtccctcagccatttctcagtcagcactgaagggttcttgtgtgattggtctactcttccaggtgacacagaggcccagctcccataagatgagatgtcttttccgaattagcttcgtcccaaaagatccaattgaccttttaaggagagatccagttgctttcgagtatctctatgttcaggtatgttaaaattttggcatgttttatatcaatgttgtgatataaactaactctggggctttgccctgaattctttaacttgaaatctttcttttttgtcccccacctcaagctcagtgaatcgtacgataattctatgatgctctttttatttttacgtttgattttgaaataacatcatacttccaaaaaagttgcaagagtagtcatctatacccttcacccagattcaccagttgttaacattttaccacatttacttgctctttagtatatacacgttttctctgcccacacaaatacacatacaaatgtatataatttttttctaaaccatatgaaggtcaattaccaaaataattctggtttactcctaaatacttcagtgtgtgttttctaataacaaagacattttcttatacaattattatacaagtaacaaaatcaggaaagtaaacattgatacatttccattatctcatctacagtttatatccatattatgcctattatcctcaaaatgtcttttatatatacattttttctagaacaagatgcactgcaggatcccattttgcacttagttgtcatgtctctttaatctccttaaatctggaacattcctcagcccttttttgcctttcacgaccttgatagttttgaggagtactagtcagctattttatagaaatctctcaatttgggtttctctgatgttttcttatgattagattgatgtcatacattttgggaagaacaacgcgagtgactttgtgtcctcagtgtaacacatcaagaggcacatgatgtcagtttatccctttaatggcaaaatgaacttcgactcttggttaaggtgatgttctccgaattcacccaaaagctactactattccttttgtaattaaaaagtaatttgtggagagtcactttgtaactcttttttttttatttatttatttattttgagacggaatcttgctcttgtcacccaggctggagtgcaatggcatgaccttggctcactgcaacctctgcctcccgggttcaagtgattctcctgcctcagcctcccaagtagttgggattacaggtgcctgccaccacgcccagctaatttttgtatttttagtagagacggggttttgccatgttggccaggctggtctcaaactcctgacttcatgatccacgcaccttggcctcccaaagtgctgggattacaggcgtgagccaccgtgcccggcctgtaactcttattatcttcttcatcaaactctcacccactagttttagtactgaatgatgatttttttctttttttgagacggagtttcgctcttgttgccttggctcaccgcaacctctgcctcctaggttcaaaagattctactgcctcagcctcccgagtagctgggattacaggcatgcaccactactccaggctaattttgtatttttagtagatatggggtttctccatgttggtcaggttggtctcgaactcccaccctcaggtgatctgcccacctcagtctcccaaagtgctggaattataggcgtgagccaccgcgcccagccctaattgattattcttatctgaatccattattataattgtggttgaaaattatgatttttctaatttcattattgcttctgcatttattaattggtatgatgagagttttcccttctcctttatttacttatttgttcattcatttgatgcttaaattattctgtaaaattgtgatattcattttactgaattgttaatttcaacgtggtaaaacttgaagagaacagtcttttccagactgatatctgattctgagctataattccccaaagatgaaagtttccaggaatgagtatctggtgtagtttgtcccaaagggaatttatccaagttgatatttatgaggtgttcctatattttactataactgcttcctattactctcacttaaatttccaatataatcacattaaacagtaagaaccaactgacctaatccttagacagcttagacatctagcagtagaactaactactcgaagaggttgcaaatctaaacataacctccccctccccactgccagaaagagagaaaaaacaaaaatgaagcaaaaaaaaaaaaaaaaaaaagacacactgtctttgagaatatctgtataaggcaaagattgctggagccatatataaaagatataaagcaaaaatgtaagaaaaatataataaaaagaagcatttgttaactctaggtagttaataacactggtgtttgctttaccatttccaatactttcctgtatatttcaaaacatttgtaatcttcaaaagctgggtagaaaaaaaagtaggcggaagatggaagagagactagacaaggtaggtatcagaggttaagaatggtgacataaattaaagtggcaataagccctgaagatcacaggttaagtcagacaggaaagacacagaacatacaagaatgttctagcagatgggggcactcagggtgaggccagtcaaattttccccacctcagtggtctttggaagactgtggtatttacagctcagtgggatgattaatgttcatgaagataaccctacatcattgggaaaagtcaagtcctgttcaatgaaccctgttgaccaagtaaagaaatgtgtagtgtgctttaaaatattttccaccccgaacaacgaaactgccacgttttgggttttttaaatgttaagctttgatcacctggacccctcacttgtcaacaatatctccttgtccccagcaggcgtgactgcatgaaacagagcctgattctcagctgatctgttactgcatcttccccatgtccctgctgaaaaccaacccagggctttgctactgcagctcagatcatgtgctacattgttagttgcaaataaatagttataggcgctggtcagtagtcgctgtagacagtgagtgcattcagtggtttttctctataattatatactcaccccattcacaagatggtgctttaaaactattttactctgcttccatttaaacatcacgagtccattgcatttataaaagaacaatgtggttgcatttgtcttggggagaggagacctcttaagtagacaaggagtacagctaaacccagttctgtttaaggtgtgtttgcacaaatctaatatagcttagggagatctttcttattcaacagacacatgttttatacatgtgagactgtcctcagaacacgaaaatgtgtctggaaatcttgcccagggactaacagaaaaagactgaggatgtttctgctttcttgccttgggtataaaataggcagtgaattagccacctcttcaaggcatagccagagggggaaaaatagaaaaacaggtatggtaggcaataaagaccaaaataaagcaactgtcatatatcctccgctgaaacaggaaatcagaatgtctttgcctcagaccctcttctttgaaatgccttgtatcacagaatgcgtgctaccataagtctaaaataacatctaatataagtcaacagatctgcaaatggtgtctgggtgcccatgttgatttcaagatactaaaaagatgcaataaaacaagcctagagaacaaaagagtaagcaggagcaacatgtatcactttacaaagataaaatcaatttaacttagtgggctcctaatgaggacagtagccattgactagatgaatcatgaaaacagaagttgcaatagtaatatctattaatctcctagttcttaatggtccatgacatattttacagattttagcatatatattaacaataaatgctaatagtccagattgttcaaatttatcattacaacgggctatactgacatttacctgtccactatctgttaagaaaaagactgttatgtcaattagcaaatgagtaagacctaagaggctccaaaatgttttcaaatactatagtactattggtttcctttttaagatctaacatgttagttataaatgaacattctggaagcctcaagtggagccttttgggacctctatttagcaaaacagatactacccatttgcttgtataactgtattttaagtaatacagttgagagcaataaaagcatgattagtaccaaatatatatatatttggaatatatatatatgttccaaatttcattctccaggatcagtctgaactaattatatcatgtaattaatcaccttgtcaaaaaattcatccagaagcctagttaaatacagggtaaagcagtgatgggaaatatggtcccagctatgactcttaggagaagtaatagtgatggctaatctttatcaagtatcttccatttcatgaaacatatttacaggtatcatggcaaccttgcgagttcattgctaactctcaagttagttgtttttgagacttaacccatttttccgataaggaaactgaggctgaagagagatgaaatgccatgttcgaggtcattttattagaagttgacagaacttagaatcaaacctggggcttttgtctctaaattctatgcccaaatcctctttcaatccattatggcatagcagttgctgaagaaaatgatttatcaaaatgatttctcaaaaaattgattcctcactgtgccaatggttttctcaccccatcctttatgggactgtataaaatgaccctatctaggctctcaaccccttggagctcatgtggacaaccctgagcacttggaaataactggtaaacccaagactagcaaaacaaaatggcagcctgtaattgctctcggaggctgccttaaatcagaccaccctatctcctgtctctggacagacccacttctgacaaggggtgctgtgcaatccaaataggtttaagattttaaggagaagcaaaggtggaagatcacattagggatgaacaggtgagagaatgtgacttcactcttagcagtgaagtgatgggctgagagacatgcacccatggcacgtggatacagagcgtgcacgcacggcacagcaccggtgcagcatgggtgagtgtgcacagtgtaaatattgtatgcagaagccatccaggggtatatgttcctattttagtaaaatcaatataggaagcggttataaatgtgcttctgttggaaaggaggcaagcaaatcttgatatagtttttcatttgaggccaagggcccacagaagtttcactaaaaaatcaagtcaaaaaagacaaatgaattagagaaaaggcatacaaatatatttaacgtatatccatgggagccttcagaatgaaatcccaaagatacaagggaaattgtccatttttatgctaatgttcaacaaagtatggatagccatgtagaaataggattggactaaaagggcctgacctaatgctaacggactgaatgaagaaacctagcaaggcctagattcttcttggcctctctgagcagcgttccttccttctgggtgtggggcaggaccctttctggaatgggagtcttatgacctacaatcaaaccatgttggtcagataatttctttatggccagtctttacacagggcagagggaaaattagagtcatatttttaggttttaaggctggctttggggaaagggggttctagtttctatgacccaccttggggaagagggattctagtttctatggctagcctccagggataacagaaattaaaaaacaggagggcaggagaaggtcaaagaaatacttttgtttctgaggccttcattttgggatattgttttttgagctccaacaaaatattcttggggcaagccaaagaataaagaaaaggaggaaataagaaagaagctaaataccatattttctagcccaggaatccagtttcccataacaaaagtaagtgaacgcacgtgtagaatatgcctaagcaatgcagcgcttcccagcagcacttagctcactgccttgtgtctaagcagtaagtgaggatactactccaaagccaacctctgttcccatgcagcactttacacttgatgacacactctcagccactcttcaatttgatccccacaacaaaccctgtgagataggtgaccttattctacagatgaacaaactaaggctgaaagaggaggaatgactcccagaaagtcaggcacttgaaaaagcagggcagttgccattgaagtgaacagaggagttcaatagctccccttatccaaggtaccaatgtgctgtgataaagcacttgatgtgcacctcatctaatcctccagccactccagtgagatagtatgaatcccgtttgcacagatgagtaaactgaggctgcaagagttaaagtgaatggtctaaaattacttacacaggtagccactgggaaaggcagaacgccagaacaggtggatatgagtcccaagccactgtgctcactcaccgtgctaattctgcctccctgcagctgctgtggctgataaggaggaggaggagaatgatgttagcagtgacagtagtaaacatgtaagagggcttacaccctgccaagtacggttctaagagcttttggggttttgttttggcttctttttttttttttttttttttttttgacaaggtcttgctcttttgccaaggctggaatgcagtggtgtgatcaaggctcactgcagccgcaaactcttggactcaagcgatcctcctgcttcagcctccctagtagctgggactacaggcacacaccaccatgcccagctaatttttgtgttttttgtagagactggatttcgccatgttgcccaggctggtcttgaactccagggctcacgtaatccacccgccttggcctcccaaagtgctgggattctaagaacttttcatggttcactcatttaatggtcaccacaacccagtgaagagggagcagtattatccccaatttacagaagagaaaactgaggcacagacaattaagaaggtgcccaagtttgtgcccctaatgaagtggagaaacaagtttcaagcctaagattccaattccggcagcctaactccagaagccacattatgctatcaatgctgtgtgcattcaactgcggcacctgtgtttggaaatttcatacctaaattcctaattgtttttacaaaaagctaaatatttaaatagcagctcgtcgatgaatgctaaatgttttgtgtggtctctgtgtttgcgcttgcaattcaatactgactcgtttccaagcagcacggtggagatgtttccacatttagcctccttgcctgggaagtgaaggttgaatcactcgggaaatgtatgtcacctgttctgtaagtccacgcgctgcggcctattctttgacaagctgtgccccctgctggtctcttcgcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgagtaagtgttgactctcagcgccatttcggagacagacatgccgcctcccttagcccgggtgtatttttgttatttgtccaaaattgatcttgtttgtgtcaaagcattcattcgccagtggcaaaatgtatgaatatcatgctcatttctggcagaagagatccatttctaatccacctttagagcattgtagttaagatgagggacatatttaaaacgaagcataaatttttgaattcctaaaggggcttgattccaagccaagctttggtcttagcacttttcacacattaatttgtttaattctcacaacacccctatgagattagtaggattttagcttcattttacagacgagcaaaccgagtcatagaataacttgcccaagtcaaatggctattaacgcggggatataggattcaaacccaggcagtgggactccccgttgtgctatagattgtgtgatgggttgaggcacctgtgtttggaaacacatgtaatgctaaagccttggacctccccccacaccctgcttacaatctcacctccaaaagatgtataaactaattaaaatcccactttccaaagaaacttctcatgggctgcctagaaagcctttctaaattccacaatgccaggttcacccaccagggggcaaaatggcttttctcaataaattcatgagcctgtgttgggaaggattaaatctccaacttgctgacttcaacaccactgttctgacaactctcagtcacctgttgacatgtagggacaaatcctcatatgcaatttgagaacctcaggccttcagttcactccttccagatgctttctctctctccccacacataagcgtgactgtagcctgagaaagacttggctcacaaagagatctcgtgctcagctggacacattcacacactcttccactctcctttttaaagttcttggggacaggtgaaactggctgccatttgaaaaggtggcctgcacaaccggagttgattttcagacaattaaaatgcatttcttttcctactttgtgtacccacattttaccaggttgaacattgtatggtcaaaaacgtctcagagatatctggcttgagtaagaatcctgaaaagtctgtaataatgttctcattcataaattcctttgaccaacaaatattcattgagcattttatatagcactcacattaggatagtagaaaatactaatatgtatgaattatattcctggccattgaggaacttgtggtctgattgtaaaaacaagatataaagataggaaaagtaattatttaaaataatgatacaagtaggattacaagaaagcccataagtagtgccaaatgatggataagacaataagtacaagttgagaaggaagaaaacataatgatcatgaaatataccatcttaactagtgaagaatatgaatggtcaagtggtgggggtaggttgtcttcctacccttctttggagaggacctagaacaggagaaataactggaatcctcttgaaggtcttcacataatttagaagacactggttagacacataacctagggtaggatttctactccaggatagatttcctagaattcaaaatatgggaccttcttagaagggggtggtagtcgtttctggtgaaattggctctttgtaaaaatgtattaactcagtcccatttgttgttgttttgttgtacatccacgtccatgaatgagaacagcatctccacatcaatactgggcacacttaagagtcatgaatcacacccaattccacaccaccagcaagaaatgttgatggagggagttagacaggaactggctgggacaaaagaactgtgtgtgcctagagaaatagccatggaggaggggagggacagggaagaatggtttggggacatgaaggacttgcatccattcttctaagagaggaagaatatgagcagacagggagattggagaatagaaatcaacaaagggatggagagaaattggtgttggaaatacaaactcggatacgtgagtgactttgaagagattcagaagttggttggacaaaatgtctcttcactttacattggctccaaatgcctccttagcattgtctctagagaatgaggaacagatttctttttaaatgcaaacatgtgtattaatgatcaagtagtgtgtgtcctgagtgtaaattaaaagttacttcctttggggacttgtctccattctctgcctcaccaagggttcatttgttccaacaaacatcagagcaccattttgtcttagataactcatcatcacagaaatgtgaaattaaagatatgctctttattgcagaaaagaatggggattagagacttttcttccctctgctgtgctgcaaagcatgaaagagaagaacataaagaaagcactttcacaccttgtcaaagcaaatcaaaacttggtaccaccgggtaaaaaggtatcacatttccatcttaaaagaaaattataaagagagaggcttgaatgcattttttaaatgtttaaaattagctcatgaataaaatacttagtaccatattttcagaagcagtaacactgtgtaacttttttctaactattaacatgtttctaacactaatgaaaaataagtattcatatagaaacctatttctttctcacaagttatggactccgtactgtagcagggaggtatgtgttcatgtgcccatccaggaaaagtttgcgtagcctctgagaccttgtggatagaagatagaattgtgaaatcattctatgtttcaatcatgcaattgcttactgctcagaccagcttcaatgcacaacagccagcaagaggccctgcaggccagaggccacattaattaaaccagggatcctcaactgtggcgtaattgacatttgggaacagatcattctttgttagggagttacggggaacatcctgtgtattctgggatgtttagcggcacccctggtctctacccacaagatgccagtagcaccctcccgtgatcgtgacaaacaaaaatgtctccagacattgccaaatgtgctcccgggaacaaaatcacccctattgacaaacaatggattcaatcctacctttggagggaagataaaattattgctgtcattcaccatcattagtgttaaaatctttttatgcttttgtttttgttttcattaagtaagagaaacacaaaggaaattttaaaatatactgttggtcagaaaagagaggtatagtttataggtaataaaaagcaaaggattccaggaaccagaaagagaaggagccttaaaatactggatctataaaattggaagcagtcttataactgaagaacactttccaattgatattagctggagaaatttgtgtgactctaatacaaatcactgtttacgtggagaaccattttgtcttagtatctgatttttttaagtcatttttactgggtaaggtacatttatttctatcccctcctcaccccacgacaatttttttttttaagtataatcagtttcaacacactatcagccacctttaactcacttcccaatttcatgggaaggatgtctttgatcacagtgagcattcagcttacagagatgtagcaagatgatgtgggtcaagttctttttaacttcagttctgatttgctggaagctaatttctataattgacttgtgatttttttttcaagcctggcccactcgtaataatttggataactgctataagatcaatcaacctatccatttatccatcactgtcctttaaaggttgtttttctagccaagagtgaatagtttgctttcaaaacaatttgcaaatgctttgcatttttgaaagaagtaggatggatgaatggtgctaagtaacaattacataaagagcagtgcctttatgtatagttaacaaataagttggcaagccatctgcaagtgaaaatagaattttatggtcattgccacttaatggtggtctacaccttgttggaaaatttcaaccttaataaacatccctggcacattcagtatgaaacatggaccttttttttttttaaatcaaatactctttttagtgatatgggatcctacatttttaagtctttgtaaagataacttttatctggataaaatttcatttataaatcacttgtgaaactcaacagattttccaagttgaattaataaaacagagccttatttagcaagttcaaacatttccacaatgattggctctcagaaagttcatttcccccgaaaacttgcaaggactggaagaaacttgagaggggaagtgtaaagggcctgtttagaaggctttgcctagattgcaggtgcgtattcaaaatgattcccacaaagtctgcattcaggtgagtctcttgtgcaatgggaatataggtagacacctcacctttgtccctaattgcaagtagaaggcccactcacctcttgaaatctcccagtgagcagatgttcaatggaacattttatggtcttgttctcacttgctgagtgccctggcccagcatatctatacccatgagtgccccatacattgaccccctaataaataagatttgaatcttgattttatgttccagtccttcatcaggaaaccaaatatgtagcaattttattcctaatgaatagtctttgtcacatctcaacttttcagccgtaaaatcatccttctatcttacacttgttttctgctagtctccagctgaaatggagtcatacccaatagagttaacacctgaggtttcttttctctcctcagctctctgcactacaagccaaggtccattatctcaagttcctcagtgacctacgattgtatgggggccgtgtgttcaaggcaacattagtggtaatttcttttttttttttttttttgctttctcttggaagccacagcagctcattccgcctctgatgacaaaagcaaatcagctgtgaatcttctccagccttcatttctaaccaacttcacaacagtctgaaaatatcagaagaaatgttaaactagataacaccactgcagaatgccctagaaaaagaaatgtgaagaaccgagagaatcaaaggattctaacaatggccttcttttaaatcattgagccagaagttgctttcacagtgaaaaaaggaaaaccaaaaagaaaaaaacaaacctcatttctaaaaggatcttatgattatgaacatactgtgctataacatttactttctaattactcatgatttatcagagcctcaattcagtcatgtatctggttcttctaattggatgatttagtacagtatgacccagaaacactttctaaagaaaatataatcttataaaaataggatcataggttcaagttggcatagcatttcagaggttcagtatttttatgttgtcaacttctctttctcagcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatgtgaaggcaagtttctcaggtgttgacacatggccttgctgtcaacagctaatttctgataacactgcagatgtttacaaggcaggcaaaagtcaatgtgtgcagagcatcacagatgcaatgtggtgcagaaaataatccaccaactcaggcctgagggctccagtcctcactaaatcgctgtgtgattgggaacaggtcgctataattctctgcgctcaatttttttattcatacgtgagaaagcaagctacataatttctaggtcccttctgactttagaatatgtgatttctaggtatagagtaggggaaacttttctgaactaactttctagaatatatgactcaaatcaagagggagatttttcccaactttctttagaattctcactccctttgcttacgttaggtccatatgtgtttattcttttggaaaagcttgatgttttagttcatctgtcttctcatatggtagcaattggtactgactgaacatctggctcctatgaatgtcatggccattccatttaaaacaaaaatctggccaggtgcggtggctgatgcctgtaatctcagcactttgggaggccgaggcgggcggatcacgaggtcaagagttcaagaccaggctgaccaacatggtgaaaccccatctctactaaaaatacaaaaattagccgggcgtggtggcgtgcacctgtaatcccagctactcaggaggctgaggcaggagaattgcttgaacccagaggtggaggttccagtgagccgagatcgtgccattgaacttcagcctgggtaacagagcgagactccatctcaaaaaaaaaaaaaaaacacaaaaatctgagatggtccacaaagggcaaaactctactcccaaaagagaataggaaatagtccaggttcctggtctccaccttcttttcccagtagagatgagttattggattttggcaatggcagtatttctactgtttctatgaagaaaaggcacgggaacaaatggagatagtgactccacaaaggagacaacaccagcctggagggtgctctgaaaatagccagggaggacccagccctacctgcctccccactagggtgctggtgtgggaggagtggattaacagccattgagaatgtggcaaagcgtttctacaaagcacatcagaatacactagagagctctgcagtgggaacagatgatcacgaaagagagaatgtggagctcagacatgctggctgtgacctgtaggacttcatgggctggatccagagggttttcatggcaagctgaaagtgtgaggatagacttggaatgctaatcctactccatgagcaaagaggctgagagaaatagccccatcacagagaaaggtggatgaaagggtgaactggatgcagttattacagatccgatgacagagataatctgtcctaaacagaaatgagtgtcgtgcccggccgatggcgtcctgcctatataaaataatgatgcggtgccttggaggctgaggggagacctcaactgaagtggaaggaaaggcagttcaacaagtagtacaggggctttggcaggaaagttaaattctacgagctgggggcgctgaatccgcccagtgtcctatacctaggagtgaaagcaagaggcctgctgtcttgctgtctttgtgcctctcttcatatctgctttttcttgcttccttatttctctctcactcactttttctctttcaacaaaaacacatccttcctaactcaatgagaaaaattgcttcatccaacacttttttttccctataagctccaaatctatgtccaattgtataataaccttattgtttcaagagagttttagtgaggccttttctcaactcccatctgttttaccctcctgtaaatttacgatttcatctagaagcaactttttactggatctctggcacttttcattcagtcttagcagtaatttccacttgaattttacctctaacactaatttacaccgtgaacccaaaacttaatcttcctgtaattttcagattgtgagttcactgctggtaactgaggtaactggtaacttaactagttaatgttaatttaccagtttaacatgtttaattgtctttaaatgttaaaaatgttaattatttgggaagaagacaatctcattttttttcatttcaatatgactgggggtccaggtgcggtggctcacaccagcaatcccagcactttgggaggctgaggtgggcggatcatttgagatcaggagttggagaacagcctggccaacatggtgaagccccgtctctactaaaaatacaaaaattagcctggcgcggtggtgcatgcctgtgatcccaactattccggaggctgaggcataagaatcgcttaaacccaggaggtggaggttgcagtgagccaagttcacgccactgcactccagtctcggcgacagagcgagaccctgtctcaaatatagatagacagatagatagatagacagacatatatatatatgacttggaagagattcaaaatgtccaggctttttagagggtgtgtcctgaatgtttttcagtaaggcactttgtgttatccttggctttttctcctgctttgggtttctcccatgaaatgtttgttcaataactcctttttccataagcataaatgcagctgttgacactccagggatgttattaagaatggatggctttaaccaaagtgttctcttttgtgtagcctatcacgcttctgatggaatcctcagatgccatgaacctggcctgcttgacggctggatactaccggctgcttgttgattccaggaggtcgatatttaacatggccaacaagaaaaacacagcgacccaggaaacaggtattctcttcctgaactcatcaagcactgacctccctgcaaacaccccacctgacaacaataataaggatgttttctgaaaagttaaggccaggcgcggtggctcacgcctgtaatcctggcactttgggaggccaaggcaggcggatcacgaggtcaggctttcgagaccagcctgaccaacatggtgaaacaccatctctactaaaaatacaaaaattagctgggcatagtggcacgcacctgtaatctcagctattcgggaggctgaggcaggagaatcacttgaacctgggaggcagaggttgcagtgagccgagatcgcaccactgcactccaatctgggtgacagagtgagactctgtctcaaaataaattaattaattaaaattaaaattaaaaaaagttaaaattgtacccacaaaaaaatcaaatgtccaaattcaatgccaaaagccttcagatacctgtgatgtgggctaattgttaaaaagaaaaatgctgatttctcaccacatttgacacatcactcagaagtgtcagggtgcttgctccaaccttgattttattatcatgaaagtctctatggctgggttttcatggccttactcttacagaggtcagggccagaggactaatgatggaatgcccgaacacgagttgtgagcccctgctttagggctggtctctcctgatggtgtcctaggcccgggtgtctgggagcctcctccctgtagtcagacttatgcccaggattctgggaactttacaaacaggaagacgtggttattgcctagcactcggacttgggaacactagaagaaaattcttccacattggcagccatcttggatccataataggagcaccaagatggcaaagacatcaaataattcagttcacctacttgacagaaaaaaagatccccacaacgaggacagggaaggctgcaaatgttaaattgattattcctttgacagtaggtggttttcattggttttagaacattttttcttcagttacttaagcattttactccatctacagtggatgcttagtaaatgtcactgatggacagatgccaccattctaggcacagccactgagccattaaaaaaaagtataatcagagtttccataattggggtttcttttaaaagaaaggggaattcttaaaaacaaattttactgttgcttctctttttctctcccttccccccaaccctgccccccgccccaagtccccggcatttatcagagaaaatgaggggagaaaaaaagggaaggaagttctgtcactgttaaattgagcataaacatcaatctttattccataaatatactgcaatatgtagacacacttaaacacgcatacagactcacacacagtttattatgatggccaggtgaatggaagcagctcagtcatagaaaaagggaagctagaaacaaggagcaatggataaagcatgttagaaggcaacacctggactttcaagtcaaataaatctgagatttaatccagtcccatcttgaggtatctgattttttttaatttctctgagcttgagtttcttcatttgtaaaatgggatttaaaaactagcttgcaagggttagaaaaataatctaggtacatcatctaaaatgatgctcagcatttctattaataattagcagtgaaaaaaaaaaaaacagaggcagaaagaacccagaatgaaagagatagaagccagatgcagtggttcacgcctataatcccagtgctttgggaggctgaggcaggaggatcacttgagcacaggagtttgagatcagactgggcaacacagggagacatcgtctctacaaaaaatataaaaattagccaggtgtggtggcacacgcctatagtcctagctacacgggaggctgaggtgggaggaaaccttgagcctaggaggtcaacgcggctgtgagctatgactacgccactacactctggcctaggtgacagagcaaaaccctgtctcaaaaataagtaaataaataaattagaacgtgatagaaacacagaaaggagagaaagacagaacatgaggcaaagaaagctcctgagagacacaaatgtttaaaaataaatatagaaaaagaaagaacaaaaaaggaggtgataggcgtgcactgggtttggcagtaaacatttttatgaccacatgttttcattgagctaggagatttagagcaatttaatgctgaccttagaaattccaaagaaggctgggcatggtggctcatgcctgtagtctcagcacttggggagtccgaggcgggtggatcacttgaatccaggagcttgagaccagcctgagcaacaaagtgagacactgtatccacgaaaaaaatttaaaaactagccaggtgtggtggcatacacctgtggtcccagctactttggacattgaggtgggaggatcatgcaagcccgggaggtcaaggctttagtgagccaagcacactattgcactccagcctccaggctggctgacaaagcaagatcctgtgtctaaaagaaaaaaaaaaaagaaaagtaaagaaattccaaagagcagttcagcaatttgacacaattgtttcccactggaaaaccaatttttggctttttattttcaaattttaaagtttatcttgaaaataaatcctttcctcatagactgtaaagattgtagaggtgtatgaagaaaaccaaagctactattctaaacatgcttacagtaataagggtctccactctgtccaattcatagtgacccacaacataaggtttaatagaacttagaggcaaaaacatagttacaaaaagtattattactgtggggaaagaatgggacttcagcctcaccatcatttctcccggtttcaaatacctatccccactctcaaagatacagggcgggaggtaggtggagagagagagagagagagagagacagagagagagaagcgaggataacagagagagagcacactccaaaaagaaactgatagacctaggttgagcagcagtctgggctcagcatactctaagggctgaaagtactctcttctcttcagaaactcccaaaagatctgagagccaagaaatacagagcggaagtcccatcaggccagttcttccccagtccattctctccttccactctgtaggagactgggccacagaatagatcccagcccccaaaccacattcttccttgtctccaaaattattccaggaagccaaatcagtagacccttctggaaggaagccagattgaacacatattttcttctcacctcaaattgatcccagatcttagtcaagatatctaataagaaacagcccccatttcttcttctctatcttgaaaattagccttcaagcactttcaaaatccctggccccacatatgtatgcatctctgggctttaggagggtctcagtaagtatccatcaacttgctttgagcctgctgacctattcagttttcttgttcatctaaatcagagttggcaaaactatggtcaatgggccaaatcatgttcttgcaaataaagttttattggaactcaaccacacacattgttttactttcctaaggctgctggaacaaattcttacaaacttgggagctttaaacaacataagtttatcctcccacagttttggaggccacaagttcaaaaccagaatgttgatagggccatgctcccttcaaaggctttaggggaggatttctcgttaccgcctcctgcttctggtggccgccagcattccttgtggctgcttaactccagtgtctgcctctgtcttcacatggccttcccctcttctctatgtggcccaaatctctctctgccattgaatttagggcccataaagataattaagataatctcatctcaagatccttaacgttgcaagacactttttctaaataaggtcacattcacagagtggacatatcttttgggggccaccattcaactcatacacccatctgtttatgtagcatctatggctactttcatattaaaacagctaagttgagtagttgctcaattgaatggttggcccacaaaaccaaaatatttactatctgggcctccctttacagaaaatgtttgccaagccctaaacccgcgttacaatgcaactttgctgaactagtcttcctcctgcaacaatccacactcacacacacacttccccccacacgcacacccagtcataatccaaattgttgttaataaaataatgctgaacccccacaaggtttatttattgtatggtaagatgcaaatatggccagtgtataattcaatgtcttcaaaattatatctcttattgttcatgaaaatacatgaatttattaaaatgaccctgaacactgttcagcattaagtccattgcatgatttgcggggagcaaaaatctcttaggtaaaactgcacttttttcccatatgtcttgcacatctgatgtcagttatccaaacttgtgctgggggcagtttgagggaacagatgggagaatagtatggccctaaaattttctggaaatgttgcctctggaatctacaaggcaatatcaacagaatgacccagttctctgtcttgttaaatatcagagcaaatctccacatcaaaattccagattgaaagatgcttgaagagcaaacaaaataatagtatttaaattggggttttgtaattttaatccatgaggaacatgaaacaaattttcaggagttcctatgatacaaacaaaaattgaaattaatctaaatattaattatgcttagaaattacagagaaaagtacgttacctgtgaccatgccaccttatgcattttatacacacacacacacatatacacatgggcatgcatgctgacatttatacatgaatattttaacatccactaggatatcaaaagactgaagatagaagttttgtactatcattacaacatttatcttaatttcctaaaaactatggtaaaactctgacgatccttgaccgtctctgaattcaatgaggaaaacactcaatatcttcctccatgaagtagggaatattaaatctcaccttacaaggaaaagaacaattaatgttctggaataacggcctattgaaatctcacctttaagggtaaaagacatgttgtatatttacatttgtagatatgaatgaagccttttaataatagaaccaagggtcagatggaattaagctatacttccctacccccagatggtattacattttatcaaatagcaattacagtttatgcagtatcaattttgttaaggtcggttctcctaacccaaggaattcttacacctgaagcctaaatcaataagtactatatttgggtagttgaaaaactgtatttacataagtgatgctacaagccattaagttaaaaaacagagacgagcctcccacccccgccccacccaaaaccagacagtacagtaatgtgtctttgcgtgattctttctctttaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggttctttcacaattgttacattcattcactgataaccatatcattccatccttccaagccatttgcccctggagtcctgttacgtggtgttctccatttcacacatgtcccatttcataaatgtgctgaaactgccatcatgggtttttttgtgtgtatgtgatttcctttgttatttttttttaaaaacataaggcacatctccccccacccccatttctggaaaaactgcaataaactcagagtccttactgaaaagggaaaaacttggtattttgttttagtaataacgagtcccattttcttacatgtctccaagtgcctctgatgcatccattaatcagttcttgttttttacggcatgcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacaggtacagcaatgatggatttagcactttgtatgacatgccaagagcatgtaaaccatatttacaacaaacttaaaaacgtaatgtctggaagaaaagtaaaaggtagaattttaaaaggccacagaactgtaaagtaccaatcattgatcccctggtatttaataaatactaaagattataaaggtgaaaatggcatttgctctttataatcttactctgtgcttgctttcagaattggatggggcaatatgtttttcctaaattctaaatgcagatgtttagcaatgcccagtgtgacttttagttatatgatagtattgcttagagtcacataacagtttgattttcttcccaagacatctgagttctaattctgccatttcattattgagggacaaggaaggataagagagcagggtatcagggagattggaggggtttggagagatcatttgcctttcggcaatcttactgattcctccctactctgtaagactgctctatatggatgttctgaagtgtcttgcataccccagtgtcaggaagattttgaggctattcctgatgagctgctttattttccccaaaataataaagtgtaaacacacgtagaaaaaagaacacatccaccttctgtatcccaccttcaccactccaccactcaatggcaggcattcccctcaccgatccacttggctggccatcacatggcaaaagcagatactctttcatacttttatgtttcaaattatgtcatcaatagtgtcttttccatacaggtcaatggaagttagtgacatcttatattggtcattttctattcctgttcttttaagattttctactttctcaaaacccaccactggctttacctcctttggaaaagctgtctgtgaatatcacctaactcatcacccaactgcatctttacctctaaactaagtcacactgtttaatccttcatgatttataaagaactttcacctgagttacctcttgcttctcacaaaaattctgtgagatggggattatttgcttcacatgacagcttttcttaaagaaaaaaaaaaatgttgaacaactggcccagtgtttcaacttcagacttttaccaggcaaacctcatgctgacttcttaaaaagattcacttatttaatttgcactaattaaattaggccacttctttaaaagaaagaaaggaaagaaaggaaaggaaaggaaaggaaaggaaaggaaaggaaaggaaaggaaaggaaaggaaagaaagaaagaaagaaagaaagaaagaaagagaaagaaagaaaggaggaagaaagaaagaaaagaaaagaaaagtaacaatgccagatttaacctaattcccttgaaatgaaacttaatatctccaatatatttgaataatctatacacagttgttttctgtgtctaagctttgatgggtagatattgggagtaaggcaattcatgaaatccctgaaaatgtttgggatttctagacaattccaaatgaatcagcagttccagaaataacagattccagtattttcttgatattcattaaaatggaaatttgttatgagatatcaagaggcagtctttggaaagcagggtgaccttagcatcggcagcccttccagactacaaccttgagaaatgacagacatcatgtagagatgtagtaaaaatgacctcccaggagatgcttaatgattctctctgtttttctactacccctagtgtagctttgacagagcctgggaaggagagacgaggaggcatgccttcagcttggtctcaacatcctgaagctgatcccatcctgctaccatcaaacattcactcggaatcaaaggtgccaattccaaatcaagaccctaatgatttctcccaagcaaatcaggcatacggagaggctgtgagctggcggccaccggatctgagaggggggagcctcaggacacctcccagccagaaggctctgagacatagcagcagtatcctctccggatctgtcgatttggagaccttccgagagagaaccaagggtgcagtcagcttaaagtgtccaggcatcacagaagcacaggaggccagttctgaaaggcgagcagaactccccctggggaggaagctcaccaaaagtttttcccaaagctcaatgcacttgagctctgaggggaggtttcacaaaaggtccccagtggctcataaagactcaaagctgtataggacattacccttgcggaagctggagggcagcaattggagatgccggggacccttcagctattgcttcctgaaccgagggcaggatgaagatggtgaggaagaagaggagaggggagaggccaccgtccaggtctcttgcctctatagaccacagatgactcaagccatgccagaaccaagcagcccatgcctggctgtggcgattcagaagcaacgaggggagctatccagagggtcagtgctgaaggtctgggcagaagacctgcgagacccagatgacttggacttcagcaacctggcttttgatgcccggattgcaagaataaatgccctaaaggagagcacatatgcaatgcctgatgggttccttgcagcccaaaatgatgccaatgagctgctctgtctcgtcagggcaaccaaggagaagagggaggagtcacgccctgaagcgtacgaccttacactttctcagtacaagcaactgttatccattgagtccagacagttgggaagtgcctgtaggaaaatggcgatggctgagaaaagcccggaggagatgctcctagctatgacttccagctttcaagtgctctgttgcctaacagaagcttgcatgcgattagttaaagtcgtgaactcagaaacacagcggcaggaaattgtagggaagatcgatgaagtggtcataaattacatttgtctactgaaagctgccgaagcagccactggaaagaaccctggggaccctaatgttggactctcggcgcgacactcaaccaccatggccgctctcgtaagcacactgacacgttctctcaagaggcttttaaacaaataaatatggaagtcacgtcataatctacctttgcaaagccatacatgaacttttatttactttgtgtgtatgatgaacagatgtctcctttcttctctctgtatattttgttattttatataaaataggagataaaagtcacattgatgaaatgttgaaatgtactaatcagatgtattctgtttatattatacatatatatacacgtaaaagaaatatccaagaaagtgatgacatttggctatttttcatatagttaaaactccaggtatatgatgtgaaattttaaattctaccatgttagagcaaaacaatgaatcctatcccctttctttccaagtagctacttggaaaccatatcattcatatttagaagtaaaacacaaaacaaaaaagagagagaaaagaaaagaaatcacaatgtatataaaacagtacttatgttttaaaattatgatttttaagcattggaaatagcaaaaagacatttaaaattcaagaagctattatgaattactagagaatatatctgtaataaattaattttttgctcatagtatttggttactggatgctttcttccaagaatcccacatatttaatttgggtttttgctactggggctacaaattggtggggatggattctactgtgtcagcacaaatgctcttcacagtggttctagcatttaaaaaacttcccggggagaagaacagaggggatgatgggcagtttcctaggtaacacctagagttatagaatatctcattacataaaatgtatggaattaataataccaaaattaattatttgatggaaagatctgctttgactaaatgtcaaaaatctgcaaaccaaagacattatcttcccctcatcccaactcaactacgaaacttaaaattccctttagagtgataggacatttagtaaagtatttgcaaacttaaaaaaaggaacatttaatgatcatcaaaattaagtacagattcagtaatgtagaccagaccacacaccagcacctgtgagtctcatctcagatcacagctctcagcatagggcttcatgcatcaccgcctctacagaggctaaggctgccagtcaaatttggaattatagcgtagtactgggacaaaatctcaaatcttggatgttccagaaaatcagggagagatggctactgtaatcatgggagccatgagtaaatagttaagtatttattaaataaatacttaatctggattggctgataaaaatatgaaatctgaaaaaaaaaagaaagaaatggaagtggtatatttgaccagttcaagtgaaaccaatggaatgcaaagaactttccaggactgtcacatctctaaaagtaccctgcagtcataaaataaaatcgatatgtatatatgtatttcctgggtcattcagtgctcaagttacatgcactcctacttagacaggtggctccttaagaacatgatgggagtacaccaggtgcaaatatttctacttttgtagcctgctgagaaggagtcataacacagtccacaattgcaatctctctctagtcagccattccacagggactcaacaacaaaagccgcacgtggttatggatggcagcaaaggaaaggagtttaggtgtgtgttattataaataatgtttaactaaataataaaacattatttcattacaattataattataaatattggtgttttgatattgagagatattagtggtgtttactgtggaaaatcttagtaaatatcattctgtgtactaaaatcctaacctattaataggatgtgtgccctatgtcagacagtgtgctaagcatattaactatattatctcatttaatcatcacaacaatctgctggtttggacactattctctctggaggcaatatggatgagttcttacggatatggggtttggggtcagaaacatcttgattaaaattttgactctgccattttctagcccttttatgttgggaaagctactttttctagtctcaatttcctcataataaaatgaaaatcaattataagatcgatttccatagggttgtcatgagttttgagtaaaaatgtgtatgtaaagttcttaccacaatacctggcagagagtaagtattcaattaatgttagctattattatcatcataatcgttgtgttaaatatattgcccaagataatatgtgggggaatgtttgttttatatgcatattgtatcctgactgtgtgcagaacacattatgtgtattgcatatatgtaaaagaagtgtacaaggaagtggccatccttgttcaagttacgtatctagttagaacaacttcccagtccattggagttctttgagaagcctcagggaagtagctctgggtccttctaatcaacctcccattactgcgccagtaagtttctgtttcttataaataaactctttgctattcagaaaacctcaaggggcccccacattcactaagcatggggctcctaactggggtccaggtccatagagtgtaggaagaacatattagaacaatacttgtgcttatttttatctagcttttttatgtttgtgtatgttttataatggcataatagtacaatggtacatgtacataattttaaataaataaatgaatgaatgaataaataa

SEQ ID NO: 3047 - DNA, 220197 bp, human
agtcacattctccttccagagtttgtctcagaaggaatgttcaggagtcaggtgtaatgatgcttttttttttttcttttccagccacaggacgaagtcttcaggctggccgcctccctcgggaacctggggcttgagccaggtgccgccctatggatgggagatgacggcaaaccgagatgggcgagactacttcatcaagtaggttaaacagatggcatgaacaatagaatccttggccaatggacttctttatctttgtttatgagaatgaacatacttaaattaggcactcataggcatttggaggccattactaaagcagctggatctcttaagccagctgcttatatttctatatatttatatatttatttctatacatttatatttctatatattgtgatgttgggttgcttcattcttcgacaggcaccatcttcgaatgacaagtcactgtgtagcatggtaagcctggctcagagcaaaagtttccaccgttaaatattaggccaagttgtattcgttgtctgagattaacaaccgaagttggacatgcaagaatctcatttacaaggttttctaggagtggtcaagacaggaatgctactttctcatctgtaattttttaaaaatcagctaaaaggattatgtacattatttgttttattgtaaatttctcacactaacgttggcttaggttttggatttttgtggtgctctggttttttgttaattgtggtatagagagagagagaaaaagagagaaagataacatgaaatttaccattttaaccagttttaggtgtacaattcagtggcattaagtacatccacaatgttgtgcaaccattcgctactatccatttccagaactttttcatgatacccgaaagaatctttgtacccattaaacaataattgccagttcctccctccccttaccccctggtgacatctattctactttctgtctccataagtttatctgctctagggacctcatacaagtgaaatttatatattttctgtccttttgtcactgacttctttcacttagcgtaacgttttcaggctcatctatgctgtagcacatgtcagaagtttttcctttttttatttttcctttttaatgttcccttgtgtggataggccacattttgtgtattcattcatctgttaatggacatttgggttgtttccaccttttgtctattgttactggtattgttatgaacatcggtgtacaagcatcaatttgagtccctgctttcacatcttctagacacatacctaggcgtggagttgctgaaacatatggaattgttgggtcaaaattaaaggctgtgtttaactttttgaggaaccaccaaactgttttctggagtggctgcagagtggtttttttgtttcgtttttttgtttgtttgtttgtttgcagttttgtgaaaagagcatttctatttctcaaaatggcaagggtccatactgccctttttctccaacctgagcaaaatatccttaattataagaaattcatgaaacagatttgaaatcaggaagtgtggttgggtctatcctgattataatagaggagagattggaggccagaaaaaaaaattatttcacaaccacatgctacattctttgttccagccaagttgattatggactgattagccaaacaccggatcaccgtgaggtgaggggtcatttttataaaaaatatctgccaagattgtttctaggggatttggtcttttgtaccaacccccgcgcaccaccacatacaagtgaggattgttggaaagtatcaacagggacaacacatgtgagtgttgtggacagtttctcagtctctgaagcccaaatctctctccttccctagaattgctgcacaggggacaggactcccaccccttcagagcacagtttctttctgacgtacttaactcctgggtccatcccaggaagatccagtatgcccttgaacatgactggaaagtggccccctggcttcccaaggctttcctaaggatatgctcacagagatactatcatagaaatggcagtgggagcagggcctcccagaaacctcaaagattagaagaaaggccaatagtttggctcaaaccccagagtttgaattcataatttcataccgtttgtccaagtcccttaggctgctaggaagacagtattttttaatattatattgtaccatctattttgtaacatggctatgattgtgtgcaattggctcagttaaggtgaactagatgctttgactcaaaacaataaaaattttgggctgaagaaatataatttttaaaagatatggatgatgggtttatgaaggtatgcatcagacttctctgattaaaacaggtgtttcttttcccctggttggatttgggttcccatacattccaggtcattccatcaataggtggaaacccaaactgaggccaactggttagaggttctgggaacgtcagctagctctgccttcatgcattaccattagcatcgctgacatttttaagagccagcctgggtgtcagtttaacatttacactggcctaatgcccactgttaaaacataagagcaaatcagcagcttaatagagaaacctgcactgattactaaatggcaagttttaaaaccaaagtcaccagtgttatttttccaaatccatgtggtttcattttacttgaaaagtaagtttctacagtcctctcagagaaagttttaagatgtcaagaacagtatttcttcggaaagtgtttgttctttatcactaatgagttttataaataatgacaatcattcttttcctttccttgttttttttttttttacttactaggtaatgtttattacaaagaggtattctaattatcagagttctcgggagcccaggtttgcagtgtggaatatttctgtactcattagttttagaagttaaaggtacaatttgaaaattaatctatggttgataattagcacctttgcattgaatttttcactctcttgcatattttttgaaagagaaatttagatgttttcttttttttatctcgtcttaggatgtaaataacccccatcagacaattgtttctgatggaggtacaagtattccaagtgacagacaaagctatgggaggaagttggcttttatgtgttcaaagttagagtctaacaactaaataatgagataattctaacataatgagtctttcagaacatggcccaggagagttcaaaatgtgctcaagtttcatcttccctcttccatacccaattatttagggtagggctgggtaacctgttatctatagagttactgattcacggggttaaatgaaggatgcaataaacacatgctaatatatgtttttataataccgtataggctgcaaactaatggttctcaaccttggccacacattggaatagactgaggatcagtaaaaaatcctgatgcctgggtctgggattgagcctggaaatagtgagtttcaggagctccccaggtaattctaatgaacagctatggttgctgctgtaaagcacttgtcaacacatgatctcatttatttggcttgaacacagaaatgattaactccatttttctggatggtagaactgagactcagcctatgagaaggaacaacttttgttgatattcttggagaaatatgaaatgcagttttaaggaacagaaaacattgtttaagaaatatgatagatgcaaatttaaaatttctcagttccttactattaccagttaagagagagcagagcaggggaagggaggaagacagatggaaagaaagaaactacaaggaaaaggaaagagtcatgggagagggagtcccaatgagaaatggataaaagagggagagatgaagagaaagagaaatgaagagaaacagagaaagtgagatactctaaggtgattgttacaataacagcatcaattaataataactttagatgtaggtatagatggagagggatgtagatatattatagatccaatcatagatacagatataaaaatagatatagatgtggacatacatatagatgatagagaatatagacattgacgtaagtattaatacagagatagatgggtatagatacatagatggatatagactataggtatagatgatagagctatagatatggatatgggtatagatgattagatacagatatagactatagatgagtgactatacagtcacattcacccaggagagtcctggtttatgggtatcattctgaagtaattacagacagcacctccttttgctctcaaagtgttctggtttggataacacaagataaggtattttaaaaatacatgtttaaaagtcagagaatgaggaacaccattttttagttaaattgggtaaaaatatgcttgtttgactgcaaaggtagggagagttaatgcaaagtaacatgattcataaatctggaactttggttttgtaaattacaggaaaaaattaaaacatgagcaaaataaatattaaaatactagctggcaaaatagattattatgatgagccaagttagagtctggggatagagatgggggttggagaggagactggagggtcagttccgaagcacatggcctgatttttcaagttataaatttaagaggctttttcttgttggcctgctggcttcctggccaccttcatcctgtgtacacaaaaagtagccctgtatgaggattggacaagacatgctgttctattattctaccagcaattcccacagtgggcaattaaactgagttactatctccttaatgcagaataattcaactctgaatcctgaagagtagagattagtaatgagatgtggaaacttccactttgttctgcagtatgggcttggctcaacttcggagtagtttagtcattcccatctgccaatctattccatggtcaatgtaaaatgtgtttttggcttatctatctatagaaaataataatctgaataaatacaagtaatttgtatgccctttcttatcaaccacagcagaagacagtcaagtcaacatgataggattctgtcatcatggaaattagaaatagaaaagccttacctcattcttctgtgtgagccccaaagtatttacccagtctaataggttatcttcagatattatttggtagttctagggctattctttggatatttttttcttgatttttactacaagatttcatgagacttttactgttattctgtggagtccctttatctgttactctgtggtgaattcccttaaactttttctcctctaaaaagttttttaaatgtcaagaagagttaaggtgtaaagttgggatgtggatattgtggttgtgcccatcatcccctgtgatatttttatatttggagcagacaccaatttcctactttatcaagcctacgttttaatacacacccaacaaaggacaaattgatctgagagattacacaagttgttatcttttgtctctgctaataaaatgctgcaggtctttgtggaaattaacagttgtgcccatgaaggaaataagagaaatctcttggtgataggttactctgttattctgtgaggtgtataagcatccaaagagttaataactagcaatatgttagaaaacaggcagtttgcctcattttttgtgggtgtttttgatgaacaattcttaaatatgttgcttttgagtacgcatgatgggttctgcataaaaagcaaatacttgcctcatggcaagagcaaatgtcatttggttcaatgagttcctagatcccaagcatccagtcaaggggaggaaagtatattgtaattttggaatgggggaaacgaagtcaatatgatagtatcattacatgaaatgaaaggtaattatgccctgttaatacaaaagcttcccaggctgaacattaggagctgtttattcccttcattggagcagatttgttttcttttgaatctgacaaagcacctatctgctgagttaataatcactgctcccagctggaaggtaagtttgcagagttgatggaagggcttttaacaggaaagctctgaaatgactctatcattccagatctaatttggcatatggcacaaagagctgtgctaggcaaacttctgcttcagaggctgtttcattttccctatgtttcttcttgaatgtttcttcttgaaactttgctggcttacttaatctggccttcactctaggacaaatccctgagttgctctccttatttgtccagcaggccagagtatctggagggattgtaattatctaaagttccttgggccacttgactacaacagagttggggcatgtacattcaagccaagctgtggacagcaggttagctagtgcactgggtcgcctctttcttctcctatgctgtatatagcccctagggatgtacaggaggtgggtcacaaagtccattcagtatcacagggatggccaacctgtgcaaaggagaagcacctggaggaccaggtttccatcacagcctgtaattgaaatactagcttggggctgcctgccacccttgatttttttgagtggcctctggacctcttctttctagattgagccaacccttgcagagagcaattttgatgttattgcctaaggctggggcacaggcagaaattctggcctgtgccaaatgccacgtgggggtgtgggtgttgctgccaagtaaattggctgagcttaagaggacatggaatcaccttggaggcaggtgccttttcagtattgtctgcactccagcataaaagaaggagagcagggccaggagcgatgtctcacacctgtaatcccagcactttgggaggctgaggtgggcggatcacctgaggtcaggggttggagaccagcctgaccaacatggagaaaccctgtctctaccaaaaatacaaaattagccaggcatggtggcacatgcctttaatcccagctacttgggaggctgaggcaggagaatcgcttgaatctgggaggcagaggttgcggtgagccaagatcgtgccattgcactccagcctgggcaacaagagcaaaactccatccgaaaaaaaaaaaaaaaaaaaaaagggggggagagcaactgagacgggagggctggtgacagaagtgccatactgtggtccaccaaaaggtgggaaactgcagttcctgccaagcccttatcctgtagttcctctcaaagcttgaataaagccttgttatcaatggccaatttctggtgaagagctccttcaattgcaaggatgataagagatcacactactcttggagccagtgaacactcggatcaatctgagtcacgagtagccatgtcacatatttgctgcacggagcatgccctccggctgctccataaacacaggtttggcattaggtgttcaggttgagaaggctgggagaaactcagaaatgctttttgaacttaaagggtgccgctgagcacatggggctggctccatgatttttaggacctgttgcaaaatgaaaatgcaggccccttgttcaaaaagcaggataaaagtgctggaaaaggtatgaaaatgtaaagcttttccccttcttctgtggtctctctgttaacatgtcatagagttttttatttcctatttaatgactttttttttaagacaaagtctctctctgtcgccaggctggagtgcaatgacacgatctcggctcactgcaacctccgcgtcctgggttgaagagattctcccacctcagactcctgagtagctgggattacaggtgcacgccaccacacccagctaatttttgtatttttagtagagatggggtttcaccatgttggccaggatggtctcaatctcttgacctcgtgatctgcctgcctcagcctcccaaaatgctgggattacaggcgtgagccactgtacccggcctatttaatgacatttcataataagacacatgaaaattttaaattattagcaggaattttactaatcatccttgtatgatgaaagtttcagatgaaaatataagagcattaacttgtctgaagaatcactgaaatgatacaatttgtatttcatagcttagacatgcatatgtctttcattctaatcagaacagtagaaatgctgcacacaactaactcaattgttttgattgtacttcttaatatgagcacatcctactaacactccctccctttggcttgctggtgagtaagggagaactgaaagaaaaagaacagtgggctgccctatctttccctttccttctgtcatcattttcactgtaagtggttggctaatacagggaagtaacacaagtaagaaaggatatggcagggttccttggtcattcatgtttcttagaaggccatgtctgttaacaactcattagcctttcaccatcacctcccaacctcacctcttgactctttttaaaaaagcatttctcacatggccttctcaataaaggcttagcaaagaggaatgattgcttttagctgttgactccctcacaaagcaatccccatgccctgtcaaggataggttttctcataaaaagataaatacttttcttcccccaccccaaggtaatcctctaagccaggtcagcaaaccttttctgtaaatggtcacatagtaaatattttaggctttggaggccatgtggtctctgttgtgactcaacagtgcaagtctgccatggtagtgttaaagcagtcataggaaacatgtaaataaatggacatggttgtgttccaataaaactttatttacaaaaacagactgggggccggatgtgacccatgagctatatagtactttgccaatccctactctaaaacatcatccatttgagcccattcttatatttttaattcactaattgataaattttcaaaaccctcccatgaaatgaggagctgacacatgttttatgtttgaaagaaactagggcagagattagtaaaatgacttttctgaggttgcagggagctaaaaatggacctcagagccccagtttgtcctacttgttgccagaaagctctatgatgtgtcttctgtcagcatgcagttcttgcatagctctgacacctatgacctaccttaaaggttgttctaggaacaatgtcaacattcaccagagaagtacaacttttaatatgaaaatgccatgactcctcccttccttttggtgggtgttcacagggaggaggtctgctaatcaatcacagggtttgcatctgctctcccactctaaccagcacctttgtgggaggggtacagaggacaggaaatgatagcagggggcagcccagtcacaatggaatgctgaatacaagtgcaaataattattaggaaggtgaaaattacatagcaatttgcgcttactaatggtcgacagaaaaacagccccattgtactttcaaaaagttaattgtccatagtgttttggaaaaatgttgcttattatcattgtggaattttataaggcttctgtgtaaatgtccttaactcatttttggtgatattctgttctagattgttctctcagcttctcctttctctcaccattctccttttgctccaagctcatgagaggttcctcaggtggttcttttttttttttaagctcaacatttaaacttcagtttcccacattatcaagcccgcattcctacataaaacccccaaaagggtaaaggattaataagttgaatatgttggtaccatttggttttggtccagaaattactggagactcatggctattctcctacaggagataaaggagaccaacaaaaatcagtttgcactgcctagaatattgtctgggaaatagtatgcagttaataagtatttgttgaatagatgtttagatgtatgtttgtatcagtagatgggtggatgaatggatggatggatgaataagcctgtttctgaagccttatattcagtgggccataagggaaaatgctgatacaaaaatcagtgagtatctcttcttaaattactgatgtagaaatgtcactagaagaatttaggcattagccaggtgtggtggctcacgcttgtaatcccagcactttgggaggccaaggcgggcagatcatgaggtcaggggtttgagaccagcctgaccaatatggtgaaaccccatctctactaaaaatacaaaaattagccaggcatggtggtgcgtgcctataatcccagctactcaggaggccgaggcaagagaatcacttgaacccaggaggtggagattgcagtgagctgagatcgcaccattgcacttcagcctgggcgacagagtaagactctgtctcaaaaaaaaaaaaaaaaaaaaaaaagaatttaggcatttagtgggatacaccttactcctgcaagaatggccataatcaaaaaaccaaaaaatagtagatattgatgtggatgcagtgaacagggaacatttctacactgctggtgggaatataagctagtacaaccgctatggaaaacagtatggagattccttaaacaactaaaagtagaactaccatttgatccagcaatcccactactgggtatctacccagaggaaaagaagtcatacgaaaaagatacttgcacatgcatgtttacagcagcacaattcgcaattccaaaaacatggaaccaactcaaatgcccatcaatcaacaagtggattaagaaactttggtgtatatatatacgatggaatactacacagccataaaaaggaatgaattaatggcattcacagcgacctggatgggattggagactattattctaagtgaagtaactcaggaatggaagaccaaacatcatatgttctcactcataagtgggagctaagctatgagaatgtcaaggcataaaaatgacacaatggactttggggactcagaggaaagagtgggaagcaggtgaggaataaaagactacaaatagggtacaatgtatactgctcgggtgatgggtgcgccaaaatctcacaaatcaccactaaagaacttactcatgtaactaaacaccacctgttcccccaataacctatggaaataaaaaaaaaattataagaatttaggcatttaggtaaagcctttattttataataagacactaaacgtttatcaaaaccttgtcaccaattcataagttagtgtggctgtttatcagaaattcaagatgcaataaaattatctttctggaaatagtgtcgttgcagtgtattttagcaacaagtggcatagaataataaagcacagaaataagagtaaaaaaacttggggtaaaatcccagctctttcagtgttagctctgtgatggtggattatcactaggacactgtgggcctcacttttctcattatacaacaatgtgtttggactagaaatctgtatcatctgggaatcctgtgaggtacaagcaacaaaaaattctaagtcaatttggcttcaatgataaaaataatttgttggtttatgtacctaaaaaataaatgataaaactgttacagccaaaaggagtctaaggatacatgacaactcaatgtaatatgctatactggttggaattttggaacaaataaaggacattaggtaaaacctaaagaaatctgaataaaatgtggactttagttaataataatgtatcaatattggttcataaattgtgacaaatgtaccacactaatgtaagatgttaacaataggggaaactgagtgccacatatacaggaatgctctgtactctgtaatttttctgcaaatctaaaagtgttctaaaataatgtcagacataagaaatacacaaaacaggataatgtcagcaagatggcggactaggaagcttcagttcctcattctcccacagagccacaaaattaacaacaagttattgaccagaataactttgtgagaattctaaagaccagttgaaaagttacagcatctagaccaatgtaaaaccaagaaggaattccagcaaaaaggaaaggaaacttttaaaaagttttgcatacctgttatcaatgcttctctccctatctgatttaggatagtgcaactaacaggaaacctcccaccttgggaatcctcttttaggatgaaaacaaaagagcggaccatgcatctagcatttgggctagtctggaggctgtctaaggaactggttcctgagttacgttactcagagcactgatgggacttggtgaagcactggtggccttctttggaagctgctgaaaacaagacatgatcctcagggcatgttatagctgcagttccaaaggcagacaccagcagaatgttcacaggcttctaagaagaaacaggaacaacaagcttcttaggaaattggagatgttttaaagcatagacacaaacgcagagaagacagcatatccttagaaaaagtttggagaggtcctagaatctatcgcggagctaatccgtgaagatttttccctgcacaaagtcagactataaagactaggagaggtggttgtttctcaaatgcccaagtctcaacaacagcagtgacaaatcccaaggcatactaggagagaggaaaaccaggcccaatcaaagtgccaaaataaaactccagaaactgaccctaaagaaacacagatcaattctccctcacaaagaatgtaaagtaactgtactaaacatgctcaatgaactaaaatggaacacagataaacaactaaataaattcaggaaaatgatgcatgaacaaaataagcatatcaacaaagagacacaaactataaagaagaaccaaacaaattctggaagtgaaaaatataataacagaacagaaaaaaattcaagaggtttcaacagaagactggatttgacagaaaaaaaaaacaaacttaaagacagattattagaagtcattattagaagtaatcaagtcagaggattaaaaagaaaaaaataaaagtgaagagagcctaagagacttacggacactgacaggtaaaccattgtatgcatgatgggagtcccagaaggaaaagagagggagtaagtgttatttgaaccaacaatggccaaaaacttttcaaacttgaggaaaaaaaatgggcatgcaaattcaagaggctcaaagaactacaaccaagataaattcaaaaagacccacaagaagatgcattgtaatcaaattgtcaaaagtcaaagacaaagaatcttgaaagcagcgagagaaaaataactcatcacatacaaaacagcttccataaggttatcagtggaattaccaatagataacttacaggccagaaggaagtgacaaagaatactgtatccagaaattgccacagccacccaaccttcagcagcccccaccctgaacagtcagcagccatcaacaccgaggcaaaatcttccgttagcaaaaagattatgatttgctgaaggctcagacaattgttgccacattttagcaatgaagtatttttaattaaggtgtgtacattgttttttaaggcacaatgttattgcacattcaatagactatagtatggtatgaacatattttttaagttctgggatacatgtgtaggacatgcaggtttattacacaggtaaacatctgccatggtagtttattgcacctatcaacccatcaccttggtattaagccctacatgcattagctatttatcctgacgctctccctccccccacaacccccaactacaggccccagtgtgtgttgttcctctccgtgtccatgtgttctcatttttcagctcctgctggtaagtgagaacatgtggtgtttggttttctgttcctgcattagtttgctgaggataatggctttgagctccatccatgtccctgcaaaggacaagatctcattcctttttatggctgcatagtattctgtggtgtatatgtaccacattttctttatccagtctatcattgatgggcatttagattgattccatgtcttttctattgtaaatattgctgcagtgaacatatgtgtacatgtaactttataatagaatgatctatattcctttgggtacatacccagtaatggcatggctgagtcaaatggtatttctggttttaagtttttgactaattgccccactgtcttccacaatgtttgaaactaatttacattaccaaaagtgtgaaaacattcctatttctccacagccttgccagcatctgttgtttctagactttttaataattaccattctgactggcatgagatgatatcttattgtggttttgatttgcatttctctgatgatcagtgatgttgagcttttcttcatatatttcttggccacataaatgtcttctgttgagaagcgtctgttcgtatcctttgcccactttttaatagggttgttttttcttgtaaatttgtttaaattccttgtagattctggatatgagacctttgtcagatggatatattgcaaaaattttctcccattctatatattgtatgttcactctgatgatagtttattttgctgtgcagaagctctttagtttaattagatcctatttgtcagtttttgtttctgttgcaattgattttgatgtttccatcatgaaatctttgcctgtgcctacgtcctgaatggtactgcctagattttcttctagggattttatagttttgtgttttacatttaagtctctaatcgctctggagtcaatttttgtataagatctaaggaaggggtccagtttcaattttctacatatggctagccagttctcccagcaccatttattaaatagggaattctttccccattgcttgtttttgtcaggtttgtcaaagatcagatcattgtaaatgtgcagtcatatttctgagatatctattctgttccattggtctatgtgtccgtttttctaccagtaccatgctgttttggttaccgtagccttacaatatagtttgaagtctggtagagtgatgcctcaagctttgttctttttgcttaggattgtcttggctatatgagctcctttttggttccatatgaattttaaagtagtttttgctaattctgtgaagaatgtcaatggtagttcaatgggaatagcactgaatatataaattacttcgggcagtatggccattttcaaggtattgattcttcctatccatgagcatggaatgtttctccatttgtgtgtgtcctctctgatttctttgagcagtggtttctagttctccttgaagaggtccttcacttcccttgttagctgtattcctaggtgttttattctctttgtagcaatcgtgaatgggacttcattcatggtttggctctctgcttgtctgttattggtgtataggaatgcttgtgatttttgcacattgattttgtatcctgagactttgctgaagttgcttatcagcttaagaagctttggggctgagatgatggggttttctagatatgggatcatgtcgtctacaaacagagacagtttgacttcctctcttcctatttgaataccctttctttctttctcttgcctgattgccctggccagaacttccaatactatgttgaataggaatggtgagagagggcatccttgtcttgtggcagttttcaaggggaatgcatccagctttggcccattctgtatgatattggctgtaggtttgtcataaatggctcttattattttgaggtatgttccatcaatacctagcttattgagagtttttaacatgaagagatgttgaattttattgaaggccttttccacgtctattatcaaatggtttttgtctttagttcagtttatgtgatgaattatgttcattgatttgcatatgttgaaccagccttgcatcctggggattaagccaacttaattgtggtggataagctttttgatgtgctgctggatttggtttgccagtattttattgaggatttttgcctcgatgttcatcagggatattggcctgaagtttttcttttttgttgtatctctgccaggttttggtatcaggatgatgctggcctcataaaatgagttagggaggagtctctccttttcaattgtttgcattagtttcagaagaaatgacactagctcccctttgtaccttaggtagaattcagctgtaaatccgtctggccctgggctttttattttttggttggtaggctatttattactgcctcaatttcagaacttgttattggtctattcagggattcagcttcttcctgattcagtcttgggagggtgtatatgtccaggattttttccatttcttctagattttctagtttgtttgcatagaggtatttatagtatgctctgatggttgtttctatttttgtggggtcagtggtgatatcccctttattatttttattgtgtttatctgattcttctgtcttttcttagctagcagtctgttttattaattttttcaaaaaaccagctcctggattcattgattttttaaaatgtgttttcatgtctctatctccttcagttctgctctgatcttggttgtttcttgtcttctgctagctttggggtttgtttgctcttggttctctagttattttacttgtgatattagggagtcaatttgagatctttctagcttttcgatgtgctagaaatttcccacttaacactgctttatctgcgtcccagagattctggtatgttgtctcttttttctcattggtttcaaagaacttcttgatttctgccttaatttcattatttacccaagagtcattcaggagcaggttgttcaattttcatgtaattgtgtggttttgagcgagtttcttaatcttgagtcccaatttgatggcactgtgatctgaaaggctgttatgatttcagttgttttgcatttcttgaggagtgtttcacttccctttatgtgatctattttagactaagtgccatgtggcactgagaagaatgtatattctgttatttttgagtagagagttctgtagatatctattaggtccacttgatccagagctgagttcaagtcctgaatatccttgttaattttctgtctcgatgatctgtctaatattgacagtggggtcgatagtgggagacttctcccactattattgtgtggcagtctaagtctctttgtaagtctctaagaacttgttttatgaatctgggtgctcctgtattgggtgcatatgtatatttaggatagttagctcttcttgttgaattcacccctttaccattatataatgccctcctttgtcttttttttatctgtgttggtttaaagtctgttttatcagaaattagaattgcaatccctgcttttttctgctttctatttgcttgataaatttttttctatccctttattttgagcctatgtgtgtctttgcatgtgagatgggtctcttgaatattgcaagctgatgggtcttgactctttatccaacttgacattctgtgtcttttaattggagcatttaggccatttacatttaaggttaatattgttatgtgtgaatttaatactgtcatcatgatgctagctggttactttgcagacttgttgatgtagttgcttcatagtgtcattggtctttgtacttcagtgtgtttttgtagtggcttgtgatagtttttcctttccatatttagtgcttctttcaggaactcttgcaaggcaggcctggtggtgacgaattccctcagcatttgcttgtctgaaaaggattttatttctccttcacttatgaagcttagtttggccagaaatgaaattccgggttggaaattcttttaagaatgttgaataatgccccccaatctcttctggcttgcagggttcctgctgagagatctgttattctgatgagcttccctatctaggtgacctggcctttctctctggctgcccttaacattttttccttcattttgaccttggagaatctgatgattatgtgtcttggggttgatcttctcatggagtatcttactggggttctctagatttactgaatttgaatgtttgcctgtcttgctaggttggggaagttctcctggatgatatcctgaagtatgttttccaacttggttctgttccccctgtctctttccggtactcaatcagtcataggttcagtctttttacataatcccatagtgctcagaggttttgttcattccttttcgttctttttttttttttttttttcctaatcttgtcgacctgtcttatttcagcaagatagtcttcatgctctgaaattctttcctctgcttggtctatttggctattgatacttgtggttgcattgtgaagttcttgtgttgtgtttttcagctccgtcaggtcattcatgttcctctctaaactggttattctggttaatggctcctgaaatgttttatcatgattcttagcttctttgtattgggttagaacatactcctttagctcagcaaagttcgttattacccaccttctgaagcctacttctgtcaattcatccatctcagcctctgcccagttctgtcctcttgctggtgttctgatcatttggaggagaagaggcactctggctttttgagctttcagtctttttttgttgattcgttctaatcttcatgagtttatctagcttcaatctttgaggctgctgactgttggatggggtttttgtggtgacttttttgttgatgctgttgttgttactttctgtttgtttttcttctaactgtcaggcccctcttccgtagggttgccatggtttgctgggaatccactccagaccctatttgtctgggtccctcccacacctggaggtatcaccagtagaagctgcagaacagcaaagatggctgcctgctccttcctctgggatctctgtcccagaggggcaccaacatgatgctagcaggaatgcccctgaataaggtatctggtgacccctgttgggggttctcatccagtcaggaggcacaggatccaggacctgcttaacgaagcactctggctgccccttggcagagggggtgtgccgcactggggggattcacactaatctggtgtgccgggattcctccgagccagcagggggaaagactaagtctgctgatccatggagactgtggcctcccctcccccaaggggctcttttccagggagatttgagttctgtccttaaacccctagctggagttgctgaaattcctacaggtaggccccgcccggtgagtagagaggggtcagagtctggcctaaagaggcagtctggccacgatctgccacagctgctgtgtgggctatggggtattccccctgggtccaaaccatccagtctccccagcctcagcagactggagctgcagcgatggtggccacccctccccctgggaggtcagtcatcttaggcagcaggcagccacagtgatggccgctgcccttctccatgggagctcaatagtcttaggcagtaggcaaccagagagatgacagccacccctccccctgtaaattggtagtcttaggcagtctccagccgagtggctgctgagaatctgcacagctatgtgcttgggacccaaggccctggtggcatgggctcaagaggtgaatctcctgattcccgggttgcacagattgtggaaaaaacctttggctgataccagacaaagacattacaagaaaataaaactagagcccaataaccctgatgaacactgatgcaaaaatcctcaagaaaatactaatatactgaattcaacagcacattaatgcagaaaaagcatttgataagattcaacaacctttcatgataaaagaaaaaacactcagcaaactaatagaaggaaactacctcaaaataataaaggctatctataaaaagcccaaagttaacattatactcaatgctgaaaaactgagtttttcctctaggattaggaaggtggcaaggacacccactttcaccacttctattcaatgtagattggaagtcctagattaggcaagggaaaaaaataaaacatccaaattggaaaggaagagctaaaattgtctctattcacagatgacacgagcttatatgtagaaaacactaaaaattacgtgcgcgcgtgcacacacacacacacacacacaaactgctaaaacaaattcagcaaagttacaggtcacagaacagtcagttgcatctcaaaaggaataatcaaaaaggaaattaagaaaataattccatttacaatagcactaaaataaaatacttcagaataaacctaaccaaggagatgaaagacttatacactgaaaactgtaaaacattgctgaaagaaagtaaagacgacaaaaataaatggaaagacattccatactaatggattggaagacttaatattgttaaatgtcaatattgcccaaagcagtctacaaattcaacacaattcctgtaaatatgacagtgaaatttttttcagtaagaggaaaacattatcctaatttttgtatgacagctcaaggaatcctgaataatcaaatcaattttttaaaagaaaaccaaattggaggattcacattttctgatttcaaaaaatattataaaagctttggtaatcaaaacagtgtgatagtggtataaagacagacatatagtccaatggaataaaatagagagaccagaaatataccttcacatacatgattaaatgatctttgacaaggctgccaaactgaaaaactcttaaaagagaacatgggggaaagctttatgacattggatttgacaatgatttcttggatatgacaccaaaagcctaatataaggcaacagaggaaaaaatagacaaatgggactacattaaatttcaaaacttttgtgcctcataaaacatgatcaacagaatgaaaatcatgcaacctatggaatgggaggaaatatttgcaaatcatatatctgatatgaggttaatattcagaatataaaaagaacatctacaactcaacagcaaaatgtcaaacaactcaatttaaaaatgggcaaggaacttgaatagacatttcttcaaagatgataaatgaccaacaaacatgtgaaaggatgctcaacatcactattcatcagggaaatgcaaaccaaaactacaataagataccacatacgttaggatagctactctcataaaaagaggaaataattagtgttggcaagaatgtggagaaattggaacccttatgcactgttagtgggaaggaaagtggtataactaatgtggaaaacagtatggcaagtcctcaaaaaattaaaaatataactactatatgatccaacaatcccactagtgtgtatacatccaaaacaattgaaagcaaggtttcaaagaggtatttgcatacttttgttcataggagtgttattcacaatagccaagaggtagaagcaacccagatgtccatcaacagatgaataaacaaaatgtggtctttacatatagtggaaaactatggaaatactgttatatgctacaacaaggatgaaccttgatgacattatgctaagtaaaataagccagttccaaaggacaaatactgtagattccactcatatgaggtatctaaagtagtcatatggaaaacaaaatggtggttaccaggagctgagggaaacagatgaaggacagttgtttaatgggtataaactttcacttttgcaaagtgaaaaagttctggagatctgttgtgcaacaatgtgaatgcacttaacactcctgaactttatactttaaaatggctaaaattacaagtgttttttccccacagttaaaaaaaaaaatacacaaagtgcatgccagtgccactgtcagaagaagtagtttaaagaaggtcccagaggcatcaggactctgtttcatccctctgagctctcttcactttgccttactctttgagtttcatccctgatatctgcatccctttccatcttcacattggccattcagaagagaaagagaacctgtgtcccagcattctcagaatcagccatgctactcactgattggactggtggaagccacacacccaaaactgaaccagttactatgggcaggagagatgggaggtgtgggttggcttaagccaagtagggcctgcctctaaaatggaaatggaattgatcccacccagaccacttggggaagagatggttttctaatgggaccaggaatcagcaaactttcccggtgaaagaccacacagtaaatattttaggctttgtgggtcatacggtttctgttgcagctactcaactctgccattgcatcatgaaagcaaccagagacgctaagtaaatgaatgagcatggctgtgctccaaaaaaactttacagacactgaaatttgaattttatataattttcaggtatcatgaaatattctttaaccactaaaatatgtaaaaatcattcttagctcataggtggctgataggatttggcccacaggctatagtttgcagactcccgttctagagaatatatccaaatgcctttttagcttggtgattatttttctttataattttaccggggttgccttcaatcctcctgcaatacctataatgagaccaccctcagctggtgtatttgctcagaatcctcaacccaactagcaacaaggcatttggaagatcgtgcaatctcttctcctttccccatctgcaatggattgtcacaatatgtttgttatcatagcacacttgggatatacaagataatacgctgttaaatattaatgataataattctcctcctccaccattattggaaattaaagacatgacttcaactccataggtacgatttatagagttaggtttaaactctgtcatgtggctaagcaattgttcttctatttttgttcacctttagcagtgacttttttcctagcttaaatatttagtagactggaactgtcttcaggatgatatatttcttaaaggctttattttccagtcattggacagagttctattatgtaaatgattaaagcaagtattcaaaatgtgagtttaaagatcttcagaatcagagggtgaccctggagagagagagataggaggtagagctgaacaataaagagaaaagggagaataaagtcaaggaagcttttaaattcctataaggagcaggtttggttgaatttctgaagaaagataaaaaaaaaaaactggcttgggaaaaagtaaaattcactggaatacccatggggctataggagggcaatgatatgttttaaaatgaaaatggaaaactgtggaattatttggttaaatgtattttggcagcctttggattttagttcaaatacctttagcacatataatgactttgttctttatgacctacctagttacttcttcaaaaaaaaaaaaaaaaattctgagcctcaaactagcctgtggtgcactcacaaaagccacccctttggggccattttgtcccagccagtggcatctttgtgctaagtttcaaggttctatgagaagactagatttcaacccccatttggctccttggacaagccccctgcatagccatttgcactggccggggtctgaggtgattcatgataaatgacatatctgattgggtagcagtgcacttgagttgctgttccccaggtagactttccaaacaaggtcaaaaagccattcagggtacagggctttgaaggaccacatagaattcacctctgttgacactaatgcatgtattgaatagaggacttagttgtctagctctttacaaaactaaattgtcctaattctggaagattacaatttataaactccagaactttattatagtgattgctttaatggcaattgattttcttttcctttttttttttttttttttttcttttgagacagagtctcactctgtcacccaagctggagtgcagtggcatgatctcagctcactgcaacctctgcctgcctgattcaagtgattttcccacctcagcctcccaggtagctgagactacaggcacacaccaccatgcctggctaatttttgtatttttagtagagaaggggtttcaccatgttggccagaatgggctggaactcctgacctcgggtgatctgcccacctctgcctcccatagcgctgggattccaggcgtgagccaccgcgcccagctggcaattgattgtctaatgcctattttacaattgcttccttctatgctctcttaagccctcattgtgaggcccactcaaggttaaggaggaacctctgactctttctctgagtggctccataatgcttttgctgtttactttatctgttttctccagggactttgttgttgttttatttttctttcattttctaaaatttaggactgccaaatgttaaactgtccccctgacatagcttttagctttaaatgtggcttctaatagcagccccttcataagatatcctgctgcctgatttccttttaatttgtagtttataacctcctgccaaccaggtaacaacaaactgaggttgttagaactatttataagataaaagttaataggctctaagtgagagcctcatgggctctcatgaaacattagcctgaggtttggtgctcaggttgtatgctgtctccttgacactcattcttttggtttgaattccccatatcttttccagtgcttgattgttgtattcctgacagttgcatttataggaaaatgacctctaaataatgttaaggtggaggctttttattatttttgaaataaaagctaagctgcaggaaagcctggtggttaggggtgtgaagtctagagtgaagctccctggggttggatcttctgtatcactttccagccacttgagggtgggcatgctgcctttctgtagtttgctttattcgtctgtaaaatgagcataattgtacttactccactgaattgtaagagggtgtcaaaagacaaaattaaaacaaagttagttatagatctaattggcttttatttgcaattcatgaaaccgggcagcctccattctataaaatggaatgagagctccactgggcaatgacagaacagtgagttttgtaaggtggcaataaggaaacagaataattgggaaaaaaaaaaaaaaagaacacctgctgagcatggtagctcatgcctgtaatctcagcactttgggaagtcaaggtaggaggatctcttgaggccaggagttcaagaccagcctgggcaacatagtgagaccatcatctctaaaaaagtttaaaaattaggcaggcttggtggcatgcacctgtagtcccagctactcaggaggctgaggcaggaggattacttgagccccagagttggaggctatagtgagctatgattgtgcccctgcaccccagcctgggtgacagagtgagaccctgtcacgataataacaaaagaaaaaaaagtttaaaaactgattggttaccttcaggttacttttatgggagggttaaagcaaaggggacttccttattaggctgactcagatggactggaatctcctgttttcaggaaaaactggtctattttggaatctatctccttccttaaaacttcagtttgattatgtgacatttagcatgagtgacttcattttggtttacactggtctgttggggcctactgcaggagctcagtccaaaacaatggcctcctataatttttgtttaacaagggttaaatgacttattcatatgaagtgctaagaacaggaagcactcaagtcttagcttttaatcaccattaatatgatgatgatgatgatggagagaaggaagaagagaacaagtaaggaagcagactctccaaacagacttcaaattaaatatcattagtgtgcctggtgtcttggaaaagatgatgtgtagtgtccttttctgctacctgtcgctctgaaatatataaagttgtagatatggcaaattttaggcttatcatgtttgaccttgatattctctgcctcctcttttagcccctgtttcctacagcatcatctccttgatgcccttcttcttctccaatgagaacctgcattgagaaatggatctgatagagtcagtcacactagagcaagcttgtccaacccgcaatccatgggacatatgcaccccaggacagctttgaatgtggcctaacacaaattcataaactttcttcaaacattgtgggaaatgttttgcgattctttttttgttttgtttttagctcatcaggtatcattagtgttagtgtatttcatgtgtggcccaagataattcttcttcttccaatgtgacccaaggaagccaaaagattggacacccctgcgctacagtctgacggaggagactgtgtactactcctcctgggggtatttgcattttcttaaaggaaaatgcctttaactagacaactgattctaatagtaaaagttctgataccaaagactaccccatcccccctcgccacttttctgcccacctgccaacctgcattcctataaacatacaaacactctgttttgaagtttaggcacaactgaccagcattaaggttaaaatagagatcataagactgacaaagcagactctttgtggcaataagataccaaattataaacatggcctatggtcatgcaaggcaacgttaagtcacaccctacaaaccataatatctcattaaacagatttttttattcaccaggtaaaatatggcttatgttccaacctgactctggcatagcatctcatgacagagcagatcctgaaggaaattatttcaccccaaaatatatttctttgacatattttgaaatggccatgcaaagctgtcttttgtggccgtttctactgcttaaacattcatgtacaagtctttgcatgtgaacatattcttttttatttttcttaagtagatacctgggagtaaaattgctggatcatatggttactcttttaaaagaaactgccaaatgttttccatttgacgttcttaccagcaatatgtgaatccagtttctccatatccttgacaatatttgtggttatctgtctttctgattatagccattctagtgagagtgaagtggcatctgattgtggttttgatttgtatttcccctgtgattaatgatgttgataatcttttcatatgcctattgaccatttgtgtatctgtttttggagaaatagctaatttcaagtcttttgcctacttttaaattgggtcattcatcttccaattaataagttgaaagagttcttcatattctggataaaatatttctttttatttcctgaaatattttgttataatctttttctcaagtctgagagtgctacagggtaggtaatttaaagttgagggccttcgaaatgcctcctcacaggagcagcactgattagcggttcccacaagcgtatagccatctgcaggctcccctggtgggtttgttcccttggtgtgaccaattcatcaaagtatagtctgtctgtgtcactctctccatagcaagagctgggtgcagtctgacatcagccatcatctgccctgaattttaattttaagcaccttcggtactgatgttcactcctgaaatctagagcagccagagtaagtgacaggagcctataatgagaaccttttctggaatattattcttaacacatgcatagatttgcccctctggtcacaaagagccccttggggcaaatcgcgttgttagcagttgacggagtgcagaaactgctgactccagagatttccatttctaaaggactttagagtaatcctattgtcagtttcactcatcacacctccctctggatccttttcccttttccctcccatgccaacctttataacacattctctaaatcttcctcttgcatgagctgtagccatctggtggtcaaatgggcattaaaagtgcctttgacagcatcgtggaaattgtaattcttgtgttttcaagacagatagctaacaggtgacaacaaaggttttcaacttccagaagttatcatatgagaaaatagtctgatattttactaagccaaaactatttcttatgctttaaaataatgttgtcttatacatcagtgtacatatcaacgagaaattactcacaggtggtgcttgttaaattctcaatctttcacaacacatttagttttaagtgctgctcttaaaatgcccaggagtctaagccctagaattacaagtttaaaaaaaaaagtgctttttcttatctacagtctgtcttcatctgctgtatccaacccagtttcatgggttatcatataaccaaatcaaattatggaaagctggaaaaaaaataagcaattcctaaagaaaacaatggctttagttgatcattttgtctttgagattgtaaactcataattggtatgcctcttgagggataaatgtttgagtgactgtgggggcctcacattcctcatagtgcttaattaaagcttttactgatttttcaattgttggagaatacaatgttagtggcatctttttggctgagtcctcacctagagaactcactagaggtgtttccactcatgttgcttggtatttagcctcatttttcccttcgttaatttacatctctgtttattttattgtcactgcttctgttaatataaatgatccttgttaatcctttgggtttaagacttgcaatattaattggcccttacccaacagcagagatctgagttacagtttttttttttttttttttgtcttccttctttgtgaaacataagcaaatcaccacacttttagaatctggctgtttttttgttggttggtgcattctgctttgcatttctgagaactccttcactcaggctaaatatccttctcccattttagacatctgcatggcaaccagatgtagacaaaagtgtaatctacactgggtcaatatacctgaaaacacccttgtaaacgttagttcctatctggagctcaatgacgacaatgcctatgctactttcatatgttaagtcctactagtgaaactttcttacagagatgggatgccgttgttggaatttttcctaagatgttagacagagcttctcaaattttcaattcaaggacattttaaggcataagaagtctttttggcttaatggggaaattgaaatgttctctcatgcaataacttctggcatttaaaaacttctctattattatccatcaaccaaccaattaacagaaatttattgattaattgccatatgccaaatgatgtagtaagtaccatgagaagtaggaagccaaaatgtgaccctgattttaaggagcataaatttgttcatctattcatttattcatccattcattcaactaatattaactaaatgttcagtgtgtgccagacacataatctagttaaggcaaaataagcatagcaaaaatatgtaagaactgtgtagcaggatatcagagataagacaaaactcccaggagctagtagttggcagagctaacatatcttatcttcctcacagtagccagtctgttagtctgtttttttttgtttttgttttttttttttttttttggagacagagtcttgctgtgtcacccaggctggagtgcagtggtacgatctcggctcactgcaacctccaccttctgggttcaagcaattctcctgcctcagcctcccaagtaactgggactactggcacccaccaccacgcccagctaatttttgtatttttagtagagacagggtttcaccacgttggccaggctcgtcttgaactcctgacttgtgatccacccacctcggcctcccaaagtgctgggattacaggtgtgagccactgcacccctggcccagtctggtaatttctttcacttctgatgcagttgcaaagcctccatggcctgacccagcctgcactgggctcctcatattaaaaacacttgccagagtgaaaagaaagataacagcattgctaagtggaagactcctctttgaatcatcttgaccgttgttccaagggagtattgtttgtagcacagatgtactctgtaaaaatccagtgttaggagtcattaaataaatctcacctgaaaaagccttctttgtattgacatttaacctggtattcaagattatccagatctatccttgagtcacttatttatcaacctacccagactggttctctcattctgttagttatctattgctgcataacaaatttcttcaaaacttagtggcctaaaacaacttacagttattctctcccatgggtcagaaatttgggcctggctaagtggatcctccaccccagggtctctcacaaggctgcaatcaaagggctgactaggacttggaatctcatttgaaagttagattggggaaggatctgcttccaagctcactcagtagttactggcaggattaggtttctccaaggtcgttggactaagggtctcagttcctcactgacagttggcctgaggctgccttcagtttcttgccatgtgggcctccccagcataactgtttacttcatcaaaacaaacaaactgagaaggctaaaaagagtttgctagcaagtagcaagatgaaaatcataatttttgcaatctaatcatagaagtgatatctccccaatgttgccatattctgttagttagaagcaagttattcaagggaaggagaatcctctaggtagttactatcaagaggcaggcatcattggaggccaactcagaagctgcctagcagatgcataattattttgttcaacaaacatttatccattatccaacatgttagtcactgaggtacaactaggattaataagtggctcttattctcaagatactcacagtctgcctgggaacatggatcaaccaatctttaacatggaaaatcttatagtagaggcagattcaaaacccaaatgagagcacagaaaagagagatgccttttttcatgaaggatcccctgaccagaatgccatttcacagtttaaaacaaacttaatgtgttctagtctattcaggaggctgggaagttcaagatcacaacaccagcaaattcagtgtcagctgaaggcccatttcctggttcagagatgacaccttatagatgtgtactcatatggttggggggtgggggtggggagcacaccagttctcagagatttcttttataagaaccctaatcctatgagagttgagcccttttgacctagtcatctcccaaaggccccacatcttaatatatcaccttggaatttaggatttcaacatgaattttaggggcacacaaacactcaggccatagaacttcttctgttggacctcctttgacactcttgtttccttaactacatttttaaaagaggtgacattagaggtggttcttaagaaatcaagtaagtagaaacagctttccaagtgtaaaacaacaaaatgaaagatgtagggatatgatgcaatgtgacacatgctaggaatgatggaattacaatatgaccagattgcttggatgtggtcagggatggagaattatcatggcaggcagtaaatctagaaacatgaattggagtcactggagaaaaggaaagtgaatgctatgtcaagatgcttgggctttgtcatttaggaagtagagagccactgaagatctctaattagtggaataatatggtgaaatgcatgccttacaaaggaactgcagaagcagggtggagaatttactggagttactagataagaagggagagataatatttcaaggagaattgacaacaatgaaaaagaggataaatatttttcaaaggccatggagatgaaaatttcaaaatcaggagatgttttagggctggaattgacaggattatcagatccagggaagagttgtgagaaatgagggggtgatatcaaagagccaaggatttccctgaaatttctatctcaggggaatagaagtctcttaaaagaaggaccatagcttagttgacttcagaatattaacattttaattgtgcttaggacttgtttggtattcactggattgacaggaggatggatggatggatggatgaatagatgaatggtggatgtatggtgcatagttggatgggtaggtaggtgagtcagtgggtggttagatgtgtggatggatgtatggataatgttggcagtcatccaaggaaatgcaagagggaagttagttttagggatagaggacagaacggatagaaggaagtaataagaatctcagatggctaagataatggtggaaagaacaaggagagcaattagaaaattaatctagttttttatggtaatccagtggctttgatatttctcaatggcaatttattgtttcattagattcaacaaatttcaagaaagagtagtttctttggagaacaaaactaattatttgtgcaaatcatattaacattgtggaaattcattcaatttctcggcactttgtcttaaaatgttatgcaaagtctggccatcaaagccatttagcatcccttcagttttagtaagggacgtgggaatattgatttattttcccagaaacgcaaatcaagaagttccctcctttcatatctcacactaaccttacctttaactttctaccagtggcacaaccataactcttggcaatcctcaagtttcttggacatcagattttctgaggcagtgcttctcaaactttaaagtgcatcatctggagatttaaaatgtgaattctgatttttgaggcctggctggggcttgagattccacatttctaataagcttccaggaagtactgatattgttgatccatgaaccacattttgggtggcaaggttcttaaggtatcattcaatattggtgacttggctgacatcactattgttgacacagttaggctgtcaactggctttcaattcaaaatttcatttacctcctacccctgctcataatctccctgggtgattttatattatctatcccttctctaatgcctccatttgctccaacttaataataatatgcatgggtagctccaacatgctgtcttcccctcctccagatccctaatgaagctgtcaaataggaccttcttaccactccctcctgcttttcctcactatttcttagcttaatgctttctttatagttcttatatttagtccttggtctcttgttccttaaagtcttcaaacactcacaatcgattaaggttcagaggtaaaggatcaagccccattttttgagtaagaatttggtatctaataacttacagtgtttggaaggtcaacaatgtatgtgagaaaaacaaacgacaaaagcagcaggcatgggtcactggggaatgatgttttcactagaaacaaggcagctcaagtatcaaccctgctgctgaacaattgcatgaccttgaggaaatcacttaccctacctgagccaacattttagcagctgtaaaatagtacattaaatttagatgatctctatggtcttttaaaattaattatgtagaggccaactcagcctcatatcttcattatatgtttaaactagaagagaggttcctaacatgaggttcatggatctccaaggactctgtggatagacttcagagagtccatgaagttggatgggaggtgaatttcatgttactttcactgacctctgactgtaagtgagcaatttcttcaataaggaatataaactatagactagagtagtattagcagtatctgtgacttggttaccgagacgcaacaaataaatattatatcacattaaagtttgtgtagatataacattcatgctcaccactacttcgaaaatttggtgcttattagactctccactacatcttcttgttgaacatgttagtgaaggagtacatctatttattatagcccagtggctgtcaataaggggacgttttgccccacaggacacacctaacaacatctggagacatttgggattgttgtaattggagaaaggaattctattggcatctagtgggtaaaggcaagggatgctgctaagtatcctgcagtacacaggacagcttttcagcagaaataattacccagtccaaaatgtcaagagtgctaagattgagaaacctgcgacagccttttaaaaatattattttgataattatgttttagtataataaattttctttgtaatcctgtgtattttattttatgcatttacaaacgttgttcttaaaagttgttcccatggccttgctagactatcaaaggaaactgatatggttgggctgtgtccacacccagatctcatcttgaattcccatgtgttgtaggagagacccagtgggaggtaaatgaatcatgggggcaggtcttccctgtgctgtcctcatgatagtgaataagtctcatgagacctgatggttttataagaggagttccctgcacaagctctcttgtctgccaccacgtgagacctgcctttcagcttccagcgtgatcatgaggcctccgcaaccacgtggagctataagtccaataaacctctttcttttgtaaattgcccagtctcaggtatgtctttatcagcagcgtgaaaatggactaatacagtaaattggtaccaggagagtggggcactgctgaagatacctgaaaatgtggaagcaactttggaactgggtaacgggcagaggtttgaacagtttggagggctcagaaaaagacaggaaaatgtgggaaagcttggaactccctagagacttgttgaatggctttgaccaaaatgctgataatgatatggacagtgaaatccaggctgaagtagtctgagaatgagatgaggaacttgatgggaactggagcaaaggtgactcttgttatgttttagcaaagagactgctggcattttgcccctgccctagagatttgtggaactttgaacttcagagagatggtttagggtatctggcagaagaaatttctaagcagcaaagcattgaagagatgacttaggtgctgttaaaggcattcagttttataagggaagcagagcataaaagttcaaaaatttgcagcctgacaatgcaatagaaaagaaaatcccattttctgaggagaaattcaagcaggctgcagaaatttgcacaagtaacaaggagctgaatgttaatccctgagacagtggggaaaatgtctccagggcatgtcagagtcttcacggaatcccctcccatcacaggcctggaggcctaagaggaaaaggtggtttcacaggccaggcccagggttcccgtgctgtgtgcagcctagtgacttgatgccctgcatcccaactgcgccagccttggctgaaaggggccaatgtagagcttgggctgtggcttcagagggtacaagcctcaagccttggcagcttccatgtggtgttgagcctgcaagtgcacagaagtcaagaatcggggtttgggaacctctgcctagatttcagaagatatatggaagcacctggatgcccaggcagaagtttgctgcaggggtgggacccttatggagaacctctactagggcagttcagaagggaaatgtgggattggagcccccccacagagtccctactggggcacctcctagtgagctgtgagaagaagcccaccatccttcagaccccagaatggtagatccactgacagcttgcaccatgcacctggaaaagctgcaggcactcaacaccatcccatgaaggcagccaggagagaggctgtgccctgcaaatccacaggggtggaactgcctgagaccatgggaacctacctcttacatcagcatgacctggatgtgagacatggtagtcaaagagatcattttggggctttaagatttgactgccccactggatttcagacttgcatggggcctgtagcccccgtgttctggccaatttctcccatttgggatggctatatttacccaatgcctgtactcccactgtacctaggaagtaactaacttccttttgattttacaggctcataggcagaagggacttgccttgtttcagatgagactttggactgtgggcttttgagttaatcctgaaatgagttaagactttggggaactgttgggaaggcatgattggttttgaaatgtgaagccatgagatttggaggggccaggggcagaatgatatggtttggctgtgtccccacccaaatctcatcttgaattcctacatgttgtaggagagacctggtgggaggtaaatgaatcatgggggcaggtctttcccatgctgttcttgtgatagtgaataagtctcacaagatctgtgaataagtctgacaagatctgatggttgcaaaaaggggagtttcccagcaagtttcttctcttgtctgctgccatgtctcttgtcttctcttgtctgctgccatgtgagatttgcttttcaccttccatcattattgtgagccctccccagccacatgggattgtaagcccaataaacctctttcttttgtaaattgcccagtctctggtatgtctttatcagcagcgtgaaaatggactaatatagggcctatggcacaaaacatgttaaaaacccctgagtgaggagataataaaggccatccagatttgaatctttttgtttgtagactaggaaactgaatctcaactacttgacccccgaagtcagcatgacacaatagaaagagcaaggttgttggaatcagataaggttcaaataccaaggttcaaatgtcagctccatacttactgcttataggactttcccccaacttaagtttccttggaattcatttttcaactgcaaataagggtaaaactgtctttcactgaaagcaggagtcagcaactatagctcacaggccaaatccagtttgcagcctatttttgtcaataaagtttcattggaacacagtcacacccatttgtttacatattgtctatgtctgcttttgcactacaatggcagtttggttacaacatagaccataccatacagcccacaaagcccaaagtattatcttgccttttatggaaaaaatttgcagacccctgacttggagtatagctgtgaggataaagggacaaaaggtatgtaaagatgtagctcattgcctggtacctagtaaacattaaataaatgtagtcattctcccctcttcaagacagagagacttttgtgggaagacagaacattgttctgggtccacaatgtatgatttctttgaactagagaggagcctaacagaaaatatataaggatatatatatatatatatatatcatatatataatacaactggtttataagtaagttctaaggaagttaaaatgagccagtagtatatttaaatatgattatatcctgcatttatccaagaaggccttaagatgatttccaactcaataaataacaatggattgaataaaatctaattgctccagaaggtagcatagtgcctgtaagtgaactttatattcagcattgagcttccaggcagccatggtaaaaagaaatcacgaaaaattgtgtaacacctgttataaggaaaaaaaaaaagtctacttgattatcacaggacaaaaggtttttatcctgacacaaattttaggcatcattacttacagaaatgtgtatagacacagtttagagtttaaaacaataattgaaactaacagaagaaatgacttttaagaatatcaaaattctccttgtctacgcacaacctcttaaacctacttgaacaataagtaaaaattgctgcaaatattaataatatggtaaaatagctctggaaagtaaagggccagtgtttgggtgagttaatacatttaacacagcagaacagttctgtgtgtttcggaaagaaggattgtttagtaggagagaatttgatgtctgagaaaaaggcaaaatgtttgtgcatttgatggttataactaaaaaatcattgtgccctcattcctctgtaaacagatgctaggaacacaagttaaaaaacaaaaaaacattgcaaaccagagccagaattagcatgaggcaagtgaggggggtcgtgtaagttcagagtcatatttgatctttatttaaaattttgataattccttcatggtggattctatgcattgattttgattttaaaacaatactgcataaaaatattatttatctagattactgagctttttatatccccttaaattttatgtccaaggcaatggcctcacttcccttctcctattcctggcccatatattcacgctactaagaaataattttaataaaaatatgtttaggaaggactcttccccaggctgagccaccttataggattcctgtcacctttcacatgttgatataaagtctttgtgtgtctaaagcagctttattcacagaaaagactcttcagggttgttttgttaaaatatttatcatttgatacattaaagttaaaaactccaaattcattgctctctggcttttaatttcagtttctaagaagagtccagactattttagcaacctgtttttaggggcctttaagtaatactggtccaatttacacacaacattatttaaataccttcaaaaattaaaaacatttttatgaagtatatgtgtattccaacaatatatattttttttttcctttttttttttttttgagacagagtctccccttgttgcccaggctacagtgcagtggcataatcatggctcactgcagccttgacctcctgggctcaagtgatcctcccacttcagcctctggagtatctgggactacatgtgcatgccacccgcctggcttatttttgtattttttgtagagactgggtatcaccatgttgcccaggctggtcttgaactcctgggttcaagcaattccccgccgcatccccccattccccacccttcacctcagcctcccaaaatgactggcctatatagtttttctattaatatttattctttaagcacgcctattgtctgaattaattaacaaaacttttccaggttctaaatacattttacaactcttgtaaaccaaacttataaatatggtgaaaaggtggttccaagatggccgaataggaacaggtccagcctacagctcccagtgtgagtgatgcagaagacaggtgatttctgcatttccaactgaggtaccgggttcatctcactagggcttgttggagagcgagtgccaaagcaggtcgaggcatcacctcacccaggaagcgcaaggggtcagggaattccctttcctagccaaaggaagctatggcagacagcacctggaaaatcaggtcactcccaccctaatactgcgcttttccaacggtcttagcaaacggcacaccacgagattatagctcgtgcctggctcagagggtcccatgcccacggagcttcactcattgctagcacagcagtctgagattgaactgaaaggcagcagcaggctgggggaggggcgcccgccattgctgaggctttagtaggtaaataaagcggccaggaagctcgaaatgggtggagcccaccacggctcaaggaggcctgcctgcctgtagactccacctctgggggcagggcatagctggacaaaaggcagcagaaacctctgcagacttaaatatccctgtctgacagctttgaagagagtagtggttctcccagcacagagtttgagatctgagaacggacagactgcctcctcaagtgggtccctgtcccccaagtagcctaactgggaggcaccccccagtaggggcagactgacaccccacacggccgggtacccctctgagacaaagcttccagaggaacgatcaggcagcaacatttgctgttctgcagcctccgctgatacccaggcaaacagggtctggagtgggcctccagcaaactccaacagacctgcagctgagggtcctgactgatagaaggaaaactaacaaacagaaaggacatccacaccaaaaccccatctgtacgtcaccatcatcaaagaccaaaggtagataaaaccacaaagatggggaaaaaacatagcagaaaagctgaaaattctaaaaatcagagcgactctccccctccaaaggaatagagctggagctggatggagaatgactttgacaagttgggagaagaaggcttcagatgatcaaacttctgcgagctaaaggaggaagttcaaacccatcgcaaagaagctaaaaactttgaaaaaaaattagatgaatggctaactagaataaccaatgcagagaagtccttaaacgacctgatggagctgaaaactatggcacgagaactacatgacgcttgcacaagcttcagtagccgattcgatcaactggaagaaagtgtatcagtgactgaagatcaaatgaataaaatgaagcaagaagagaagtttagagaaaaaaacagtaaaaagaaacgaacaaagcctccaagaaatatgggactatgtgaaaggaccaaatccacatctgattggtgtacctgaaagtgacagggagaatggaaccaagttggaaaacactctgcaggatattatccaggagaaattccccaacctagcaaggcaggccaacattcaaactcaggaaatacagagaacgccacaaagatactcctcgagaagagcaactgcaagacacatatttgtcagattcaccaaagttgaaatgaaggaaaaaatgttaagggcagccagaaagaaaggtagggttaaccaacaaagggaagcccatcagactaacagctgatctctcggcagaaactctacaagccagaagagagtgggggctaatattcagcttttttttttttgagacggagtttcactcttgttgcccaggctggagtgcaatggcacgatctcagctcaccgcaacctccgcctcccaggttcaagcgattctcctgcctcagcctccctagtagctgcgactacaggcatgtgctactacgccaggctaatttttgtatttttagtagagacgggttttctccatgttggtcaggctggtctcgaactcctgacctcaggtgatccacccgcctcagcctcccaaagtgctgggattacaggcatgagccaccgcgcccagcttcaacattcttaaagaaaaggattttcaacccagaatttcatatccagccaaactaagcttcataagtgaaggagaaataaaatactttacagacaagcatatgctgagagattctgtcaccaccaggccagccctacaagagctcctaaaggaagcactaaacgtggaaaggaaaaaccagtacaagccactgcaaaaacatgacaaactgcaaagaccatcgatgctaggaagaaactgcatcaactaacgagcaaaataaccagctaacatcataatgacagcatcaaatccacacagaacaatattaaccttaaatgtaaatgggctaaatgcaccaattaaaagacacagactggcaaattggataaagaatcaagactcatcagtgtgccgtattcaggagacccatctcacatgcagagacacacataggctcaaaataaagggatggaggaagatctaccaagaaaatggaacacaaaaaaaggcagggattgcaatactagtctctgataaaacagactttaaatcaacaaagatcaaaagagaaaaagcaggccattacataatggtaaagggatcaattcaacaagaagagctaactatcctaaatatatatgcacccaacacaggagcacccagattcataaagcaagtctttagagacctacaaagagacttagactcccacacaataataatgggagactttaacaacccactgtcaacattagacagatcaacaagacagaaaattaaaaaggatatccagcaactgaactcagctctgcaccaagtgggcctaatagacatctacagaactctccaccccaaatcaacagaatatacgttcttctaagcaccacaccacacctattccaaaattgaccacatagttggaagtaaagcagtcctcggcaaatgtaaaaaacggaaattataacaaactgtctctgagaccacagtgcaatcaaactagacctcaggattaagaaactcactcaaaaccgcccaactacatggaaactgaacaacctgctcctgaatgactactggatacataacaaaatgaaggcagaaataaagatgttctttgaaaccaatgagaacaaagacacaacagaccagaatctctgggacacatttaaagcagtgtgtagagggaaatttatagcactaaatgcccacaagagaaagcagggaagatctaaaattgataccctaacatcacaattaaaagaactagagaagcaagagcaaacacatttaaaagctagcagaaggcaagaaataactaagatcagagcagaactgaaggagatagagacacaaagaacccttcaaaaaatcaatgaatccaggggctggttttttgaaaagatcaacacaattgatagacggctaccaagattaataaagaagaaaagagagaagaaccaaatagatgcaataaaaaatgataaaggggatatcaccaccgatcccacagaaatacaaactaccatcagagaatactatcaacacctctatgcaaataaactagaaaatctagaagaaatggataaattcctggacacacacatcctcccaagactaaaccaggaagaacttgaatccctgaatagaccaataacaggctctgaaatcgaggcaataattaatagcctaccaaccaaaaaaagtccaggaccagatggattcacagccgaattccaccagaggtacaagaaggagctggtaccattccttctgaaactattccaatcaatagagaaagagggaatcctccctaattcattttatgaggccagcatcatcctgataccaaagcctggcagagacacaacaaaaaaagagaattttagaccaatatccctgatgaacattgatgcaaaaatcctcaataaaatactggcaaaccgaatccagcagcacatcaaaaagcttatccaccatgatcaaggggacttcatccctgagatgcaaggctggttcaacatatgcaaatcaataaatgtaatccatcacataaacagaaccaaagacaaaaaccacatgattatctcaatggatgcagaaaaggcctttgacaaaattcaacagcccttcatgctaaaaactcaataaattaggtattgatggaacatatctaaaaataataagaactatttatgacaaacccacagccaatatcatactgaatgggcaaaaactggaagcattccctttgaaaactggcacaagacaaggatgccctctctcaccactcctattcaacatagtgttggaagttctggccagggcaatcaggcagcagaaagaaataaagggtattcaattaggaaacgaggaagtcaaattgtccctgtttgcagattacatgattgtatattagacaaccccattatctcagcccaaaatctccttaagctgataagcaacttcagcaaagtctcaggatacaaaatcaatgcgcaaaaatcacaagcattcttatacaccaataacaaacggagagccaaatcatgagtgaactcccattcacaattgcttcaaagagaataaaatacctaggaaggaattcaacttacaagggatgtgaagaacctcttcaaggagaactacaaaccactgctcaatgaaataaaagaggacacaaacaaatggaagaacattccatgctcatggatagaagaatcaatatcatgaaaatggccatactgcccaaggtaattcatagactcaatgccatccccatcaagctaccaatgactttcttcacagaattggaaaaaaactactttaaagttcatatggaaccaaaaaagagcccacattgccaagacaatcctaagccaaaagaacaaagctggaggcatcacgctacctgacttcaaactatactacaaggctacagtaaccaaaacagcatggtactggtatctaaacagagatacagaccaatggaacagaacagagccctcagaaataataccacacatctacaaccatctgatctttgacaaacctgacaaaaacaagaaatggggaaaagattccctttttaataaatggtgctgggaaaactggctagccatatggagaaagctgaaactggatcccttccttacaccttgtacaaaaattaattcaagatggattaaagacttacatgttagacctaaaaccataaaaaccctagaagaaaacctaggcaataccattcaggacataggcatgggcaaggacttcatttctaaaacaccaaaagcaatggcaacaaaagccaaaattgacaaatgggatctaattaaactaaagagcttctgcacagcaaaagaaactaccatcagagtgaacgggcaacctacagaatgggagaaaatttttgcagtctactcatctgacaaagggctaatatccagaatctacaaagaactcaaacaaactcacaagaaaaaaacaaacaaccccatcaaaaagtgggcgaaggatatgaacagacacttctcacaagaagacatttatgcatccaaaagacacatgaaaaaatgctcatcatcactggccatcagagaaatgcaaatcaaaaccacaatgagataccatctcacaccagtcagaatggcaatcattaaaaagtctggaaacaggtgctggagaggatgtagagaaataggaacacttttacactgttggtgggactgtcaactagttcaaccattgtggaagacagtgtggcaattcctcaaggatctagaactagaaataccatttgacccagccatcccattactgggtatatacccaaaggattataaatcatgctgctataaaaacacatgcacacgtatgtttattgcggcactcttcacaatagcaaagacttggaaccaacccaaatgtccaacaatgatagactggattaagaaaatgtggcacatatacaccatggaatactatgcagccataaaaaagatgagttcatgtcctttgtagggacatggatgaagctggaaaccatcattctcagcaaactattgcagggacaaaaaaccaaacaccacatgttctcaatcacaggtgggaattgaacaatgagaacacttggacacaggaaggggaacatcacacaccggggcctgttgtggggtagggggaggggggagggatagcattaggagatatacctaatgtaaatgacgagttaatgggtgcagcacaccaacatggcacatgtatacatatgtaacaaacctgcatgttgtgcacatgtaccctagaagttaaagtataaaaacaaaatttttgagagagaaaaaaaattatggtgcaacaaaactagttttgttttatacatttctaaatgtccacataaattatttagatttcaacttgaaaagatcactcaattatatactttatctgggagtcacaagctattgtcttaataggctatatttctcttaactattcaagcatatacaaccccaagtttgtgcagatgccttaaccaggaaacatcgatacaatgtttttaagtgtcttggttatttctgttctcatttttaaagcttcccagagttgaaagctatgtgggcattcgggaagtgaaaggcaatctcagttactgagatgacttttaattagagattttaactgggtgctgagacttggaatggtagacatctaaggtgattcttctcataccaactgtgattttatcccatgaaatttggggtttgccttctcagtatcctgcaggttttgaacaatcagtgatttcagccaagagctcatcaggtccttctcaggaacctaaatgggttactctaaacctatgtacctagctgctactggtaaacccatagctttacaggggtgcaatcatgctgcccaggtctttggaggtgaattatatacaatacccaatcctttcttcttctacaaaaagactgcaaaccccacgtaagttaatcgtttgactagattctgcatacttttgtttctgtatcagtgtaaatgccccttctgtgtgagtttaagatcttcgaactaggtagaatattgcttctttcagattgtcaggccccaccctgttcgtggacagttatttccactcctattgaattctctacctggctgtctagcctgtcaccacaactggtaagcctcttctgttagcacacggaattgcagaattttgttgattctagaggaaacttgtccaacccgccacccgtgggccacatgcagcccaggacagcttcgaatgtggcccaacacaaatttgtaaacattctttaaatattatgagatttttttttaagctcatcagctattgttagtgttagtgtattttatgtgtggccccaagacaattcttcttccagtgtgacccaagggagccaaacgactagacaaccctgttctagaatgttctccatggctgctccaaactcagccgcttgctctgtattaactgcagaataagagcttttctcatttatgcctcccagtcatcaggaccaaagtgtaagatgcatcaaagtttccctggatggttggtgccctagggcagttgccatgaaccaagtacaaaaagaaaaacagacttttccaaaattaattcaaatgggcataactcttttggaaattgtgtagcacatgttgccaggctggggggatgggctgtgtgtgctattttaatgagactgcagactggttacatctacagcttcccatattttggcttattttagaaagagccagaaaatgatgtttaacggtaaactgcaagaagacaggcagggaggaggggcagatggcatgaagtaatctttctgcatttcaaggcataggccaactctttgttaaaatattctttccagtttggaagcccttggcttaagggaaatttggaaaaaccaagctcatgtcccaaccagcagctcatctagaaagtaaaaatgaaaactctaattatcagtcagtcagtggtttttatcgtgcaacagttaattgtttcacttaaaaccactgctggtaacagctggaaaggaaagtgactggagaacagggtcatttaaaaccattattttgagctacagtttcaatgtcaatgaaagagttgtccaaattttggcatatcactttctaacgaattttagttttatgagatagccatcatttagtgaaatatatcccaaatcgtgagaactgtatttcttgccaactgtctttttttttttttttcttttgagatggagtctcactctgttgcccaggggtggagtgcggtggcgtggtctctgttcactgcaacctccacctccaggattcaagcaattctactgcagcctcccgagtagctgagatcacaggcatgtgccaccacacccggctaatctttgtatttttcgtagagaccaggtttcaccaggttggccaggctggtcttgaactcctcacctcaaatgatccacctgccttggcctcccaaagtgctgggattacaggcatgagccactgtgcctggccttgccaattgtctttattcctcttctcttagtagcccatgggagactattgtagtgtgtccttatgaccagtgttttccaattatttgttagccagaaattggaacactgaatatactcttctataatgttaaaaatggtggcaaaatttcaggccaacctataagaggtacctggttaatatataatatagctgtagttgggaatacaaagggatattttttccccagtagtctttccatctggcagtatattatgatccattcatctcaatcttgctacctcaaaagcagaagtggcagatgaatccacccagcaaacgccatagaggtgggtccagctgaggctttacctggcactgaccgtgtcctcctccattaaaacactggtaccaggctgggtgagtgactcatgcttgtaatcccagcagtttgggaggctgagatgggaggatcacttgatcccaggaggcttcagtgagctatgactgtgccactgcactccagcctgggtgacagagcaagactgtctctttaaaaaaaaaaaaaaaaaaaaaaaaaaaaagcttattaaaacactgatacctgacatatatggctgttatggctgcggtggggattacatgtaaatatggcaagacctataataaaaagttaatatttattaaatacttatgaggtacccttcactaattaagtcgctcctgcaacgatgccacagaatggtgcttccctatgtcacagacaaggaaccaaagcacagaaatgtcaagtaatcggccgaaggacacacagctagcaaacagcagagccaattcaaacccacacagtctggctccagaagccatgctttggtcactatagtccaggggtcagcaaaccatagcccatcacctgttatggtctggcccaaaagctaagaatggttttaccaattttagagttggggtgtagggagagagaaatatttcatggcatgtgaacaaagatattaaatttaaatttcgatgttcataaatcgtctcattggaacatagctactcctattcatggaacacagctactcttattcccatacatactgtctatagctactttcacaccagaaatatcatgacaaaatgtttatgacataatggcaagggataaaaaagaatacagaaagtatgattccactaatttacaagaatgcttaaacaaaaaatactttaattattaataatggattgtagaaacatgagtaatttttttcatctgcatttcccaccttctctgtgatgatcaggtatgccttttgcattaacaaacatcaaccttaaaattaagtaagttggcaaaggatcggttaatttgtcaaagaatagaagggattctaaataacaaaagtaaacagacatttggtgaaagactctaagatcgggagttctaactatcatgtccattttaatgacttttggttgtaaatcattcttgggtacttaaaaatatcaaagatacactgcagacattttagaaggctcccgtataagtatggacttaatatatttttatgtatctttatttcccatatatatccttgttaattctcaaacagggaaaaatgtaaaccttaacttttatttgtcacatcattagtttcttaatgtagatatcctgacatgaaattttgccccatgggctgtactccccttctatgttattactgaagtgtgagatgtctgaaaagtatcttaactaaagatgaaggaatttcactgatatctgggcattataggaaaggggaaaaaagtgagtttaaatgaaatgattttctgagggattttaaaatccttaaattgggtataaggagggccttcttttattagtgtacaaatccagccctctacattgtgctttcacaccctatgccattcattgcagcatggtaacttactgctttctgagctctgaggttcagaaaagttttacttgcccgaagttacatagctgcaaaattctggtctggcattatatctggttctgctgaaactgtacttctcaactctggcttctcaactgcctggcaacatgccaacatgatgacatccagtttagaattccaccctctactgtcccttggttctcactacaaggtgtcactaaggcacagcattcatttccaatgtttttttccatctttctgtggactgattaaatgagaatattcttggaaccgatagagaactgggcagctcattggcagcatggcagtcaataaccgaaggggccataaacaaggttaggtcttatctagttgggccaggcagcagatgtaggttttaatcaagtcaggccacacatgggttggggaagtagctaactctagctaagcctgtgttgggaagctaaatctaggctggtgaaggaagccaatagggcccaaatagctaatggggcttgatccttcataatgagttcctcccagaggtggctcagcaccttggacagttaccaggagagtcacagtttctgaaggagcctgattccctcccaggtcgatttttttggcacaacttctacttctttgaaaaacttcctgttctcccctcttttctcagggttcttatgtgcagaattgggagaatactgatacaactagcaaaatgagctgcttctgaggatatccacacacataagatttccctgattattagacagaaaagtcaccgcttctagccagaagtgtgtctagttccatcagattggcttgtgtcacgaagggaaatatctagttattgtcttcccagaactcttctttcctgggccagcttataagtactaacaacacagactcttctttgcaagttattgagaggaaaaattgtcatttaattcacagagtggattcctaaaatgtgcacactcaaatattctctatttcttatgttgatattgactgttctcactttcccataaagttagattattcaaatcatagatcttcatttacattctatagctgaagttaatgtaccttttcttgattaattctcaaaacaagtttatattttgtataagatctctttaatatgaaagctcatagtgtatctttatagataggtgtatgttttctctgtaaatttgccaacctctgcatctggttcagaaaatggaagttctgaatcagagctacaaaaagatttaatgggcttcatgctgctgttagcggcagtatccaggcaccaatagaccagtatttcccaaactgtgttttgctggacactagtctaacaaaagctctgtgaaaggaaattcttccaaggaagagaagtttggaaaactctgccttactttctacctttttggagaatcgcagtgctcattagcattatgtgtgtaagtaaagaaagctttttcatgctcccagttcagcattttccaaatacattggacaccataacagtttttaaaactagtagtactctgatctactatttaccataaaacccttttctagatgtagtcaattgtcagaatgtcattgaggcaaccaacatatctaatatacaaagttagtgagatttatgtctcctaacctgagaatctatgactttttgttatcctagcttaaatatttacatatgtgacagggtcaatcctagaatcaaaagaaatcatatttatgtctttcttaagtacacactttggaacttggagaaatacttttctaacagagaagcaagtaattaggtgtaattacacattggaaagtggcaggtatgtagatagaggcctcaaacacacggatccttttaaccataattaaagtatataaaattgatagacaataaattttattataaagttctgtgttgaatatggaaaataaccaagccaaaatgtaaaaaaaaaaatccttggactgacatcataatgaccttaaagatgttagcatgctctttgaagagtaaaactcttctgaatatttaaaaagatcatgatatctatttatttttcccaggaaagagtgtaatgatttattttggattcactgaggtatactgctactgaatatttcagaatagcatgccaagtgcaaaaactgtagtactgtttgcagcttcaattttgaaagcacttttccaacccatttattaaagagtatccattttctgagccaaatgatgtaacaaaaaaaattgttctctgtatatacacagcacttttttttcttttggaccttgggtacaaaagattgatttaataatactcctcaattcatagaacataatcatacttgatcctcataaggctttctgatacacgtactcatatatacatttatgtacatctatgtgtacttactttctcttttagagtgtatataagaatatagcaaatatattcatatatatgcatccatattaatatattcccttttatattgtaaatatatacgaatacataaaatatgcatatgtatatatatatcatacatatgcatttatgtgaatacatatgcatattttatttttctgtctcctggagaaacactgtttcatatatattctattatttttatgtgtccttgataaatatgtatagttttctgagcatgttgtcttagtttatcatgtaaacatatttacatatataatgtttcttttttcattcaatactatagttttagaaataacttttgactttgaaaaactgcaaacataaaccaagtatgcaatgagagaagagtacactgaactcccatatgcccatcatgcagtttcgacaattattaactcatgactaatcttatttcatctatgtccccacacacttctctcctacctatactacttgacacaaagcttagatatcatgtcattttatcaagtatttaaatatatatatccaaaacatataatgacactgaaattatcatacccccaaaagacagcaatttcttaatactacgaaatttcctgtccatgttcaattttctcccagtggcctcatggatttgttgttgtttttgtttgggtaaatcagcatccaaataagagctatacatagcaactgattgatatgtctcttgaatctcttttgatttctggaatttaattttctttccatatatttgttgaaaatctatttggtttgttctgtaggtttttatctctggattttatctcatacccatggtgttatttagcatggtcctctcatcctgtattttctgggaattggtggttatatagagagatttaattagtcttctgttaatttttctttctgaggggagaatatttcattggtggtattgagtacttccatttggaagcatagggggtgtctgtgtgtgtaatgttagcagccattgatgctcagtgcttaaacattaagttaccaggtgatgggaaatagtgatatgctaattctatcattccattttcacttagtaactgaaaaactccccctcatcaactctttgttacattgactacagtttgtatgaaaggtagaataaatggttgagtctttccctttattcagtagttttcaaaataatgagttggttccctagcatcccccaaaggtggccaatgatgttttcctacgttattgtgaatttgctttctggtataacaagatattccaggatcatttgtgcatttcctatcccagacccaggatcagtcatttctccaagaaacccgttgcttgtagtagcaaatggtatttaaatccaaaatctgggagctagcagtatttattactactgagttgttcactgttcttcaaggtctttttagtaagcagtgttaggaaatatatactttttacaataaactacattatgatttcatatttccaattcaaattcaggattgtaagatttttatataacctcattgatcttacatctgtatctatttttccaatatctctcagcaccaatataagtattattttgcttccatcccctaaatcatccagtctcaacataatacctcaacaccaataacaacaatatatattgaaaatggttaaatatattttgcagttcttttgtccttagggtatattccactagggatgtttattcaaattgccatgcttcaaattcacttgaaatgtttcctttctttatacttatgttaccagctcaattcacagattcttttcacttagcttttgatttctaaaaatgtgcttcttaaatttaatcttgctctataactatgtaaagtatttacctggttccaaagtgaaatctataaaacgatatttattcagagaagactaacttttatccctgtctcttccccataggtaatattgtatttttaatttttattctgtcatcccattatttttaaacatctatgaatatgtctgtgtatatatcctttttgaaaataagctgagtgcaatgcctcgtgcctgtaatcctagcactttgggaggtggaggcgggaggatcgcctgagcccaggagtttgagatcagcctgggcaacatggagaaaccccatctctccaaaaaatacaagagttagctgggcgtggtggcatgagcctgtaatcccagctacttgggaggctgagaggtgggaggatcacttgagcccagggaggttgaggctgcagtgagccatgattgtgccattgcactccaggctgggcaacagagtgagaccttggaaagtaagtaaagtaagaaagaaagaaagaaagaaagagagagagaaagaaaaagagagaaaaacaaaagaaacaaaagtatacaaaatattctttgctctacgttgcctttcacttcacagtatattctggagatagcttgccaatggtatatagaagtagtcctcactctgttttgcaactgcagagaatagcaatgtacatttgggttgtttctagtcttatgcaactacatatagtgccatgtgccactagttttgtgagatctatccatatgcctatatatatatatatatatatatatatatatatctaatccactaatttatttgcaacaacatacttcatgtagcatttgcctctcctctggccccctccctttaacaaccttcaactcccctgctacttactcaggtccccaggtctttacaccagtcccccaccccagccaaagctgtaggtggcactgtccaaacaaggcgaggtcctgctagatggcataaaacaccagctctgtgaaagctggagtctttgtggggtctgtggttttgccctgattctcatgaagcgaaatcttctcctgaagcaggtacttcagaagaaactatgtaatttcagtatcaaaaatagctgtgcttctcataaatgttgtgagtttattttatacacaatgtgaattatgtaaatggctagaattttctgcattgacttcaagaaagtttggtgcctaatttatgacccactcataacaagtatatgaaattttatggttgtattttttcttgttttcttaaacaatcaacattatggtggacataggttttgtttttgtttttaactgttaaatcaccctagttctacaaagcgcaagtcttgctgcaatgtacccattttgtatccagcctatgtcagcattctagaacatatacaaacattccatgttattccattaaagtgaatatttacaaacatcattgcccttgaaaaatgtttgtctcaataaaaaatacaacctaggaaaatctgcatatgtatagtatagtgttttatatagactattgtttatatataaacataatttcattatctagcaccactaacaaattatatatgatatggaagggagtttttctgggtacctggaactaatatccaaaacataatccactaatgcattcaggagctactgaaatgcagatgatggtggttcatatgcagagagatttccaaacaatgtgccttccaaggctgtctgggtcattgtttgtgaaactgtagccatgacctattattgacttatgaagtcaattcaataagtcacaaccagctttaaaataccacctagattaaaatagaaaatacagtacattgtgtataagtattcttttggaaaacttttgtttcactcttaacaaatatagatgtatatatgcacactggatcagaaaggaaaattcatatctttgttttttttgagatagggtttcactctgttgcctaggctggagtacagtggcacgatcaataactcactgcagcctcaacctcccagggctcaggtgatcgtcccacctcagcctccagagtagctggaactacaggcacatgccaccatacccagctactttttgtactttttgtaaagatgtggtttcaccatgttgcccaggctggtctccaactcctgaggctcaagtgatccaccaatcttgattgccgaaagtgtagggattacaggtgcgagccaccatgcctggtcatgtatgtcttcttgtaggaggcagttaagaatgtcggaagggtcctgctctggggggccgtaggtcccaacccatctcaccccctgaccactccactctgcttcatctccctgtgggctcctttcattctttttggtaccaaaactacattcagaatagccaccttcttcttcccttttctttttgttacttttcctttttctttttaaaattatgtgtgatgactctgcttgtcctcttagtttgggacaaaaaaaaagagttctaaaatagtctcctcttgtcaatggacctctacctcaccttcagctgccatataactggtgagtcatagaatgtcagggtggatttctggcccctgcgtcttttctactgtgtttatctgtccacacagtccaaaggttgtttttctcctgcttttttgtttaagttgggttttatgctcttatagctgtcaagagacttaattattcttttatatatttttttgagattggatatataaattcaataaaatagctatcactctttcttttactgttattaaaaatcaaattgagatacatcacaaaaatatattgtggatagcttaagataaactgatggattcagaagcattcctcttgtctaaaactttgcagtagacaactgaccttttaccaccaaaatccaacaagagagatggaggaaaaagtaggtacttagaggcagacatcgccatatattaactaaatagtccctcaggtcaaatcaagtgcagtcttctacaaaatactcaaaagctgtcggctttacagaggaatttccagaaagcagtaagattctggcatcctattaaaatacctagagtactctgtggatggcttgaaattaagcctagtctaatgtatcattttaactatactgtaattggaaataacaaaattcacatgaaatatgccatgcaaaggtttacccacttttatatcaaattaaacatgccatttttttctttctttttattttttagtgatggggtttcactatgttgcccaggttggagtgcattggttattcaaagatgcgatcatagctaactgcagcttcaaactcttgggctcaagcagtcctcttgcctcagcctcccgagaagatggaactacaggcactgtgcctggcttgaattaaacattctagtttgattagtgtggtgggtagaattctgagaaggcacccaggatccttgatcctggtataaataccctgtataatcccctcctgctgaatatgggcaggaccttgaacatgataggatgtcacttctatgattatgttacttagcatggcaaaggtggaaaaattgtgagatgtaatcaaactcctgatcaactgacattaatttaatcaaaatggagattatcttgggtgggtctgccctaatcagatgtgtccctttaaagagactccaagcagcagagaccctcttgctgacctcaaagaaacaaaaagtaatgttatgcactgcctacggaggggggtggactctaagagctgagggcttcactcctacagtcacaaggaactgaatccttccaaaaagcactgagcttagaaaagaaaccaaactccagataagaatcacagcctggccaaaaacttgattttaatttcatgaaactctgaccagagaacccagttaagccatgcctagactactgacccacagaaactgagataacagatatgccttgttttaaagccctatgtggtcatttgttacagcagcaatagaagactattacaattagaacctcgttaactctcaaagggtcataaatgttagacccaaaggatgcatgtgtaggagccaatggaaaacttccccttcaccctctgaaggttctctgcaaaaacagctcacaaaagacaaattaataagagaaagggtatacaagtttgtttgtttatttgagacagtctcgctgtgtcaaccaggctggagtacagtggcgtgatcatggctccctgcagcctcgacctgctgagactacaggcacacaccaccattcctggctaatttttgtattttcggtagacatgagattgtatcatattatccaggctggtcttgaactcctgagctcaagtgatccgcccacctgggcctcccaaagtgctgggattataggtgtgagccactgcattcagccagggcatataagtttattaatatgcatggggagaaccacagagtgattaccccaaccctccaatggggttcagaagtttatataccatcttgaggttacagaaagaataagggcttggatcttggcgaaacaggttatgggagggagagaagaggtagcaaaggtggtcttgttgtgtagatgaaacctcacaggtagcagctctcagagagaatagatggtgaatatttcctttagacctttgaaagtgtcagactctcaattaatcttccctagatccagacaagggaaggcttcgaagaaagcctggcttcatcaatgaagatttttctctacagatgcaaatctccccaacaaaagacagtttttcagctattcttgtatttccagcttttctgaatagccatcttgaaatatgtcaaaggagtatattttggggtgaaacattttggtttccttctccctcttgggtttcccaaaatactgaactatccccattggaatatgttgaaaatgtagcacttagaaaatctctcccaaagtttaaaatcaactgaacatttccaggaaattctccagtcctatctccatagtgccccatctctctaagcacgtgatttattctaagtgttacatgaatgctggaccccccctccccaggtgggccctgacctttacctggctattgtgcacaatcccttggtggatctcatgaaccagggattttacctgttcagaagggggcaggacttagaaggagaaggcaacaaattggaagccttctagggatctgattctgtgacacagagtgaatttatttcattttaacagcatcttctgagttaggcatcttttgccaattttgggaatgagacaacagattcagagagatgatgaagtcaaccacagcatattgttagtatatggtaaaaacaagatatgcagtaggtctgaaggattccaaaaagcaagtctcttgccaccacatcatgtccaattacaaatgtacagcatgtcaaacttcacacattcttccccaaaatctccaagtaaatcattcacatgtgatagtaaggctaccatttgcacatcccttcatgggctgcagtgaaaactgtacgtgtttcatttgatcctcacaaggttgattgcgcatgcaaaactgtcatatgcttttcccttgagaaacaatgagggtacattatctggaagtgaaaaagtatagggtcatgcctaacaagtcattgataaaaagaaaaagaaaagaaaatggcctacagacatttagatgaccaatgttctttttgtaaatgcaacaaatgcatgcaaaagaaagtaatgcatatattatctgtctctgcaactgtaaggttacaatgaaaaccaggcattttgtgctttttaattcaagacatatccccaggaagtgatctgactttaaaacataaactatatttgctaaatgatatctgttacagcatcatagatgttgactcttttcagaagtcattttgcattcaataggagacagcagggggaatgcatggattttttttttcccctccacatgaaaaggctaagcaaaagcagtatctttcaggagacatcagtgatagttactaaatgagcttattcaaacaaacattaaaataacctccagctgggcaggcctatatttccagctatttgggaggctaaggcagaaggattgtgtgaggtcaggagttcgaggctgtagtacaccatgatcatgcctgtgaatagccactgcactccagcctgggcaatacagtgagatgctgtcccttaaaataagaataaataatctctaagttccaggcatggtactgatttatatgtgttatgcttgaattttatattggtgtccacattttaactaggaggaatcagttaagtgtcagaccttcctattttgaaactgccaaaatttgcctacccattacccaagataattcttgagcacagaaaattgatttgggctctatactgtgtcagatttaggttaataactttcattggctgatttagaattaaatatgccttctagcaaatcaggagtacatttgagaaaacaaaagcacaagagaaatattggaggagtagaaagaattaattgtagaaaggattaggtcaaatggaaagagtgaacaagaatatgggaggtgtggggaagtgacaaaagatttttctagttagggcatgatcatacactatgtagaagtcttcatataactcttactggggccaggcgtggtggctcacgcctgtgattcctgcactttgggtggtcaaggcgggcagatcatttgaggtcaggagtttgagacaagcctggccaacatagtgaaacgccatctctactaaaaatacaaaaattagctgggtgtggtggcaggcacctgtagtcccatccactcgggaggctgaggcaggagaatcgcttgaacctgggaggcggaggttgcagtgagccgagatagtgccattacactccagccgaggtgatagagtgagactccgtctcaaggaaaaaaaaaaacaaaaaaaactcttattggagaaagaatcaaccttccttaaataaatattaacataataaaatatttttatttaataaaacaataaaataaaaattgtgtgacaaggggaacttgtgacttttgcctggttgaacaattattttaaattgtcaatttagggaagagaagaaagttgatgtcttcaaattatattttattctgtgaagaataaaaatgtctactgtattttcaatatgccctctgttttcagtccagaaaactcaatgttttgtttagagatgcaataaaagacttttcttttacaaatgtcttacaattacagactacattcagatagatgatttattgagttcgggaagtgaacagaatctaatggtaattcatgacacttttttcaaaacctactgaaaaaatattggtttagctctcacaataaaatattagacattatatacacagttggaaagtgttctcatttaaatataaaggtttgtgattccataattaatatttttcctttgttcaaacctgtattcaaatacttctgctttctcatctgaagcttttttctttaattttagagttgcccaaactacatgaaacagagttaagaccccagaaacatgcaaaaatgaacagccaggattgatggaggggaaagaaatcagcaagaaaaaatttagaagggaccaaaaaaaaattagttgcctgagggcctttataggtattggctagactttacagccatttgacttcataatgacacttaattttaagaaaaatttaagtaatgcattctttctttaaaaatgaaaaaaaaaaaaaaaaaaaaacccagcaaccagcaatggtgtaacttttggaaaagcctgctagccaaacaagaaaataaaattttggagcttaaagttttattagcttaaaatgtttatttccaacagtccttaataaattattgctgaatctttataaatttggcatgacatgtgtctggacaattggcatgtgtatattttttcatcacttcctagcatctcagagtaagggttctccctagtgtatgcacctcccctcatctttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacgggttttcaccgttttagccgggatggtctcgatctcctgacctcgtgatccgcccgcctcggcctcccaaagtgctgggattacaggcgtgagccaccgcgcccggccccctcatcttttttgacagctctaccaataatttctaggtccagtggaaattttgaatgttatttatctatttttacttttcaccgacattgtggaaatcagtacgtccaaatgtctaaacatctctccagatatttccactttttcaatcaattgaggactgataaaattcaatatattcccaataaaaacaataaaaaaagttaaaacatgttttcccattgaatcccatgttcaccttggatgtgtattccttagaaaaattccttagctataagtcataataaattacaaacttcaaaatcttatatttcaccttaaggaattgtctgcctctatcaagtgatacttagttatatttaattttcctacaaggtgctaaatgaataatcaagtcacctgatttttaacacaaccactttgaacatatttatggacacttattctatgaaaagcactattctaggtcccataaaagatttttaaaactacccttcattctcaaaaagcttaaaacatagttatcataaccataaactaaccgtataaagtagtttgtgatgtgtaccaaatgcagaagattggcaaagtgttgcgtgtgtttgaataagggatcgttacaatagttaatatttatctggtacaggcaccatgttttttccaccctgtcaacaatcttatggcatagttttattagttaggagtctcctggttgcaagtgacagaaactctgactcaaactggcttaagcacagagagggttttgttggctcatattcggggatagcaatagatctaatagctctcactgactctatgacaattagatgttaggcagcaattaagccaaagggcgagcagacatctctaattgtagcaggtgtgtggaaactggggagatttttttctgctagacatcagcctacccaagtctacagatgtcaatcctgcattcactcatcaaatgttacttgggaccaattcagtctcttgaagtaagccaaatttattcaagggattctaatttcatttaccactacagtttaataattatgatttaggcttaaaaacctacatcctgcttagatgaacctgtgtatataagtcagagcctgaggtgggttgggtattccccagagaggtttgaaaataaatcatattctttctgtaacttaaaaatacttttttcttaaagttctatgttcttatgaggatttcctctatttaacaagggtaggtcctaattcacatgatatagtcagcctttgtgaatattctccactgtggtattcaataaatttacctatattgtagctttttggtactggccatagtgaacctgtcatttatggcctatttccctcatccagacaattatgaaaatattggcagtctacctacctgagaggcttccttttcatgatctctgaggaactcagtgtgaagtaattttagctccttgagaggaaaaaatgtgcaaaagaagtacaaagtgctatgattaattctttcattgttttcaaatggtgttagttgaaagcagaaaatgaataaaacacaggaaattgacttgaaaactcacataaacgcacactcagtgaactgcccttgcatgctgagacccagagcgctttctactgaaaacatagatttggctaaaatctgtcatgaggcttgtataggcagagacaaatcttagtctgctttctatttgcatccaataaaataaagacatttaaaaacattttttgttttaataatagagagggcattgtcttgccgtgttgcccaggctggtctcaaactcttgggctcaagcgatcctcctgcctcagcctcccaaagtgctgggattacaggcatgagctaccgtgtccagctggtaaagacattttttcccagtgaaaacttggagctcagtatgtttgatgtttctcattaggggtgatgttaaaaatattttaacaacagttacaatatgggcacagccaagtcaggggagatatctagcaaaaacaaagtaaaccagtggttgcccatggaagcataggcctgatttccttggagcatgggctgtcaatgttgaaactgaaactgtgaagggtctgaaatgttaacctagtttcaagctaacaaattgacctgtcacaattttatgcatgtaagtgtgtacacacacacacacacacacacacacacacacacataccagacctctgaatcagagacagactgctcacagagcttttcccaaagccctggttcctcccagagcaactcagtgagatgtacaggagaggatctctggaattatgaaacccagagcttatataggaactgctggaccatctgtccatcaccctttgtggagaaagagggtgaccgctggtctgaatcataaacacaaattctctctgggaagtagaaggaaagatctctactcaccaccctggaagataaacacaaggctccagggaaaggtaggactttatattactgccaagggctcagtctttagggttgctattcagttgcctattaaccaggtgccagtactgttttcttagaaagtctcaaccttgcagaaacgtgaaaatattcatgatgcattatttctcaacacacaactttacctgcccattggaaacccttggaatttggctttcccctcaatgctgactggtctggaatgcttccagagtatttttaactctaacatgtccttataattgggttgagaaacactgctctaaatttcaaagtaatgttagatatcattagggactgaattggtaataacagcacatctttaagatgattgttggaggacatttgctttatgtcttagttcagactgttataagaaatacacactaaactagggtgacttaaacaatgaacattcacttctcccaactctgggggctaggaagcccaagatcaaggtgtcagcagatccagtgtctggtgagggcctgcctcctggtttgtagttggccatcttctcattgtatcctcacatagcagagagcagagagagaagaagcaagctctcccatgtctcttcttatgtgggcactaatcctatttgtgagggctccatactcatgacctagtcatctccctaaggctccacctccaaattctatcacattgaggattaggcttcaacataccaattttggtggaacacaaacattcaatccatagctctctacatgagatttactttccagactggaataggtatgccgctttaaacatttatgtaaccagagattaatcgacagtttttaaaatctaaatgactcagatttttattttacaataaaataatgacaaatgatgacacataagccagtagaatttattccatttggcaatgaggaattcttcagccacatgttattgtataaggacactattgagctctacacataagtgcaacatttttccccaaaatgactctgatctcagaacctgaagtttcacaatttaatagttaatttcaacaacaggtacttagtataataagtgaactttatactcagtaagtcattggaattgtaatcaataagcaggatcaacttccaggttaaggctcgtgattcctattatagccctgattaaattgtaggagtcattctccaacaaaaggaagcagagatccctggagaaatggctgattatgaggctggaactggaaaaatacaagatgagcctacaacatctcatagtactacaaggtaaggaaatgcttgagagagagagagagagagagagagagaatgtatcagagggacacagaagccaacctgaaaagttctcagtggccaaacttggaaattttgagtaacaaaatagtagcatggccgggcgtggtggcgggtgcctgtaatcccagctactcaggaggctgaggcacgagaatcgcttaaactgggggaggcagaggttgcagtgagcggagatcgtgccactgcactccagcctgggtgacagagagagactcagtctcaaaaaaaaaagtagcatagtattggattataaccaagtgtaaaaattaaatatacatggctccatactgatataaataaatgatttgatataaaaattaataagacagagggagaaacaaatcttgcagaaaaattccaaataatttatgtggctactcctcccctccaggaggtggagcttaggcccactcttgagtgtaagctacactttgttacttgattccaaacagtagagtatagaaaggggtaaaaaatatatatagctttacaactgagaaagctggcaagcactaccttagccagggatcaaagtcaacatcaccagtgataagtcatgttgatagcagacaccactgacataatataacaagaagggcacatcacctctgtgatattctttacaaaaatccataacctagtctaatcatgaagaaaatgtcagcccaacccaatttgagagatagtctatcaaatatctgaccagtactcctcaaaactgtcaaggtcacaaaaaatagggaaagactaagaaattgtcacagaccagaagagactaaggagacatgactactaagtgcaatgtggcacctgaaatgcatcctggaacagaaaaggcacattaatggaaaaactggtgacatctaagtctggaatttagttaatagtaatataacaatgttggtttcttagttgtgacaaatgtaccatgccaacataagacattaacaatgggggaaacggggtaaggggtgaactggaactctctgtgccatctttgcaacttttgtacaaatctaaattttccataataaaaagtttactaaaatgatgaggtgaagctttaactcatttgttctaaagcacaattttcttcatcatattagtcattttagggccgggcactgaacaattagtggtaatgatgatgaattggtggcaggaaggatttctaagaaacagttttaaatataggggacatgaaaagaacaaaatcttctgaacacctagaaggtagaaactgaaaactgtgtgtcctatagtaaggcccagtgtcttctacagaatgtctggctacagaaacgaattatgattaaagagataatgtgaatacaatgggcccttgagaactgaaggaaatggaatgcagcaaaagcggaaaaagaactgtgacaggctccacctcctccatgatcttgctcaggttcaagtttgcttgtcctagaccacccctagactctaacaaaccctagggaagactcaagtcttccagtcaatttttaaattcttgtcaccatgcattttgttttctgtatatcatttctgatgttaccaccatgactgccccctgagtactcaatgttaatatgcttacatttctcttacaaaaaaaagattcacttcatagcatcacaatatcacaatataaataggattttctattgtgtgattattttcatcaggccaacagaaatgaaatgaaggcagaagaaacattgtccccatgtaatttaaagaaaacaaaaagaagatcactgaaatgaactgtcttaaatttctaaaacttgaaaattaaaagagctaagaaattatttatcgaaactatttattttgcttttctctgaggagtgcaagggtgaattttttgcataaaagattacgttaataactgcccactgctttttggttttaaaaccatgactctttggggaacattttttgaggagtttttgggggtcatttagaaagtagcaaaaaatattatttccccaagatcacacaccaaactggccctcacaactcagctctcagcgaagagaaaactacctttcttttctcatttgtactataaggatactctattggatataactcaaagttcagtgatagaaaagagaaattaatgttgttttccttcattccatttcaatataattttcccacaaagataggtaagtcattatacattttcctctttgccctagtgtggggaaaaaaaacactttttttccacactaaattctcctccctcagtttctgccatacacagccatattctgaaccactggtgattttcattgtctaaattaaattattgtaataaatacctgctgtattcctaccattctgtacctaaggctttgggagcaacagatttgcacaatacttattttctaagaacccctccaatgctggttgtcccagagccacttggatttaagataagagttttatttaaagtaacatatctgtgtccctttgtgatgtttctgtgacatggcattcattttccaggaagatctaaaaatctcagctctctgcaagcattcattcatgcatacatgcatttatctatttcttaaacacttaggtgctactttgtggtaggtgattaggattaaaaaatgaataaccaatgagccctatactgaagaggcagatagataagaagataatcacaatcaatgtggccaatgctgaaccagagaaatgagcaggaattgaaatagttgggtagatggggtgatgcctacatggtgagcaggggttcactttctgtagataagccaaggactttggggaaagagggaacagcagggatgaccaggcttctgacaggccttagatgtttcctgcactaggattgatgaccctggatcctagtgaggtgctatgcagaatgatggtagagaggacagtttgaggcaggttctgaagagccctgtatgctaccagaaaaccctgaacttttttcctatatgcattttgagccaacagagatgtttaaccaagaatgttacgtggatagtctcaggttttggtaacatctgcattccattgactgtttcaaggatagcctaattatgtgtattttttaataatatcaacatttctagaaaggtttactgtctaaaaattatctaatgacaatcacaaaatggaaaggtttctttgctgccctctacaggcttccagggctcagtgctttgaaaaaaatcagccttgaatgggcaaacacacatctcattttgtttggcaagaaaacgctaacagtaggaaaagtttaaaatagccaaattaatgtatagcaagtagaatgacaaatacagaaaggtactgtgtgctattggtgatcccttgcatttcaaagtcttttaacttggagttctatagttcaaataattttccagtatatttatctaaggctcataatactttataaatcttaagttgacaataattattgtgattaataattgttacataatttaaacagattaaggtgcaaataacaaatttaaaaggccaattgataaaatattttcattacatatgactaacaaaaggcttgctttatttttgctttgttctattaatctcgaagagctttccatatcaacacacaaagagctcttcctcattctttctcagtgcttcataaaattccattgtatatgatttttaaatgataaactttttatgtcattaaaatatttatttaaggatccaccagaaatggtaagcattgatatcttgtgggcaatgggcctggggtttggggtactgggacaagacccttattttccattttattgtcttctacagtatttgaaattttctcctaaagcatcttttacttccataattatagaaagctgttctaggattataaattagcagtgaaaagtatggaattacttgatttctagtctgtgactcagactattgaatatggttcatctacaaggaagatacgcatttcagagttacatgttctataaaatcacatcagctatggtttgaatgttccttccaaaacatgtggaaatttaactgccattgtgatcgtattaagaggtaggactgttaagaggtgattaggccatgagaactgtgccctcatgagtagattaacgttgtcatttgggagtaggttttttattactagagtaggttgctataaaagtgagttcttccttctcttcctagctcactcttgggccttttatcatggatgactcagcatgatggcccctttcagatgctgacaccacgctcttggacttctcagcctctagaaccatgagtcaaataaatttctgttcattataagttacccagtctgtggtattctgttacagcaacataaagcagacgaagacaacatctaattttcaaatttctaagctattagagagtgaaatttcagaaaacttcaaataaaaattttgataaaatttcagtatagaaaattatgctaatacaaagttgtaattaatattaaaatgcttttaagctgaaagtcaggaaacccagagttcagattttttctctccttaggcattaagatagtttcttctctatggctcaggttatcaatcagtaaaatgggaattattttattcacctatatcaataggagatcaatattttttacccactattcaaagtcagtaaaaaattaacttggaaacttagaaaaaatagttttaaaaaaccacactctgtttctgttttctgttaacttttactaagagtttgtgcttatagactaacacataatttaattcaagtatgctttctttcagtctagttacacagaaatttaatttaaaaacaaaagaggtatcagtggaaacagctgagcgctagtaaaagtgcttaaacctgagaaattttagaaattgctttaagtggttcaatctggaggtaaatgtcttcagttcgggaactagcattttagtgtatctacagcagtacttggtatagcattagtgtgacaggactgccaggttcctaaatctagcacctcctatgtagttctgtggttttgttcctccttccagctgccttgggttcaaatcagaaggtgtcttaaaagagctcaaatgtggaacacactatgcaccaggtaaatttaaatggctttcattaccctctgtttgagtgtttgccttatattcttcattaattgaataactttgtagttggccaagcacttttatgttgatattgtattggagtacatgtaaattacccaacagttgctgggaggtgaagcaacctgcctgaagcaaggctagaattgcagcccaaggcatctcctgtaattcctttgccctttcccctgcattgccagtgcctcagggcagcatccagttcctaatctccctgaaaagacagaactccactctctgaactttacatatatttattttattttattttattttattttatttttctgagatggaatcttgctctgttgcccaggcaatggcacgatctcagctcactgcaacctctgcctcctgggctgaagtgattctcctgcctcagcctcctgagcagctgggactacaggcacccaccaccacacatggctaattttggtatttttagtagagatggggtttcaccatgttgcccaggctggtctcaaactcctgaccttgtgatctacacacctcagcctcccaaagtgctaggactaaaggcataagccaccatgcctggccacatgtatttattttctaacaccacagtatcagagaagtactgttatctcagtacagtagtccccctttattcatagcaagggttatgttgcaagacccctagtggatgcctggaaccgaggatactactgaaccctatggattctgttttttcaatttaataactgagaaggccactaagcgacttaggggcagggagtgtatacagggtggatctgctggacaaaaggatagttctccagagcacggtagagcagaaacattgtgagatatcatcacgctactcagaatggcaagtaattaaaaatttaggaattgtctattttctggaatttcccacttaatattttcagaacttggttaatctcaggtaactgaaacctcagaaagcgaaacagtgcataaaaggggattaccataaataaaaataaatgttatttttgttttaaatgtctctaagtgatctgcatcgaaacctaaactttgaggtaagattctctacccaatctttaagcctgaatggaatttattaaactactgagctcttttctcccacaatgaataatttactcttcagccaggcatgcctgtgaaatacttaagtgaaagctacacaaatgatcacaacaataaaattcttattaactcacatataaaacatattatggtatttgcagctaggtgttgctatggcaacagttaaaaaaatttttttaaacatttgtcacactaaatgaagtatgggatgtacttttttgttaactgtgaatttacatgacctgcaacacgacaatggcttaatgggagctaaacaaagggtgcagtttcccctccctcttcctgcctgtttcccctttctcctaggagccatttcaggctttctatcttgattaactgtgtcttagtaattggagcttacagctcagaacagtaattctgtcccataattgtagatgttaaattttaattctactctgtaattggcaataatcaggccatgttctggcttttctggagtgctcaattagaggcctgtggcctcctctttcttccccttccagcaaagcatctattcttgactcatccccatctgaatgattgtgtctatagttaaaagatatgataaatattcttagatttggaagactttgaaaaggagtatcctaattactattgttcacttgattgaaaatttcccagctctaaagctacattctgttaaacatggggtcactgaagctttcatttgcttcaaaaaaaggtcattttatgtggtcagcagctaacagtataaaataatagtaattttatttctatttcttttaaacaaagagaactttttctaaattaaagaaaacagaaaaggaaaacataagattaattgggttttcacttagcatatttctgaagcaatttgccttcccttaaaaagacagtttctccaagtgtgttattattcaaaatactcctacccaaaggtttccctaagaaaggagcccctgtttttaaaatgccctgcattatataccgctttgggaggtttgcagtatgttctagacatttaagacctctgatgattcctgcaataacaaacgctatttggtttacttttaacttttcaaagcttagattaacccattgcttcccagataactgtaagacactgctttcttgtgacttacattgaactgtgcttataattcactcacccatttttaagtccagagcttctactgtataaacatattaaggtaatcatgttagggttctaaaaattcctgaaaatgcataattaaaggggaaatgattaagttcctttttaagaaagcaaaataaatgctgcctttagaaaaagacatgctaaagcttgtaagattaaaattaaaaataaaatcattttttaatagcagagtttctcagccatggctctattgacatttgaagccagatgctttttgttatgggggtgtctatcttatgcactgtaggatgctaggcagcatttctggcttctacccattacatgcagtaagggagggaaaaatggcttccctccacccttctacattctttgactatactacgaactaaactgacataagacagattaataggagaaaaaaataggtaattatgtacatacgcacaggagtcccacaaaatatgagagtctaagaagagccaggtaattgaagcttatatagcatcctgagctacagaaaggaatagtggcttggggcttctctggggaggtggcatcaagtcatgggcaggtgagaggaagaaatgtgtggtgaatgaagcttgtcttgctgtacaaataaaaagtctctcaggtataaaacttgtctctaagcagccctctttctgacacagatactttgactaatgtagatttcctttatagatgtaattttttacaaaatttttaccaaaggacagtttcatcatagcgactcttatgtctgcagtttttcagaatagccagctctaaatatgctaaagaagtatatttaagggtgacatattctgatctcctatagtcattttttgagttgatgtatcctgagccccaatagttcttaacgtaattgaggggcaagtccaagaaattttcaaagagaacactgatcaagtgctttggctttgtacctttaaagcacaacagagctctgcctgtcttattaaaaaggacttaaaaaggaaatttgacttttattcttaggtcactggttaatagctgctcaaaaactcttctagtttgaaaactctcagaacaaaatgaaggataaaaaagtagaccagacctatgtagaaggaatcttagagtgaagtgggtagaccagcatgccagagacttcctcagagaccaagtccccaaaactgtgattgcttcttaaagactaaattcatttacagtggtaatatggagccatggaggaaaatttcacttttcaagacactttttccctgactccagtcccagtacatattctcttgcgtttataagtttgtcacttaacgggggtccatatagtcttaactccctggttgagagacatactagagcagtgattctcaaagtgtgatctagggacctctgggaatactgaagatccattcaggagatccagaatgtcaaaactattttcacaatacaaagatgttagttgtccttttcactcacattctgtcacaagtacacaatggcgttttttggatgtgtgatctcacaagagactgaatgcagaagcagatatgaaaatccagctatcttctattgagccagacattaaagattttttttttaatgtaaagcagtgccactcttctaaattttgttttggaacatatattttataaatatgttgcttatgttaaaatataatgagtttatttatttttatttatttttttgagacagtctcacgctgtcacccaggctggagtgcagtggcatggtctcagctcactgcaacttctgcctcccagcttcaagtgattctcctgcctcagcctcctgagtagctgggattacaggcatgtgccgccatacccagctaatttttgtattgttagtagagatgggtttcaccatgttggccaggctggtcttgaactcctgacctcaagtgattcacccacctcagccttctaaagtgctgggattacaggcgtgagccaccacacctggcctattattgttattttaatgaattagtaagtatttaaaattttttctcagttttaattcccaacatggtaaatatcaatggatataacccatttataagtgctatgctagagaatgagaatattctgttagacatgtgtggaaagggaaggatcagactaaactccatggaatctttagcatggtggagccttttatttttttattttctattttttgaaacaaagtctcactttgttgcccaggctggagtgcagtggcgtgatctcggcgcactgcaacctccacctcccagactcaagcaatcctcccacttcagcctccccagcagctgggaccacaggcacatgccaccacgcctgaataatttttgtagtttttgtagagacagagtttcgccatgctgcccaggctggtctcgaatttctaagctcaagtgatcatcccacctcggcctcccaaagtgctgggatctgaatgggatcataggcataagcactgtgcccagcccggggtattttaaatacacattgaaaggtagatgtaaatttcagggctgggatttataaacatcttcaacccaataaaatgccacattgaaaattaggcttttcctctgacactctcctaatctcctgaggttgctcattaaataagaacatctatgaagactagtctcccttcctgacagcttttgtatcagtcttccccttccatgaactcgttaaaagaagccctaatttcaggagagagactgccagtcccttggccatctgctggaaatgacagatcagggaggtcccttaagtgatgccattcatagagaacctatttgatgtacatgattatttgaatgctattaataaaagaaataaaaagtgtactttatcctgaacatcataatttattgtcagtcttttcatgaatctataaggtcaactatcctcttgttttcctcatctgttaagtagatcataaaaaaaataagtagtaaattcacatttataagtaaaggtcttttttttttttttccagaaccgtatcttatttcccctatgacctttgctgttgctcggtcctaataaaattgaggcccaggtggatgatgctaacattcttagaatcaagccaagttagagcttcaaggaaccttttagcattgaattcagtggttcttgaattcccctttgagaacctgttgacagctagtagccctttcccccaggaagatgcatattgtaggcagaatgatagccctccaaagatgtctataccctcatgccccaaatctgtgaatatattacattacatgacaaaggacagttcagattgcagatggaattgaggtttcttatcagctgaccttaaaacagggagatcatcttggatcatctacacagattcagtgtaatcacaagggtccttaaatgtgcaagagggaagcagaagagtcagagcgatatgaggtgaaaaagacttgatgggccattgctggctttgaagatgaaaggggcccatgagccaaggaatgtgagcagcctctagaagctggaaaacacaaggaaacagactcccccctagggccttcagaaaggaaccagccctgccaacaccctgattttagcctagaaagacccatttcagacttcggataaatctgtgttattttaagccactaagctcatggtaatttgtcatggcggcaatgggaaactaacacaatgcataaccatgtctacatatccaactttgtatacagttccagggaggactgaccccagggtaagggcttcatgatgtgttccaaaatctcatccgatggatgtcagtagaacccaaaccccttgacttctgatcgccaaagctctttgtatataaaagaaaaaacactcaccttcctacagccaagttcagagttaaaatgggctatcgttagatgctcttctctaataataataaagcctttgacttcaagttggacccaaaacatttttaatgaaactaaaataagaaaaagaggtttaatccagacttgtaattgatcatgctgaagttggagaggaaacatttaaaaaattctgaacagagcccacattaatgcagatccctgagatatgtctgggtctgtgaggacacaggaggcagtcatctgtccagagaaatttatatttataccataccacatcctcatctgcttaaggcctgctggctccatttgtgaaacaagaaacctgccagtcttttctttcaagacagtaccctcaggcactcttctgtgagaattcaagcaaggaaaacaaatcttttctcagggttgcagaaggcaggctaatagtaatggcaagataaagtggatgttattgctcagagggcaccttcctgatgggatcctggggtattcggatggggctctttccacaccccatggtaatccactgctatgagtatcattaaaggcttagaaattatctttagcacattgtttataaacaaaaaaggaaacagagatcattgagggtagagtattcaccattttttagccattttctctctgccgtagggaaaggtgtaggagtgggcattcactctgaggacagtttaatgagctgtgtctgtcacctggactggtcagaggtctttgagggaccaggaattcctgaattccatgatagttgtcaatttaaggctctgattactgttacattgcaaattcatggatctgaattctgaggcccttgagaaaaagaattatgtgtttttcatcatcccacagtagcaaaagcctcatatatagtgggggctcagtaaatgtttattagttactggggagagatgacactttagttttaatccacagctgtttattaattccaaccattgcgttaggtgctctggatttctaaaataaatcaccaaaagaaccttccctcctggagaaggctacggtccagagtagatgagagaagatccttatgcaggcaatggtaattgatcaaaatatgatacatgcaatgggagaagtaggaagaaagtgaggggggattatggagtggggagatgctatttctagagtgaggcttaggaaggcttttgggtagaggcttcatttgaattggtgtgggtggtctgtaggattttttgagatgaagatggtggaagagttatgcctcaagaagagggcagtgtgggcaaggagatgagagtgtgtggggagcctgaagccagcaagcttggctaaatctaaagtgataggaagggtgaggaagagtgggttattagtcatttaaacccagtgcaacctaagagagtagcttggatgggaccaagggctaaggacaagaggccatagctgataaggaatggaggaaggtgcccaagaaggcagggcttgaaagctggggaaccaaaagaaatgtgcctgaacataagctagacctcagatggctggcaaactggagtggatgcaagagtttcagggccattgaaaagaaagttctacatctgtccactttggaggctgcatgcaacactcacatgcctacctattggggtattattggggtcttagtcaacttgggctgccataacaaaataccaacgattgggtggcttaaaagatagacatttattttatcacagttctggaggctagaagtccatgattagtgtgccagcatggtcagttctaggtgaaggcccgctttagggcttgcagatagctgccttcttgctctgtcttcacatggtagacagagacagcaagctctctggtgtctcttcttataagggcactaatctcatcatgagggccttcccctcttgacctcatctaaaccttattatggcccaaaggccccatctccaaatatcatatttggggttagggcttcaacacaggaattttaggggtcacaattcagtccacagcactgggtcagaggattatgcctgggaggtcccaatctagctgcagtggcagcagagagtaggactgctcacccgctggtgttgccagtaagatcagattgcagtgagatctttctaggatgtgccttggtgactagttttatgttttttttatccactgtctacagtgggtcattatcagatctaagttggggcacagttttttgaggtgatcatgatattgaactgacagactcacacgaaaccccaaatggatgtaaatgtagatatagatagaaaatccgtgtctattgtataattataaatgtctacacctaacttgtattctgagatatatatatacatactgtatagtgtgtttgtgtgtttatgttactgttttcgaacccttttttattatctataccaccagcaaaagaagcctttttaagtattttctattaattgcactcgctaacattttaatatcgcaaatatgctgcatataagtttatatactgtatgtgtatctgtgctttacatatagaaagaataaaatttttgccccccaaaaaacaattttcatccttgttggagcaatgctgtccctattgagaatgcatgatatatatatgtagatgtgtatctgtgtctatgtatgcatgtgtgtgtcaccttactgcacaaaagagtttaggatgccaaattagatgttgtttatgcattcacaatggaaaatgtaactttccaaaggaatgaatattcctgtcttctatccaggtatcaggaaagttgaagtagtaaatgggggtgaaaaaaagaaactgcttaaagagcactgagtcaaaagaaaataaattggatagtcatggagaatatttcatccaaggtatagaaatgcctggaataactatctcccaccctaacactaaaacctgactttagtgaaaaaatctatgtagctctgtaatatataaaatgttgctgtttgatagtgctaaatgaattctcaaaatcggttttttccattctactttttctagacactcttcagaccattcttccaattttataatacaactattgtctcagacttcttacaatgcaactgagtagcttatagcccttgagaacatcttagttttcttaattggattagactgcagactctagcctatcttcagggacacatttcaaagccatctactaaggagagttacttcagtagatccattatgtattgttttgagtcatttcagcttccgggacaatcggtttctgaccttgtctctaaatccttgtggtcccccagtggagcccacgtgcagggatcgtgagtcagggaccggactgggcatgctctgttcagcttgctagcagatgtttagctttctagctccattgtaaagtagtaatgcttttcatattttatttttttaaacccatagattttttttagacaaaaatcaatttcttgattcatcagaagctgattattgagttagtaccttttctgaattcttcctggacagaaagttgaatccagtttgcttcatgaatgcttttttacagtccaaaggtattgacaataaacaaaagaaaaccgaaaagactttcttgtcacagctccagaaaatgatgagattgaaggaaagaagacattaaaactaagggataaaatgtctttggaaaataaaactttactccattagaaggaaagctattggaataggttaaaagttcagattacagatttgtttaaaaataaaaatgaatttccacttccagtatggccaaagaagttcctaccagactgatcttgcataaaacaactataaactctggacaaaataaaaaatatttaaataccacaaggcattgaaaaatgaacaaaagcagttagattcaagaggggagttgacacttggaagaaaggaatgacaagaggtaagtttaccagtttttgtggcttttagtctaaggcatgtcacagttggccccatgtccagtggctaaaactctaatagaaaacctatagtttttctggcctgaagaacaaggggccagagtttggggcaaccagtcctgctggaaaataaagagagaaatcccataaaggagaaagccaaagaagatgtacccttcattctctgtacagtagtctccccttatctgcaacataccaacatcccccagttgatgcctgaaaccacagatagtactgaaaccctatatatacaatgtttttcctatacccatgataaagtttaatttataaattaggcacaggaagattaacaacaataactaataatgaatagaccatttataacaacatactataataaaattatgtgaatgtggtctctttcttgctctcaaaatgactcaccccttctcgtgatgatgtgagatgataaaatgcctacgtggtgagatgaattgaggtgagtgatatagacgttgtggcatagctttaggctactattgatctccttatgctacatcaaaaggaggatcacctgcctctgatgctcctggattattgagccatgacactgttgaccctaggatgtcaggagcagacaatgtcaatgactaatgggtgtgtagtatatatagtgtgaatacactggagaaagggatgattcacttcttgggagggatagagcaggatggcatgagatttcattaggctactaagaatggtgtacaggttaaaacctatgcacagttcatttctggaattttacatttaatatttttggactgcagttgaccacagataactgaaactgtggaaagcaaaactgcaaataaacgtggactactgtataaactctgctcaaatctctggctaactcctgaaccacacgtgtgcaagcaagctagaagcagtctagctaaagataagaaaaccaaactgaaattttagctaatgcctaaaagacagtatgcagtttgagtccaaccaaattagttgattgaaattctgttatgtttctctgaaacagtctccacaatataacatcacaatgtccaggatataatccaaaatcacttggcatataaagaaacaggaaaattacatgaaccattcttagagaagataatcaatagagaccaggtgcagatgagcataaccatcctcaatgacctaaaatatatgtgtaataaatgaaaagataggcaatctcagcagagaactagaaattatttttcaaattgaaattttagaactgaaagatatctgaaaagtaagtataacatgattaagattcatataacaatatatactagtgcttgaaaaacagtcaagaagaaattttgcttaaactaatggccaagaatcatttataatctgtttattaattttaagcaaataaattctaccagagtggtatccagtaggtacttgagtgtttgaataaatgtcttaccaggcctcgtgtagcctgtctctctgtcctcatgtcctgctactctccctcggctcgtcctcctcccgcccactgcctgcttgtgattccttgaacatgccaggcaccctgcagcctgaggcctttgcatttgcagttccctctgccaagaatgcccttctctcaggtatccatgattcactccctctcttccttcagattcttgctcaaatgccattttctcatgaggcctttcctgcctccacctcccaccctgccatctgacacttctttattcatttcctatgttattttcctccatacttctcattagcctctgacttggtgtatatttgatctccatattttactatgtctcactagaatgtaagttcccatgagtgcagggatgtgtgtatgcttgtctgctgtctctgcagtgcttagaacaatgcccggcacataataggttatcaaaaatattaaatgcatgcatgcaagaattaatgaattatcttcttacatctaattatacaatatgctataatcatgaattaattgccatgctttcactatatgcccttcacgcagatattaaagtagatccctgaagatggttgctttctctttgtattggttcctttctgagacagaaaatgtaagtaataataactgcctgatgaaaatagtcttccagttttcttcagaccatccatgtcaccagcaaattcattttccaaggcttaaaaactttcatggcttcccctattcagaatgtgcttcacatcctatcttccaaagctccatgatatcgcccttgtctcaggttgcatacctgagacaaggatttctggcaaagtgatttattaggaaatttcgctggcaaactcccctgtgggaggagggaggcaggacagggaagggaaggagactgagcaagggtgcaacatccagaaaatcccatgaagaggacttctgctcagccctgcaggaaagcactatggacagtgaaggtcacacttcataggtgtctccatctctaaggacaagaagctggagtcattccacccccttatcctcctacaggctcctttcttttcattgtaaattttttccagctctctgtgcacacaggcaaagcagcccagtgctgtcagccaaccaagagacacaggtgctggctgttgggagtgaaagccccagaaggcagcatgtagtgaaacagtaaagggattctgggaatacgggcgtgcacaaaacactgacagcatctgctgcctttttaactggattcttactacttcccggttgcaaaagtcactcattgctcttccttctatgcctttgcttgcaactcgcctgccttccctctcccaccatccaactgatcctttaagattgatttcctatgctccctcctcaatcaagcttttcttggatttcaaaaccctgtggcaccctcatttctctgaatcttcattatgtctttgaccctggcatctgccaccacctctattactaatctgctattggtcactatgagaacatatgctcatctgtcaagagtttgcattctgattactcagctcccttccagggcaagaattctgcaattgcatgacttacaatattctaaagtgtattaaaatcatgaatacatttatcaaccctcatcaaattgtaaacttctcaaggataagaatattttgtcttttgggggaaagggatgagagccccaggccggctgagacggccggtccagggaagctccgccagtactgggcacactcaccgaacatggcttccagcagccgcgtctggacctggaacacctctggatctttcaggtcttcgggaactttcacccacggcagaatatttctacgtgccgggagcgttcccatattatgatcctcataaccaaaaccacgctccagcgcaagccaggcctaaccgcaccagctgagcctcagtgctggtaaagcctcgcacctggcggccccgcccccggccctggccaggaccctgagtctgcgcgccccgccgccctgtctgcggtccagctggttgccatctctgccgcttcccgcgacctcaagagagcctcacccgggcccagctgtctgcaggttaactagggtttccacctgcattgacctgtgtctttcgcaccagaatctcctgggcttgggaatggctgggggcggggcgctgttgactcttctagggaacaaccggtggggcctgaacctcagaaagcgggcgtccaggcttgagggtgcgaggaccacccagtagctgccgaatcgagttcctgcctcacacgttccaaaggagggtccgtatcccctcggccctaaggagcaggacccgcggctccactttgctggcaacctgggcaacgtcctgggaactctggaggaactcctgccattgaacaaagaggaaaccgaaattcggaaattgattatcttacatgaagggattagcgttcctcaaagccccttgaacctacccggattttaaagctcacctgtgccctgcctgggcactcgggccaaaaccggtccagccttctggctcgtctctaaataaatttggtttactcgttttttaaacatagtgtttggagcgatgcactggattcactagttgagagtgtgatttcactgttttatggctttacagatggtgatgaagctggcatttccagtcctggtaacatctaatatcccctcagctgtccattattgacggcttcttaaggcggacctcttcacacacacaaaacaactatgggttctattgcaaccaccagtgtagttaatttagaaaacgatcatcactgctaaaactatcagatgaagactgttgaggaactagatagtcacaaggtttggaagccctagcccacatattatgaattacaaaggaggaaaaaaaaagaacgttcctttacaatagagacttggaagaagccaccttaacccaagttagcatcaccaataatgggaaaaatggacttctgcttcgtcaatatctgaaaacaaaaagaggactgttttattacttgactaaagagactaaatgctgtgtgcatggttcaaataattctgaatcaaaggtgaggggttgcatttcaggaaaaggaaggaaattttagtataccctatattgcaaagtagtattagaaacttctagagtggaataagtgtactacaattatgtataaggtcattattctcaggagaaacatgctaaagtatgtggagtgaattgggtttctctatttttatttttttaatttaatttttttgaggcagagtctcactgtgttgctcatgctggagtgcagtggcactatctctgttcactgcaacctccgccttccgagttcaagtggttctgcttcagcctccccagtagctgggattacaggtgccagccaccatacccagctaatttttgtatttttagtagacacggggcttcactatattgaccaggctgatctcgaactcctgacctcaagtgatctgcgcacttcggcctcccaaagtgctgaaattacaggcgtcagcaccgcgcctagccaaataatcaattttttttttcttgaggcggagtcttgctctgtcatccaggctggagtgcagggcgcgatctcagctcactgcaacctctgcctcccaggttcaagcaattctcctgcctcagcctcctgagtagctgggattacaggcccctgccaccacacccagctaatttttgtatttgtagtagagatggggtttcaccatgttggccaggctggtctcgaactcctgacctcctgatccacctgccttggcctcccaaagtgctgagattacaggtatgagccactgtgcccgaccataatcaattttcaatttcccatctcccattccacctgcagcccaagctccatttttcctgtcacccagactcttatgaaaaataaccctcgcttctacttctgtataccttacttattcctaaacacatcattccatggtaccttcctttgcatttcagcaaaagtcactctggacttgctccgtccaatacagaagtcactagtcacatgaggactggaaatgtgtctagtctgatttgagatgtgctgtaagtgtaaactacatgtaagattttgatgacattaataccaaaaaattaaatattaacaattttagattgattatatgtttaaaaaagaataatattttgttctctgaactacagctatgtctgctgaaaattgggaataatatatctaaatctatttcatgaaatcaggaataatatatgtatagtgtctgatacatagaagactcttgaaatagatcgatatattggcatatctttgtacttcaggaagagcctattcagagcctattcagccttgtacattagaagcattcaagaaatatgcattgtagaaacagaaactaaaggccagatgctagttagtggcaaaggcaagcctcttcacactgcatgctgtgacctttctattcctccatgttgccagagccaagagttgattaaatactggacagctggctttggccaaatactaaaagagctaaaacgcacatggaagttatgttcaatcacttaggacctccaccaaccacctggttccaagacagtccacttttagtctcagccactcctaaagcttgttctttgctgtcattaaacacataaagtatggatctaatgccgaggagatagtacccagtggtcctccaaaaagtggcagctttaatatctgatgtttgcatcttgctgttattatttattgcagagtttaacattcatcatggttggttgcccactgcaaggtttgatctggatcagtggctgatcattcttaatttagctattgaaattaataagcggaccatgcagacataagctttagctgtcacttgtttgctcactgctacacaaaagtgtggagaccggaagctaattctacagcaacgattctcctgctcagaatcacaaacacaatttattatacccagaacctgcccaaaacattattataaaaccttcctcaagcaggtgggattaattagatcttcctttctctcaggctcttcctttatagacactcttccttctccttccttttcccactcctttccttggaaaagatcatgtgaataatggtacaggaaatttgatcattgtactttgcaagggagctttcgtttcctttaaggattatccttactcccaggcaatgctccaaagaggcactgaagaaaatgagggagattcagagagaaaattagcccctcaaagggaaatattttaatgctttttttgtttttttttttgagacggaatctcactctgtcgcccaggctggagtgtagcggtgtgatctcagctcagtgcaacctctgcctcgcgggttcaagtgattctcctgcctcagcctcccaagtagctgggagtacaagttcgcgccaccacgcctatctaatttttgtatttttagtagagacagggtttcaccatattggccaggctggtctcgaactcctgacctcgtgatccaccctcctaggcctcccaaagtgctgggattacaggcgtgagccaccgcacctggcctttaatgcattttttattgtggtaaaatatacataacctaaaatttactgctagttacatttaatacattcataatgttttgcaaccatcatcactatctagttccagaacattttcattaccccaaaatgaaactttataatcattaagcatttatttcccatcccccttctccccacccctagcaaccactaatctgctgtctccatggatttgcctcttctggatgtttcatataaatggaatcctgtaagatgtagccttttgcatctggcttctttcacttaataacatattttcaaggatcattcatgttgtagtatgtatcagtacttcattcctttttatggctgaataatattccattatgagtgtgtgtgtgtgtgtgtgtgtgtgtgtgtcactatttgttcatccatttatccattcatgcatatttgggttgtttctacctcttagttctcatgaatagtgttgctgtaaacgatcatgtacaattttttgtttgaacacctgttttaaattcttttgggtatatacagtacctaggagtggaattgctgggtcatatagtaactctatgtttaacttattgaggaattgccaaacttaacacatttttaaaaaccattctggcctggcctgtagaattcttcttatgtctttaatttgagttcagtggtgcataaaagatagcaattaagataattggttttttgtttgtttatttttgacacggagtcttgctcggtctcccaggctggaatgcagtagcatgatctcagctcactgcaacttccacctcctgggttcaaacgattctcctgcctcagcctcctgagtagctgggattacaggcatgtgtcaccatgcccggctaatttttttgtatttttagtagagacgggatttcaccatgttggccaggctggtctcgaaccctgacctccagtgatctacccaccttggcctcccaaagtgctgggattacaggcgtgagccaccacgctcagcctgagaattgttaaatgatgaaggaaacttcatgaagtgcaaaatggcagggcccaggatttcctccctttgggtataaggtaagaatctagcaaataccacataatacacctcatgatgctgttactgatcaggatggctggtccatgtctgtgaagatctgaattgaaaacgaaagttttttatgttcagtatgtaagtcgataaaggtgacattatgacaagaatcttaagagtgggatatataaaatgttttggagtattttacaactatatcataggtttgagcatagcgacagagataatgagcctttccaactatatttcacatttcaatttgctttcttttccacctagaaataatccaaatgattttgcatgatatagacaagccaatatatttccaattcactgtatcccttttgtaatgaaatctcccacgccacaaggaatgccaatttgcttaaaacatcagttgcttatcagtatatttcaaatgcctcttaatttaaaattctttttctgcctatttcaaatgtgtacgtgtataaacacatgcacacacatacatttttttctttttttccagtgaaataaatagaaaaccaaacacatacatacattttaaaggagaatcatatgccacttttaaaacatcctgacaccaattctcttatgaattctgtaagaatgtttggggatcattatttatcttcagtttttatagaataaagggtttcctaagtcgatattatgtaaatatttgattgaagacacattgaaataattcagatgactttctgaatattgtcagattatgttcataatataaacacaggcattttagtgtcactaatatttgatagatttgagtcttagagcctttgaaaacaattttattcaatttgttttaaattaggctaatattgagcttgattttttcctttaggccaaaaccaggtggctcacttgtggcttctattgtctaatgatcatattcaagaaagtggaaataccattatctgaggatcaagctactgttcattcaatcacttactaataaattctcagaattcaaggaaaatgctatggagagagaaactgctcacaagtgggaacaatctcagattttaatatatccgaaactgaatccagaaagctttgcattctatttagcaataatagtcacacacagaaaaggtttatcttttcatgtggcatgggtaagattaaaaatattagcaattatattattatctataaacacctaaatttgatatctacagaggacaagtgcctaaactctgtctatccaacctgcattttcatccactttcaacatattaaacacgttctgagacatgcctatgaaaagtgaattgtggcctttccatgcttaatttgctgcttaattgtgcatgattttataatgcccataaaataatacttataggcataacattccaaggcagcctttttcagaaaaggagagttcgatttatctccagatgtttctaccaaacattttcttttttctttccttcacccttcattcccacttcattgttgtgattaacagcgcaaagctccgtagcagaaattcatcaactgattccttccacctaccaaatccacatttttcaggtctcaatttgagacataatgaaagtctactttgcataattatcatatgagactatctataattaaatgatgaaatgtggttatgctccagtgtgtagacgaggctttatatgaactgaaactgcaaaggtttatttatctgctttaactttcatctggtgtttgtggaagaaaaacaaaaacaagcaatttatttccaaaggagtttaggtccccagtggacaccttcttttttaaaatttcaggagagaaggtgatttcttgaattgaggaataactggagactttaatatgatttcctcctcagcgtcaataaatattgctcacaagctttaaaaaatgctaattatcgacattgcattttgagttttgccttaaaaatattttctaaagattttaggatagctttttaaatacctgtagaaaaacccttcttattatcatgcaaatttaaagcttggaaaaaagcctttcaaaagtttctcaccttcattcatagtcttgattgattgcctttccatttcttctaactagacaaagtaaagttgactataccaagtttaatatgaaaacaatgattctaaaatttattcaaggcagggaatagcatctctgagattctttgtgaaaccccatgaagtattgttgaattgaaccttaaaaacaaaataagtaagcttgtctaaattatatccttatttgcgaagtattctttgcacacaattatatgccatacactgtcagagactgaaaataaagagatgaatattaaacaaccttcaaggagttcagaatccagtagtattccattctaaaagtgccaaggctgcctctatcagtgattcactaggacaaattctggagtaaagctccaatttaggtatgtttcatccactggcctttcccaccctaaatgttgggaaaaggccaccaacatgaagcatttgtgctattgacatgactctgaaaagagagaagcttcctccaagagccaaatgaagaaggaagtttaagtattaatctttaatatttccctaataatattttggaaaatcatgctctatcatttttgcaaatgtgatgatttcacatatacagttgacccttgaacagtgcaggagttcagagggccgacccccaaaacagtcaaatatttgtatataacttttgacttcctccaaaacttaaatactaatagcctactgttgaccagaagcctcatcaataacagcaacagttgattagcacacattttgtatattatatgtgttatatactgtgttcttacaataaagttagctagagaagagaaaatgttattaagaaaattgtaagaaagagaaaatatatttactattaattaattggaaatgagtcatcatagagttcttcatcctcatcatcttcatgctgagcaggctgaggaggaggagaaagaagaggagcggttggctttgcttttcaggagtggcagaggtggaagaaaatccatgtatatgtggacctatgcagttcaaactcatgttgttcaagagtcaactgtacatctatatctgaggtcagcaaactatggctcaaaagccaaatctggccctctgcctgtttttataaataaagttttatgagaacatcagccatgttcattatttatacattatctatgtctgctttgtgctacaatggcagagttaagtcattgtgatcaagaccagatgagctgcaaagtctatctgggccctttacagaagaagtctgccaaacctcgatctaaataacgtgcttaattttgtatttctaggcttaccaattttagaccttatctactgattacttactctgcaagataagggctagctcagctgcaccataccctacctccttcttgcacttgttgaggctcaggacttgatacctcaaagtatggtgccttggcatgctgagtactttgaactaaagaagattggaaggacctcagaagcaaggtctctctgactttatcctgcccttctgtgtcctgcctctctttctgtcccgaagagagtcatagaaaccagatttcctcttctccaagacaggtcgtaggaaccagaacccatctcccacaatgcaagccataaaacctagaaaggtcactgtctcccttctcccttgaagaccttcattttggaggagtcctgccccatactccaaaggaaggaaagctacagagacaggtcaagaagtatctggacagacaggccttggtgggtttttcccttagtctattaccattagatcatacccttttgtctaatcacattgctacatgactctctattcttcgtcgaacctaatcataaaaatagacagtattccctgggtctttgggtcttcattaatgaaggttcccatgtaatataaaatgttgattaaatacatttatgtttttctcttattaacctatctttggttataggaatgtcagccatgacccttatgatgggcgaggaaaggtatcattacctttctgcccctacacacttctctttctccagtgtaattctgtaactgccaattagctttgtaattttaaatgataaattatacatttctttctttttctttctactataaatagcatgtcctgatattagtaattccacttagtgagatgaaaatataattcttgtacccttcttgcttacttccccttatcctttctttttccaccttttgtcttccatagttagtctttaataatacaatggttgaaaacattcacaattgttccataaccattacgatgtctttcatgccttatttataggttgatttaaaatttttaaactcactggagggtttttattcttagtactaaggaaatattattcaccgtatagctaattattgctgattataatgcctctattgaaaagggatttttgttgtttttctagcagtctctgacagtttttcattttctcccttgcatgtcctgtgttaaaaatgctttgtccttcttaaaaatagagtcaaatctctggaaccaccttctttcccaggcacctttctcctcaattcttcctcccactctaacctgggttgatgacttcctaggcctcgttcaagactggcatccttgattttgcttccttctcctcctgtgttggatccattgcttccttaatcccatgtctttctatttcttgattttgttagagcacatcttcagatcacttgcttcaaaaagatgtgtgggaagtaagcgttctaaatttttgtgggtctggaaatgtctttattctgacccctcacttaacctagaaatctagattgaaaatgatttttccacagtagcttcagggcaagctacattgcctttgggtctccaggtcccacagtcaaataatgatctattctcattcatttatcctcaatgtatcttttctctctactgttttaaggataatttatttatctttggtatattaaactttcattgtgatgcttccaggtgtaaagacatttttattgtcaagctctcaggctgagttttcagatcattcagctcagggacttttcagattcttttttaaaaataattcctttctcattattgttctctgttttctgttttagaaattcctatcaattgtttattggatcttctgaattgatcatctataaatgttttcttttctctcgtgttttgatactttgtctttttactcaactttctggaagatttttaaaatttttatccttcaggctttttattgaattgaatatgaaattgtttaatttctaagaatattccctcggtctcatgtttctttttttttccagtgaagtgctgcagtacacaatctaaggcacatggctctatccagttatcttatacaatttaggcctagaaatgagtttgctgagacacataatatatgcattttaattttgaaaacttatgatagcccttcagaaacaggttgcagaaacttacacttctaattctagggaagggaaatgatacatcagaatttttgctttgcatttattaatgagaatgagtgtcattcagaactaccatttgtattatttttatctatgtgcctggtcatgtacttcattttttttttaattgagttgccttttctttttgaattctacaagttctttattgtgtatattatgtatttgtctgtttcatatgttgcaaatattcccttctaatgtgtcatttgctttgtaactttgcttatgcttttgatattttaaattactgtgtaattgaacctgtttgtgttttcctttgtagcttctgggtttcacattatgcttagaaatgtccttcctactcctagactctaaaggtattctttagtagtattttcttctagtgctttcataggttaaatgttttacatctaatacatacaggaaacttggtgtatggtatgtgtgtgaatctagcttattgactttccacatagatactgtatttagttaaccccatttatttatttatttatttatttattttttgagatggagtctcactctgtcacccaggctggagtgcagtggcggggtctcggctcactgcaacctccgcctcccgggttcacaccgttctcctgcctcagcctcccgagtagctgggactacaggtgcccgccaccacgcctggctaattttttgtattcttagtagagatggggtttcaccgcgttagccaggatggtctcgatctcctgacctcgtgatctgcccacctcggcctcccaaagtgctgggattacaagcatgagccaccgtacccggccagttaaccccactttaaacaatagtttattctttccctgggatttgaattgccctcatgctttagtttgtgaccatttctattccattgcactatttactagtttcttttagagaatgtattgttccgtaatgtaatggttcagtggggactcccttcactgatacttactaactgtccaaagtccagttactttaccaatctgttcctcaactgtaaatgactgtaagaataacacccacctcataggttcgttgtgaaaatgaatgtgctaatacatataaataattgagagtagctcttggaaggctcagtaaatgttagcagcagctgctgctgttaaggtaatggttcttttctccagggcctagcacagtgcctgattaaacaaatccaactgaaaggttagataacatgaacgtcaattattgaagagaattgaatgtcttccttgtgaggaagacagaaaggcataaagagctataatgccctttttccaaaagtgaagatggatggggcaaaatctcccagagttttatcctgggtcattgatttgttttccccacggcttgtgtggcccagaaagtaagtcacactaataaaggtcgaaagcagttttcagcctttaaatggaattaaatgaatactattatgacaagttaattagatacccataaaactgctaaacatatgtcattaaaaagtccatgctccaaattttgttaaacatcaattatgatcataagaaatctgcatctagtaaagtggatactgctgacacatgttaattattctggaaaataattgagctctttaaaaattttactatgctattaagcatgtatggcctctgaaaatttgagctattgtgagcttatccaaatgaatctaacaatataaaatgaagtaaaaatgttctttgagttctcttagtatgacaaaaggcaaacacaaattattattttgaagggtccataaaataaacttggtttgaactctaaatgttcaggtaggaaagttgcagagtctcagcaactccagtctgtgttagagtggccacagcaaaatagaataaaacaatgaagagctgttttctttgtccacaagatgacggtacatcacttctcaacagtgcaacagaaggaaggagttttgaaatgcatgcctctaatctatatgcattccaattcttgacagtggtcttgatttatgccaatgtaatgggaaatgttaattcaagtcatcaaattgtttatcataaagaattgctattgctgcccataaattgcttcttatctgggaactcagatgctcaagaaaatcaccagggaattaaaaagatataagaggctggtgagagtgactgcaaattacaggctatatgagggtcggatacctgattcatctcttgagctctttctctgggtgtctctcactgaaccagtgcttttccaagtgtgatcctgaattctgcaccagaatcacttggaatgcctattaaaacagattcctgggtaatgctgggctcactggtggggagaatttcagtacgatttaggtaaactgggcctggaaaatgaaatacttttaagcaaatagcaccaaaattgatgtcagggatgctattaaggaaatagcatcaaaattgttgtgctttctttaattactttcatatttgtattttgaaatgaatataggtaatgggaaattcataatcttggaagacagtgctcattctactctcagtgactattctcttctccctgctgaaatagaaagccttccctgcttgagtgggtctgaacaactaagtcctctggtttcctcccagttcactttctcttgaggttgaccttgcttatcaacacctctagcttctagcgggagtgcactcttgaaatcacaagactacctccaagtgtccaggaaagaccattgacatgatctgaagatccctacccctggatcctacccagtatctcagaagtcagggttgagaatacaaactttagcttactgctacatagttttccaatgtggtcataccatttattctccaggaacagattttgataagggtattcaaagtgtcctatagcatctctagaattcaattcacagtggcttacactcatgtggatagcatactgtttacactgattattataataccaaacagagcatataattcagggtatttattgtctctattacttgtctttttaatttataatcactgataagtctcaatctaagcttcagtgttccttgggagcaatgcctatctggggttgatggtaggagggaaggttgagagctaccagctctgttcagcatctctatcaacccatgggtgtgacttgattattattgcctctgacacattagagtatcattaacataaaagtcatctcttaaacacattaaactgaactcaattaacagaattgattaccagcctaactgtagggattttgcagctttagggaaactgacaaacatcttgcccttttagatcctacaatcacattcacaaagcacggtcaataaacattttgccagctctcaatttatcgtctttaacgaggacaaaaatctctctgggtggatgaactggctgttgataaaagactaattgtggaaatggttttcagtagtggtattgacaaatagaactgagtccttgaaggataaatttgaccatgaattaatggaacctgtcttggatgttaatttgtacaagccctaatagatctttgatttattgcatctcattttctgaagtggaaagcatgactggaaaaatgtatcagtctagatgtataaacctcatggtcctttgaactgtaaccctcaaaatgaataatattctgattcataaataacattaataacgtgtgcattccatttaatgtttaagaactccattaaccttagtttctaagatattccactttttccattgataatctctgtttagaaattatcttctaaaacctgaaggcatttgccaaagtcccatctagctctcaaatttggtgttcttctctctcataaattttactataggtctgttggttttgctatgtggtaatgttgaacaaagataaaagtttactgtgaaaactttgacagagagacaaacaaagagaatgtctcagttgagataaaaagagatctcatttcatttaaattaggcaacatcctcattgtatttcaaggtccgtatgtggaaaatatgtcttatccggaaaggaatgcttatttaataggtatgtgtttttcaggttttgtttttaattttttgagaatgttggtgtatatattagttggtatattataaacaaatcctagttgaataactgatctcagtgctgtttttaatgcaaaagtatttattgttcttggagaagaatcagaaaagaagctgaaatgagatttttcactggaagccaggaagaggggactccccatcagtgccatccaaggggcaggtttgtttcacggcacctactagatttctccatgaaagagtgagatatggtgtgtgagtgactcagagtcctgtcaggaaacaggtggatgtgggcacagataaggaaactagtaagtcacactgaggcaccagggactagcagcagctgggacctgttagcacttcgaggtctcaaaaggaaggagtaagaagaataaataacccatctctctctctctcttcccatcctcattctctcctgccagcacctcccattgttttgcccgagcaggaagccagaacacaaggatcccatgtgatgcaatcataagcgtgaagctctcagggcaccaatgctgctggtggggttgagggcagggagatgagattcagttcacatgtacaaggctcagaacaagagaaacacaagcaaaacccaaaacagaaaagatgtgtaaagttggacagtctaaggaaactgaactctttaggtaagggctagaaataacaatttcaatgcagaaagatcaagagatcacaagttcttaattaaaacaactgttagctcaaacctttgattctgtaatttccttaccagccccttttaacttccatcagaagtttttagttatcaaaaaatgagcctttattatgtaatcacttcttaaaattatttacgtaaagattatagaattatgaaattttcaaagtgtggccaatcaactctccaaaaatatctcttttatcaaaattaattcgtgtttgactcgtgtcttagatcgggatttctgtaacacatattcttgtagtttatatttaccaaaaccatggggttcttttcactttccgagtataaaattataacgtaaattttcaaagaatacatgcggactgggaggacatacaacagccccttaagatggggaggagacctgccgtgtcttcagccctcctcctcaactactgccctaaaatatggatacaatccaatttgatagagacaaactctcaggcctaaaatgattattttaacatgattgataaagactttgctcattgttatcaagcttttgttcaaaaatgtattttcctgcaggtaaaaaaaaaacatatgagtaatcaattaagaagaaaaagcctgcccagccatgcaataattatgttctctgtaaacaatggatgttgacacctgagaaaggtttggggtggttacatttccaatccccaaaggattcaatctatcagagcccaaacaagagcacatgtaagaactatcaaccagtctgtctcttcatcactcaaacctggggctactctgtttcatcccacttgctgtggtaggattaaaccagcaggatggaaatatgccattccccaccagcactctaacttcatttttaggtttctaaaaatgccactgaatatttctgaatgtgagagtggggcttttcaagggctgtggtgagctttgtgatatcaatgactctgtccatcacatttgaatatgtaaaacaccttttgggctcacaccagaagttaggaaccctctggatcatacagaacagaaatccttacattttttttgcttttgtagtcctgtcactaaaaaaagttttgaacatgtactgccccaaatgtgtattaatttattcataatttatatatctgtactactgtaaataatatattatggagaatataaaatatatgttaagaggtgttgaaatgaaggtaaaatatacattttaatcactcaaatattttgctatcactgctgcattaaaaaatcaatattttaaatgataaagtggtcaaggatgctgatttatttttgaacatcttggtttaacatttcattgagtaaaaatgtgaaggtctggttgcaagttcagcttatttctttatttggttttaatcattgtcattggaggaaaaaaagaactgcagaaacatatgaagaggcaaacggacaaagtatggctccaacttgcttactagatcatgaaataccatttttcaatcccatctatgcaagagattttgttgacattcgtctggaaagtttccatctcctttgatgtccgtcagctgttcttacaaaccaaatggaagatattgcctttttattatatttaacaagtgagttcacaatccactgaaatgcttcatttggaagattgttaaacaggttagacaaatccattttcaagttttcaaagactgcagtttttatctatgcatatttgcataattttcaataaaacaatcaaataactgttgttatgtctaaacatctgtttccctacattcagaccacaatccaagtttattttgacaaactaagttgctttctcactctttgctgtatcttctttaccctgaaaagacaactctttcagttcattgtcaccagcaaaccaacaacccctttgtcagacaaaagattttcatagctgctcgactttattttaatcattttgtttcaaaacaaccacactgttgatatctaaagtacttcaattaccctggaagcctcgttttgttctagtcaaagctactactccattgttgtatattttgctatatttcgtgccagtatcataggattctaagaattgtctttttataataagttctggtatcctgtagggctagacaaccatagcatttttcttgtttagagtgttcttttatagcattatgtaaaatttagaattctcattgttgaattttttaaaaaaggactattgaaatatctttattggatggcattaaatttgtaaattaatttggagaaaactaaaattatcacatttattctacccattaaaaagaagcctcatttatttcaaagcctcctaaaattctccaacaagattcttctaaacattttgtgattttaaatttaattgttctggattgtctcggcttttcaagtactatgtaagtttccaagcttgactaaacagttctaaatctttaaatgctcctgacagtgttgtgggaattgactgacagtggcctgtggaattgattagcggaggttaaattcttctgaacccacagtatgcgtatttatgaaggcaaaaagcatgcaattcaccatgttatgtgagctgaaaacacacgatgtgcagttatgtgtgttcatataaaatttaactcatttctagtgaagggatttgatttggctcttttgatcccaaaggacagaggcagtagttccagatgcagagaaggtttaggatcctgattagtgagggttcctggatcttctgtcctgatattgctccacagagtggtctctctccaagtttagtaacttctcttccaactcccatcttcgttccaacaaagatggtttctgttttctcatgtagcacatataaatcttattcctaaactcatgtgtgcgatcgtattatattcctgctggttggcaattcaaatgtaatcatgttgaatattcacaagttctgggaatcttacacagagaagaaatttgagcagggctttatggtttcaacccacattacgtgctcctaagataccctgatccaaatctgtgtgatcccctgaagttcactgactgccgtttcttaggctcagacttaagtcgtggtgccttgccgggcatcccaccaagctgcttctcctgaagttgctgccacctcacaggggtcttctacccttgcttcctcagccaagctgctcagactttcaggaaacaaaagtaggaaagagttataagcagtcaacttttgctttgagccctgataaatacatcacccctaaggcaagagtctgcaaaagacctgtctactttattagacctgggagtggaaaaaacccaatgagaacaaagcgaaaaaatatatattttcaatatattactttaccacacacaatatcatcattttgactcactggaaacctagaactaggttctaaaatgcctcgtgacctctctccgttgtaacctatcaactttaacaatccatactttgctttcttttattcttcctactgaaattcttgctctgaggaactctggtttacatagatgagcacttttggtcaaagctttccatgttaggcccccttccaggccacagcagggattacgaattttgcagccctactgtgcccaagcccaaatccagtcagggatgtgggaagatgctgaagaatagactgtggggttcctgtggctgccatgccaccaaggataataaggggagaagtttcctttggaggtgtctgtggtgtttgtccaatgtaacatacttagtcatgaatgacatggggaatgaagttggtggagaaaatccttttgacatgtggaacttcagggtatttattaataaatactattttaagcactatttacagactagatgcatgagcttttggtacataccaaacatcccccaaattcagtgtcataaaaccatcatcatgtcttatcccttattcaggtagctgatctaggcttgggggctgggcagctctgctatacttagcttctcactgaggtgcaggctctggtcattctagagaacaggctgaaagggcagcagctaccttgagaaggccttcttgtgacgctggtgggcagtaagaacagatgcccaaacaaactagcattttttacttgacacgtctgggctccatcatgggacatgcttagggcaataggatgttagcagagccaaggggcagagaaacatgtactgtgtatagtgggaaggtactggaaaggaatgtggcatctggtggcaaatcatgacctagggagcaaatcaagactaagtcagtctaccacacagaccagtgctaccaagataagagcatatattgatgcttggtcctctcttgtaatcatagctggtcatccctgaaacctaacaccaacgatgacctcaagcataccttaggcacaaaaatgtttatactccataagtagttatacctatctgtgatccagtcttaactacccaggtagcctacctgccattatcttcccagattctttaacctccgcaccaaaggtaacggcttctaaatttggattttccttccagaatccttccactcagcacatattttgaaaaggactttgctggctttaatgagtgcatcaaaaactggaatgacttcaggttttcacacagcatgctttctactagtcaaagcaattatttgtgacacattgggtgtatcagtgttttatttctgctgagaaagaagggctccaagagttcaaggaaagccctttccttttgttatggggagttaggcagcaggatttctgtcattccttttgaaatgaaatctgtcagaaacaggaagattgctcactttatcttgatggacatattttccatttcaattaatatactctgtattttttgggtcacagattcctggcctatctgtgtgttttttagagaaagttggggacagaggatggaggtttgaatagctcatcagttgtatacttctagtctcagcatcagaattcactgacgcacgttcagcaggtaaaaaaaaaatgttgctttttcagctcattaaacaaggactcaagtgtctttattaaaaaaaaatattgcaagtacagggccaaaaactgcttgccttgttacagagggtcaaatgatgtttcatggggaacatgctagtaggcttgcattcttactggaaaagagacgggggttgattatttttaggtaatttattctgaaaacacaacctgttgagagagaagatgagaatgccattggaaggttatcctcaacatgcaagcaaaacaaaaataataaaaaaatcattagcaaagatgacaacactagaccaagcagtgaccacacagtacatatttggttgtgtttcaagccttatttgggtagaggaaaaaaaaaaaaaaccaatgaagaaatataggccaatgtaagactctgttgacacagagaatggcagcatctgaggttgaaaggacgtatgcctgtatcgcccctaattatagaacatcatcagtgcttcttatttccctcaagactcaggcttgcccccggcactatgttcaatggtcacttaatggtctagaaacatggttgagaaaaaacatattaacagcaatccagtcaccagagcacctggattttctcctaccttcttttattctttcgtgttctggtacagtcttgccttgtgtatatcaatgtatgtttgtatttattgtgtcattgcatttgataggatttttcaaattgaaagcctcagagcttacgtaggatttgtgaggcattttactaagaaagttgggctgcaagtattttaaatgttattgagtttattttcaaattttaagactgactgagttcataatgtctgaaacggactcctttctattcattgatctccagagaagaaaataacaatcaatactttgtttttaacttttattttaagttcaagggtacatgtgtaggtttgttacataggaaaacttacgtcatgagggtttgttgcacagattatttcatcacccaggtattaagcctagtacccattagttgtttttcctgatcctctccctcctcccacccttcaccctcaagtaggcccccgtgtgtgtcgttcccctctatgtgtccatgtgttctcatcatttagctcccacttataagtgagaccattccagccaatgctttttgagtgcttactatgtgcttacattttgctgagtgctttatgtttattcattcagttttcacaagtatcttatgaacttgttatgatcattgtcaccattttacagataagaaaactgaaatatagagtgatggagtaatttgtgcaggtcacgtcaataagaagtaggggagccaggacttgaattcaggcagtctggctccaaagtctctcaccaaacgatcatatcagttctcacgttcacactgcacctgggcatttatttgtttcttgtacaaactagaaagtgtcacctacttgaagagacaaatgtctcccataatgtggacacatcaggacacgagaactgcatgctcataggcaacatgctcataggtatctcctcactgggaacgtctgctgtgtgcaggaaaatggttccagagtagaagtcccactcctggtctatcagggtggcctccaaatatattaaaagcacaacaatttctgcggcttctgccactctcaccctggtccaagccaccgccatcaggggttgatgtaatggcccctgaaatgcttctaccagtaccctctcctgtcatcagcagggcagctggatcacatgtctacttgttccactcagaacaaaagacaaagtctttccaagagcctgtgtgatctgtgtccctccttcccatcacttctttactcctcaccaccctgcctgcaaccccacatccttatctgcgccactagccttcagattgttcctgggcaggttcacgtcaggcacgttatgcctcaggacctttgtgcttcatggtccctgtgttggaagtgctccccccgaaacgtttcctgttccctgctgatcattacagcaccttcacccacccactccacccactcagctctctatccttcctccctgccttatttttctccctagtgtttataatgactggctcttccatctattttactaatgtgttagtttcttctttgtcgctgaacactagcgtgaacactttcttttttgtctgctttctttcccagtgcaatcccagaaatgagaatccagtgggcgttttacgaattgactaaatgaacaaatgagtgcattgtggagttgttttggagaattaagtaaactagcatatggaaagcatttggaacaaacaatgcttagcatgaaattaatgtttaataaatgtcaggtatcaataaaagaataacataatagttattgaatgaatgatgcattagatactattacttgttcctgtggtaggaagagggtaatcaagctccagaagttttaagtatgttaacgtacatttacaatggttgctagaggagataatcagggacatcatttgtgtcctcttttcctattgtctggagggcgtactataatccatccttctctaggcaagagagtggctctcaaacttcattggacttgggaatcacctgcagagttttaaaaaattgatcctggttcccatcccagatattctgatatggttagtccggagtgtaactcgggcattaggagttttgaaatgctccctgagtgattctaatgtgcagcaaagtttgggaatcactgccttaagcttttcacagagctaacagcagcagaaggaaaagccttcctcagtccctctctatgcttggaaccgagagttgcaccaacctcggttctaaaacacgtgtgaccattagcaagtcacctagcttcagcaagctttaccttcctcaattttatgtctgctgtggaaaatggtgaaaactcagaattcagggccaggttccaaaaatgtgaattttccttcttccctctctcccttcctttcattcttccttcctccctcccttcttttcttctttctgtcccctctttcatctggaggtaaaaggacagaattgttttcagatgtggctcaaaaatggcttgctctgaaatggtgctttcttacagaggggaccagagaaccaaagtgtccaccatgcctagctggccccattcttccccaggcatacccagccatgcctgtttcagcttcaggagggatcaatgtctgaaggtcaagttcccacccattggggtccactgtgggagtatcagaggtcctactagtgtcctgggttccagccctggcctccccacttcttccctgtgtcttagtgcctcccagcctggggccttgtctgaggctcctaccctggtcactggggctcacactgcattggttttgctggctcactcagggtctggaattctgtcctctgacacccaggcctctccgtctgatctcctgcccacctgagttctgcccacctctcttcatccatcccaagcatataccatatcatggtagctgcgtctaatctctgggtcccgaaaaacacctgcacccaccctatagtgccaccaatctcagcctggacttttctattaatagaatggtggtgagacactggggatagcacaatactggggccagcatcacgggtgtgtgacccattcagtgacacaggaccctgggctgggtttcatgttctgctgtcttgaaattagtcatgtttgaatgagaggctccacattttcattttgcactgtttctgcaaattatctaatgtgccccacacttcaaatcagaagacctggtatggattgcacctggcttacacctgagaaaagcgtgaccttggccaagttatttttcctatcttggcatttgcaaagaaggaatgagtggggtaaaactgtctccatcgtaggggaattttaagaatgaaataaggtaacagatgagtgttagcacatggtgcacaacatgttagttctcaactaacacttctctttttcctactgttccacctcccaagaagctaagtcgaaaagacacttcctttctgtttaaaatggattttaaatgtttgttttcctagatagtgatatatacctaaaggaaagatcttaggagttgtcattgatcttacctcattcttattaattatgcagaaagacaacaggattccttctttgctatctttctttattacattgaacaatatgttgtccagatggcatatagagtagcatcttccaagatatttttaaatgatcttcttttacttattgaagaagattacagggagagaaatttgaattaaacccgtgtcattgaaataatcttagcttacattacattaaggagatttctattattcagactaataacttttccccaaaagaaggctgccttgaacaatgtgcatgagtgaagacttcatcaagagtcatgggagtgagtctttggcccaaccctctggcataccagccatgggcccttagtgacaataaactagtattttgatctcagttttcttattggtaaaatccacaaaataataccagttctgccctctcattctcaatttgtgtatcaaattaggtatttgtggaagtattttgaaaatttttgaatgctatacaaattttgagttgggattattgataagacttctgaagtttaggtgttaatgaaaagattcatttgaaccacttgaaaatctttccggagaacaaatgccaagagttaagttctcaacttctttggaaatggagatgtgtttgacaacaggatagtgtgtcaccaccaaaataatccacttcaattttactgcggccagaagccataggtattaccttctaaatgtctgaaaccctctgaggctgtttctaagcatatcagttataacttaacagcttttcacaaagaaatctctttttctctacttattaattcaagtactaattgagaatgtactatgtgccagatacagttctaggcacctgagataaatcagtgaataaaaccaagttccttgccctcatagagtgtatgttccagtgtatagagcaaaacaacaaaaataaccataaaattaagtatactgttgacccttgaacaacatggggcttggggcgccaaccccacatgcagtcaaaaatccacgtataactttggatgccctcaaaactcaattactgatagcatactgttgaccagaagtcttaccaataacataacagttgattaacatatattttgtatgttatatgcattatactcatatactgtattcttacaataaagttagagaaaacaaaatgttattaagaaagtcatagggaagagaaaatatatttattaatcattaagtagaagtagatcatcataaagttctccatcctcattgtctttacattgagtaagttaagaaggggaaggaacaacaggggatggtcttgctgtctcaggggtggcagaggaggaagaaaatctatgtataagtggacctgtgcagttcaaacctgtgttgttcaagagccaactgcattctacagcacgttagcatgtgattagtgctgtggggaacaaagaagtagaagggcataaaggggatcaggcatgttggggagcagggttgcatttttaaaatgtatggccaggacagtcctcttcaaggtcatatgtgagcacaagcttgagcgaggtgaggctgggccatatgcatatctgcaggataggcattccaggttcgaggaacagccaatgcaaaagcctgaagcaaaactggcccaagtaggccacgaaagaagcatgactatgggtctccccagatctttctcactctctaccaaaaaacaggttttgaaattaaagagaatatgattgccaggccaatgcctaagacatacattgatgccttgtttctcttgtatgtgctttctccacagtcacatgacacaggcaatcccttttgacgaccctcggttagagagctgccaaatcatccctccggctcctcggaaggtggagatgagaagggaccccgtgctgggatttggttttgtggcaggcagtgaaaagccagtggtcgttcgctcagtaacaccaggtaagcacccaatcccagttcttggtttcctgggaatgtctgccacactctgccagaataactactgttcagtttcataagtgtccaggctgtgaaagctggatatgtttttccaaaacctggatagagtcacttcaccagaggaacagaaatgcttcctcaaactaggttttaaactgccaaatccatcattatcaccagactcaggaaaatactgagccatcatctataaccatggaaatgaatcacttcttaacttatgaatgcagacaagaagaggcaggccctgtactgtattacagtaagcccatgatgaattccttagtgaaaaaaaggaggaagtggttacagtaggatttagtcataggggtagttggattatttcacaagtatgcactcccctcccttctcattagaggcaaaataaagggaaaaccatactccattgctgttgggctggatcaggtgattgacaatggccaacggcatattagcaaagatgacataagcaaaggcttgagacgtgcttgtgcaattgagcttgtttcctgagcttctgccatggctataagaagagagtttttggctgggtgcagtggctcacgccataatcccagcactttgagaggccaaggctggtgggtcacttgaagccaggagtttgagaccagcctggccaacatggcaaaaccccatctctactaaaaagacaaaaaattagccaggtgtggtggcgcttgcctgaagtcccagctactcgggagactgaggcatgagaatcgcttgaacccaggagggagaggttgcagtgagctgagattgtgctactgcactccagcctgggcaacagagtgagaccctgtctcaaaaaaaaaaaaaaagagttttccccaggtagctgtgatctcttccatatgagccccataatgaacacacgaggcagcaagcctgcagtggggagccaagtacagcctcatctgcagtttggtacacaactgtccagctaagcctagctgaaatcagccagcctgtggttatcctaaagacccataagcatgagaagaaatgatcattggtcacctgttgagcttgggggtgatttgttatccagcagatgctgactaatacagtatatgtcaaatctttaaaattctacaatatgattagataattaatgtactttccctcaatcttcgtattacagtatacagatgttccgctgtcaacacagctgaatacagtggactatgatgcaatcgcctgaagtgggctgcctttacctttccagaaacaatgtgcttttattatttatttattatatatgtatttatatgcttactgtaatggactcatattggatttattttcagaaaaaaaggggaattatcttccatgccctttcttcataggattttgcaaatcagtaacaggattcagcagtaaagtactacacttaggagcacagactctggcatcagactgcctgaatctgactcctacctctgcccctttttagactttttagcttccatgttaaattccctgcatttcagtttgatgtaacttctctacatcttctgtataatggggatcagagtagtatctaccttgtagggctatggaaaggatgcaataaattagaagagtgccaggcacatcctggtcattccatagatgtttacttttattgttattgttatttaactctaaaatgtttggccagttgagtgtctcaattaagggaaacgaaactcaagtagcgtcctggtatagattttaaaatttggtttcatttttcgtttttcattattttgacataatatgccccagggcaagcaccacaaataattaaccactttagacttgtgctatctgctaaacttttttatttcattaaatgtagatcatattttagttctctgtgtaagattgttgagctcgacacaattgagaattctcaaaacagatctgttgcttcttatgataacatgctttgtaaaaaaaaaaaatagaaacaatgtagatagtatagaggagaaagtaaaaaaaaaaatcacctaaattcctactaccaagatatagccattattgatgtagacagcaataatatgtatagtagatataattccgtgcatacacaaacacacatatgtaatacatatgagatcatatattttacacatacataatacatatatatagatgtatgtatgtatatgcagacacattttttcctaaatggaataatatttggcatgctgttttataatattgggataatctaacatctctgattatgagattctccgaagtatgtgtcttcccaggagctgaatgaagattcaagtcttattttttattttttggtatcatctcactgtttctacaacctctctccttcctggccctcaattctccttagcttcaaagacactaatacctactcttacacaattttgagaagagtagaaaaaaggtaaaaacaaaggtcaaagagtactatttccagttattgttatgagtgaaaacattggtcaaacaagctgtgtctatcataaaaatgactctacagaagtcccaagtgatttcagtgcgtgactagattttctgtagtaggcaatccagacttcaaagtaaaggccatgagacagttctcttgaagtgtgccactgttttgtattttggatgggacagtgtgtctcttctccagaattcttgattaaagttgcttgattagacaagaatagtttcatttgatcaaaaagcatgggtcaaatataagagtatgttaatctgagagtggttttcttattagaatagttaacattcgtccttcagttactttgaaagtttttctgtatttgatcagcgtttgattgctacccatttgtttgactgaatttgagtgattacttgcacataatacttataataagtttcccaagtggtttttctgagttccttatgtgtgcaaacactgaatcccacatctgtaaaatgaatattttgtatcagtaatataaggacatgttaagtttctcctactctcttacttcccggaaggaagacaaatttatgctacagcttgaatgacacatatgcctcgtatctgggtgggtagagaacaactgaattactttcagttccatgttctgggtatgaagtgttcatttcaattactaaatgaagtaatagcaataatatttgaaagatagcgtttcagctgcaactatcacccagagtcagacctgtggaaatatagttaaaattatagtaccatatgctaccgtatcaatatttgggaggtaattgcacatgtctagagcttaattcaggtaattgtttttatatcttacttaaatatagatgtatgcttcactcagatgtggttttaagtttatgtgtcaagaaacctggcagtgactaggttctgaattataggaacaaattcaaaagggacattcaccattctgaacttggaagagtccaagctaagatctagtccgtccttcaagtcaattctttaacctgtgtaagcctcaattatctcattatatggaaggcattatagtattcagtgaagttactaggccaagaatttaacccattgcctggtgcataataaatgctgaacaaatattagtttcctactcccttcttggaaacaacggaaagagaaaagggccaggcacagtggctcaagcctgtaatcccagcattttgggaggctgaggtgggaggattgcttgagcccaggattttgagaccagcctgggcaacacagtgagatcttgtctctacaaaaagtaaacagggccgggtgtaggggctcacgcctgtaatcccagcactttgggaggctgaggcgggtggatcacgaggtcaggagatcgaaaccatcctggctaacacggtgaaaccccgtctctactaaaaatacaaaaaattagctgggcatggtggcgggcgcctgtagtcccagcttctggggaggctgaggcaggagaatggcatcaacccgggaggcagagcttgcagtgagccgagatcgtgccactgcactccagcctgggcgacagagcaagactccatctcaaaataaataaataaacaaacaaacaaacaaaattagccgggtgagtggtgtgtgcccatggtcccagctactcagcaggctgaggtgggagggttgctggagggatgcacatggagctgtgagggaggaaggggacacctgcctagccagccagatcagctgaatcaaccctggcgatcaatggggcaacagatgacacagccagatcaccttcacatccgaacacccttttactgagatatcttacgattccccacagtatgctgtctccctacttgtaataagtacataaatgcacctttgtttgaatccagctgtgccgaattgttgcagctttggccacagggtatcaacacaactgattggctacctgttgagagaatagctccttctaggggcctcaccacacacacacacacacaatatggcctgttgaccagcagcatcagcagcacctgggagcttgtgagaactgcattatctcaccccgcacccccgcatggtaacaagatccccaggtgattcaccataaagtgtgagaagcactgctagactgagtctcgaccttgcttgcaaagttttagaaaaatgtggatgcctgggtcccatcccgaaagattctgatttaactggtcagggtaaagcctgggcctcagaattgtccaaagaacacccaagtgtggttgggtttcggttttgctgatagcaccatttgctcacagtgaatcatgatcaggagaggaggcttgggataggttgctaatggtcttctcacctgtgcttcattctatttgtctccaggtggcccctctgaaggcaagctgatcccgggagatcagattgtaatgattaatgatgaaccggtcagcgctgcacccagagagcgggtcatcgatctggtcaggtgagtgactcattcacctgtgtcctgttctgctttgaaggctgctgcacagctctgaggtctcaattagcagaggaagagcctcctgtgggacaatttaggatggaaatgcaagccaacacatacacatggttgaaaatgctgctgacactgacctgtaatatcaaaacacatactccataaacacaaaactcctaattgtccactctctgttaacattgaaggtacatatgcctcagtttaaaatttttatgactcctatatccaaaggttcattttttccttccagaattactaacacattgatttttcataatcagggagatcaaaacacaatacctgaattcagcacaaagtgatgagtaattttatatacataatcccatggatatacaaacatacagttcactgatacttcatatttgactaagtgcttcattactgaaatttgagattatcaactgtggcaataggataattaggtcaaagctaagagtttacaaaatacaagtggtttattggtttagttttattgtaaatataagtagtttgttatgtgatattcttaatggggcaccagaaaatgtattttatgttatgttaaaaaatattggtcaagaatccctttagaagcccactggagttatacctccttagtgaatttaagggaaaagagttctttagaagttttttaaatgaagaagctgggcctatcatatgaatggatccattcattctatgggagtgttgaggaataaggagacatgacatttgtcttttataaactcatattttcaaccaagattgaagccaaagctgaggttatcagaacacttttcactgaagaggggatttcctaacatttatgctcactcattacggaaagtgttaggttggtgcaacagtaattgctgtttttgccattgaaagtaatggcaaaaacttcaattacttttgcaccaacctaatacatctgtactttgggaaaggcactaagtggagtatttctggggtctttcagagaaagtttctttctcaagcctagttcagcttttgcttcacaaagaggttctggagggtcaagcactcttggaagaactgggagaggagcaaaaagagaaatagaaagagaaggcacttaagagtaagcaaccatcctagttttagcatgtaaaaggcccatgtcccagggaaactctggaatggttggtcactgctatggtctgaatgttagtgccccctcaaaattgttatgttggaacctgatacccagtgtgattgtattaataggtggggcctttagggaagtgattaagtcatgaggtctctgcatcgtgaatgggattagtatccttataaaaagttgaagagaattgccttgctccttctcccatgtaaagacacagtgacaaagtactgtctttgaggaatgtggcctttaccaaacaccaaatctactggaagatcttggacttcactgcctccagaactgtgagaaataaatttcaattattcacaaattacccagtctaaggtactttgttgtagcagctcaaacagactaagacagtcactctacttcagtctgggcttaatggagtcttcccagatggctagaaaagtcatacttgtactcctggggcatccagatctccaaggaatggtcttacacaggagcagacactgagacttgtgtcatattcactatgcatcgggaacaagacctgagaatgtctccaatctttctatggacaaggggagccagaatatagaaagactctgtatgtaagagcccttgggaaggagctgcagtgttcatctggaataacttctctcttgagatgtgtgtgggtgtcagcaggggcataccttatctaggcaggctctgagccttctatcggcttgcatcctggaatgccatgtttgggcttgatggcagaagttgcatggatgttttgttttcccctaggtgcgcacctctgtgattagtcctattgatttttgtgcctggaggatgatagaagaaataaaatatctgtgtttaggttggctgtgacttaattgcctgctgcagggcagtgacagagaaaaacctatctgaaagtgtgatcacttcctagcagttgttccagggacttttagaaagattatttccaagaaagatattttatttctggtttaacgcttgtagaagaaaatggcatatctgtaaaaaaagcgctctctatagaactttacatataacaaaatgaaccagttaaaagagaggatggcaaacagctccaagttcaaatccagcctgccacgtgtttttgtaaagtccatcagctaagaaaggtaggtttttttatacgattttttaaaagttgaaaaaatatattttgtgacacatggaaatcatataaaattcagattttagtatccataaatattttgctgggtatagccatgtttgctcatttgcattttatctatgtctgctttcctgctacaataacagagttgagtagttgcaacagaaactgtctggctcacaaccttttcactcttactaaaccacaatgttaaaataatgtatgtctcactaatgaaaatgatcacacattacaaaatattcctgtgccttcccataagtttagtcatctgtctgccataatgtgtactaacctaaacacttagctcttgtaaaataatcccctttttactgggctcctcagctgatatatgttttaaggtctatatcttacacaagataaattccctttctgtataataaaaaacatcccgttttcttagccactaaggaaatttggaaaaacactcatcattttgataacactgtaaaattctctctttaaaaattggcatccatttgctggctttagtggtgtagtcttgttttgttccttttcccccattgcagcatgtgttcatggatcattttttgttcccagatccatttgtgtttcttggtggattatttttcttatcatttagttactctattatggaaaattatttttttcttgagaaaatgaaagagttttgcagagaccaatttactgctatactaacaacattttggttttttcatgtagtctcaaaaagctataattgctgcactgaaattagatgaattctgttcacttcatagtcttctaagttgttaactctaactcagactgtataatggtgtttgaggactaaaatctttgaagaatccatgccctttacaaattaccatatctttcttctttaaaagtatctaaggataattttcttttcacaattagactaattaactgaaagcagtctccaaaattttatttttaaaaagtaaggagtattattgcccatagaaacattatgaattgtgccttgccttcccactcccacggctagccagcccaattaaattcatttgacttcaacaaagaattattgaggattaacagacatcatataaggcactgagcatgtatagatacgtaggcatgattcttgccctcaaggagaagaattctaattaatttccatatatttatgactggacaatgctgttggcgagggtagtatttggtaggaatgtttggtggagatggatggtgtattaagggatattattgatgctggtaaagagtagccatcaacgcgaagtggaagggcaggtttatgcatgagaagggagttgtaaagtagatctttcctttgaccctagaaaccccagaccttcttgatggacactcactttccaacctgcagatattgaaaaaaaaaccattgcctaggtggctgtcccgaatcacaacctcaaaatttggtccttcaaggcagcaacataaatctactaactcctgttagaatgggtgcactagattttttggattagagatgcaactgggaacctgataaatgccatagacttttccctccatccagagaaacccacgtgtatacaaagttctgcatacaatattagaatggtttttgactccctaaagttagtcccagttttagagccggggcagcagactctaagaatgctgtctctcttcctccccttctcccccttcctcagtaccagatgctaacattgaagagtcaagcttataaacaacttgctcttatccttttctatcaaagcagttgaagtggaaaattgcccatcccataataagaaggtacactggtcaaactggagactaattcccctttctcccaacatctgtaatagggcagctaactatccctccatctgcccttctcccactatttatgttgattattcctactaatctaattgatgagcagtgttatagttatggctatttatctacagagggttgctcacatctgtcagacatgtcaccccttctatactaataccctgggaattggagagctttcctgggtagcggtagtgttctttcaataagaaagtaactgtaataagaaataagaataaatgataggggagtgacattaacaaggtggcaaaatgaggtcccccactggtatcccccatagcaactataatttggcagccacctatggacaaaagtggctttgtgggagttttggaatccaagtaggtcactaaaccctggtggagcccaagactgaggagggccattttgagaaggcagacccacccaggccttggtggcagactcactgactatgatcccaaatacagacccagaaacaaccacatccccccgtggagttggctacagccctgtttggccttagtcctaccactggcattatccatcaagggacccgggaagagtcatacctaccttggccttgggtaacagatctgctgaccttggccccagttgtggaccctagagtggcttgtgaccaagctccagcctctctcagccattgtctgcgagcagtcccacctgtcctgggacctgctgggaaataggccagttcatacccccagaggtaggcctaatgaacttagttccacagattttgaaacagccccataattcagctccagcctctctcagccataatctaggagcagtcgtgcccacccagggacaccctgtgtcccctcaggcaggcctactgacctccatctgaatgtggatcctgaagtggccccataacctggccctagctcctctcagccatggtcagggagacaggcttctctgtgccctagaggcagacttgccaaccttgatccaactgcagatcctgaaacagccctgaaactcaattccagccactctcatctggtattcaggagcagtcctgattccccgactccacctagggacctgttgagtgacatgcccatttgtgccaccacaggcaggcctgctagccttggtccaactacagatcttaaagcaacactgtgatccagctccagccctgcacagccacagtccttcccacccaggaaaccacgaggaagcatgtccatctgtgtccccagaagcaggcctgcggatcttgatcttgactgtggaccctgaagtagccctatgactcatttccagcccctctcaaccacagtccaggaccagttatgcttactcagaaacctacccaatggtccagcaataaccctcccagggatcaggtggaagctacaatgatctgtgtacctagtaacaggccgatgatctgtggaaccttgtcccagcatcagcccaattaatgaagatcctagaagcattccagtccactcaggaatgagataggatccatgctctcccaaggctctggaaataggcctaccccccattgcaagaccccattgcagatctagcagtagtcacatgatctagctctactgtaattgcagaggcaatctcatcagtcaacaagagaaggtctttacctgctgaaaccagtctataaagaccagtctgtaaaaactggaaatctagcagaccccattgcaaatacagcagtagtcacatgatctggctccactacaattgcagaggcaatctcataaatcaacaagataaggtatttactagctgaaaccagtctataaagaccagcctataaagactggaagagggccgggtgcagtgactcaagtttgtaatcccagtactttgggaggccgaggtgggtggatcacttgaggttaggagtttgagatcagcctggtcaacatggtgacatccagtctctactaaaaatacaaaaagaaaaaaaaatagcctgctgtggtggtgtgtgactgtagtcccagctacgccggaggctgagatgggaggatcgcttgaacccaggaggcagaggttgcaatgagccacgatcacaccagtggactccagcctgggcaacagagcaagactctgtctaaaaaaaagaaaacaaaacaaacaaacaaaaaaaacgactgaaagagatgtttgccctctcaaatgcacagataccaactcaaggctacatgaatcacgaagaatcaagcaaacatgacaccacaaaaggaaactattaaggcttcaataagcagcccctaagatatatcatttgagatatataaattacatgaaaaataatacaaaataatcaccttaatgaagctcagtgggatacaagagaacacagaccaccaagaaaaacaaaaagcaatacataaacaaaataaaaagtttaataaagaaatacaggtcaggcgtggtgattcacatttgtaattccagcactttgggaggccaaggcaggcagatggctttgagcccaaaagttcaagactagcctgggcaacatggcaaaaccccatctctacaaaaattagccagatgtggtggcccgaatctgtagtcccagcaacttgggaggctgaggtgggaggatgacttgagcccaggaggcagaggtttcagtgagccaagatcacaccactgcactgtagcctgggcaacatagccagaccctgtttcaaaaaaagaaaagaaaagaaaggaaaaaggaaaggaagtaataaggaaaggaaaaaggaaaggaagggaagggaagtgaagggaagggaagtgaagggaagggaaaggaagggagaaagaaagaaagaaagagagagagagagaaagaaagaaagagaaagaaagaaagaaagaaagaaagaaagaaagaaagaaagaaagaaaggaaggaaggaaggaaggaaggaaggaaggaaggaaggaaggaaagaaggaaagaaagaaggaaagaagaagaaaagaggagaagagaggagaggaaaggagaggagaggagaggagaggtgaactataaaaagaaccaaacagaaatcctggagctaaagaatacaatgacaaaactaaacattttaatagcttcaacagcagactcaattatgcagaagaatcagcaaatgtgaagacaggctatttgaaattacccagttagaggaacagaaagtaaaaagaataaaaaagagtaaaggaagcatacaggtcctatgagataccatcaattgaatgaatatatgcattatgggaatattagaaggagaaaaggaaaaaaggggaaaaagcttatttaaagaaataatggctgaaacgtcctaaatcttggaagggatatggacatccagatttatacaaatcaaagggtctcaagcagaatcaatccaaagactactctaagacacattataaccaaatttttaaaagccaaacacagacatagaatattgcccctaagagatatcatttgagatatataaattacatgaaaaataatacaaaataatcaccttaatgaagctcagtgggatacaagagaacacagaccaccaagaaaaacaaaaagcaatacataaacaaaataaaaagtttaataaagaaatacaggtcaggcgtggtgattcacatttgtaattccagcactttgggaggccaaggcaggcagatggctttgagcccaaaagttcaagactagcctgggcaacatggcaaaaccccatctctacaaaaattagccagatgtggtggcccgaatctgtagtcccagcaacttgggaggctgaggtgggaggatgacttgagcccaggaggcagaggtttcagtgagccaagatcacaccactgcactgtagcctgggcaacatagccagaccctgtttcaaaaaaagaaaagaaaagaaaggaaaaaggaaaggaagtaataaggaaaggaaaaaggaaaggaagggaagggaagtgaagggaagggaagtgaagggaagggaaaggaagggaggaagaaagaaagaaagagagagagagagaaagaaagaaagagaaagaaagaaagaaagaaagaaagaaagaaagaaagaaagaaagaaaggaaggaaggaaggaaggaaggaaggaaggaaggaaggaaagaaggaaagaaagaaggaaagaagaagaaaagaggagaagagaggagaggaaaggagaggagaggagaggagaggtgaactataaaaagaaccaaacagaaatcctggagctaaagaatacaatgacaaaactaaacattttaatagcttcaacagcagactcaattatgcagaagaatcagcaaatgtgaagacaggctatttgaaattacccagttagaggaacagaaagtaaaaagaataaaaaagagtaaaggaagcatacaggtcctatgagataccatcaattgaatgaatatatgcattatgggaatattagaaggagaaaaggaaaaaaggggaaaaagcttatttaaagaaataatggctgaaacgtcctaaatcttggaagggatatggacatccagatttatacaaatcaaagggtctcaagcagaatcaatccaaagactactctaagacacattataaccaaatttttaaaagccaaacacagacatagaatattgaaagcagcaagagaaaagcaacttgtcacatgcaagaaaacccttataaaactatcagtggattgctcatcagaaaccttgcaggccaggaatggatgatatattcaaaatgctaggaagaaccgccaaccaagaatacttagccaggggcagtgacacccacctgtagtctcagctatttgggaggctgaggctagaggatcacttgaacccaggagtttaagaccagcctgggcaacacagtgcgatcccatctcaaaaagagaatactatacacaacaaagctgtccttcagaaatgaaagagacggaaagatattcctagacaaaagctgagggagttcattgccagtatatctgccttagaagaaatgctacagtgagttcttcaggttgaaatgaaaggatgctaagtaactacctgaaaacatgaaagtataaatctcactggtaagggaactacatagttaaattcagagtactctaatactgtaatggtagtgtataaatcacttttaactacagtatgaaagtcgaaagacaaaagtattaaaaaataactacagctacaacttgttaatgaaaatacaacatgtaaagtattacatcaataacatataatttgggggcagggagagttagacgtgtagagttttgtatacaattgaaattaggttgttatcagcttaaaattaactattataactataaggtgttttatgtaggcctcatggtaaccacaaagaaaaaactattagtagatacacaaaagataaggagaaaggaatcaaagtatatcattacaaaatattaacaaatcacagaagaatacagcaagagaggaatgaagtgacaaaggcactacaaaacagcctgaaaacaattaacaaaataataatagtcaaacaatagttagtttgttcaatagttagtttgacaatactccaacctttgtataataggaatcgcagaaggagaagaaagagaaaaggggccagaaagtatatctttaaaaataatggctgacaaatgagattacatcaagctaacatcttctgcacagcaaaggaaacaatcaacaaggtaaaaagacaactcataggatgggagaaaatatttgcaaactattcatctgacaagggattaataataataatatataaggaacacaaacagctcaataggaaaaaaaagaataatccaattaaaagtgggcaaaagatctgaatagacatttatcaaaagaaggcatagaaatgaccaacaggtatataaaaaatgctcaacatcactaatcaccagagaaatacaaatcagaaccacagtgagatgtcatctcaccacagttaaaatggcttttattaaaagacaggcaataacaaatgctggagaggatgttgagaaaggggaaccctcataccatcactgttggtgggaatgtaaattagtacagctactagggaacacaatatggaggttcctcaaaaaactaaaaatagaactaccatattatccagcaatatcactactagatacatattcaaaataaaggaaatcaatctatcaaagagatatctgcactctcgtgtttattgcagcactattcacaatagccaaaatatggaatcaacctaagtgttcatcaatggatgaatggataaagaaaatgaatgtagtatatatacacggtagaatattatccagcaataaaaaaaaatcctttatttgcagcaacatggatgaaactccagttcattatgttaagtgaaataagccagacacagaaaaacaaatattgcatgtttttattaatatgtgggagctaaaaaactggatatcaggaagatggagagtacattgatagttaccagtggctgagaagggtgcagggaagggagggataaagagaagttgattaatgggtacaaaaatacagttagatgaataaataagacctagtgttttatagatcagcagaatgactacagttaacagtaatctattgtatatttcaaaatagctaaaagagaattactcaagtgttcccagtataaagaaaagttaaatgtttaagatgacagatatcccaattaccctgatttgatcattacacattatacgaatatatcaaaatattacatgcacccccaaaatacacacatctcttatgtatcaataaaaaaagtttattaaaaaataataatagtggaaaacttttctaatctggggatagatagcaacacttagatacagggagcgtatggatttccaaatcaaatttaatccaaaggctgggcatggtgactcacacctgtaatcctagcatttttgggaggccaaagtgggaggatcacttgaggccaagagtttaagaccagcctggtcaacatagtgagacctggtctctacaaaaaaattttaaaaattagccaggcatggtggtacacacctgtagttccagctactcgagaggctgaggcaggagaatcacttgagcccaggagttgaggctgcagtgagctatgatggcaccactgcacagcctgggtgacaaagtgagatcctgtctcaaaaaaaaaaaaaaatcaatccaaagaggagtacaccaagacatatattaatcaaactaccaaaaatcaaagacaaagaaaaaattctgaaagcagcaagaaactagaaacacaccatattaaaaggagagccaatacaactatcagcagatttctcagcagaaaccctacaaaccaggacctagtggtccaaagtgggccaagtctaaccatgtggcacattaagtttttcttacttggggggcccagcaaatgacagagctgtaactggcctttagaacctgagtcttatcttgtatgccccatagacacactcccttttttggattatacacaagtagtctgtctcctatcccaggactgctaagcagttgccttgattttagtagggagttgtcaggagtacctgcttattgcagtcgatgggagattggcaagactattcagagcaaaataggccatttagaagggatccatccaaaaattagatcctagcacacctgtcttttcatcagtcccacctcatcagaattataatggaaagtcaaatcagatcatgttccaggggcattctgtctgcagaagagtatattagaaaggtcatcttcctgcctaatgttagatggacttaggtgcaccatgatgctgcttagtaaaataacaaagcagggccgggcatggtggctcacgcctgtaatcccagcactttgggaggccaaggcaggcagatcatctgaggtcaggagttccagaccagcctggccaacatagtgaaaccctttctctactaaaaatacaaaaattagccgggcatggtggcgcatgcctgtagtcccagctactcaggaggctgaggcaggagaatcgcttgaacctgagaggtggaggttttagtgagccgagatcacgccattgcactccagcttgggcgacagagacttcatctcaaaaaataataagaataataataacaacaaagcaaagaacatctgccaagtatctgacacataaaatatgcacaatgatgtgtaatataataaggccttattaagaccagcaagcaactccagtgaaaacacaaaagaaacagctctatggtatgctgacactacaaattgtaatctcacctcatacacacttgcagcatacacgttttctgataattgcaaattacagagcctgaggagaaagaggttggtgattctagaaaatggaaagtgtgggaaaacattataacaaggctgaagtagaaaaagggatttgggagcatagttcataaaagctataatgatatataatgacggaaattaataagaaaaatgacttcacccagattatcttaatgtccttagattttgttaatgaccatgtcccacttacttattaagtctcttcactactctagatgcttttatgcaactcatgtatggaaaatgaatgttaaagattgaagaatcagaataaattttaaattagggcatgttttcaatgatctcatatggttgacactactgaatgtcttaacatcttactttattaagaaaaaaatggaaggagataattattgaaccagtgccatgttctgttcttcctttggaactacaaatttgcaagtgattgcctgccttttctataagtagatgaaaagacaaaaaaaaatcattttggtgaggctgtgtattttccctgtggtcagaacatgcccagaaccaaagtataaaccttattgcctagagagaacggagagctgtaggagcttacagcgaaatctatttttacaggtaacacagtgggtgggtgtggtgggcaagaatctcaggccacacactcagatgtgagagaagtgtaacattatctatatattatctataataatctaatatttatttcaaatccctattccagtgtatgatcagttcatcctgttttccttagagctgagtcgacctgtagagggttgttttaatgagaggaggcattgggagatgtgaagtttacccactcctgggtcacatcatctgtcttaccagaacttgctgagatatatttgtacccatttggtctgtctttgactactcacctagaaaggaagccaacatgtcaccccttgttcaccattgtcaaccctcccttagccacttctctgtcatcttgcatgcacttgccactcctgagccattatgggacatagaatagcctctggggctaatttcctccagaatcttgtcaccttcccagggttctgactagaaaagaaggcacaggttgctgtgctctttaattcttcaaggctatctgggggttcccagttggttcttcctggagaatcagcttctgaaaagacagggagcatgcctgccctttcacaggcaactacaagtctggacccgttgcttgtcctgtagttcaccccattttccccatcctcagactaatccccattctggggaggactaagctttactctggtttatgtaataaccatctgtattagtccgtcttcacactcctaataaagccatacctgagactgggcagtttataaagaaaaagaggtttaatggcctcacagttccacatggctggggaagcctcacaatcatggcagaaggcaaaaggtacgtcttacatagtggcacaagggagaatgagagcaaagcaaaaggggaaacctcttataaaaccactcgatctcatgagacttatttagtaccacaagaaatgtatgggggaaactgccctcatgattcaattattttccagcaggtccctcccacaacacatgggaattatgggagctacagttcaagatgaaatttgggcggggacacagccaaaccatatcagcatcctagcttacagcttttaccctcagtttctaaaacctagatatttctttactttcttctgtaacaatcctttcctgaagtaatgagtgttatatgatctggctgaccaaatgggcaaagaaatagagctgctggaacagagtaaaggaatgaaaggtatgggggtgggagggaaactttggtgactatttcaaaatattgtcctgctgtgtgctacccagtgaaaagacataggggggtagaagtcagaaaaatctgagttcaagttctacctctgtaatgtattagctgtttgtgacttgcacaaggaacttaatttatataatcctcagtttcctcacctataacatgaagacctatcttatacaattgttggaagaattaaataaaacagagtaagtaaagctcttagcggagtaagagcacatagtcagctcttaatacatttgaattatcattgtcctcatcaaggttattaccagcggcatcactatagctgaatgatcatgagcaaattacttaagtctcagggtcttagtctcctagtctataaatgtggctaagaatttgtacttccaagcctttgtctcaggatggaatgagattatgtacatgaagcactttgtggcctgtagcaagttaggtcactgtgtcagatgctgtcattactgctctggaaattgcagggtaggagattggagcacaagcctgggtatccaatcaaaaccaaagagaggaatctgggtggaaattcaagactttcaggatgaagataacttgaaaagcagttaaaaagctctaagactcagggtttgtaaacatacctagactcagccttgcggcactgaaactgagagtttggcagtgaacttgactttggggacacataggtgtgcagcagtgtgacatggtgacaggaaccagagtgacttcactgttctgtcatatatgagtgaaggggatgtgaagaaattcaggggccactggcatgtgccctgcttgggtcgagattaggttaggaatgacccaaatcagggatgaacaaacttttcccttaaaaggcccagatagtaaatattttacgcattgcaggccataagggtctctgtcacaacttaattctgccattgtagtgcaaaagcagccatagatgatattaatacataaacaaattattatggctctattccaataaaatgttatttacagaaatggggatggggagagggcaaatttagcccacaggccttgtttgttgccctttgacctcaaccaatgaagcttaaagagaccaacctgaagataagagtgtatagaggaagagaaatgaagcagaggcttttagctagaaataataatgacaataaagcaaacattatgaactctgtagccacctaaaatccttttcagaaagtggacagataggaaaaataataagcaaacaaacaaatgataaacatcacagacttttgtgatggcttccatgaccctttgtaatccaccccccagggtggcttgcactcatatttttacccactgaaagggatttacaccttgcttataatctatacaacacaatgttgtcactatttgcaaacttgtctttctttgtcacaattctgtgtgtttcctaatgataatggccaatattagggtagctctatcttgtaaaaaacccaaaactatacagagtttccatcacaataggagtttgtcaatcacataaagtccgtaatgggtcctcctgattggtagacagctctccttcagagggtaatccggagaaacagcccagaccttcttcattttatggctcttaaatcttcaacacagagctcccagtttgtccttgtcaaactggcagaaggggaagatgatacaagggtgcatggaagggttttacaaaagaggtgtacagcgcttttcctccccttcctttggcaagaaaccagccatatagatggatctacctgcccaggaagctaagcatggtgtagctgtgcacccaggcagtgcagggagcagtttggctgagcatattgccagtctctgcacacattatgttttattaattatgttagccttcaggcctaccactgtactcagaatagaattggaaagaaagaagtgtttgccgaaagagccataaaagggaatttaatactacccacctttaaaaagattactataatttattattcttgtaaccaaatctaaattaattgatagacttttttatactttaagttctggggtacatgtgcagaatgtgcagctttgttacataggtatacatgtgccatggtggtgtgctacacccatcaacccatcacctgcattaggtatttctcctaatgctatccctcccctagccccccaccccacaacaggccccggtgtgtgatgttcccctccctgtgtccatgtgttctcattgttcaactcccacttatgagtgagaacatgcggtgtttggttttctgttcagcactgtacctgaagcaggttcattgctcatttcacgcttttccatatgcattgattttagccttgacctcatatttttcaaatgtctccatcacttcgtcagtgttgttaactatattatctccatctgcctcacttttactaacctctgggttctcaacctcttcatgtcaccttaggcttcattcatgaaatgaagtatttgctaaattgttcaaattactattctggaattaacctgcatttaaccttcccccatgctgcctaatccagtgtcagatcatatacccagcataatcagagccacatttatgcccaccaacctctaatttcacattaaactcaataacctgtatttcccctggggaaatgcagtgtttattgcccttttgtgtggagttatatttatgcattatgtgcatgatttacatgtgaacttgcagattaacagcctcctgtctcctgactgaaccagcatccaagctatgtagtctccctgcgtccccttcctgtccttaagatgcagagatgtggtagcttgaaagagacatgcatctgggagagacaagatcatggctttacaccagggatttcccaacttgaacctgtgacaccttcagggtcctcatccccgcaaaaggtttgaagggaagactataggcattctgtgagagaccattcttcattgtacaagtctgtccttcaatggaaggacatttaacttctgtgaccccatccactaatcctgatggtgatccccaatcattgagggatgcttccactccattgagaaccatcagagatgatcattataaaagctttacagcttaaatatactattaacagtagaagatgcacctcactgttttctcaagaggatacaattttcaaattcctgtagatgaatggttccccaatggtgggaatgttccaaaatggcagctcatttatgctattgttgagaagagaggaggtggtaatgaggcaagtccttatccctgttcccaagcaatggaacagggagcagggaggtagcaatgatcaagatctactctctccctaccaggaatccagataatgtactagcagagaccatcatgttcagaaatgaaatactaaggcagtagagtttagttataaatgggatcttcaaaagggtcttggcaggatgaggcagaaaaggattccttgaacaagaaagatacaaaaaaaggattttgtactcccttgccacccttttgctagcgtgttttttcatgcagtcagaagctgctgaaagaaacacttgaaccgaattttttctaaaaagagaaaaggaagcagccaccatttattaagccctcctctgggcagcatacaccaaatccttacacatctctgtgaggggcgtaattggactgattcgtagttgaggaaacaggattagacaagtgctgactgtgtacaggattctatactagtgagctctgtaatttgctgaaggtcagttgagcaatacttgatgaagccaggaggtaaacccagtgtctatctgtatatgtactttctcttaaaccatgctgccactctgggtgagaggaagtgaatagagggataacaaggtgagttttaggaaagaaactagtctcatctcttttcccagatgcagctcagggaaagaaaggccctagctatgatgttaaaggtccaagttgactttcaggaacccttaaacccccttccaggaatccttagacaatgtgtgggccagtcttcagtagctggtgtggattaaccaccagaggacccttttgaatggcgagagctgagtagcatcccctaaaaccttgtatgacctgggcgagggggaaaatgtcccaagacataactatgtttcccatcagcctgttgggcaggggctcagagtagagatacattatttagaaaaaataagaaatgagatatttcttacaactagtgttatggataaacattttgtacacacgacatagttttgtttggttttttaatgttagacaaaatacagaagcctggaaagtagtgccctttttcactctgaaatttgttttgattccacctacaaacataggagctcatgtctgtcaaatcagacttattccaataagacttcatttttatttcaacatcttcacttattcacatttgatgtagtttaaatcagtctttattatgtgcaccaagttatttaccaccgtgtagtagacaataaaaagcagtttaaaaaccacttgataacaacttaaagataaaatatagattcatttcttctatgtggtacatatgttagacagaaaggtacaaaaaatttataaatcttgtcattagacagaaacaattgtaatatattattattccaaataagatttcacttttgtatcaacctctttgctctttaaaaaaattttgagtatttcacacttaaacaactaaggcaaaatttcttaccaattctgggtcaaataataaaaagaacctggaaaacaaaagatttgttatttttcccccatgtaagaaattatcaccgttaaacatccttctgtctcttttagctccttgctgttgttctatttatatttttatgaacaaaatagtctatatgtctgtgtctaataaatgggatagctttgtgggctgagcattcttcatttttataagaagcatgtcagagctgaattgatcacatgctctgaaactctcccccagggtgttttcatttatatttaatgttaaatcaacgatattagaggtggaacaggctgtttgccattgaatgcaatcagcagtatcagctcactttgaattccataaatgccatttggaatgttctttttggtagagcacttcagggtatctgggtaacatgcagcttgataatttcaaaactgaataaccaaacacagtaacaaaggaaaccactcttaggatttataataaaaagtaccaaatttggagaaagcttctaaaagtgtgataaaaattttaaaaaccacacatttcttgccccttgaacgctacatgtattatttttcttaagcacagtgagctactggtttccattatttgacaaagtaatacaatatgtgagaggcccttaaaggtagccttcccctatagttttcttttctctatgaagtccatctctctttttttttttttttttttttttttttgagacagagtcttgctctgttgcccaggctggagtgcagtggcacaatctcggctcactgcaacctccacctccagggctcaagcgattcttctgcctcagcctcccgagtagctgggattacaggcacgtgccaccacgcctggctaattttcgtatttttagtagagatgggatttcaccatgttggccaagctggtctcgaactcctgaccttaggcaatcctcccgccctggcctcccaaagttctgggattacaggcgtgagccaccgcacctggccaaagtccatctccttgggctctcagatatacagtatgtcttaaaagtagcatagccgtaactagtaagagcctttcagatgaaagtgaaagaaacacaatgcaaaatggcttaaggaaaaaagtgaatttcctggctggcagaactcaaaagagtgtcgggtggagctggtgaggcacaagggaagtggggtgttgaggcctgatggtatcaggaatcctttgttctctgtctctgcccactttcctgtgttggcttctttttcaggagagctttctccaagtagcattaagaatttacagaagctctaggtttgcgtgctaccagcctaacaactcgaggggctgaaaggccatcatttcccaatgagtccaactggacttcccaaacagagcttatactggcccagtatggtgactgtctacctctaaatgaatcactgctaccccggggggtggaatatgctaggaggggccaggtctgggccgtattcctgcccgtgagaaaaggagatagggtgagccccatgtggattttcagcagctgagagtgggaaaggttggttctgcaaaagaaattgggtagccgttaataaatgaatagactgaagcctaatcaagcagaggaaacaactgccactacagctggtcattcttggctacaggttgttttagagaaatttcattatggaaagttgtgaacagaatcataggttagagaacagtatataaatggtcaacccatgttcccatcacccaacttcagtagtcatcaactcatgaccacacaccatactccacatgccaaggtactttctcacccttagatgacattgaagcacatcccagacatcacattatttcatccatagttcagtatgtgtctctaaaggataagcattctttacaaaaaataaaaacccacaatgccattatcataccttacaaattaacaatattttcttaatagtatcaaatatccaatcagtagtcaaatctcttccatggtctcataaaataatttctcattatagcatatttgaatcgaggtccaaatgaagtccatgtattgtgatttgtggatatgtggatattaaaagactcttttaatctatatttttcctttcatctcttttttattgtctttgaaaaaatttatttatagtttttttaaagttttttgtcctatagcgatttccacagcctggattttgctgattgcatctctgggtgtcatttaacatgatcttctgtccttctgtatttcctatgagagtttgtttcactcccagagtggaggaagctgtgcactttcatcctctagaggtgtacggtatctggttgtttctctttctgtgatataagcagctattgataactttgccaagatttattaattcattaatgattgcaaaagggtgatgctctaattccataatttcctcttcaattattagctgaataacgttataaagaaaaactatttggctacctcaagacacagtttatatgaaagacaacaaataacttgatcctgtctctttatttaccacttttcaaaccaatgagttgtttcactggcattcccactggggaaaaaaatagtatatttttaagtatcattatcataaactcatggatttaagtatattggatatatttatatccattgatgatattattcttattgaagctcaactcatcttatctttggtaatgggagcccattcaagtgagatatcaagtcctctcaacataaacctaatagtctttgttagtttcttggctttctgatatgataagatgctcaaggcttaacttgtatgtttgttgctccaaatctgggatgagtaatttctccaaggagccatgattccttttagtgggaaatgatatgtagtaatctgaatgctagtgtgctcattgataaggacagaactaagaaatatgtgtacatttttaaatgataaaatacatcatgagctcatactgatatgtccaattcaaatgcaggacaaaaggtttctatataacctcatctatcttaaatctttatctcttctttctcaagtcgtaaatcccaatgctcagtgacatcaccataatccctcaactttatcccacagtgcacatgcaacagcctcagaaaaacaacactaccacaaataacatttaaagatatttttattgcagttccatttgtctttatggaatatccaaccaatatattcaaatgactgtgttaaaatcactggaggccaggtgtggtggctcatgcctataatctcaacactttgggaggctgaggtggaaggatcacttgaagccaggagttcaagaccagcctaggcaacaaagtgatatcctgtctccacaaaacatttcttaattttttaaaaaattagccaagtgtgatggtatgcctgtagtcctagctacttgggaggctgaggcaggaggattgcttgagcccaggagttggagaccacagtgagttctgattgcaccactgcactccagcctgggtaacagagtgagactctgtctcttaaaaaaaaaaatcatttgagatagttcccctatgtgacactctgctactaactggatgatcagatgcaattatttcattttatgtataattcttagaaatggctttttaatttaattatgttttaaaattaagttcaactgtaatcatgccatcaactggatacacaggttctgcatttcattttacatgcaatttttagaaattgctttttagaatttagagttttataattatgaatactatttacatgatatctaagtcaaatctacaaaatgtatattcaaagaagtatacacgctttgttctctccatcctatttcctcccccatagataacacttatttttatattctattttatggtccattcttctattgtttaacgtgagcacatactctgatccctctccattcttagaaacagtattacactagacacacttttattcattttgcttttttcacgtaactgtatatcttagcattcattgcatcatgttttctcaaacacacaagtgagaaaaaggtgagtaggcacatgtgtgtaacatttagaaattagatgtatatttttggtttgtttttgtttttattttttgagacaaggtctccactctgtcacccaggctagagtgcagtactgcacctgggctcaagagaccctcccacctcagcctcctgagtagctgggactataggcatgccccatcatgcccagctaattttttttcttttttagagatagggtcttgccatgttgcccaggctggcctcaaactcctggactcaggcagtccgcccacctcagcctcccaaagtactgggcttatagacatgagccactgcacctgacctggaagacatacatttttattctagtggttgtcattagatcaatgcctttgtataatagcttagtccacccacccacccaccacacctgcccaccttttgttccctggctattgtctattggtctccttctatgaacattattgaaattagctaagtaataacctcttagctctctttgctctctccttgaacacttgacttgaactagtttctttctactgccagttagtattaatacctataaggcaagcagctacctaactctgttcttcatacagccagtacgagtgctacctgtctcccagatagcatcagagtcatagttaataccggtaaaaatgtgcttgatcctcaccactctacttcggtggctcccacgctggccattatggctgtccgcagcttgttttcttgtagattcccaggatgaggaatctcccacttcttgtgaggacctgtaggcaattccagggttcttctggtctccaagtcatcagaagccctttttccttgcctccatttccttccacatggatactgttggtatgaatcatattctggcattcatgggaatagctcaccacttatttttgctggtgatgttgtccatggggttttggctttaatatctgagttgctttctctcttttttatgggagaactcaaggagatccaaaaatgattttgccaactttccataatcctccagtggctgcagaatttatcaaaaagttttgactgaagaattatttataaatattcaatatctcttgtggtcatgtagcactttaatttgactaattaaacttgaattaatcctgaagtcctggcagacaaatacaaacaaatggtaattttcacaagcttaggtaaaattctctcttttaatgaagaagaatcaatcatctattatggaaatataaaactttgttgtcctgctgaaagcaaaacttttttccccttgaaagtgaatagcaggccactttttacgatacatatgtaatttgctatatacattgtaaacgttgaaaattttatacttatggacatcaaagaaagcctaatttttaaaaagtacctatttataaggtagtctggatatatttgatctattgaagttattgttttgccagtataattttcacactatgtgttcttccatgattaatatatgtgagtatataatgcttcacaaatagtagactcacaaatacttcagaaaatagtagactcacagaaaaggtcttctttcgagggtgaagaggctcaaagaggtgtagtattttcccagagttacacagccagtagatagcagagcccagagtcaaatacagaagccaagtgggacaatggactgggaaccattgtagtagaccacatgaaaaccataacgcaatattttcaacagaagaagggattctaaccattaccattggagaggaacacttacacttttcatttgtttaaaaggtaggaatgtggccaggcacggtggctcacgcctgtaatcctagcactttgggaggccaaggcgggtggatatcctgagctcaggagttcgagaccagcctgggcaacatggcaaaaccccatctctactaaaaatacagaaattagccaggcattgtggctcacgcctgtaatcccagctactccggaggctgaggcacgagaattgcttgaacccaggaggtggaagttgcagtgagccaagatcacagcactgcactccagcctggacgacaaagtgaggctgtctcaaaaaaaaaaaaaaaaaaaaaaaaaaggtagtaaggagagaagggggaaggaggaagtagtcgaaaggcttatacactctaagcattgcaatttaatatattttaaattttttcttccaagttttataagccataattcacagaggcaccagggtggtatctgcccacctctagattgaaaaagaaatgaggaatcaaggctattttaggcatctgtcaagctgtaattacctctttgctcagagaaacctttatgtaagactaatgtagattggcatttcttctgtttaaaagaacatttccagtcattcttttaatagaaggatccctattatgatggttatttcaatatgttttggtagagggaatatgttcccagtatggccttgacatagaaattacacttttaatctggtctgtttcttatttacttacaagcttcaatacttcttagagtcttctttccctaccctttctagttcagaaattgttgaatggcttttatttaagcttttcaagtaagctgggtttgtttaccaataagtctatgtataccttccactaaaagtttacccaaagtatgaccattaaaaggtgggattgagccaggcatggtggcgtgcacctgtaatcctagctgcttggggaggctgaggtgggaggatcacttgagcccagcaattcaaggccagattgggcaacatagtgagaccctatctctaattttttttaaagaggtgggattgaaatgacaatttatagaaagaaaacaaatttttcatcattaggcacttgttcattgtcttaggttggactcccagaaactgaccctgaaatgaagatccatatgtaagtgacttaatagggagagttctcaggaaagataaatagagggatggggagtgggacctggaagaaaaggagggcaaacatagatgcagtatcaggcaaagccccaggagggtgactttggctcagtgcacagggaagctccagatactttttaagaccacaccttaagttgtcctatcagaggcagagggatagagtgtttatagtcgccagttaagaactgcctcctgggctcacgttccccctcccctccatgctctcaggcagtttagactcagtaggctgagggtatttcaaagagccaagtccaggtgctggatgctgagaatgaaagcacccagcatcaactgttgactgcctctggtggtttacttttcttgcttctatcagcacatcctggagttcccaaggatatcttaagcagacaagggtgtgtaagaagttcaagttctgttgtgttttctagaaacttaccaaatccaaaattggagaccacctatacgtaagtccagtgtttttttctagcccaacattccacatttattaatgattatctctagagaaaggacttggcagtgaattaatttaactagaaaaagatcattgctgtaaaggaaaactatgcttttctaatatttaactcggattataaatatgcaaccaaagtagccagaatgttctgactagggtgatggatcaccagccactgaaatgccatttcaaagaatggatggtgttttaaagaaattatcctattcattaagactgtatctatgcagaggagaaccaagtgcaatgaaaatgtttgcgtcccaggcacttccttgggtgcttggcatatttaatcattacatgagtcctctaaggcaagtaagtattatttttcctgttttagaagtgaagaaactaaagttcatagaggaaaaaaaaaagtatacatttaataagcatttagtaggcatccgctgtgtgttaggcatgatgcaaggcactgattatgggatggcaaacaaaatggacctggtcccttccctccttgagcacacagcctagtgagcaagaggtgaaacaagcaaatacataggttataaatggtggtaagaaaggaaaggaaaagaacaggacactgtaaagcataatgatggcataggagtagaagattcagtagaagattctcattgtctcctcaatgagaaagtgacatttaggttgagacccggacgatgggaaaagctaaccaggcaaagagcgggaggagagaaagagcttagagtgctttggggagtgaaacaagagtgatattgcagttcctggccagccaaggggaaagaggtgtgaaaagactagagatagaagcaggagcaaggtgattgagggtcttctagagtagcagttggcaaattttggcccacaggccaaatctggcctactacctgtttgtgtaaatcaagttttattgaaatatagccaccactgggcatggtggatcatacctgtaatcccaaaactttggaaggccaacgtgggtggattacttgagcccaggaatttgagaccagcctgggtaagatggggaaaccccatctctacaaaaaatacaaaaaattagcagcgtgttgtggtatgtgcctttagtcccagttgcttggtaggctgaagtaggagaatcacctgagctccagaagtctaggctgcattgagctgtggtagtgccatttaactctggcctgagtgacagagtgagaccctgtctcaaaaaaaggaaaaagtaagaaaaaagaaacacacattacctgtggctgcttttgctctatgactatagagtagagtagttgcagccaactatctggtccacaaagcctatttactatctagctctttacagaaaaagtgtgctgactcctggtctacaccatgaaaagaagtctggattttactctaagaaagagaaggagccattggagggttttaggaagtagattcaaataattcagtttttttttttttgagatggaatctcactctgttgcccaggctggagtgcagtggtgtgatcttggctcacagcaaactctgcctcctgggttccagcgatcctcctgcctcagcctcctgagtagctgagatcatacctggctaatttttttgtatttttagtagaaactgggttcactacgttggccagtctggtctcaaactcctgacctcaagtgagccacctgcctcgccctcccaaagtgccaggattacaggcgtgaggcaccgtgcctggcaaataattcaatttatattttaaaaatatcaccctggccgtgctacatggaaaatggaatctaggagacaagagtggcagtaagaagccattagaagtttttgaaagagtccagataggaaataatagctagaggactggacagagcagtggttctggtgttagagaaaagctatgtgtagaggaaggatcagtaggatttagcattgtatttgatgtggagattgaaacagggagaaatgaagtataactcccaaatttgtagcttgagccctgggtggatgacagtgccagtcaatgagatgagtcaactggaagtagcggaaataacgtaggtgagtaaataagtttaagttcctcagagttctccattattaaatcttaggacctgcattggagaccaagtcttcatgcttttccagtaaacagcatggtctcccattggaatcatcacatgagtttactgtcaattgacacaaaaccaccaacactaaattttttcactgccaataagaccacaaagaaatggtcaaagtgatctgttttaggtagatgtgcttgtaattttgtagccttgtctttacattttacagactttatatataatttgtaatatgcataagcatgagctaattttgagctcatcttttttttttcttttttctttgagacagggtctcactccgacatccaggctggagtgcagtgacatgatctcagctcactgcaacctccaactcctgagctgaagtgatcctcccacctcagcctcctgagtaggtgggactacagtcatgtgccaccacacctggctaatttttttttatttttagtggagacagggtttcactgtattgcccaggctaggagctcatctttaaaataaaaaatatttcagaccattgattaaaatctttcacagttaattaaatatgtatctgcattggctatgcagagagcatctttagggacatacaatatagggcttcaaatagttgggctcttgtcaccgtagcattcattttgtctcgggcagctgtgaggcacccactcagcaacatttctgaggtcctaattgaaaatgaggagattctagaactgtgcttaaccctaaacttggaagggagtgtctctgaagcaagacctcacatgtctgtggttcaccttcccatctaggtagctaagagggcagaaaaaggcttctctgaatagccccactactctgcccaggctgaatggaatgtcaagctctaggccaccccaacacaagtctccttaagcagcagacccagcccaggttggaatctggcataacttggaagctgaaagatgacctaactagccacatttcaaattcaagctgaaagtaccactcacatttaatcagtttctggagatctatatggaagccttttatttccacttctttaaatgaacagcagttcatttacctggagaaactgcatgtgaataacagcaaagcaagtcgagagtgagttattaactatgcaaactgactacttaacctgttcttttcagacttcccctaacagttttattgaggatatgcttaaaaacatatttagatgatacattgcatgagtttcaaagagaccattaaggtctcatttgggcagagaaaaatgaatttttaaaggaaccattaatgtgtgtttttataattgtgtcttatggtatttttaatattgctaccatttatcaaatatgaaaaataagactttacaatattatcaaaataatattcatacggtagtagtctcatacccattaaatattatctgctaatcctttaccattgttcctaacatattatgattcattcagatctcattagattttatttcatactgcttttcatgcatagtatctcatactatgcatcaggtagtttttaacactctcactctttttttttttttttttttttttttgagatggagtctcactctcgttgcctaggctggagtgtaatggcacaatctcagctcaccacaaccttcacctcccgggttcaagtgattctcctgcctcagcctcccgagtagctgggattggaggcatgcaccaccacgcccgactaattttgtatttttagtagagacagggtttctccatgttggtcaggctagtctcgagcttccgacctcaggtgatctgcccacctcagcctcccaaagtgctgggattacaggcgtgagccaccgcacctggccaaaactctcactctttaatgcaatttttatttgccttttcttatccccttacctccctataggacatttttcctctcttacctagttgaaaattaatcttcctcggacattaaggaaactcaagaaaaaaatacttagtttaagaaacaaaaatttgctcatatttgtaaatagattttcgcatgcattttggtttgcacccttttcaattctgaaactctgaactctagttttggacatgagattaagcttccatttgatggcaggagtgaaaaatacaggaacattaaaaacggaaatcacgatctccaccaaccctgttcttcatagccttgagagtagaaagagtaaaaggcaaagatagtgttaaactccaatctgttattattttagaggatagataaggaattagtctaagctatgttctcaggttctgtaggaaggaagcttttccactaattctgtttttcttgcttttcctttgtttctaaccccaatggatacatacttttgaaaagtaatctttatataatgtttcatgtagtaattgaatagcttgtatgagtgaaacatttttcttttttatatagccagcccaaatgcagactgtaagtcctattaatataaaacagaaaggtctcaaaattcagttgcagggttagtgtgccccaagttcatcttcaaagcagtatttcccaatagacaggaaaatgagatttctctctgctttgccatggataaagtatcactattgatcaatttataaataatttttctaggttgaggctaaattcaaacatgggaggcacacttcagaaatttagtataaatcccctaacctctttccctcagagaaaattttatcatggttcactgaaaatctgtcaactttcagagaggattggaacattgctaggttttctgagatttgaggtgccatttcaaaatagctgtgtttgaactatgtacctatcgttccttaacctaatttttacctgcagtaagaaggtatattccatcctgtagctgtttataaacagtctctgcaaacattgtcttcgaattgaagcttcttcggggatatcatctctattccttgccaacattaaaaatagtatttctctgtttacatttgtctcctcttcccttctatgtatacgaaagttaccaactggaaaaatagtttatggtctttaccattgccttattgttaatattcaaatacatgttcaatcctggtaaagctctatattgttccaattctgatacatctaaattgggaggtagtggctatgaccactaacccctaggaacaactgggagccccagctccttctggctccaggataacgttatacataggctccccttagttaatttcacctgaatctctcacctttttattcttgaaccgctcaaaatgtgaggcctcaggacacagatttcctctggcacctgcttctctgtgacacctggttcttccttctccatgacttaacacgttccctatgactaattgatcttagttttggttccttcacaagccaactctgacacaaggatttgtgtgtgtatagataatctagggcgtgatcccaggaaacaccagccagagactagagatgtgagaccaaaaaggaagacaaccaataaaatgtaagttatcaaaccaattgccactgtgggcaactggagcttcatcctcttggggagttccaggatcagtgtagaaaacatgccttggagttattcagttgagtggtgagggagtggaggtatttatactctaattcttgtcaggtattgaatgaggactcctctgtggggtcattccccagaacttccagctgattatgtgtggtcagggtggactttagcagccagagagagcccccaggcaggtggaaatgaagaagcctcctcaattgtctgctgtaactcctaactaaccatttctactgcaccccttgaacactcactctattgcaaatgtaatggccttaacaattaacctctttttaccattttctgagcccttgcccttctcttgtgaccacgttgaaaggaggcttagtccttctcgtgccacttaaatcacagggtaaagaggtagtattggcattctcctggcttctcatgattaatttataagtcattattctctcaacctagtgcaaaacttgctcctttttttactagttatgccctccaacaatatgacttcagactttctctgaatttcatgccattccttacatatactgaagactttgacaccttccaagaatcctaccacactctggataaaaatcagcattcaaatatccacatggatgaaattaccttcttagtttttctatctcctcaactccaagtgccttcttgaccattccctttcagccaagcactcctgatctccacatccccaacctttttgacacccataactgaacctcctctgacaccataaattcccaatatcccaactttgtaattattctattactaaagagtgattctcactagaattattctcatcaatgctgtctttcccaactctttccagtcttccttcgtagacttctctcacccaaaagccactcaccactcatcttgtgtcctaattatacttgctggtatacttttctctaagcagaccccatgcatccctgcctgtagtcctcttttcacctacactgcccctggaaactgcattcctttcaagtgcttacccgttcatcaagatccaactcaaacacagctttttcagtggttctccaccactttccctcctatatctcgcatgttggagtcactctcttcttgttctgtatttccaagatatctatctgtagtcgctctgctttgcaactgtcaaattctgccctgccaggtgaagtgggtaaattacttggcctttcaatgcctcagtgtaatcaactaccaaatagagaaagtgatagttacctgtcaacgttattgtggagattaaaagaaacaatatgtgaacatgcttcagaacccaaagatgaacacaacatgtatctttattgggcagctgtaaggaacaaatagagaaaagcaaaacctttttatgggaactttgaatactgataatgactttaccatggatagaaggaaaggacattggtgcacatagcctgggttgtattcctggctccacttcaaatgagctgcatggccttgaacaagatgcttactcgcattggagaaagcccatttcctcatgtaaaaagtggaaataatgaaacctaccttgaagagttactgatgactaatgcatggaagcagacagagctctgataacttgaactgaaatggctcccgatattcccttatcatctctcacccaggccagtaaggttggggcacacaccccaggcaagaggcagtattacgtgacctaacaaggtctgagtgagggagtgactgtcagccccataagacgggattccatcctgggaggctgcactgctgacttggacaagtgtcaagatcctgctttaggaatgataggctcagacagaagctctgagtacatgcagcgtgcgtggggacagagagaggagcagttctttatgtgcccttaaagtgagccaactccatgtctgggctagcctctcctctgtgtcttctagaatgctttccctcatggctctagggacaagaattagtaattactgattactaataatttttaatgattgaataacaacagcagacaccaccatttatgaagatatgattcagggctgtgtatgtcacatctctcatatgctatctgcctactttatccttcccctcctgacccacattctaccccagagttgaacctgcaactcggtctgcagcaaggactatcctaggagtggataaatctggtaaatgagaagatatgaggatttcttctggcacctggattcaaagtattttaatttctggagcctgtgtatcttcatctctaagtgggaataataatacctaagtcctaacatactcggaagagttcttgagaaatattgagtgtgaagtactttacacggtgcttagcatacagtagacgtgaagtaaatgattgcttatactggcgattcttctgacaatgtcctggttgccccccatagatcctgaccatcccttgttcctctctgtattgaaaccttgtgcagagcagtcttctgatgaaaatggcccaagccatgtgaccccaggtacccaagcaacctgtttatctcttctcccaatttgttctctctcttctttaaggaaaggccatcttttcacccatctgcccctgcagagctgtttgtggatgttgaagggttgccatggacaccagtaggcctggaggcacgtgggtgaatctgggaagacttcaaaggggtgatctctggacagtgttctgaggaaagagattgaggtgccatttgttgaagaaaaggtagcaggaagttctagatcaatgacattgcacaaaacacgggaagtgatatacgggactcaacttgaagggtaagcgccttgggtctctagaggaaacccatgtaattttaggtccagttcagtttctacatcttctggatgcaaacagacagcaggagagtgtgaggggctccccacacttacttctagccacctgaggcatcctctgttctgctaccagagtctcaggtcattccatagaatggtggccccagacaggcagggatttttttctgttttcttcatcggtctatccacaaagtctagaacagtcttcgttgcatagtaggcacttgtcaaatatctgtttaatgaattccaacggtctttaaagttgaagtgtaggtgaagataagaggaggtgagtggagagctactggaggtgtttcctactgggggaaaatgattaggaaatcttacttgaatctgagctgcatttggaaatcatcatagtatttggagaagggaagtgatgtgatgaacattaatacctcagtaagatgggtcagctttcttccaaatagaccagaagagaggagacaggaggcacttcacttcttgctaaaaagttattttccccaaatacggttattgaatgaataaatttgaaaaacaatttatatatctgttgtcattgaaagccatatgcttcttatctcatctcacctgacaaagtcgaacataaccatggagtggaagataggaatttaacttctctcactataaattgcagcaagttgacattcagcctggccttctgaaatgctcagtttaaaataacagttgcaggtacccgcctttgcaggctaactcccttagagcatgcagtatcagtgtttgcccttgggaccagacatttgcagttgcctggggaaagtaatctctgtgtgtgctaaaaacacagaacacaatgatggaaatgataccaaaaagtatgccaacaagatggacatgattctcttagcaaaatgcttataaaatctagatgcttcacggacaagggcgcaagcagaaaacatcctcgcaaatgctccacatcctacgtagctgcatgtctaggcagaagtttattgaagcaaatgtaatggccaagaagtactttaaatgagctatttcttgcatccttgaattattttctctccctttcctccctcaatccctgctctcatccacccactaggattttttttttttttttttggcaatcttcaaggaaaaataataaaaagaactggaatttacataataccttccttccaagatactaaaagcagttcacccatctataatttgtccttacaacaatcctttgtacaggcctgttattattattattaacattattattatttcaattttgcagtcacattgcttgctgctgagaattttagctaacacctcatttcttgaacaattttagcccctcagcatatgtataaaaaaggcttcaactgccacctcccatttgtgattgtgccatgtattacattacagtctctggccctctgtttaattttcatttaaaaatatattaaattcctttattgtgagagcactgccggactgctgaacagaaggtgaagtgagcgttgaaagagaacagaatcaaacataaatatcttccaaactaaaagggaaatggaaagtaactgtcaaggcaaattgatttgaattgcataagaatgtgatttttttaaaaattgactcagaatatgaactattctttctaacagcttcaacttggcagatgacactacctgtctcttcctaatctcttgcagtctttcaaattccaaatttgtattgggttcaaaatttttcacatctcaaaaatgttcccagttcactgaattcctttagttatctcacatttcccatatgaacagggcctcccatgggaatgaccctgaaaaggcatgagccatttgccaatggtctttcttaattgccccagcaatcattttcttccatggccctctacctaatttatttttaacataaacaggtttcattcagcagaccagatgttgaatcctccccgtcttcttctcttactcatttacagtgttacatgaaaattccattcttctctctatataatagctgccctgctattagatagggctgtatcagtcagctgttgcttcataacaaataatcaagatctcagtagcttactgaatactttcttttttgcactgtggtaaaatgtatacaacacacaattttccattttaataattttaaatgtataattcagtgccactaattatattcacaatattgtgcaaccatcaccgttatctattttcaaaacttttttagtgctccaaacagaaactctgtacccattaagcaataactccccatttccccttctccaagcccccagtaacctctaatctactttctgactctgtgaatctgccagtcctagatttttcatacaagtagatttaatattttgatatttttccttctgtgtctggaaataagtgtttctttctcatgcatctgcaaactggatggggaagctctggtgatcttggctgggcttgcctggaaactacagattagtttcaaatctatttcgtatgtctctcctcctccttggaccagaaggctgcacaaggcaatacagagcaggagagagcaagcaggaacaggtggcaaggcctctgaaagattaggctctgaactggtacaccgtcactttcacggttcttccattggccaaagcaagtcattgaccaagcccaaagtctaaagtcaggcaagtaaacttcagctctagtgggagaatgcaaagctacatgaaagtgcatggatacagggaaggttaaagagctggggccatatcctacatggttaaaatgtaagttctgcagttgaatggaccctcctctaccacttttcagccacgcagctttatgaaaagggatttaatctttctgagccttgtttcctcatcagtaaaatggggataataatattacctatctcacaggctgctgtgattactattgaaatgctctaaatttgcagtaaaaaaaatgcgagcaatattattgtcattcttaaaacgtaaagaatagaaaaagcaaccaaagccaatagaacctttttatctttgcttttcactgaggaaaggaagttttaggttagaagaggatgctggaaaccatggaagttcagaaagggaattagaattacaaactaagacctattggtacttgaagaaccagtagcaatcattttgtctatttgttttcatattttcttttagtaatgtcactttttttgacataaacctagcctatgatctcagtgcataaagcagtagaggggttctggttgaaaagacaggggtattcagggctctgcccactggcaagagtccctgtctcagaagggttgcatggagcacaatttgaaaaccgctaatcaatcaatcaatcaatcaatcaatctgcaaccttagagactgacttttaaatcagaacctttcaattgttactgtcctctactacatattctgtatctatctgtaatcatataaaataactatgacttactaaaaaaaaaaaaaaaagaaaaccactaatttttgtttgtttgtttgtttttgagacagagtttcgctcttgttgcccaggctggggtgcaatggcacgatctcggctcacagcaacccccacctcccggattcaagcgattcccctgcctcagcctcccaagtagctgggattacaggcatgtgccaccatgcccagctaattttgtatttttagtagagacaggttttcaccatgttggtcaggctggtctcaaactcctcagtcacctcaggtgatttgcccacctcggcctcccaaagtgctggcattacaggcgtgagccaccgtgcccagccaaaaaccattaatttaatccaagcttcctcttcttccagatgaaaaaaaaatgaaacccacttgtgtaatgtgatttgcccccaaaatcacatacctaattgatgccagatctaaaaggagagtaaaacctctctttctaactcccttgcccataccatgctggcttctgtgaactttcaaaggccttgttggtaacagcaacctcttcggcctaattttatctcctctcttctttttcaatttgtccctcattcagatatatcacacttataggtaggtagtgctcatatattagccatgattctgcccatctgaagaatgcaaatgtgttactggtgaaagaaatgcccatctccatcagcaaaaaaggggaagaaggaaatgaaaaagtatatacagtagacatgtgatacaagaaatatgtgaatatgtatattcattctcctataaatgtactgatatatgtatatatatacacactcatacatacacaccattttgtgaatctgacacataatagagagtcatgagatggaagtcaaagttctaccatgtaatagctgtagggctttagacaaattattcagcatccctgagttcggcatcctctaggtaaaatgaggctaagaatcactgcttcccagggatgttacaagcatgaatacgtatgagaaacagaagtttaccaccttgggagtgttaccaggactgccaaaatgccaccctggtactttctaagttctgtgcttctagacccatttctgaattctacagaacaacttataaatacacaggctttggagtcagaaaagcacagatccatgtgctgattctgccagttactgaaatgtgaactgagaacattgaattgatctatttgatctcggttttctcatttccaaataagaatgacattaccttctttactggaatatcaggaagcttgaatcacacaagtaatttgtgtagtacactgtatggcacatggtaaacattcagaacacattaactcttaatcttgttcttatattgtgattgttactgttcttcaaagtttcccctagttttctacccactcaggcacagggaaatacatttggggaaatattgaaatagcagtactttgaatctttagaaatcagattgttttaaaaaatataatattttctttattttagggagaaactattaaaatcttttttcccctagagaatgactgctgtgacgattgttcagtgtggtttcatgtccctgaacaccatctctatccctgtgtgtgtgttccaacaatttaattcagctggcagaactgtccccctttagaataaggtagagattatgctaacattttagacgaggatcctcttgttggtttttggaaaagtacctccacatgagcatctctagatgggcagcattgtccaacatatcatgctgccatgatacagtatggtagcctctagttacatgtggctattaagcacttaaaatgttgctagtgcaactgaaggactggatttaattttattatgtttagtgaacttaaatttaaacagccacaggtctggagacttctctgcatgttctgggccaatgagaatgctgtttgaaattttgatatttaacttatcaaagaacacatccttgaagataaagacaaacaaaaagacaatggaaagaaagctttcatcctggaagcatgtcaaagcagcccaaaatgaatgagatgaaacgaattacccctttcctttcccaaatcttcatgatgattatggactattactaactgctcaccaggactttgggagtcccaataattttcatacagtttgtgctacttagtttgagtgagttgaatgtggcatgcttacaccttcttagtatccctcgctcaactgacaaagctttaactactttttacattactgtaagacattcttctccaactcctcctttgtgaaacataaatggattgcttattcaacatggtgtctttcagtcataatggcatttatctccacatccactcaagaatatgtgtttagatgacagcatgtattgatggactgcaacttattccagttgctgacagagtagaaggaactcagtcagacactaagaagagtaaaaaagtaaggtaaaggaagactaattgagttcatagagttagagatgcacatgtaataggattgtcaatgaatgataaagccaaataaaacagagtcattggttgaacacatgtataccctttgacctaccaattccactcctaagtatacaccaaacagaaatagatacacatttaatatattcaccaaaagacatatgcaagactgttaatacatagcagcactattatttaacagccccaaattggactactcaaatggccatcaatggtagaattgataaatgaatagtggttcagctacacaatggctactacacatcaatgagaataaatgatctacgactacacatcacaatttggatgaatctcaaaaacaattctgagtgaaagaagaaagaaacaaatcattgttactttacaattgtattcatataatgttgcaaatgaggtcatactgttctatggtattaaaaatcggaactgtggttatcctcaggaagtatatttggaaaggagcatgggggcttctgggatattggtaatgttttgatttcttatttggaccctgattacaattatctattggtacataacaaattacctcagccaggcacagtggttcacacctgtaattccagcactttgggaggccgaggcaggcagatcacctgaggctgggagcgagaccagcctgaccaacatggagaaaccccatctctactaaaaatacaaaattagccaggtgtggtggcgtgtgcctgtaatcccagctatttgggaggctgaggcaggagaatcgcttgaactcgggaggcggaggttgtggtgagccaagattgcatcattgcactccagcctgggcaacaagaacaaaactccttctaaaaaaaaaaaaaacaaaaacctcaaaacttaggagcttaaatcaacaacattattatctcacctttcctgtggatcaggaaactgtgtacagcttagctgggtgcctctggctcaaggtgtcccacaggggtgcaatcaagttattgtctggggctgtggtctcatctgaggctcaactgaaaaggaatctgcttccaaggtcactcatgtgtttctttgcaggattcagtttctcacaggctcttggactgagggcctcagtttcttaacaacttttggccgggacctcccttggttctttgctgtgtgggcctctccaaagggcagcttatgtggtatttggtttcctttggagcaagtgagcaagagtgtgagagagagtgagcccacagtatggaagccatagttttggggttttttttaacctaaccttggatatcacattctctcacttctgccatatttcgtttattagaaatgaatcagtaaatccagcccacatgcaaaggaagggaattatacacagtctgagcatcagaaagtgcagatccctggggatcatcttagtggctgcctactgcatgtgtgttcagtgtgtaaatttcaatgagctgtacactcaaggcatgtacttttctgtatattcattatacttaaaaagtgtgattgaataattaattaacagaatctctggatctcacaaaagaggcctttggccttcagatagactttactaaactgcaggttcttaaatttaagtctagcctccggaaacagaagccttttttctaactggtttctgccaaactgggcttactacaacatcactaggtctttgctcttctatcctgtacattatcacagtacacatagctgtagctgccactgcctctgaaaacccatgaaccctgaaagacagaggagttctttccagttggacaagcatggggcctggtgcttcttgtgtcatagaaaggaaaagtggctcggtcatgatgaggtcaagacctgggcttcctgtggcaaaccccacagtcaaattcagtcagagcaggaaaacctctgagatggtgaagaatggtaattgtattatttaaagtcagcctctagtactgacacacatttaaaatggaaaaaaacatgaagattccttgggcaagcatcagaacaattgctgtgggccaaaattcataaatatgctatacactgtccctgattttagggttggcctgtttctagtcactgtttatctttactcttacggaaatgtccccaggactgtggacatgcatagaggcaggaaagaagggaataaatgaaggaagtcttatcctaggtgatgagaataaaatagtgatcctgaaaaggcttgagaaatgttaataaaggagctgccagttaaaacacactctgttatttctcactataaaagaagccgttggcttcttctcaataaccaccctgtcatttgttctaaaccatggctggatggcccatcaacagagcacacaacctggtggcctgcttttgcttaatgtctgttttgttcatccatggcaaagtgtttaagaaaaacatccaccccaacttttttttttttagtactttttgtgctttcagtttactatgtcagttttttccaatggtatttacaagaagcgctcttaagaaccgaagttcatttagagagccattaaaaagtctgctactcaatgagttcatgactattgataacagccacctactgcctgcattgctgccttagcccttaactgggcccacacttccaccttgccctcctgcaatccattctcagcttagtggccggagtgacctttttaaaacatgtattttgtcattcctctgctccaaactcacaggtaaagccagacttttgcaatggcccatcaggccccaaatgatctgggccctggccctctctctgatctttctccctagaatccctccctactctgttgaagggtcgctgagctcctggctctaactcaaacttccctggcaggttccaccttagggcctttgcctgtagccccctgtgcccaggaggttcttccccttgacagcttcatagccaactaccttacttcctactcattgttgctaacttgtcacctcttaatgacatttaacttgtctaccctattcaaaatggcatggtggcctacctcccaacactcacaaatgtccatgtcatcttcagcatgctgcattatacatatggtggtatttgttatttattttttattgaatgtcttccctctttagacggtaagctctgccaggttaggtgttttattgactgttttatttattgatgtagctcaggattcctcaatctcagcactattgacattttgtgctgagtaattctttgttgtgggggctgtcatgtgtgttgtaggatgttttgcagcaactatgggttctacccattagcacttctcctaactgtgacacccataaatgtcttcagacattgccaaatatcccctatggggtaaaatcactctccactgaggatcactgatatatcccaaatgcctggccccaggtagatactcaataaatatttgctgaaggaatgaatgcagggagagctagacagcatcacagaagtgtgcaaaataatttaactattacctcatgaaaagctgctgccttttatacattttaaatagaagcactattttcatccattagtcaaataagcatttcaaaggccagagacaatattcattcagcaaaaaatgaattaaatggacaaaaattaggtcaaaccaaaaccagatacatatgcaaattaactctcttagcagtagtttccaaattcaaagtgccaaacctgaaattttattgcaaaggtttacaaaatacaataaaataaagagtttgaaatgatgcaatttcatcaaaatgttaattctgatcaccactgtatcaatgatgtagattttaaccataatagcctaatattaatcttcttcacaaagaaaatcacagcctaagccttaaatgcattcagtaaaatgtgaattagactttgcaaagatttctgatttctccctaggtttaaaattcaagtcgttggttatatgtaagcgagttaattctaagcctaaaattacaatgtactttaatcctttctctgcaattcaaatatttacttgacaatgccataccaattgtgccctccaaattattccttgtagtgaagcatttttagtccaagacacttgattgggtctgcttctcctctaagtttgtttttttcccctctaccccattctccacaagtccataattaatgttacaattggcaaatcccactctgagcagtaagaaaatctttttccacacttcaacatacgtttgtataagacaatttttttggtttgttttaatggaggtcacaaatacagtatactaagggagtcattggcttggacattttatcttccttgataagggagacatgttgaatttcaaaactgtttgactgttttaaataactgtttctttaaaaacatagttttcaaattctttttgggaagatgatgttctagttatctattgcagcctaacaaacgtaatggcttaatgtaataattaatataaataattggttatctctcatggttctgtaggttgactgaactcatccagatggttctcactggggtctgtcttgtggctgcagttcaatggcagctgcggctggagccatctgaaggcttgattgaggagatatccaagatggcttcttttgtcatatgttgttgcctggacttggacagctgccatagtgaaagctggccaggcatctctccctctctccacactacttctccacatggatggcttctatatgacatggtggtcacagggttgttggacttctaacatggtatccggctttcctcaaagtgagcattccaagatatccatgtggactttataaggcttctaggattattctgaccaaggcccagaagtcatacaaagctatctctatctctacaatattctgttaaaagtgagtcacaagattagtccagattcaaggggaggagactagacagaatgtgaatattagaaggtgtgttacttgaaggtcatctttagatccctagtatcacagacaaaaaaagataagcaatacaattatccagtttttaaggatgaagtctttaatacattgcttaataaggatcttttcttaaattctctttattttccctttggcttaaactggtagtctttttgatcagcagtgtaacgtctcactcaagggtgaaaatggtagtaggagaaacaatatctatagaattggtagaagccaagtccaatgctactgggcaagtggactctttaattcatctcctctatgtttctgttaccctaatgactatggtggcttcattatgcccattttcttccatagcattccctgaacatgacttagaaatgacaaatagtcccattcctcttctttgcaggtaccagggtggaagcaagcttcagcggcaatgagcagagtgtaaatgcttcatatagtccatgacagattacacttaactgtaatatgttgaccttttctgaatgcttggtcatttgctggacatttccactctctccagctaatggcttcagtgcctgttaggaattgattcagtggataattataatctctcttcagagtgttgcaaaggtcaacgagataaagcaataaacccccatttcaagtgcagtcctgtggcgacttttctgaaaatgaagggcaacacttcttccttcatctttgccagcaattgactaggctgacgctacgttatggcttgttatcaaatctgaaaaatctcagtgttcttttcacatctccaggtttaggtgggaagagaaaataaaaagcaagcaagtggcttcatcacaaaataccctaggattggggaaacgcccttctgagcaaagatcatcggagaaacactgttaatcagttcttattttcatgaatagtgactgtccaccagcagcgagtttaagggctgagactcactagcttgcagaaaacaattatttttttttttagttttcttttttaatatttttattatactgtaagttctggagtacatgtgcagaatgtgcaggtttgttacataggtatacacgtgccatggtggtttgctgcacccatcaacccatcgcctatattaggtatttctcctaatgctatccctcccctagccccccaccccccgacagggcccggtgtgtgatgttctcctccctgtgtccatgtgttctcattgttcaactcccacttatgaatgagaacatgaggtgtttggttttctgttcctgtgttagtttgctgagaatgattgtttccagcttcatccatgtccctgcaaaggacctgaactcatccttttttatggctgcatagtattccttggtgtatatgtgccacgttttctttatccagtctatcattgatgggcatttgggttggttccaagcctttgcaattgtgaacagtgccgcaataaacatatgtgtggatgtgtctttatagtagaatgatttataatcctttgggtatacacccagtaatgggatggctgggtcaaatggtatttctggttccatatccttgaggaattgccacactgtcttccacaatggttgaactaatttacactcccaccaacagtgtaaaagcatgcctatttctccacatcctctccagcatctgttatttcctgactctttaatgatcgccattttaactggtgtgagatggtatctcattgtggttttaatttgcatttctctaatgaccagtgatgataaactttttttcatatgtttgttggcggcataaatgtcttcttttgagaagtttctgttcatatccttcgcccattttttgatagggttgtttggttttgtcttgtcaatctgtttaagttccttatagattctggatattagcgctttgtcagatgcatagattgcaagaattttcttccactatgtaggttgcctgttcactctgatgatagtttcttttgctgtgcagaagctctttagtttaatcccatttgtcaattttggcttctgttgccattgctttttgtgttttagccatgcagtctttccccatgcctatgtcctgaatggtgcctggtttgcctctagggtttttatggttttaggtctaacatttaagtctttaatgcatcttgagttaatttttgtataaggtgtaaggaaggggtatagtttcagttttttgcatatggctagccaattttcccaacaccatgtattaaatagggaatcctttccccattgcttgtttttgtccggtttgtcagagatcagatggttgtagatgtgtggcactatttatgaagcatctgttctgttccattggtctatatatccgttttggtaccagtaccatgctgttttgctgttctggttactgtagccttgtagtatagtttgaagtcaggtagcatgacgcctccagctttgctctttttgcttaggattgtcttggctatatgggctcttttttggttccatatgaaatttaaagtagtttgttctaattctgtgaagaaagtcaatggtaacctgatggagatagcatggaatctataaattacttttgacagtatggccattttcatggcattgactcttcctatccatgagcatggaatgtttttccatttgtttgtgccctctcttatttccttgagcagtggtttgtagttctccttgaagaggtccttcacatcccttgtaagttgtattcctaggtattttattctctttgtagcaattgtgaatgggagttcactcatgatttggctctctgtttgtctattattggtgtataggaatgcttgtgatctttgcacattgattttgtttcctgagactttgctgaagttgcttttcagcctaagacgcttttgggctgagacaatggagttttctaaatatacatttatgtcatctgcaatcagagacaatttgacttcctctcttcctatttgaatacccgttatttctttctcttgcctgattgccctggcccagaacttccaacactatgttgaatagcagtggtgagaaaggacatccttgtcttgtgccggtttttaaagggaatgcttcagcttttgcccattcagtatgatactggctgtggttttttcataaatagctcttattattttgagatacattccatcaatacctagtttattgagagtttttagcatgaagaggtgttgagttttattgaaggccttttctgcatgtattgagataatcatgtggtttttgtcattggctatgtttatatgatggattacatttattgatttgcatacgttgaaccagccttgcatcccagggatgaagccgacttgatcatggtggataagctttttgatgtgctgctggatttggtttgctagtattttattgaggattttcgcattgatgttcatcagggatattggcctgaaattctcttcttttgttgtgtctcttccaggttttggtatcaggacgatgctggcctcataaaatgagtcagggaggagtctctctttttctattgtttggaatagtttcagaaggaatggtaccagctcctctttgtaactccgatagaatttggctgtgaatatgtctagtcctgggctttttttggtttgtaggctactaattactgcctcaatttcagaacttgttattggtctattccgagattcgacatcttcctggtttagtcttgggagggtgtatgtgtccaggaatttatccatttcttctagattttctagtttatttgcatagaggtgttgatagtattctctgatggtagtttatattactctgggatcagtggtgatatcccctttataattttttgttgtgtctatttgattcttctctcttttcttctttattagtctggccagcagtctgtctattttgttaatctttaaaaaagaaaaaaaaacgtgctgggtgcagtggctcacgcctgtaatcccagcactttgggaggccgtagcaggtggatcacaaggttaggagattgagaccatcctggctaacacgaagaaaccccatctctactaaaaatacaaaaaaaattagccgggcatggtggtgggcatctgtagtcccagctacttgggaggctgaggcaggagaatggcatgaacctgggaggcagagcttgcagtgagccaagattgcaccactgcactccagactgggcaacagagcgagactccgtctcaaaaaaaaaaaaaatgtgaaccaagatcgtgccactgcactccagcctgggcaacagagcaagactctgtcaaaaaagctagctcctggattcattggtttgtgaagggtttttcatgtctctgtctccttcagttctgctctgaaaccctacaagccagaaaagagtgggggccaatattcaacattcttgaaagaattttcaacccagaatttcatatccagccacactaagcttcataagcgaaggagaaataaaatcctctacagaaaagcaaatgctgagagattttgtcaccaccaagcctgccttacaagagctcctgaagtaagcactaaatatggataggaaaaactgataccagctactgcaaaacataccaaattgtaaaggccattgacaccgtgaagaaactgcatcaactaatgggcaaaataaccagctagcatcataatgacaggatcaaattcacaaataacaatattaactttaaatgtaaatgggctaaatgccccaattaaaagacacagactggcgaattggataaagagtcaagacccatcggtgtgctgtattcaggagacccatctcatgtgcaaagacacacataggctcaaaataaagggatggaggaatatttaccaagcaaatggaaagcaaaaaaaaaaaaagcaggggttgcaattctagttctgataaaaatagactttaaaccaacaaagatcaaaaaagacaaagaagagtattacataatggtaaagggatcaatgcaacaagaagagctaactatcctaaatatatatgcacccaatacaggagcacccagattcatgaagcaggttcttagagacctacaaagagacttagactcccacacaataatagtgggagactttaacaccccactgtcagtagtagacagatcaatgagacagaaaattaacaaggatattcaggacttgaactcagctctggaccaagtggacctaatacacatctacagaaccctccaccccaaatcaacagaatatacatccttcttggtaccacatagcacttattctaaaattgaccacttaattggaagtaaaacactcctaagcaaatgaaaagaacagaaatcattacaaacagtctctcagaccacagtgcaatcaaattagaactcaggattaagaaactcactcaaaaccacacaactacatggaaactgaacaacctgctcctgaatgactactgggaaaataacaaaattaaggcagaaacaagttctttaaaaccaatgagaacaaagacacaagacacaacttaccagaatctctgagacacagctaaagcggtgtttagagggaaatttatagcactaaatgcccacaggagaaagcaggaaagatctaaaattgacaccctaacatcacaattaaaagaactagagaagcaagagcaaacaaattcaaaagctagcagaagacaagaaataactaagaattgttttctaatttctttgaagaacgctgaagtacaggaagaataaagaatcctatgtgtgcatgtgtatacccatgaagtgagagttcaacactatgaagtgagagttcaacactgtttcactgcactttatcgcctttctttctaaataaaaatactgcacatccatctttcaagaagttacattagaatgttatttcactgtttataaaatgctttcatatgtaatcctaaattacctctgttttccttttaaaagcctaacatttcacccttcacagattgattatttacttccatttttgaaatttaaaattgtacagttaacttgtttagacttaatgtttctaaagcaagattctcgaattctgacatgaaatatcttcctacatatctttgttatttgagttttattttgtttggttttcccaatgtctgagcaaatcttgattcccatgatgactgttaaattagtatcagtgtctgggttcatcaagaaatctatttaagttggtctagaaagaaaatatacattagcacatgccaatatgattatatattataatttttaaatggtataaatataaaatgagaaaggcatttaaagaaacatgtcaaactatgctgctctaaaaaacagagaacaccagccttagcttcattgtttagagggattgtaatactggaaactctacctcattggaagctgggcttcttcctcacatagctttgctttctgcatcaaatgacatccaatgaaatcataaaatggtatataatgccaaagcatgctctaaaaccattgatgctggtgtcccaaacatgtttcaagggactctgcatcaaaaaaggataagaataaacctttgtcaaagaaatgaagagagaggaattgaaggcaagtttgacaggagtggtttagggtaggatagactatattcccctgcagagatgagcactgtgattcagggatgaaaatgatgtttttaacaaactcaaccatttaaaaaatattgtcacagcaatttgaaattactcttcaaaagtagaaaatttatgtggaatttagtatgaaataatacttatctaaatgtagttataactggattcttaatggtctctagctgttttaggccatcccagaaagaagttaatttgatggcttaaaagtgtcatcttctattcctgattctaatcattctgttgaggctatttttaaatggtgtagatcattgttttaaatggtgtagatcattgttttgttttgtttttcctcctaggatcgttgggttaggaattttaagggatccaaaacattatagagttaatttttcttgtttggcaggttataattacataattatagacgagaaaaaaagagaagaaaagcatgtccctagtcctggtgataaataacatattggaatattttatttcaattcagacaacttcatttattcattaaatagtaaaattaaagtcaatctagattatgtgtcagataatttacaaagcattactatagctgtaaagactttaaatataatcaacatattttgaaaatagttcccattttcaaattaataaagtgtgctgaggagtccttcttccagaatttcttgaaagaagaaattctgcatgaggttaagtcatgaatggaaactacttttttttttttttttttttttgtgagccagagtttcactcttgtcaccgaggctggagtgcagtggtgcaatcttggctcactgcaacctccacctcctgggttcaagcaattcccttgcttcggcctccagagtagctgggattacaagcatgtgccaccatgcccggctaatttttgtattattagtacagacagggtttcactatgttggccaggctggtctcaaactcctgacctcaggtgatccacccgcctcggcctcccaaagtgctgggattacaggcatgagcaactgcacccggcctgaaactacttttaagatacatatggattactaagctagaagtctctttatgcatgtggcaggcaaaatgtaagatggaccccaatgatctctccacttgtattcttagatttgtgtatttccttcccttttagtttgggtggggcctgtgacttgctttctaaccaataaaatgtggtaaaggtgacgggatgtccatccatcattatgttacatgagattgtagctttcatcatgtcagcagactccctcccttgctggctctgatgaagcaagttgccacgttggtgagatggggagatccacatggcaaggaactgagagtggcctcaagccaactacccacaaggaactgaggcccttggtccaacagcctaaagaggattttcatcatgccaaaaatcactgaagtgagtttggaagtgaatccttcccaaacgagctcccatatgggaccccagccctggccaaaacattgcagcctcaagagagaacatgaaaaagatgaccaagctaagccatgcttatatttctaactcacatgaactgtgagataataagtgggtattgttttaagcaactagctttctgggctttctgggaatttgttatgcaacactaggtaactgataaagctaatgtctatggtcggcagaataatgatcgcctgaaaaatgtcctcatactaatttccagagtctgtgactttctttgcatatatgattaagtcagagatgagatgattatctttgattatccaggtggacccaatataatcactagtccttttaagttaaagaggaagtgaaagtcagggaaagatttgaagatgatactgctggttttgaagatgaaggaagggaccatgagccaaggaatacaggcagcctctagaagttgaaaagtctttagaatgagtgcagcccagctgacaccttgattttagcccagcaaaactcattagagacttctgacttccagaaatataagatagtacatttgcatcatgtttaagccactaagtttgtggtaattcgttatagcagccataggaatctaatacagggtctatgcttattagcatcaaggatgactaacaagagtccttctccagggccttgcctgctcctaacagctactgcactgaagcggtgcatatcagcttccctttccagagtgaacaaataaattcagtgccactgagcattgctctagagaaaattagcatttgtcccacagccttatgggcctattcattctcccacccaacctaccaccttacagttttttgtctgacaattatccctcattctcttgtttactgttttattgtttcatctcaagattctaagcctccctgtcttagtcaaagggtgtttggactcaaataatatgatctaatcaaaccagttcatcatgctaactgacttcaaactatactacaaggctagagtaataaaaacagcatggtactggtaccaaaatggatatatagaccaatgcaacagaacagaggcctcagaaataacaccacacatctacaaccatctgatctttaacaaacctgacaaaaacaagcaatggggaaaggattccctatttaataaatggtgttgggaaaactggctagccacatgcagaaagctcaaactggatcccttccaccttatacaaaaatgaactcaagatggattaaagacttaaacgtaagacctaaaaccataaaaaccctagtagaaaacctaggcaataacattccggacattggaatggggaaaggcttcatgactaaaacaccaaaagcaatggctacgaaagccaaaattgacaaatgggatctgattaaactaaagagcttctgcacagcaaaagaaactaccatcagagtgaacaggcaacctacagaatgagagaaaattcttgcaatctattcacctgacaaagggctaatatccagaatctacaaggaacttaaacagatttacaagaaaaaaacaaacaactccatcaaaaagtgggcgaaggatatgaacaaacacttctcaaaagaagatatttatgcggccaacaaacatgacaaaagctcatcatcactggtcattagagaaatgcaaatcaaaaccacaatgagataccatctcataccagttagaatggcgatcattaaaaagtcaggaaacaacaaatgctggagaggatgtggagaaataggaatgcttttacactgttggtgggagtgtaaattagttcaaccattgtggaagacagtgtggtgattcctcaagggtcagaactagaaataccatttgacccagcaatcccattactgagtatatacccaaaggattataaatcattctactataaagaaacatgcacacgtatgtttattgtggcaccattcacaataccaaagacttggaaccaacccaaatgcccatcaatgatagactggataaagaaaatgtggcacatatacaccatggaatactatgcagccatagaaaaggatgagttcatgtcctttgcagggacatggatgaagctgcaaaccatcattctcagcaaactaacacaagagcagaaaaccaaataccgcatgttatcactcataagtgggagttgaataatgagaacacatggacacagggaggggaacatcacacaccagggcctgttgggtggtggggggctaggggagggatagcattaggagaaatacctaatgtaaatgacagattgatgggtgcagcaaaccaccatggtacgtgtatacctatgtaacaaacctgcatgttctgcacatataccccagaacttaaagtataataaaaaataaataaataaataaatagaagttgggaataagtagagcacgcaggtcttggagggtgcaatcataagacaactatattctttccccgcattgtccacttataacagctccccagggccagttcctccaagccctcaacaaaatctcaggtagttcccataaacatattgaacaggttcagaaagttatccagtcacttgtacacttgtaatcacaattaacacttgattgtcatgtaatagtcaaaacttccaactccacaaaattcctcctttttgcctagttcaggcctaggaagcctgcagtgggttaaggggcattgtcaatgttttctctactgccccagcattcagctccttccagattgaaatgaggccaagatggtgaggtaaaaggcaagaaagttctcacttgattggcaccagtgtaatccagcattactttcttctgtccgtggaaggtgatgttggtggactctttccttgtgtttgctttcatggattcctggaagatttctttgttgagttactcctattgcagcccgcttgtgtcaggcagaaaccaagggcgggctatgctcagtgctccttggattctgtatatttctgcgaaggccctctcatccctcaaagtagctcagttgatcaggaggtcccaggccaatgtttctactgcatcttccaagagtctcatactttgggcctgcctcagtgtaagggtagtaactgcacaaatgtagcctctgctctttgagcatgtgctgcttctgacagcctcttcctgctgccttttttttcagtttgtaatgaagatatgagtcagatcccaagatgagtaaggggtaagggttccaaactctggttttcaacacctttgaaaatcttgcggcacccttctttggcatgtgggaatgattggcatgtattggcatggggcctcagctgattctgtctcagttcatcttagcaccctgtaacatatgaacacatatggcttccatctttttttccacctaggtttggattaggagtcctaagggatctgtagtgctatggagttaattcttctctggaagatgatgattatgtacttaagatgagagaaaacaaaagtaaaagctctttctcagaatgatgatcgatatcctgctgagatcatttatgtgaatgattttatttctagcaaaatggtgaacaaccagccctcaggaatggtggaaaccaggactgttcaggggattactggcatctgtaatgtttactctggtgctcagtcgtgaatgtgacttggctcccaactctcttagtctctgtgtctctaagttctgattctggagaaaggatatctgattggctcattccaacattcaggtccaatgagctgggcccattgcttgctcctgaggactctgggatcagactcagacaggacaagccaggcagggcagatagttccactaacatggctaccacgctcacacattctttggtcaatggggttatagagcatttcttatctgataaacgtttcttgttgcctgtgaacgaggaaaacttgaacaaaaactaagaaacagtgctttgtttctgtttgtgctgctttccacatatttgtctcatatctgttatcctggagatggacacccagtttgcctctgacacttcacccccatgcattctgctgcaagtaacatcctcatccacctccccttaaaggctagcagcagaatttttggggggatataaaaccagagttgactggcttggtcatggtgcttgtgacactgaagttgacctattgaagctagattgcttccccaaactgctacacgtgtgtatattcccaccagcaatgcagatccttcatcttatgcactgaattctcatttgattgcactgttgctctgtccactgcagtcattgggctccctgccagccttggtgactgggaacttgtgggagcagactggccaccatcagcactgtgctaccttcctgcccccaccagcaccatcatcctaagtgttcagagtcttcctggagttttagttctattactcctttccctgccctcttgattcctctcttcccctaccccactccccaactacatggtccagcccagccagagtgagtgggccgagccacaaatcagttagtgctagaagtgtgatttgcagtgacttcttccagggaacagccttgcaaaagatctccttccccttacttatgtgggcaataaatcagaaaagcaggtaattaattacaacctaaagtagaaaaaatcagctcttcttcaacaaaatggcaactgacctttctcctagtcatgatttaaaaaagaacaaagaagggaagaaagaaaaactattataatccataatatgatttttcctcaagggtttgagttacgtggagggaattagataaaccattatattacattgttctgcttttagccatgaagtgcggcctattgtgagtaatatttcccaaccggtgcctgtctgaaatatttatcagcccagggtcctagcattgtgaccagggacttactaagccacacagtatgggaaccgatgtttgctgggatgctatttttttcataagaaacctacaataacatttttgtctctggatgctgatcctgagaggtaatgacgttccatgaactgacagaatttttaaaaatctcttcccctgacagaaaactacagagaaatttttaagcagcaaagaaaaataggctaaaggaaaatcagaaggagagaatcaattctgagagcagcaaaaaatatagagatttgggtgatgcttctaaaactgttcttcccttcctgggttttattttaaggtcctgctgtttgacagcacagataatattgcccaatgtaaacttactaggaagctttcaattgggcagtttgttaaactcaggaaacgcttcattttggcttttgtgtggtctgaaagcctacatctgagctatttggtttactctatcctgggagtccagggagcattcactaacgcatcacacattttgttttgaaagaaaactcttactagttagagtccgggctcagtgcatatcataaatatgtttgtttttctctcttacagaagctgcaaagaatcgatactcctcactgtcattcagccttaccctgtaagtgttctgtgaataaaagtgccacttaatgttctcaggcttcttgtttcttctgcccactccagtaaaaccataatgatgaataacagcagagaaaaataacatgcactcacaatatgggttcaaaaatcttgactatttttgtaatttatactccatgttagcaaagtcattcattgaagagaaaagggagtaatacattttctaaagttcttgaaagacaaccagctattccagtcctatgcaatggtcacatttgtaaatgacactaaattcaagaccttcttatgcttttcagcttaagaaacacaaatctcatgagactatctaattgtaggaggtcgatgcatgattgttattcttatccccatctatttggcagagaactggatattttagcaaagcctgctttaagaatagatgttatatgacatatggtgtcagaattcgatttcagctatcatggttaggagggtggaaagtgatttaaaaactggacagttcttgtgatttaaaaaaaaaaaaaaaaacgactttatcatggtataatctgcgtaccataaaattcatccattttcagtgtacagttctatggtcttcataaaatccactgaggtatgcaacgatcaccccatccagttggaggacatttccatccccccaataagatccctgttcccatttacaattaatccctgttgccacactcagtcctaggcaaccgctaatttcctttctatttgtatagacttgccactgcttgcaaatttcatacgttgtcagttgaactaaaaattaccgaggcaaattcctttagatttttcccaaaatggttcctgtcagtctggccttcgtaaggagtggcagcgattccagcctgcttaagctcctattttcttccccatagagttggagcatttctatatcaattaaagtgctctggtatttgctgatctccatcttctgaccaaactcttcatttcccctgtcccagaatttttcccctaagctctgtgggctaggcattttagacaggaaataataaggatcaggattctgataagaccacaaatagaactaaccaagacaacaaattatgccatcttactatgcatatttatattaaaagctcagtttaatattgactgtcactgttaactccatctctttgacagaacttacacacatacacatacattgggatttgaaaactaaggaggccccaggatgttagagaaccacgacttgagatctagctcacagcagtataacaaacgagtcagcagtgactaccatagctgctcagaaccttggtctccccaactgtctgattccgagattccttccatgtgcttctataaaaaatacagctgggctgtttttagattgttttggttaatcaaattgtcattttcacttacttcacatctatacacatttcttgatttatttgcagtggacaaattcatttgggtaaagccaatgtaaatgtctataataagcatcgaacaactataaattgagattgaacaactataaattcctgatggaacttcacgtttgcattgtcattcctgaattctctttctatattgtataatctattagaaatgcaagatcaggcaggacctttgtgttttgttttttgtttgtttgtttgtttgttttgcaatgtgggatactgttttacctcatgcagtaaacttagaaaaagaaagaagagttttacatgtaagtttatggttgtgtcttgtggctttacttgctgtttgccactggagtccatgtgacttgttattcatttgaatattgattactatcagtgaatcatggcacttccttttaacagataatctggaattttctaggagttccgatggctcttgccgttgtgctacattgaaaggcaacacttagccacaatattcaggaggaagtgtcacatgttcttatagccaacagctgtacctctgctccagagtcactttccccttgcccaatcaccgcagataaattctcatctttgactttcctttgaccactctcctttgagaaatgactccagtcccaccacctcctcggcctcgctaaataaatccttctcacctttcaagtctcaggccaaattataaatgctacctcaaggtttttcaaccttggttttgttgacatttgaactggagagttctctgttatggggacacgtcctgtgcattgtaggatgtttagcagcgtccctggcctgtacctactagatgccagtagcatcctctccccaagttgtgacaaaccaaaatgtctccaaacattaccaaatgtcccttgggagcaaaattactcccagctgagaaccactgtcccacctaaagtcttccctttactgttcaaatcccaaatggcttttctctcctccgaggtgtggaagttgaaattaaagaattaaaaccccaaagtttcttaaatggatatcagacatggagaggagagcagatgggaaaaaacaagactgcaatcttttacttatatttttgggtttggattttactacaagcaagttgctttttgtaaaaaaaaaaaaaaaaaatacttattgagtttcatttatttgttaaacatcttcttggcaatcaagactgacaaacagaaacggatgacccagcagaccaaaagaaagtccataagttctacttttattacagacaataaaaattagcattttaatttcttttgcaacttgctggacagcatttttaatgttgtatttcttctgcataaggtccagtaaagatagagagccaatgtttataccttccggccacattccacatgtgcccagggtacctcaacatgacccaactgcagaaattgatctccaatgagacctaggtcaagggggaatgggggtgagagtcttgggatccctgaaattctttgataagaagtaattcttaataggttgctgcattttttaaaaaaagtattatggtaggctttccccaccaccacgatttttactgtttttcttgggaaaaaaaatactaagtggaagtatagaaagaaatacagatgcagaaaaatgtgttggcaaacttttcccgcagagacaaccagtgtaaacattttgacctatttccttccagtctttttttctatgccttagttgagatcatattgtacatataattttattctgcctcttttactaaatatatcataaacatttcctatgtcatcaaaaactctttataagcatcacttaaatggctgcaaaacattacactgaaccaagatttccttaaccaacccccatcactgggcctttcacatcgtctttattgttttgctattataaataattccgaaaagaaaatctttatgtgtaagtcttaatctgtagttagtatttccccaggatggaattttagaaggggaatttctgggttactcatgggttttatttgtttggctccgatataccgtcttctttccttgtactgttacccttttttattatagatctttcattggccagctccttccttttttcctttgactctgctttctacagtttccaagtctagaattccaaagccaatcttacctgagacagagagtatttaaagagtttctacggctgggcatggtggctcacgcctgtaatcccagcactttgggaggccgaggcgggcagatcacctgaggtcgggagttcgagaccagcctgatcaacatggagaaaccccgtctctactaaaaatacaaaattagccaggtgtggtggcacatgtctgtaatcccagctactagggaggctgaggcaggagaatcacttgaacctgggaggcagaggttgcagtgagccaagattgcaccattgcactccaccctgggcaacaagagtgaaactctgtctcaaaaaacaaaaaagagtttctacaacttcccctcatgcaaccccaactcaatgggacttgagctaagtcattctctcagttctggtgtcccatgagctagcataattcacattcctttaggtttcttctagtccaaagagctgagggacccgctttcctgcctccaacttcctaactacattttactgtgttccacacagctgagagaggctacacacctcctcatggaaaccccagtgtagcacattctatcagagcccagaccatatgtcatgctgagcataccagcccaatttccaatggagaacacctgtgagtctttgcctgtgggctcttcctggccccagtagcatgctcatggagcaggccacaagtgctgaggaattatcattcccagaaaggctgtgttttgtgttctcttacatggtggtcagtcagatgtagccacaagaggggacacaggagacatgcgggaaaaagaagttttttttatactcacaggtcctagagaaactgcatgccaagaggaggggtcatatgagagggagcaccaggggagccgattcaaccaaccaggcggggaccagacagagaggttagagcctgtgggcaaatgcctttatcgggggtcagggtggaacacacaagaaaagtgcgagggaatttcattggtctctttaaatgttactaagtcacagtcaggggagggtgggaaagagtacttgtggcaggagctaactttatcacactggtgcacctggttgcctgggcagggtgctcacaacctgtatgtggggatgttgaggcagcaggaaaatttgaattttgaaaacttacaatacaaggagacactccatcaatgattgacagaaactggtggataaataccccagctccctctctcctcagacagtataactctgaggcatgtggtctaccttgtttcccagaggttcccagcaggagtaagctccagttgcctataatggtgccttagtaacagcgaatgctttactggtttattctcccttcctgcctgccttccccactcacctacctgggattcctgtgagcacctcccaaatcagctacctgtttgtgaatccttgtcttaggtctgcattttggagactccaaactaagccaaccagtgataactgtaggcgagtcttcaccaaatgttcactcaatacctgctatataagtaatactgtacagctctaggaattgcaagttcaagaccttgcccttcaatttcagaaattaatcttatttctgtaattttttcaagctatgttctagtaacttctaagagcattcaaaagcatcaggagcattccacacactattgtggccatcttagcaacagcaaatttggaaaatgtacaggggttgattaggggcctgataatcttaaaattaattaacagtaggagaatctgattattctaaatgataattacttgttatttccaccacaggatatgaagtgcttgtgatcaacacctacaggttgctcagaattaattcagcaggctttcaagtggtacacattgtatattttttgaaagcaaagataaatctgtgttaaaactatagtcatgactggtttacattaccccatataacacaagtaactctagccagtggaataagccagtattttgttgattctcattaagtagccttcagacttggagagcctatgtagttgttatccaaaagtaatttccaaaacatttgtcagttttatgaaatagtcacaaacccagaacaaaaaaagtacttgttatgaattcttagttagaagtttaccccgagtctgttgacttcaaattgtgtataaaataatatttacttaacaaccttggctatttagtttcctttctggtcttcctaaattaccatgtttctcattattgcatcgtaaataaatacaggaatgaagttacataaaatgggcatgctacatatagctagagagaggagatagtacataaggttatttgcccctaaagtaaatagccccacgtttactggcctcagcagggctagtaaatatggggctatttacttcaggggcaagtaaccttacgtattttcgtgatccctgggaacaccatggcactctaaggttatatcaaatgatatgcatccgaaaactctatatttgttattgaagcaaggaattagatggaacactttagaaaaatatggcaaaatataacatttaaaaattgagatgcatagaggaataaacctcagtatctggcacactgaacacacgtgaaacatttcattcccaaacaatgctggagaagtgaggtgtgactgcattaaaacatctcatctcatgagtagtgtctgttctgggtagctttattacagccgcttcacttgtgctcaactcattgtgccaatgtaaataccgcctgcctaaaatcattacgggagaataatgttttcccttcagctaaaaaatgaaatatcaaaagcaaatgcgctcaccgctgtatgatttgctcgttaatcattactaaagttggcctataattacaaagatactgatgagaacaccctgtcacatcacttcagctctgcagcaggacttttaaaagtcacgttgagcatgtttaaagctattctttcggtttcttgctgttgtctgtttgtttgtttgttttttaaagacggcagccattctcttaaaacatcttgcataaatggatgaattcaagctctgggagacaaatcatccatttatccagtcttctaagacactactcacagcaaaggatgggatcggtgtggaggggaactttagaaataacaggattctcctggtattaaagcaaaaactccatccaggatacacacacacacacacacacacgcacgcacacacacgcaccccacacacaccttgtatcatacttttttcaacagcttttttattacagtaaaatacacataacataaaatgtaccattttaaacatttaaaagtgtacaatttcgtggcattaagtacattcaaaatgttttacaaccattgccgctacctagttccacaactttttcatcaccctgaaaggaaaccccgtattcattaagcatcactcctcattccctcattctcctccacccccagcccgtggcaactactaatctactttttgtccctatagattagcctattctggacattgcctgtaagtggaatcatgcaatatgtggccttttgtgcctggtgtccttcacttagcaaaatattttccaggttcatccatgttgtagcatgtgtcagaacttcattcctttttatggttgaataatattttattgtacagatggaccacatttgatttatctatttcatcatattgctttttaaatttaattgatcttaagtatacttgtatttgacaaggatgagagtccttttttaaattcattttacttgaaaaccaaagtataggtcaccctagttggcttttgtatctctagattagtacaataaatagagggttaagcctctgtgttgtttctagagtcaattactagaattctttacgcaacagcctctatgtcttaagactacatagcatggaaaacgttagtttgaaccataggcaattgccaatatttgaccattttcatttataaaataacaattatatgattcaaactatttacctctgtattaggtttcatagagaatgtaattctttttaaaaataaacaaacaatgcctgcaacatagtagatatgtactaggtgtgagttcccttccccttaggcttctttaaaattatgcaacaatggtgattctcagataaagtgactttaccaagatcatgcagcaagggatgccccagtatcacagcacccttctaggcaggttctcccattgtacttccaatttctgaggaagaattgtgccacattgcccctctttctgataaaagaaaggagagaatcataaagcacaaagagcccataagatgaggaagaatatgaagtcaactttcaattgtaatgaaaggtctcgtctctaccctgcccagtaagatcacaggatcacaagttaccaagaagaggctaaaactcaggttgcaggtgcataaggcatgagtgcttgagagagaaagagagagagagggagagacagagtacttgtctgctcacatgcccatatgcccttaatgtgaataacaataggattatgaatcattttaggactatcaatggctcttctccacctcattaaaatagatgattaatgatcaattcatcataaacccaacattagatctgactaccacctcaccttgaacactgtgctcaaagctctctattaaaagcagagtttgtgtgcttttgcagccattgttttaaaacatccctggaaatgtgctcagttaaaacatggaacatagtggtggtagttctgatctggccactaaatcaaacttactaacttatagacatgacagtgttttgactgcatctataatttgcattttgtccttgaatcggacatgcaccaagcattttatttttaagcaaaattattgcatacctaagatggaaaacaactgttacaaggtttgcattatgttaccagtaatcagataaaatgttttcttttcttctagtctcccaaatcagcatttattagtgctgcaaaaaaggcaagattaaagtccaatcctgtcaaagtacgcttctctgaggaggtcatcatcaacggccaagtgtcggtgagtttacagtcacctgctttgtgactcagggagagtcaatgaggcagaagctttgcactcaaaacaaagtcagtagtcccactggaatgactgatctgaaattggttgttggtttttacagaggtgtcaaatctcaaggttgtaaagggcttgagagttcatcaggttgggcctgaatctcctctagcacggtcagaatatgtggtagtccaggatttcctagaatgctttcagtgtcagagacatcactactttgcaaaggagttcatatgatttgggatcactgacactgcctcattcatactcagtaaaatatgcgtctttgaaacttccacctttttcttcccattctgctaaataagcattcttccatatgatagtgctttatgtatttttgagaaaggtattgtgtttctcctttttacttccccagaaaagcctaatctttcaactaatcaggcaaagaacttaaaacgatggaaaaattttatgtaggcaaccagaactgaagaaatactgcccacatctccataaataggtcctgatagaaatcatgattactcaggcaattaactgaacttcagaatgaataatgcaactatcaacaggatgttttgactttttctcccaaaaatatactgaagtgttttcagtttttagaaaactatcatccaaggcactaatattttttggacctttgaaatgccagagcgttggtgttctgttggtattgtttaaataaatccacgaggataaaatctcacctatgatatattcattattgatcacaaactcttctctgaggttggttctggatctgaatctgaatctgaagatgtaggcctatacatcctgggcaaggcactcatgctccaactgtctttgaatcaaaacttactgatctagggctgctccacttggggtccagctattgtgatgcttgtggggaaggctagaggctgtggctgtgctgccctgtgagcatggtctgttctgtgcctctcaatgtgtcccatcactctggatgcacggtcactgtacattattaatttacaacaagactgtcccagctgaagggtggaaggtacagaggaatcaatatgtagcagaaagtcatctgaaacttaccttttctgcccagagctttcgagcgtgtaattgggcaaccaggtagtttatgcatctttagaaagaatatgattctagaagctgctacagcagtgtcagttcatccctggatatagcaggactcctgcaaggcagctgatgtgtaaggacacctctgaggataatcatctcctgaagcctccacagccctgccacaggcttgtggatggcagggatgttcggtcacgtggatgctcctcagacttcatgactgtcttcatttccagtttacccttgctcttctgagtcactgagtgcaatttcttctggactgggatccagatttattcagtgacttgagagcaagactgtgcgggaagtccacaggagcagaaaagagggggaggaaattcaggaaaagaaataggaagtgaaaggcaggaggcctattatggaaatacttagggactgaattctctctgacactggcaaattcctgaatatcttgccttcagttccttcatgtgcaaaacaagggatgtgtgcactcatgactgctgagttctcctcaactcctaggactttatgaccaactacatgtgaataactcagctcactcctgggacttatagaactcattcagtgtgcccccttcctccctctttcttctctctcatctctcactacttccaatgaaagaaaaaatgcaaagaaataacatttctattgtttgctttttgtcatgtttcaagctggcatctttttctgagttatttctagattatgatcttgttcattatagacaatgttttactctcttaacacactaagccattccttatcttttcccttggagttttgttttttgtttttgtttttgtttttgtttttgttttgcagttgcaacatttaatagagttcccttggagtttaagactcattcctaactgggtgaaaatactttcacaaaataactttatacttgaagcttatttatgctggtgactcaccatcatgacactgctaggcaacaacagtacctcatcaaacagcatcattgctggtcttttttctgctcaagacgtcctgccctgcttaggtctgggcttgtagttccaaatgtcaaagcctaatcacaaaagaatcacgtctgcaatcatgtttgccagtggggaatcttgagttaaaaaaacctcatctgattgattttctgatgagcaaatgtatttttctatgagcaacttaactcacatatcaccaaaggaatgccttgttggccttagagagtttgattgttttttaatgccatgcttagaataaagtatagatgtgctgctactgcaaagagaagagttataatttgatcaatttatgccctgcccttttttttgttaaacaggaaactgttaaggacaactcacttctttttatgccaaatgttttgaaagtctatctggaaaatgggcagaccaaatcatttcgttttgactgcagcacttccattaaggtaagatgacctggtaaactctgtccctggacgctttcaggtacaacatgcaggacactgtgagccattgtagcagcatcttctttcagaactatccctttatttctgcagttttgttgattgcctccatataatgtagtctgtgaatacttcaaaccaaaccaaagccaaaagcttaaaccaagaaggctctgctcttttatttctcttggtgttgcaaaacaatataatatgctgtcagtgaagaaacactagagctagtcattttgatgcaactacagattaattaaaatagtgtgactatcaccaagaaggcttggcaccctgcccaaggccagcatgatttctcagcaatatcagctgctcagaagattaagctgttagctgttaattgaatatttgctactttggtgtccagcaaaaaacaaggggtagagtaatgtaaaagtaacatttacttttaatttctgtaaccaatttcatggtaatgatgcataaagaggcagaaatgaggcctgcttcttagaagaagggctggaaaggaagactcacaaagcaatcctattctttcagagccacaggtgagttttagataataggtattatagcaaagcatatggtttttttccccacatgctttcttcctggaaaagaaaagtacagagtctcttccttttattggacaaaagtgtattcagaaattgattgctccctaatgcttcatcagcctaaaataggctttcttcccatggcacagtaaaaaagattttatgaaggtaaaagagtacctagtgattatctgtataataatctatcaagagaatatcaaccctctgttaaaaaatgtctatcaatatccgacctctaattcttgttggtttttttaattaatcagcatagacctcacacatagaagcatttctgcaaagacccattcactgtgtattcttattgtcacgataccagcaagcagctcgttttgaattgctataagtatgtagtggcttaatacgtcatgcagtggaaaatattagattgatgttggagcattaaatcatcctcaaatcattccagatgaaatattaacttccttcatacaagacttctaattttaaatggtgatgactggacaggtcttcttccctttttcctcattcattatcaatttgtggtgagatgttaatataattattgatcaactaacccaagagtaggcaaactttttctggaaagggctagatagtaaacattttaggctttgtgggccatttgatctctgtttcaactactgaactctgtcattgtatcaggaaagcagccatgaacaggtgggtttggttagtccttaagacaatgctcagtcttgataattcactcaaaggacccacagaactcagcaatttgttatactcacaattacagcatattatagcaaaagaatacagaatagaattagcaatgggaaaggctcatagtcagggcacaggagagattgagtggaaagcctccagatgtcctcttccagtggattcatacaggtaatgcttaattctcccagaaatgatgcatgacaatatgcatcaagtactgccaaccagggacgttcacccaagccttggtgtccagagtttttattgggggttttccacgtagacacagctaaccacctgcatggttgaacttagtatccagtctctccagagttagagctgataccatatggcccaatgttctcactataaatcaattgttagcgcagactatctggtatggcccaaggccacccagtaaacaaaaatactcctatcagacaggacagtccaagggcttacaggttacttcctaagagtgggagaaaaagagcaaatttttctttaggcaaggttaatctgttacttcacagtcaatatgtgaacaaatgggcatggccagatataacccgcaggtcatagttggcagacctctgaaataacctacagagctacattattacagccctttctgacaccatggccttgttttgtgttgccaactggtcaactccctgccattggactccctaccccacctgaagaccgaggtaaagacttgaatgcatttcttaacagaaataaatctaaattgaagaaagccctgttgtccattccctccagcctctttattacggaacatatgcaagactaagtttgatttccctgaggattgcagatgacaatgagaagacaggaagaaatgcaaagagttcacatcaaattcaagttatcttatcttatacctaacagcctcattattacaatagacactggctggtaggtgtaaaggagaaatagtatagttatgaaaggaatatgacactgtgtaacaaaaattgccaaaattcttgctgcagaattacaatagggaaaaactcttgctattgattttccaatgtcctccctggtggttcaggaaaatgctttataaagtatttgttgccacacaaaggctggttttgttttctctttcctgggctttaagagaaaattataaagcagggaaatctttttttttttttttcttgaaattcaacatagtcaaggcatttctcttgaatgattttttttcaggagtgggtggatgtggggatctttgatttaatggggcctgaagaaattgaaaaaggaccacagagaaggattaaaacatcagaaaagtcagtaaaagaaaactataagttttcactctaaggtttccggatcttgacactgttgagatattgggccaaatcattctttactgtggggctgtctctgcattgcaagatgttgagcagcatttctggcttctacacactccatggcagtagtgtccccaaccctattgtgacaaccaaaaatgtctccagaaatttccaaatgttgcactggggcaaaacttccctatagaatttttagcatctgagtctaaattatcttcgagggatcatttaccagttttcaagtacatgaaaaaagtataggttgaagagattagttttacattgtagtaaatgtgtgtgtttgtacatggaacacctttctgatcataaatgcttaatcctataaaagattgctgacaaagcttgctcattccaccttccccagagatgtaaaataaatatatgtatattattatggtgccctcactctgtgccaaacaatgttataataaacgctttgtatgtgtgaactcatttaatctttatatccgttctgagataagcattattattatccccagtttacacacagggaaactaagatacttagcgactaaataacttccccaaagctgcacagctaataagtagtagagctgggattagaagcctaactgttttcttagcccctattccttacaaccactacactgctctttcagaaggggaagccagggtcagcaagcagatatttcagtcttcacagtctctgttgcagctactcaactctgctgatgcagcacacaagagcagccatagattttagataaacaaatgggtatgaccacgtcccattaaaactttatttacaaaagctgatggtgagctagttttggcatgcaggccatgttttccaacccttggggcagaccactttcagaactggtttaattgctaccccatttagaaaaaaggagaattgaactggctacactgcacaatctattgacaacctttctatatcaagagcttacatgatattaagcttctcctccagctatttaccttgttaactctctgttgtgaactccataaagattttgaatgatcgaggaggccaggaaaagggcaagagaaggaaggcttcatttctgcatctttttggatatttggagcattaaatttcagaatcaaccaaacgtataaaatttcaagattggcagcctacatgtgtaacacttttcagtcatggtagactccacaagatggcagcttcgattttggtctcatcatgttcatgtttcctctgtaaggatgtcatcttaacccttcaagagaagctctccatcaaaggcattgaacacttctctctcatgctggagcagaggacagaaggggctggaacgaagctgctcttgcttcatgaacaggagactctaactcaggtctgtgaaatctcaccctcaagtgatgaggctgcaggttagagcagaggttgcccagtccaagatttctcccccactctaatcctgtaaatgtattaattgtatccctgggtatcctctgtaaaggaagtgctggcattcttaatgcattttacacctcaaggtcatgtttccctttctgcccatcttttgcagactgtcagtctcacaactagatttgtcattcaaagtctcaccagctgcacattgagaatacagctctgtaaaattatattttatgggattacagtgatctgttcacctgttttggtcaacaatctcttgaaaccattaaaaagaaatggtttctgggattacttaaattaatccaaaatcatatttagttgtctgaaattctgggtgcatacttaagactatttttggaagcctgaaatctctgccccagtcctgcccgctataaatatgtgatctaccaatgtgtcccagttcctgattaccaagatgccacccccatctgttccctggggagacaagcaggctgcttagctgctgaattcagcgcagcaccctgatttttcttgtgacacaagcaaagtctttgttgaacgtataaaagatttcaacaaatttctcttccataggagagatcaatgataacagaactttatggaaaggggtaggaggggacaccaggaggagaagcatcagatgctgccagctggatggagtggcaaaaagtgttgtcatactaaagtgcttcttccttgttgtatataaaagctggtgtcccacacattgggtcctgcaaatatccccgattctcttgattcagtccaactttttgtaatagattagttcaaaagttgccatctgtgatttatattcctctacccaaacttggcttattatttccatcaagttttttggggttttttttgttgttgttgttttgttttgttttgttttgtttttttgagacagagtctcactctgctgcccagagtggagtgcagtggtgcaatcatagcttattgcagtcttgaactcctgggctcaaacgatccttccaccttagcctcccaaagtgctgggattacaggaatgagcccccatgcctggcctctattgagtctaaatctacctatagatattttaaatcacttctaatggttattattttaacctgtgccaaacactcttggaaataaaggacttattttatgcttcattacaggggcacaacccctgatatacagaatctctcatgtgaaaggtcagtgtctggatctgagttcctccagaggcagaacttaaggatttgaatgcatgtagtttatctgggaagagatatctggaaatacccacagaggaatggggaagagagatgagaaaaattgagaggccaataaagaatgtattatcaaaccagtttctactgtgggtaactggagctcagtcctaccggagagcactgggagacagtgtaggacgcacctcagaggtatcccaccgagaggcgagggagctgggacatgtgcctactgacatgctgtctgttattgatagtgggctactctcttgttattggggtttgccttgtgctatcgaatggtcacaggtgtttgctgtaaatatccttcagcttatagcaataaatgccaaggggaaatgggcagacatccagttactacgagtctaatgaaaccccccacaacgttttgatctttctggttatactttctctctaaacttttatctactacatagccattataggaaagcttcatgctgatttagttggacaaaaattctctaaaagtctcttctgatgctaggtaaacacaacttcccgctccagttacatttcttttaaaatgttggaaggaaataaacttctaataatcattctttctttaactttatttttccttatagaatcagaactagaagtgaagtgctaaaaatcaagtgaagtgctaaaaatctctagaaaagaaaacggatttaaatatcctgaaacaaaccagctatatgcctttgaaatcaatgcatatgaaaaaatcgattgctaaaatatttgtaggcatgataaaagtggagagtaagaaattatattttttccaataataaaatcattttaaaacatttaatttctatgaaaacctcccaatggaacttttaagcaactttacctgaatttctagtggtttgatactaaacttctgctagaaaacattatttatatactacttaaagtttccaagaaattgtttctgtttgtttattttagaaagtgttatggactgccatttctaatggcttgaggcaacctttttgcattacgttaattcatttcccaaaaccagtgtaaccttctgatactaaaagtaaactcaagataagatggcttatggaaaattcaagaaagaaaagttgaaccagtaattaaaggagtcagagatatagtgattcctgactttctaacacaccaggacaaaccttctggcaaaatagctcatgaagtcgctgtgaaacacaacagcaaggctggccagcactagtggcctcttagtgtccccaatttctttattcctggtttgctttaccctcagccagtgataagtagcccatagccctcaagtctcaggaatccactcggctctgcaggcctgcccacagccagaaagctggtgtgactactcaggatgcccacatatgtacaagtagggtgtctttttccattggaattcttctgttcaacaaagttagcgaactgtaaatacatacacatgcatgcatacacacaccacgggactcaataaagctattttattttaaattttttaattgcagctcacatttttgtattgccagatctgtcccctgcataagagtattacacacaactgtgttggttcatgctgcatggttttcattttgttttgttgactccttgaagggaaatcgatgagctcttgccttctttcttagagtccaatgtctttcattcattcaagtgtttattaaacacctattattatttattaattgatttccttttgttgcaaaaggaattaagaaacgaacttctagtatgtgacacatattatgctgtataaaatgaaaacaaactgaaatgagccatggtccttaaccctgaagaacctgtggtatattttaagctccattgagcaagtggaacaatatcatcatgatatcagaagtttggagtagtttgaatacttgtagaatctggtgtactacatgggccaaaacttctgtcttcctactttccaatgtgatgtcatctaaggttgacactatcatgttttcattgcaatagtcagtctggagtctaatttggaaaaacaaaacaaaacacagcaatgttatgcaataataaaccatactggacaatctctctgctgtctctttggatcccctttttgtactccccaacatagatttggggtgctatcactaacagccagcatctgcagatcttcttccaaggactgccctcagactaccggagcccatcgtgtccaaacctggaaactcacatcccctgggacagctctaaatgaatgactcatcagtgctcctttggctgaggtctcagcagctctgtggtatagctaccactccatggtctcctgcaggatcaggctatagctactctctgctggggttccctgaggaggcacccttgcttggcttcctcttctttcctgacctgcttcccccactcccttactagcctcccctgggagcactttcttaataagtcccttgcacacaacccctcatctcagggtctgcttctggggaacccaacctaagtggcaaggttatgtgtagttttcagggaatgagtatctataaatactaaaagaatatccgctgattctttccttagtgtccaaaaaaagtcgactgcttcagtgtccctcagccatttctcagtcagcactgaagggttcttgtgtgattggtctactcttccaggtgacacagaggcccagctcccataagatgagatgtcttttccgaattagcttcgtcccaaaagatccaattgaccttttaaggagagatccagttgctttcgagtatctctatgttcaggtatgttaaaattttggcatgttttatatcaatgttgtgatataaactaactctggggctttgccctgaattctttaacttgaaatctttcttttttgtcccccacctcaagctcagtgaatcgtacgataattctatgatgctctttttatttttacgtttgattttgaaataacatcatacttccaaaaaagttgcaagagtagtcatctatacccttcacccagattcaccagttgttaacattttaccacatttacttgctctttagtatatacacgttttctctgcccacacaaatacacatacaaatgtatataatttttttctaaaccatatgaaggtcaattaccaaaataattctggtttactcctaaatacttcagtgtgtgttttctaataacaaagacattttcttatacaattattatacaagtaacaaaatcaggaaagtaaacattgatacatttccattatctcatctacagtttatatccatattatgcctattatcctcaaaatgtcttttatatatacattttttctagaacaagatgcactgcaggatcccattttgcacttagttgtcatgtctctttaatctccttaaatctggaacattcctcagcccttttttgcctttcacgaccttgatagttttgaggagtactagtcagctattttatagaaatctctcaatttgggtttctctgatgttttcttatgattagattgatgtcatacattttgggaagaacaacgcgagtgactttgtgtcctcagtgtaacacatcaagaggcacatgatgtcagtttatccctttaatggcaaaatgaacttcgactcttggttaaggtgatgttctccgaattcacccaaaagctactactattccttttgtaattaaaaagtaatttgtggagagtcactttgtaactcttttttttttatttatttatttattttgagacggaatcttgctcttgtcacccaggctggagtgcaatggcatgaccttggctcactgcaacctctgcctcccgggttcaagtgattctcctgcctcagcctcccaagtagttgggattacaggtgcctgccaccacgcccagctaatttttgtatttttagtagagacggggttttgccatgttggccaggctggtctcaaactcctgacttcatgatccacgcaccttggcctcccaaagtgctgggattacaggcgtgagccaccgtgcccggcctgtaactcttattatcttcttcatcaaactctcacccactagttttagtactgaatgatgatttttttctttttttgagacggagtttcgctcttgttgccttggctcaccgcaacctctgcctcctaggttcaaaagattctactgcctcagcctcccgagtagctgggattacaggcatgcaccactactccaggctaattttgtatttttagtagatatggggtttctccatgttggtcaggttggtctcgaactcccaccctcaggtgatctgcccacctcagtctcccaaagtgctggaattataggcgtgagccaccgcgcccagccctaattgattattcttatctgaatccattattataattgtggttgaaaattatgatttttctaatttcattattgcttctgcatttattaattggtatgatgagagttttcccttctcctttatttacttatttgttcattcatttgatgcttaaattattctgtaaaattgtgatattcattttactgaattgttaatttcaacgtggtaaaacttgaagagaacagtcttttccagactgatatctgattctgagctataattccccaaagatgaaagtttccaggaatgagtatctggtgtagtttgtcccaaagggaatttatccaagttgatatttatgaggtgttcctatattttactataactgcttcctattactctcacttaaatttccaatataatcacattaaacagtaagaaccaactgacctaatccttagacagcttagacatctagcagtagaactaactactcgaagaggttgcaaatctaaacataacctccccctccccactgccagaaagagagaaaaaacaaaaatgaagcaaaaaaaaaaaaaaaaaaaagacacactgtctttgagaatatctgtataaggcaaagattgctggagccatatataaaagatataaagcaaaaatgtaagaaaaatataataaaaagaagcatttgttaactctaggtagttaataacactggtgtttgctttaccatttccaatactttcctgtatatttcaaaacatttgtaatcttcaaaagctgggtagaaaaaaaagtaggcggaagatggaagagagactagacaaggtaggtatcagaggttaagaatggtgacataaattaaagtggcaataagccctgaagatcacaggttaagtcagacaggaaagacacagaacatacaagaatgttctagcagatgggggcactcagggtgaggccagtcaaattttccccacctcagtggtctttggaagactgtggtatttacagctcagtgggatgattaatgttcatgaagataaccctacatcattgggaaaagtcaagtcctgttcaatgaaccctgttgaccaagtaaagaaatgtgtagtgtgctttaaaatattttccaccccgaacaacgaaactgccacgttttgggttttttaaatgttaagctttgatcacctggacccctcacttgtcaacaatatctccttgtccccagcaggcgtgactgcatgaaacagagcctgattctcagctgatctgttactgcatcttccccatgtccctgctgaaaaccaacccagggctttgctactgcagctcagatcatgtgctacattgttagttgcaaataaatagttataggcgctggtcagtagtcgctgtagacagtgagtgcattcagtggtttttctctataattatatactcaccccattcacaagatggtgctttaaaactattttactctgcttccatttaaacatcacgagtccattgcatttataaaagaacaatgtggttgcatttgtcttggggagaggagacctcttaagtagacaaggagtacagctaaacccagttctgtttaaggtgtgtttgcacaaatctaatatagcttagggagatctttcttattcaacagacacatgttttatacatgtgagactgtcctcagaacacgaaaatgtgtctggaaatcttgcccagggactaacagaaaaagactgaggatgtttctgctttcttgccttgggtataaaataggcagtgaattagccacctcttcaaggcatagccagagggggaaaaatagaaaaacaggtatggtaggcaataaagaccaaaataaagcaactgtcatatatcctccgctgaaacaggaaatcagaatgtctttgcctcagaccctcttctttgaaatgccttgtatcacagaatgcgtgctaccataagtctaaaataacatctaatataagtcaacagatctgcaaatggtgtctgggtgcccatgttgatttcaagatactaaaaagatgcaataaaacaagcctagagaacaaaagagtaagcaggagcaacatgtatcactttacaaagataaaatcaatttaacttagtgggctcctaatgaggacagtagccattgactagatgaatcatgaaaacagaagttgcaatagtaatatctattaatctcctagttcttaatggtccatgacatattttacagattttagcatatatattaacaataaatgctaatagtccagattgttcaaatttatcattacaacgggctatactgacatttacctgtccactatctgttaagaaaaagactgttatgtcaattagcaaatgagtaagacctaagaggctccaaaatgttttcaaatactatagtactattggtttcctttttaagatctaacatgttagttataaatgaacattctggaagcctcaagtggagccttttgggacctctatttagcaaaacagatactacccatttgcttgtataactgtattttaagtaatacagttgagagcaataaaagcatgattagtaccaaatatatatatatttggaatatatatatatgttccaaatttcattctccaggatcagtctgaactaattatatcatgtaattaatcaccttgtcaaaaaattcatccagaagcctagttaaatacagggtaaagcagtgatgggaaatatggtcccagctatgactcttaggagaagtaatagtgatggctaatctttatcaagtatcttccatttcatgaaacatatttacaggtatcatggcaaccttgcgagttcattgctaactctcaagttagttgtttttgagacttaacccatttttccgataaggaaactgaggctgaagagagatgaaatgccatgttcgaggtcattttattagaagttgacagaacttagaatcaaacctggggcttttgtctctaaattctatgcccaaatcctctttcaatccattatggcatagcagttgctgaagaaaatgatttatcaaaatgatttctcaaaaaattgattcctcactgtgccaatggttttctcaccccatcctttatgggactgtataaaatgaccctatctaggctctcaaccccttggagctcatgtggacaaccctgagcacttggaaataactggtaaacccaagactagcaaaacaaaatggcagcctgtaattgctctcggaggctgccttaaatcagaccaccctatctcctgtctctggacagacccacttctgacaaggggtgctgtgcaatccaaataggtttaagattttaaggagaagcaaaggtggaagatcacattagggatgaacaggtgagagaatgtgacttcactcttagcagtgaagtgatgggctgagagacatgcacccatggcacgtggatacagagcgtgcacgcacggcacagcaccggtgcagcatgggtgagtgtgcacagtgtaaatattgtatgcagaagccatccaggggtatatgttcctattttagtaaaatcaatataggaagcggttataaatgtgcttctgttggaaaggaggcaagcaaatcttgatatagtttttcatttgaggccaagggcccacagaagtttcactaaaaaatcaagtcaaaaaagacaaatgaattagagaaaaggcatacaaatatatttaacgtatatccatgggagccttcagaatgaaatcccaaagatacaagggaaattgtccatttttatgctaatgttcaacaaagtatggatagccatgtagaaataggattggactaaaagggcctgacctaatgctaacggactgaatgaagaaacctagcaaggcctagattcttcttggcctctctgagcagcgttccttccttctgggtgtggggcaggaccctttctggaatgggagtcttatgacctacaatcaaaccatgttggtcagataatttctttatggccagtctttacacagggcagagggaaaattagagtcatatttttaggttttaaggctggctttggggaaagggggttctagtttctatgacccaccttggggaagagggattctagtttctatggctagcctccagggataacagaaattaaaaaacaggagggcaggagaaggtcaaagaaatacttttgtttctgaggccttcattttgggatattgttttttgagctccaacaaaatattcttggggcaagccaaagaataaagaaaaggaggaaataagaaagaagctaaataccatattttctagcccaggaatccagtttcccataacaaaagtaagtgaacgcacgtgtagaatatgcctaagcaatgcagcgcttcccagcagcacttagctcactgccttgtgtctaagcagtaagtgaggatactactccaaagccaacctctgttcccatgcagcactttacacttgatgacacactctcagccactcttcaatttgatccccacaacaaaccctgtgagataggtgaccttattctacagatgaacaaactaaggctgaaagaggaggaatgactcccagaaagtcaggcacttgaaaaagcagggcagttgccattgaagtgaacagaggagttcaatagctccccttatccaaggtaccaatgtgctgtgataaagcacttgatgtgcacctcatctaatcctccagccactccagtgagatagtatgaatcccgtttgcacagatgagtaaactgaggctgcaagagttaaagtgaatggtctaaaattacttacacaggtagccactgggaaaggcagaacgccagaacaggtggatatgagtcccaagccactgtgctcactcaccgtgctaattctgcctccctgcagctgctgtggctgataaggaggaggaggagaatgatgttagcagtgacagtagtaaacatgtaagagggcttacaccctgccaagtacggttctaagagcttttggggttttgttttggcttctttttttttttttttttttttttttgacaaggtcttgctcttttgccaaggctggaatgcagtggtgtgatcaaggctcactgcagccgcaaactcttggactcaagcgatcctcctgcttcagcctccctagtagctgggactacaggcacacaccaccatgcccagctaatttttgtgttttttgtagagactggatttcgccatgttgcccaggctggtcttgaactccagggctcacgtaatccacccgccttggcctcccaaagtgctgggattctaagaacttttcatggttcactcatttaatggtcaccacaacccagtgaagagggagcagtattatccccaatttacagaagagaaaactgaggcacagacaattaagaaggtgcccaagtttgtgcccctaatgaagtggagaaacaagtttcaagcctaagattccaattccggcagcctaactccagaagccacattatgctatcaatgctgtgtgcattcaactgcggcacctgtgtttggaaatttcatacctaaattcctaattgtttttacaaaaagctaaatatttaaatagcagctcgtcgatgaatgctaaatgttttgtgtggtctctgtgtttgcgcttgcaattcaatactgactcgtttccaagcagcacggtggagatgtttccacatttagcctccttgcctgggaagtgaaggttgaatcactcgggaaatgtatgtcacctgttctgtaagtccacgcgctgcggcctattctttgacaagctgtgccccctgctggtctcttcgcagagttgtaacgatgtggttcaggagcgatttgggccggagctgaaatatgacatagccctgcggctggccgcattacaaatgtacattgcaaccgttaccaccaagcaaacgcagaaaatctccctcaaatacatcgagtaagtgttgactctcagcgccatttcggagacagacatgccgcctcccttagcccgggtgtatttttgttatttgtccaaaattgatcttgtttgtgtcaaagcattcattcgccagtggcaaaatgtatgaatatcatgctcatttctggcagaagagatccatttctaatccacctttagagcattgtagttaagatgagggacatatttaaaacgaagcataaatttttgaattcctaaaggggcttgattccaagccaagctttggtcttagcacttttcacacattaatttgtttaattctcacaacacccctatgagattagtaggattttagcttcattttacagacgagcaaaccgagtcatagaataacttgcccaagtcaaatggctattaacgcggggatataggattcaaacccaggcagtgggactccccgttgtgctatagattgtgtgatgggttgaggcacctgtgtttggaaacacatgtaatgctaaagccttggacctccccccacaccctgcttacaatctcacctccaaaagatgtataaactaattaaaatcccactttccaaagaaacttctcatgggctgcctagaaagcctttctaaattccacaatgccaggttcacccaccagggggcaaaatggcttttctcaataaattcatgagcctgtgttgggaaggattaaatctccaacttgctgacttcaacaccactgttctgacaactctcagtcacctgttgacatgtagggacaaatcctcatatgcaatttgagaacctcaggccttcagttcactccttccagatgctttctctctctccccacacataagcgtgactgtagcctgagaaagacttggctcacaaagagatctcgtgctcagctggacacattcacacactcttccactctcctttttaaagttcttggggacaggtgaaactggctgccatttgaaaaggtggcctgcacaaccggagttgattttcagacaattaaaatgcatttcttttcctactttgtgtacccacattttaccaggttgaacattgtatggtcaaaaacgtctcagagatatctggcttgagtaagaatcctgaaaagtctgtaataatgttctcattcataaattcctttgaccaacaaatattcattgagcattttatatagcactcacattaggatagtagaaaatactaatatgtatgaattatattcctggccattgaggaacttgtggtctgattgtaaaaacaagatataaagataggaaaagtaattatttaaaataatgatacaagtaggattacaagaaagcccataagtagtgccaaatgatggataagacaataagtacaagttgagaaggaagaaaacataatgatcatgaaatataccatcttaactagtgaagaatatgaatggtcaagtggtgggggtaggttgtcttcctacccttctttggagaggacctagaacaggagaaataactggaatcctcttgaaggtcttcacataatttagaagacactggttagacacataacctagggtaggatttctactccaggatagatttcctagaattcaaaatatgggaccttcttagaagggggtggtagtcgtttctggtgaaattggctctttgtaaaaatgtattaactcagtcccatttgttgttgttttgttgtacatccacgtccatgaatgagaacagcatctccacatcaatactgggcacacttaagagtcatgaatcacacccaattccacaccaccagcaagaaatgttgatggagggagttagacaggaactggctgggacaaaagaactgtgtgtgcctagagaaatagccatggaggaggggagggacagggaagaatggtttggggacatgaaggacttgcatccattcttctaagagaggaagaatatgagcagacagggagattggagaatagaaatcaacaaagggatggagagaaattggtgttggaaatacaaactcggatacgtgagtgactttgaagagattcagaagttggttggacaaaatgtctcttcactttacattggctccaaatgcctccttagcattgtctctagagaatgaggaacagatttctttttaaatgcaaacatgtgtattaatgatcaagtagtgtgtgtcctgagtgtaaattaaaagttacttcctttggggacttgtctccattctctgcctcaccaagggttcatttgttccaacaaacatcagagcaccattttgtcttagataactcatcatcacagaaatgtgaaattaaagatatgctctttattgcagaaaagaatggggattagagacttttcttccctctgctgtgctgcaaagcatgaaagagaagaacataaagaaagcactttcacaccttgtcaaagcaaatcaaaacttggtaccaccgggtaaaaaggtatcacatttccatcttaaaagaaaattataaagagagaggcttgaatgcattttttaaatgtttaaaattagctcatgaataaaatacttagtaccatattttcagaagcagtaacactgtgtaacttttttctaactattaacatgtttctaacactaatgaaaaataagtattcatatagaaacctatttctttctcacaagttatggactccgtactgtagcagggaggtatgtgttcatgtgcccatccaggaaaagtttgcgtagcctctgagaccttgtggatagaagatagaattgtgaaatcattctatgtttcaatcatgcaattgcttactgctcagaccagcttcaatgcacaacagccagcaagaggccctgcaggccagaggccacattaattaaaccagggatcctcaactgtggcgtaattgacatttgggaacagatcattctttgttagggagttacggggaacatcctgtgtattctgggatgtttagcggcacccctggtctctacccacaagatgccagtagcaccctcccgtgatcgtgacaaacaaaaatgtctccagacattgccaaatgtgctcccgggaacaaaatcacccctattgacaaacaatggattcaatcctacctttggagggaagataaaattattgctgtcattcaccatcattagtgttaaaatctttttatgcttttgtttttgttttcattaagtaagagaaacacaaaggaaattttaaaatatactgttggtcagaaaagagaggtatagtttataggtaataaaaagcaaaggattccaggaaccagaaagagaaggagccttaaaatactggatctataaaattggaagcagtcttataactgaagaacactttccaattgatattagctggagaaatttgtgtgactctaatacaaatcactgtttacgtggagaaccattttgtcttagtatctgatttttttaagtcatttttactgggtaaggtacatttatttctatcccctcctcaccccacgacaatttttttttttaagtataatcagtttcaacacactatcagccacctttaactcacttcccaatttcatgggaaggatgtctttgatcacagtgagcattcagcttacagagatgtagcaagatgatgtgggtcaagttctttttaacttcagttctgatttgctggaagctaatttctataattgacttgtgatttttttttcaagcctggcccactcgtaataatttggataactgctataagatcaatcaacctatccatttatccatcactgtcctttaaaggttgtttttctagccaagagtgaatagtttgctttcaaaacaatttgcaaatgctttgcatttttgaaagaagtaggatggatgaatggtgctaagtaacaattacataaagagcagtgcctttatgtatagttaacaaataagttggcaagccatctgcaagtgaaaatagaattttatggtcattgccacttaatggtggtctacaccttgttggaaaatttcaaccttaataaacatccctggcacattcagtatgaaacatggaccttttttttttttaaatcaaatactctttttagtgatatgggatcctacatttttaagtctttgtaaagataacttttatctggataaaatttcatttataaatcacttgtgaaactcaacagattttccaagttgaattaataaaacagagccttatttagcaagttcaaacatttccacaatgattggctctcagaaagttcatttcccccgaaaacttgcaaggactggaagaaacttgagaggggaagtgtaaagggcctgtttagaaggctttgcctagattgcaggtgcgtattcaaaatgattcccacaaagtctgcattcaggtgagtctcttgtgcaatgggaatataggtagacacctcacctttgtccctaattgcaagtagaaggcccactcacctcttgaaatctcccagtgagcagatgttcaatggaacattttatggtcttgttctcacttgctgagtgccctggcccagcatatctatacccatgagtgccccatacattgaccccctaataaataagatttgaatcttgattttatgttccagtccttcatcaggaaaccaaatatgtagcaattttattcctaatgaatagtctttgtcacatctcaacttttcagccgtaaaatcatccttctatcttacacttgttttctgctagtctccagctgaaatggagtcatacccaatagagttaacacctgaggtttcttttctctcctcagctctctgcactacaagccaaggtccattatctcaagttcctcagtgacctacgattgtatgggggccgtgtgttcaaggcaacattagtggtaatttcttttttttttttttttttgctttctcttggaagccacagcagctcattccgcctctgatgacaaaagcaaatcagctgtgaatcttctccagccttcatttctaaccaacttcacaacagtctgaaaatatcagaagaaatgttaaactagataacaccactgcagaatgccctagaaaaagaaatgtgaagaaccgagagaatcaaaggattctaacaatggccttcttttaaatcattgagccagaagttgctttcacagtgaaaaaaggaaaaccaaaaagaaaaaaacaaacctcatttctaaaaggatcttatgattatgaacatactgtgctataacatttactttctaattactcatgatttatcagagcctcaattcagtcatgtatctggttcttctaattggatgatttagtacagtatgacccagaaacactttctaaagaaaatataatcttataaaaataggatcataggttcaagttggcatagcatttcagaggttcagtatttttatgttgtcaacttctctttctcagcaggcagaaaagcgctcggaagtgactctcctggttgggccccggtatggcataagccatgtcatcaacaccaaaaccaatctggtggctcttttagccgactttagccacgtcaacaggatcgaaatgttttccgaggaggagagcttggtgcgggtagaactccacgtgctagatgtgaaggcaagtttctcaggtgttgacacatggccttgctgtcaacagctaatttctgataacactgcagatgtttacaaggcaggcaaaagtcaatgtgtgcagagcatcacagatgcaatgtggtgcagaaaataatccaccaactcaggcctgagggctccagtcctcactaaatcgctgtgtgattgggaacaggtcgctataattctctgcgctcaatttttttattcatacgtgagaaagcaagctacataatttctaggtcccttctgactttagaatatgtgatttctaggtatagagtaggggaaacttttctgaactaactttctagaatatatgactcaaatcaagagggagatttttcccaactttctttagaattctcactccctttgcttacgttaggtccatatgtgtttattcttttggaaaagcttgatgttttagttcatctgtcttctcatatggtagcaattggtactgactgaacatctggctcctatgaatgtcatggccattccatttaaaacaaaaatctggccaggtgcggtggctgatgcctgtaatctcagcactttgggaggccgaggcgggcggatcacgaggtcaagagttcaagaccaggctgaccaacatggtgaaaccccatctctactaaaaatacaaaaattagccgggcgtggtggcgtgcacctgtaatcccagctactcaggaggctgaggcaggagaattgcttgaacccagaggtggaggttccagtgagccgagatcgtgccattgaacttcagcctgggtaacagagcgagactccatctcaaaaaaaaaaaaaaaacacaaaaatctgagatggtccacaaagggcaaaactctactcccaaaagagaataggaaatagtccaggttcctggtctccaccttcttttcccagtagagatgagttattggattttggcaatggcagtatttctactgtttctatgaagaaaaggcacgggaacaaatggagatagtgactccacaaaggagacaacaccagcctggagggtgctctgaaaatagccagggaggacccagccctacctgcctccccactagggtgctggtgtgggaggagtggattaacagccattgagaatgtggcaaagcgtttctacaaagcacatcagaatacactagagagctctgcagtgggaacagatgatcacgaaagagagaatgtggagctcagacatgctggctgtgacctgtaggacttcatgggctggatccagagggttttcatggcaagctgaaagtgtgaggatagacttggaatgctaatcctactccatgagcaaagaggctgagagaaatagccccatcacagagaaaggtggatgaaagggtgaactggatgcagttattacagatccgatgacagagataatctgtcctaaacagaaatgagtgtcgtgcccggccgatggcgtcctgcctatataaaataatgatgcggtgccttggaggctgaggggagacctcaactgaagtggaaggaaaggcagttcaacaagtagtacaggggctttggcaggaaagttaaattctacgagctgggggcgctgaatccgcccagtgtcctatacctaggagtgaaagcaagaggcctgctgtcttgctgtctttgtgcctctcttcatatctgctttttcttgcttccttatttctctctcactcactttttctctttcaacaaaaacacatccttcctaactcaatgagaaaaattgcttcatccaacacttttttttccctataagctccaaatctatgtccaattgtataataaccttattgtttcaagagagttttagtgaggccttttctcaactcccatctgttttaccctcctgtaaatttacgatttcatctagaagcaactttttactggatctctggcacttttcattcagtcttagcagtaatttccacttgaattttacctctaacactaatttacaccgtgaacccaaaacttaatcttcctgtaattttcagattgtgagttcactgctggtaactgaggtaactggtaacttaactagttaatgttaatttaccagtttaacatgtttaattgtctttaaatgttaaaaatgttaattatttgggaagaagacaatctcattttttttcatttcaatatgactgggggtccaggtgcggtggctcacaccagcaatcccagcactttgggaggctgaggtgggcggatcatttgagatcaggagttggagaacagcctggccaacatggtgaagccccgtctctactaaaaatacaaaaattagcctggcgcggtggtgcatgcctgtgatcccaactattccggaggctgaggcataagaatcgcttaaacccaggaggtggaggttgcagtgagccaagttcacgccactgcactccagtctcggcgacagagcgagaccctgtctcaaatatagatagacagatagatagatagacagacatatatatatatgacttggaagagattcaaaatgtccaggctttttagagggtgtgtcctgaatgtttttcagtaaggcactttgtgttatccttggctttttctcctgctttgggtttctcccatgaaatgtttgttcaataactcctttttccataagcataaatgcagctgttgacactccagggatgttattaagaatggatggctttaaccaaagtgttctcttttgtgtagcctatcacgcttctgatggaatcctcagatgccatgaacctggcctgcttgacggctggatactaccggctgcttgttgattccaggaggtcgatatttaacatggccaacaagaaaaacacagcgacccaggaaacaggtattctcttcctgaactcatcaagcactgacctccctgcaaacaccccacctgacaacaataataaggatgttttctgaaaagttaaggccaggcgcggtggctcacgcctgtaatcctggcactttgggaggccaaggcaggcggatcacgaggtcaggctttcgagaccagcctgaccaacatggtgaaacaccatctctactaaaaatacaaaaattagctgggcatagtggcacgcacctgtaatctcagctattcgggaggctgaggcaggagaatcacttgaacctgggaggcagaggttgcagtgagccgagatcgcaccactgcactccaatctgggtgacagagtgagactctgtctcaaaataaattaattaattaaaattaaaattaaaaaaagttaaaattgtacccacaaaaaaatcaaatgtccaaattcaatgccaaaagccttcagatacctgtgatgtgggctaattgttaaaaagaaaaatgctgatttctcaccacatttgacacatcactcagaagtgtcagggtgcttgctccaaccttgattttattatcatgaaagtctctatggctgggttttcatggccttactcttacagaggtcagggccagaggactaatgatggaatgcccgaacacgagttgtgagcccctgctttagggctggtctctcctgatggtgtcctaggcccgggtgtctgggagcctcctccctgtagtcagacttatgcccaggattctgggaactttacaaacaggaagacgtggttattgcctagcactcggacttgggaacactagaagaaaattcttccacattggcagccatcttggatccataataggagcaccaagatggcaaagacatcaaataattcagttcacctacttgacagaaaaaaagatccccacaacgaggacagggaaggctgcaaatgttaaattgattattcctttgacagtaggtggttttcattggttttagaacattttttcttcagttacttaagcattttactccatctacagtggatgcttagtaaatgtcactgatggacagatgccaccattctaggcacagccactgagccattaaaaaaaagtataatcagagtttccataattggggtttcttttaaaagaaaggggaattcttaaaaacaaattttactgttgcttctctttttctctcccttccccccaaccctgccccccgccccaagtccccggcatttatcagagaaaatgaggggagaaaaaaagggaaggaagttctgtcactgttaaattgagcataaacatcaatctttattccataaatatactgcaatatgtagacacacttaaacacgcatacagactcacacacagtttattatgatggccaggtgaatggaagcagctcagtcatagaaaaagggaagctagaaacaaggagcaatggataaagcatgttagaaggcaacacctggactttcaagtcaaataaatctgagatttaatccagtcccatcttgaggtatctgattttttttaatttctctgagcttgagtttcttcatttgtaaaatgggatttaaaaactagcttgcaagggttagaaaaataatctaggtacatcatctaaaatgatgctcagcatttctattaataattagcagtgaaaaaaaaaaaaacagaggcagaaagaacccagaatgaaagagatagaagccagatgcagtggttcacgcctataatcccagtgctttgggaggctgaggcaggaggatcacttgagcacaggagtttgagatcagactgggcaacacagggagacatcgtctctacaaaaaatataaaaattagccaggtgtggtggcacacgcctatagtcctagctacacgggaggctgaggtgggaggaaaccttgagcctaggaggtcaacgcggctgtgagctatgactacgccactacactctggcctaggtgacagagcaaaaccctgtctcaaaaataagtaaataaataaattagaacgtgatagaaacacagaaaggagagaaagacagaacatgaggcaaagaaagctcctgagagacacaaatgtttaaaaataaatatagaaaaagaaagaacaaaaaaggaggtgataggcgtgcactgggtttggcagtaaacatttttatgaccacatgttttcattgagctaggagatttagagcaatttaatgctgaccttagaaattccaaagaaggctgggcatggtggctcatgcctgtagtctcagcacttggggagtccgaggcgggtggatcacttgaatccaggagcttgagaccagcctgagcaacaaagtgagacactgtatccacgaaaaaaatttaaaaactagccaggtgtggtggcatacacctgtggtcccagctactttggacattgaggtgggaggatcatgcaagcccgggaggtcaaggctttagtgagccaagcacactattgcactccagcctccaggctggctgacaaagcaagatcctgtgtctaaaagaaaaaaaaaaaagaaaagtaaagaaattccaaagagcagttcagcaatttgacacaattgtttcccactggaaaaccaatttttggctttttattttcaaattttaaagtttatcttgaaaataaatcctttcctcatagactgtaaagattgtagaggtgtatgaagaaaaccaaagctactattctaaacatgcttacagtaataagggtctccactctgtccaattcatagtgacccacaacataaggtttaatagaacttagaggcaaaaacatagttacaaaaagtattattactgtggggaaagaatgggacttcagcctcaccatcatttctcccggtttcaaatacctatccccactctcaaagatacagggcgggaggtaggtggagagagagagagagagagagagacagagagagagaagcgaggataacagagagagagcacactccaaaaagaaactgatagacctaggttgagcagcagtctgggctcagcatactctaagggctgaaagtactctcttctcttcagaaactcccaaaagatctgagagccaagaaatacagagcggaagtcccatcaggccagttcttccccagtccattctctccttccactctgtaggagactgggccacagaatagatcccagcccccaaaccacattcttccttgtctccaaaattattccaggaagccaaatcagtagacccttctggaaggaagccagattgaacacatattttcttctcacctcaaattgatcccagatcttagtcaagatatctaataagaaacagcccccatttcttcttctctatcttgaaaattagccttcaagcactttcaaaatccctggccccacatatgtatgcatctctgggctttaggagggtctcagtaagtatccatcaacttgctttgagcctgctgacctattcagttttcttgttcatctaaatcagagttggcaaaactatggtcaatgggccaaatcatgttcttgcaaataaagttttattggaactcaaccacacacattgttttactttcctaaggctgctggaacaaattcttacaaacttgggagctttaaacaacataagtttatcctcccacagttttggaggccacaagttcaaaaccagaatgttgatagggccatgctcccttcaaaggctttaggggaggatttctcgttaccgcctcctgcttctggtggccgccagcattccttgtggctgcttaactccagtgtctgcctctgtcttcacatggccttcccctcttctctatgtggcccaaatctctctctgccattgaatttagggcccataaagataattaagataatctcatctcaagatccttaacgttgcaagacactttttctaaataaggtcacattcacagagtggacatatcttttgggggccaccattcaactcatacacccatctgtttatgtagcatctatggctactttcatattaaaacagctaagttgagtagttgctcaattgaatggttggcccacaaaaccaaaatatttactatctgggcctccctttacagaaaatgtttgccaagccctaaacccgcgttacaatgcaactttgctgaactagtcttcctcctgcaacaatccacactcacacacacacttccccccacacgcacacccagtcataatccaaattgttgttaataaaataatgctgaacccccacaaggtttatttattgtatggtaagatgcaaatatggccagtgtataattcaatgtcttcaaaattatatctcttattgttcatgaaaatacatgaatttattaaaatgaccctgaacactgttcagcattaagtccattgcatgatttgcggggagcaaaaatctcttaggtaaaactgcacttttttcccatatgtcttgcacatctgatgtcagttatccaaacttgtgctgggggcagtttgagggaacagatgggagaatagtatggccctaaaattttctggaaatgttgcctctggaatctacaaggcaatatcaacagaatgacccagttctctgtcttgttaaatatcagagcaaatctccacatcaaaattccagattgaaagatgcttgaagagcaaacaaaataatagtatttaaattggggttttgtaattttaatccatgaggaacatgaaacaaattttcaggagttcctatgatacaaacaaaaattgaaattaatctaaatattaattatgcttagaaattacagagaaaagtacgttacctgtgaccatgccaccttatgcattttatacacacacacacacatatacacatgggcatgcatgctgacatttatacatgaatattttaacatccactaggatatcaaaagactgaagatagaagttttgtactatcattacaacatttatcttaatttcctaaaaactatggtaaaactctgacgatccttgaccgtctctgaattcaatgaggaaaacactcaatatcttcctccatgaagtagggaatattaaatctcaccttacaaggaaaagaacaattaatgttctggaataacggcctattgaaatctcacctttaagggtaaaagacatgttgtatatttacatttgtagatatgaatgaagccttttaataatagaaccaagggtcagatggaattaagctatacttccctacccccagatggtattacattttatcaaatagcaattacagtttatgcagtatcaattttgttaaggtcggttctcctaacccaaggaattcttacacctgaagcctaaatcaataagtactatatttgggtagttgaaaaactgtatttacataagtgatgctacaagccattaagttaaaaaacagagacgagcctcccacccccgccccacccaaaaccagacagtacagtaatgtgtctttgcgtgattctttctctttaggacctgaaaacaaggggaagcataacctccttggcccagattggaactgtataccccaaatgaccacctttattggcgaaggggaacaagaagcccagataacatacatagattcaaagcagaagacggtggagatcacagacagcaccatgtgtccaaaagagcaccggcacttgtacatagacaatgcctatagttcagatggacttaaccagcagctgagccagcccggggaggccccctgtgaggcagactacagaagtctagctcagcggtccctattgaccctctcaggaccagaaactctgaagaaagcacaggaatctccgagaggagctaaagtgtcctttatttttggagacttcgccttggatgatggtattagtcccccaacccttggctatgaaacgctactagatgagggtcctgaaatgctggagaagcagagaaatctctacattggcagtgccaatgacatgaagggcctggatctcactccagaggcagagggcatccagtttgtggaaaattctgtttatgcaaacataggcgatgtgaagagcttccaggccgcggaggggatcgaggaacccctcttgcatgacatctgttatgcagaaaacactgatgacgcggaggacgaggacgaggtgagctgcgaggaggacctcgtggtgggggagatgaaccagccggccatcctcaacctgtctgggtcaagcgatgacatcattgacctcacatccctgccccctccagaaggtgatgacaatgaggatgacttcctgttgcgttccttgaacatggccattgccgcacccccacctggctttagagacagttcagatgaagaggactctcagagccaggcagcttccttccccgaggacaaggagaaaggcagcagcctgcaaaatgatgagatccccgtgtccctcattgacgctgtgcccaccagcgccgaaggcaagtgtgagaagggactggataatgccgtcgtctccacgctgggagctctagaggctctatccgtgtcagaagaacagcagaccagtgacaattcaggttctttcacaattgttacattcattcactgataaccatatcattccatccttccaagccatttgcccctggagtcctgttacgtggtgttctccatttcacacatgtcccatttcataaatgtgctgaaactgccatcatgggtttttttgtgtgtatgtgatttcctttgttatttttttttaaaaacataaggcacatctccccccacccccatttctggaaaaactgcaataaactcagagtccttactgaaaagggaaaaacttggtattttgttttagtaataacgagtcccattttcttacatgtctccaagtgcctctgatgcatccattaatcagttcttgttttttacggcatgcaggtgtagccatcttgcgggcttatagtcctgagtcttcgtcagactcgggcaatgaaactaactcttctgaaatgactgagagttctgaactggccacagcacaaaaacagtcagaaaacctctcccgcatgttcttggccactcacgaaggctaccacccccttgcagaagagcagaccgagttcccggcctccaagacccccgctgggggcttgcctccaaagtcctcgcacgccctggctgctaggccagcaaccgacctcccgcccaaagttgtgccttccaagcagttacttcactcagaccacatggagatggagcctgaaactatggagactaagtcggtcactgactattttagcaaactgcacatggggtcggtggcatactcctgcactagcaaaaggaaaagcaagctggccgatggtgaggggaaggcaccccctaatgggaacacaacaggaaaaaaacagcaggggaccaaaacggcagagatggaggaggaggccagtggtaaatttggtactgtgtcttcacgagacagtcaacacctgagcacttttaatctggagagaactgcctttcgcaaggacagtcaaagatggtatgtggccactgaaggtgggatggctgaaaaaagtggattagaagcagcaacagggaaaacctttccaagagcttctggtcttggggcaagggaggccgaagggaaggaagaaggagctcctgatggagaaaccagtgatggctcaggacttggtcaaggggaccgcttcttaactgacgtgacctgtgcatcttcagccaaagacttagataacccagaggacgctgactcgtccacctgcgaccatccttccaagcttcctgaggctgatgagagtgtggcccgcctttgtgactaccacttggccaagcggatgtcatcactgcaaagcgagggccatttttctctgcagagctcccaaggctcttcagtggatgcaggctgtggcacaggcagcagtggcagtgcctgtgccacacccgtggagtcgccgctctgcccctccctggggaagcacttgattcctgacgcttctgggaaaggcgtgaattacattccttcagaggagagagcccctgggcttcccaaccacggagccacctttaaggaactgcacccacagacagaagggatgtgtccacggatgacagtgcctgctctgcacacagccattaacaccgaacccctgtttggcacattgagagatggatgccatcggctccccaagattaaggaaaccacaggt

SEQ ID NO: 3048 - DNA, 2119 bp, human
caactcggtggtggccactgcgcagaccagacttcgctcgtactcgtgcgcctcgcttcggtgagccccagggcccctgcctccttcctcctgccgtcctgcctccgtccccgccctttcatcatccgcgtccctgtgaaggcattccctaaatccgagcccgagtggttctccccgggaaggctactttggggagctggggggatgcgaaacaccctagatactggataatggggtggggaaatcgatgatttaagaacaaaaccgaaaaactggcgttttgccgtgccgctcggaggggacattaaaaaatttcttagtgtttgcccgcaaaggtattgtgcgttgccttggaggctgagatatgggggaatagacaagtcctttgttctgaggttcatcttccgagccccgagcctcctcccagcctcggacggctgcgcgggctgcatctgtgcagcctggcggcggcggggctgtgctatgacatctttacagtccttcttgcagagacatgtgtgccagggatgccgaattgccgggagagcaggcaagaccggcttcggggcgcgcggcggccgctttgtgtgcggggctgcattgtgacgcgggcgatgaagccggtagggcggtggtcggaagctccagccgcggccgccgcctttgtgagaggactagaaagccggatccggcccgcatccttgcggagaggccgcggctaggaaatggaaacgcttttcctacctgggctccattttaggaattcttgccgatttttcccacttgaatttggaagtggctttcctcttctttccttgtcctagccagcctttaattttaaacgctgtaattaacaattcgcagtggtcaatttcctttattctgcaagattcggctttgagaggcatccgccctctttggtccacagcgttttgaaatatggggaggaggggcgcggggggtgtcgcctctttttctgtagaaagaggaagctcgtgagcgcggaacggcagcagtaggagagcgagaagggtttttttcaggctgcgggtcggagggcagaagtgcagttcccagcccagagacagcggggcgggtggctcttcctcacgctcgctcttggcttgctccctgcagcttttcctccgcaaccatgtctgacaaacccgatatggctgagatcgagaaattcgataagtcgaaactgaagaagacagagacgcaagagaaaaatccactgccttccaaagaaagtgagctccgacccacccccatctttagaaaggctgggtgggagcggccggtgggagggcgggaggctgggagcggccgcgggaagaattcgggaggggggagtgcgggggaagagccgacagttgatgaatgtggcttgcaaaggttaattaaaaatggttttgcagccaacaaacacggggctttagtaatttagtaatggaatatttaatatgccatattaatatacaaacatttatccattaaaatgtatttctatttagtatattcaatatacatattttattccattgtggaataccgtgtagaatgtttatgatttgaaaagatgctttaaatgaaagccctttagtctgtactgaatcctttaatcatctccctccatcttttttttttttttttttctggtcacagcgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaaactta

SEQ ID NO: 3049 - DNA, 1983 bp, human
tgaaggcattccctaaatccgagcccgagtggttctccccgggaaggctactttggggagctggggggatgcgaaacaccctagatactggataatggggtggggaaatcgatgatttaagaacaaaaccgaaaaactggcgttttgccgtgccgctcggaggggacattaaaaaatttcttagtgtttgcccgcaaaggtattgtgcgttgccttggaggctgagatatgggggaatagacaagtcctttgttctgaggttcatcttccgagccccgagcctcctcccagcctcggacggctgcgcgggctgcatctgtgcagcctggcggcggcggggctgtgctatgacatctttacagtccttcttgcagagacatgtgtgccagggatgccgaattgccgggagagcaggcaagaccggcttcggggcgcgcggcggccgctttgtgtgcggggctgcattgtgacgcgggcgatgaagccggtagggcggtggtcggaagctccagccgcggccgccgcctttgtgagaggactagaaagccggatccggcccgcatccttgcggagaggccgcggctaggaaatggaaacgcttttcctacctgggctccattttaggaattcttgccgatttttcccacttgaatttggaagtggctttcctcttctttccttgtcctagccagcctttaattttaaacgctgtaattaacaattcgcagtggtcaatttcctttattctgcaagattcggctttgagaggcatccgccctctttggtccacagcgttttgaaatatggggaggaggggcgcggggggtgtcgcctctttttctgtagaaagaggaagctcgtgagcgcggaacggcagcagtaggagagcgagaagggtttttttcaggctgcgggtcggagggcagaagtgcagttcccagcccagagacagcggggcgggtggctcttcctcacgctcgctcttggcttgctccctgcagcttttcctccgcaaccatgtctgacaaacccgatatggctgagatcgagaaattcgataagtcgaaactgaagaagacagagacgcaagagaaaaatccactgccttccaaagaaagtgagctccgacccacccccatctttagaaaggctgggtgggagcggccggtgggagggcgggaggctgggagcggccgcgggaagaattcgggaggggggagtgcgggggaagagccgacagttgatgaatgtggcttgcaaaggttaattaaaaatggttttgcagccaacaaacacggggctttagtaatttagtaatggaatatttaatatgccatattaatatacaaacatttatccattaaaatgtatttctatttagtatattcaatatacatattttattccattgtggaataccgtgtagaatgtttatgatttgaaaagatgctttaaatgaaagccctttagtctgtactgaatcctttaatcatctccctccatcttttttttttttttttttctggtcacagcgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaaactta

SEQ ID NO: 3050 - DNA, 2116 bp, human
actcggtggtggccactgcgcagaccagacttcgctcgtactcgtgcgcctcgcttcggtgagccccagggcccctgcctccttcctcctgccgtcctgcctccgtccccgccctttcatcatccgcgtccctgtgaaggcattccctaaatccgagcccgagtggttctccccgggaaggctactttggggagctggggggatgcgaaacaccctagatactggataatggggtggggaaatcgatgatttaagaacaaaaccgaaaaactggcgttttgccgtgccgctcggaggggacattaaaaaatttcttagtgtttgcccgcaaaggtattgtgcgttgccttggaggctgagatatgggggaatagacaagtcctttgttctgaggttcatcttccgagccccgagcctcctcccagcctcggacggctgcgcgggctgcatctgtgcagcctggcggcggcggggctgtgctatgacatctttacagtccttcttgcagagacatgtgtgccagggatgccgaattgccgggagagcaggcaagaccggcttcggggcgcgcggcggccgctttgtgtgcggggctgcattgtgacgcgggcgatgaagccggtagggcggtggtcggaagctccagccgcggccgccgcctttgtgagaggactagaaagccggatccggcccgcatccttgcggagaggccgcggctaggaaatggaaacgcttttcctacctgggctccattttaggaattcttgccgatttttcccacttgaatttggaagtggctttcctcttctttccttgtcctagccagcctttaattttaaacgctgtaattaacaattcgcagtggtcaatttcctttattctgcaagattcggctttgagaggcatccgccctctttggtccacagcgttttgaaatatggggaggaggggcgcggggggtgtcgcctctttttctgtagaaagaggaagctcgtgagcgcggaacggcagcagtaggagagcgagaagggtttttttcaggctgcgggtcggagggcagaagtgcagttcccagcccagagacagcggggcgggtggctcttcctcacgctcgctcttggcttgctccctgcagcttttcctccgcaaccatgtctgacaaacccgatatggctgagatcgagaaattcgataagtcgaaactgaagaagacagagacgcaagagaaaaatccactgccttccaaagaaagtgagctccgacccacccccatctttagaaaggctgggtgggagcggccggtgggagggcgggaggctgggagcggccgcgggaagaattcgggaggggggagtgcgggggaagagccgacagttgatgaatgtggcttgcaaaggttaattaaaaatggttttgcagccaacaaacacggggctttagtaatttagtaatggaatatttaatatgccatattaatatacaaacatttatccattaaaatgtatttctatttagtatattcaatatacatattttattccattgtggaataccgtgtagaatgtttatgatttgaaaagatgctttaaatgaaagccctttagtctgtactgaatcctttaatcatctccctccatcttttttttttttttttttctggtcacagcgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccatttttttttttgttcaaatgattttaattattggaatgcacaatttttttaatatgcaaataaaaagtttaaaaactt

SEQ ID NO: 3051 - DNA, 37253 bp, human
tcccaaaagttgtttgatagtatacaggcatgagatggtgtgactctaactcattagatgccttcgtcttttcagtcatgtaagtaatgaatggtgttttcaaggccgttacataaaccttgtttatggcatgtatgcagtttaaaaattaaattatccctactactaacaggaaccatgagtttttaatgtatttttcttttgagataatgtgtatttaacacttgtactgatagacatatatgcaggtatcttgctattttatcatattgctcatcaccacattattggccatgggatttttggaggtatctgtcaaagagtagacggtgcctcttcctatagtttgactttgtagttctgcccttatctagcttttgtgggccccaaaagattcaagaaaccaagggaatttgtagctgtacaagtagaattagactagtaccaaacccatttcccacaatgtgttttccagggtgtgtcaagagatcacggtgagcctatctacggtaattaatatgtgatattgctggttttgaggtaaatgatgatggagagacctaaaccagagcacagattacctgatcttcatatagatacaagtgatggttgtgtccctaacacttgatgttaccatgatttctttttaaatgttcagataggaaatgatagagtctttaccaattctcaaaaccacgaattttccctcagcctcccgagtagctgggactacaggcacgcgccaccatgcccagctaaatttttgtattttagtagagaaggggtttcaccgtgttgaccaggatggtctcaatctcctgaactcgtgatccacccgcctcggcctcccaaagtgctgggattacaggcgtgagccaccacacccggcctcctattttctttattgaaaacctgagaccaattgaaaagcaataaaacaagcgttcgagagcttctttaaatcaatacaagagcttctttaagtggaaatatatatccagttggtcagactctccatcatacactttgctttttgttgaaattcaaaataaaactttctttaaggaagcctggatctcagtcttaaacccctagctataaatgtctccaacaaaggggaagggaagcaacctagtctgaattttaattcagccaaatgggaaacccatgaccttccattctcctctgattttaccattcttctaggatccatttcacagctattgttcatctgggtatagaatcactgctttgtatttcaacaccattgaaaatatgtcagaccaagacccgtatagtataattctgctggaaaatagaagttaaaggggttaacctgtagtagtagattaagatagttatggaaaaaaggttaaagaaatgagggtttaaaaagctttcaacaagttgctgtcacctctgggccatccacatagtaggtactcaatatgtgttgaagtaaatgaatgcttctttatggattggctcattcaacaaccattctttctttcagcatgtgatggaaagaaagctatcaacttcattcctgagacttcctgcaacacaggtgggtgagcatgatttaggttccaccatcagatgttcacatgtaacctctattggaactgagccatgggtagaaaggcaggagagtggacatatattttactagcatggattgtggcaggggtaccatggttctggctacatatgtttgaggagcttggagttcataaaacagaggcaagccagagctagagatgtagcttagggtcagatatgttaaagaaaacattctttcatttttccatttttgccttttagtttttgaaaattttacagataatgttacagggataaaagaaattgaaaaagaaagaaaaaaccattataccatcactaaaatatataaacactttatttttccctgttatcagtcattacccacatttatacatatcatatagggaacataaggttcatataattttctgatttctttctcttaaaatgacattgtaaatatatacactcatatttaatatatggaaaaatgcaaaaatgacaaggaacatttaaacgtgtaaatctatgcatatagaagtcatttgttcatttaacagtaggtacctactggtagtaggtacaattccctgctttgatgatcaacagtgaagaaaccacacaaagttcatgcctaaggaagattacattctctaatgggttcaactccaatgatccatacattcttgtgtccctgggagagtctcaccttatttcattgtctcattataattattaatagctctcactctcaagagtgtctcagtttggataatacattacatagtcaccctggacataatagagaatatagaggtgaggacatatattaactgcagagtaataagtgctataaaaatatccattccagctggacactgaagatgaaaaaatagaaatttaaatgtttttaacttaaaaataaatatcctaaagtaaggtgacagtaatttggggaaaggacttctttcaattgggtggtcagggcagttctttctgaggggagcacagaatgaatgacaagaaggagccagtcggataaagagtgaaggtgtaagcattgtaagaacagcaaggggaaacgacatatccagaggacagagagaggcagtgtggatgaagggcagtgtgcagggatggaagtggcccaaggggaggcaagggctaggtttttaaggccctgcctgtcgtgaggaggagcttgggtttcctttgaaatgcaatggacagtctttaaaagagagcagagtgacctcacttacttgtctgtgccaaatgtcttcaaacccataggccagaaaatcactctctgatgaagctctcatatttaaaaatactgtgtctcctccaataaagccacagacaccaggattctttggaaaaatatgttttttaccaacactggaatgaaagataaattattacatgaaacatgaagcttaaagttctcagaagcagatatatttataactttttcccctaacgtattgaaagataaagtgctgaactttagaactttataacagactcacaaataaatgcaaggcttcatgagttttatcaagctctcctcttgtcatcagtgatggtagtgaaggattatacagtttgaaggtagttgggacaagtctcccgacaagggagtggtgacttgggactaactaactgaagagggagggaagggcaagatgccagaaatctggtggaagaccttggtagtaggtattccagcagcttccagattctttctgaggcaatttaaagagatgcagctcagaggtgcaactccatcctgctaggcttggtcttctaaggcccagcacttggccacacaggttatgcagcacaccagaatgccaggctgtaaaagctagatcgagggccaaattccaggtcacaccctgcttaccaaaccatgccagctcgaagggacacctcctcaattcagctctgctttacctctctgcttatgaattccaagctcctgatacacatctggtcagaaccatggtacccctccacaatccacgccaggaaattggatgtctactccctgcctttcttcccattgtttggggacttttccttagttcagctgaagacggggtccttgtcacacggccacgaaaatttaggcttgcagattatttgaagggtgagtagggcacggttttattgggtgaaaaggaagaaaaggagaaaagagacacctagcaaagcaagagagtgtgcttcctgcccgtgggcttctcaggtaccaccgaggaagaggaggggcaaggctcctctcccctgcaaaagctggacgttctgtggctccaccccactgcgcgctccttccagtgtgcaggtcggtcggaggctctgccagggagcccttcccacctggctgtctcaccatggctttgggaaagggctgtgcccagaggggattcttttctatacaacacaaaggctttgtctgtgctcagcagccgtgtgtttaggacatttcctgggccttatggcctctgacagtcatcctttactgtctaaatctcttagcagatgcaccctcaccagctagccaattctgtctcctggttctcaccctgggtatgagactatgctgatttcttgtttcagcaacatcccgggcataaaacagcattttttgttatttactcacgtaaataatcagttgctggaggctgttctggaaagcaggacacatacagcacacataggaatgaatccatccagcactgctcctccttggagccaggagtcccattagggcttcatcatctcctctgtcaccatttggtacttttggttctttctgtctccctcaagactagttaagacagctaatgtgtggatgcagtttcgaaaacaatacttttcatagcagtggtttgagctaatggtgtttttcatctcaaaaatgttttacaaacattaattaagcttatgtagctccctggtgggcttaggcagaaagaatgcccagagagagagagtttccgcttttcctccaagccacagaaagtcctcaaggaaacagaaggcctggggcttcagcccagcagtcctttgcttgaagaagacttaacatacctttacaactttcctgatgctcagaaaatgaagtcttttgtgatacttcataaaatgaaatctcttagaatgctttgggtttttttgggggggggtgttgcgggggtttggtttttgttttgttttgttttgttttgacagagtctcactctgtcgtacctaggctggagtgcagtagtgcaatctcggctcactgcaacctctgcctcctgggttcaagtgattctcctgcctcagcctcccgagtagctgggattatagccgcccaccaccacgcccagctaattttttctatttttagtagaacggggtttcatcatgttggtcaggctgatctcaaactcctgacctcaggtgatccacccacctcggcctcccaaagtgctgggattacaggcgtgagccaccgcgcccagcccccttggaatgctttgtaaaatgaagtccagcctggaccacctgtcagaaagtattttttctttattgttgtggcaaagtatgtatctattgatatattcttagtgaagcagggaaacagaaactgcaaacctaaaccaattcaataaaacattacttatttctcagtaggaagagggaaaaaagctagcaagcatgagtaagaaggaaggatatgagagaataggagattcttaaaggcattcttttcatttccttcttctgacgcagaaatccaaacaaaagctttagaagaaacacctggaaaaatagtatctccactttgaaaatgcagaaatacaggcataatacaatggtgaaatttattcatggtcattctcatctcaatcaatggttctcaaccaggtgctattttgccccccagggacatcattttacaatgtctagacatttttggttgtcaccacttggggaggcggtgtaagggtgggcaagtggagtgataccggcatctagtgggtagaggataaggatgctgctacaaacattgtacaatgcacaggatagctcccatcaccaagaatgctctgacagtggtgccaatgttgaggaaccctattctaaatcattgccttgtcagagatggatctccaaatcaagttggagtttgtggtatgtcatccacacagttgactccaacccacccaactccaagcaggctcaacatggtgatgtttcccactacttgctctaggataccttcattaggcctgaagacccaacctgtgcacagactctaaactcaaacatgtacctagctgcattcttgattttctcacacaatcatggccatgcttatattttgaagtgatccaggatccttttactttttcttctagttcattaaggtgtaattgacaaacaaaattcatatatattcaagctgtacaatgtgatgatttgatataggcatacactgtgaagtgattatcacaaattaacacattcatcgccatatctagttatctctgtgtgtatatgtgtgtgtgtgtgtgtgtgtgtgtgtggtgaggacacttaagatctactctcttagcagatttcaagtaaacaagaatgtattattaactgtgatcatgctgtatgttagatcacatacagctgtatgttacaccatgctgtatgttagatcacataagttctggtgaacttactcattttataaccaaaagtttgtaccctttgaccaacatctcccattttcctcacctcccagcccctggcaaccaccatactactctctgcttctatgagcttgactttgtttagattccacatataagtgagactgtaggaaagtttaaattttttcccctgaagtttcagtcatttgagtttataaaacaaactgataatagattatcgggaaaaacaggcatacaaattttattgtgtgcacatgtgtatggaagtcatacaagctcaaagaaatggctagagggttgacacttttataccatcttgaggttacagcaagaatgaggacttggattatagcaaaacaggttatggtggcaagacaggttatgggacagagagaagaggaggcctggctagtaaaggtggtcttgttatgcagatgaaatctcacagatgaaatctctctgaaatccctcagagagaagagatgggagcctgtgataaatgtttctgcagggcctttaaagtgtcaagactcccaggtgatccttcctggatccagagggagagagtggggtggtgtttcaaagaatacatgatagcatctgttgtttacttcattttactccctctacagttgcaaatctccttcacacaagatagctttgcaggccacttctgttggcaggccctgtgaacagccacctcaaaatatgtcaaaatatatattaaaatttttttttaatttcaatacctttaggggtacaagtagttttcggctaaatggatgaattgcatggtggtagtctgggattttagtgcattcatcactcaagtagtgtacattgcatccaatatgtagtttttcattcctcatcctcctcctacctcctcccttctgagtctccaatgtcctttataccactctgtatgcctttgcatacccatagcttagcttccacatataagtgagaaaatacggtatttggttttccattccttagttaacctctcttagaataatggtctccacttccacccacgtgtgtatatgtgtgtgtgtgtgtatatatatatatatatgtatgtatatgtgtatgtgtgtgtgtgtatatatgtatgcatattgtatatatatatatgtatattcctaccagcagtgcataagcactccctttccaccacatccatgccaacatctatagttctttgagtttttaatgtccattctggctggggtaaggtgttttgccatgtttcccaggctggccttgaactcgtggtctcaagcgatccagctacctcggcctcccaaagtgctaggattacaggcatgagtcactgcactgggtcaagctattaatccatcttgagttaattttcgtatgtggtgagcaatagggatgcataatattttggggtgagatattttggtttctttcagatcatacagtaattgtgtctagtttatttcacttatcataatgtttcccatatggatagcaggattttcttctttttatgatcaaatagtatttcagtgtatttatttatgtaattaatttattttttgagacaaagtctcactctgtcactcaggctggactgcaatggtgcgatctcggctcactgcaacctctgcctcccaggttcaagcaattcttgtgccttagcctcctaaatagctgggattacaggtgcccgccaccacacccagctaatttttgtatttttagtagagacagggtttcgccatgttgtccaggctggtcttgaactcctggcctcaaatgatctgcctgcctcgacctcccaaagtgctgggattacaggaatgagccaccacacctggcctcattgtatttacataccacattttctttattcattcatccatccattgacagacacttaggttgtgtccatatcttggctattgtgaataatgctgcaatgaacatggaggctcaagtatctcttggagatactgattttattgtaatagcagagacatagatcagtggaacagaataaagagcccagaaataaccccacacatgtacagtcaactagtctttgataagggtgccaagaatacatgatgggaacaggacagtctctttaataaatggttttcggaaaactagataccctcatgcaaagaataaaattggggttttatctcacgttatatgcaaaaattaactcaaaatggattaaagacgtaaaaccgtaatactcctagaagaaaacacagcaaaagccttccttgacgttggcagtgatatgtttagatatgaccgctaaaacacaagcaacataagcaatgaacaagtgagactacatcaaactaaaaagcttctacacagcaaaggaaacaatcagcaaggtgaagcggctacctccaggctccttttattcagaaaggcatacacatttctgctcaaatattttgccagttcattttatttgagtagaaacagtcaaatgccacataaaggaaagccccctctaatgaaccctctgaagcacatcatgttaactttcccatgctaactaatgttgagaaagaggaagttttgcattttttcctttgcccccttgttacaaaatcatctgttgacctacaaccggcgttctgcttaaacgattgtgtgcagtgatctttagaaaatgcagtagaggagagaaaggggttacaaggggaaaaagatagattcacttaaactgcatgcatagaaaccctccttttttctttacaagttttatcatgaagcaaaaatattgagagatagtaacgtcaatcaaaattacaatcaagttaaacaatctggtgcattcatcactttagtagtgtacatccctgtttgtatttttcatttcatttctattaagatttagtacacaacctaaaatacaaagacaactaggacaaaattcctgcctttgagctcagttaaccatgggaaataagtaataaaacaacttagacaggaagtataatgaaggttaccagggactggaagcgggggaagagttattgcttagtaatagagtattttggggtgatgaaaaagctttggaaacagatcatggtgatggttttacaactttgtgaatgtaactaatgccactgagttgtacacttaaaaatggttaaaatcacaaattttatgttgcacatattttatcacaatttctaaaatcagaaaaccctcaactatctgtgaagtgtgacaacagctatagatgagatatacgttaaagatcttgagtaaacaagagaaataatcttttaaaaacaaaatgtattgagtttctactttttcttaggcactctactaggcacttaatatacagtgtctcagtctgcctccaagaagcagacaccaagatgaaattggaaattgaacgtgcagctgggctcagtggctcacacctgtaatcccagcactatgggaggccgaggtgggaggatcacatgagcccaggagtttaagactagcctgggcaacatagcaaaaccctgtctctattaaaaaaaaaacacacaaaaaattagctgggtgtggtggtgcgtgcctgtcattccagctactcaagaggctaagatgggaggatcgcttcagcccaggagatcaaggccgcagtgagccatgattgtaccactgcactccagcctgggcaacagactgaggccctgtctcaaaaaaaggaaaaaaaaaaaaaaagaaattgaatgagctagagatgtattgggagaaacacctgtgcaggataaaggggaggaagcaggggtgtgcagggagagtctcccaactgcagtgcaggcctgacaccagcttagaggagcaaaggaagggagaaagaggattggagacagagcctcagactgcagtgctggtgtcagaatgtttaagccagatcagtgggaggccttcaagcccatgtctcctactagaggagtctcatcctccagcaatgggcctgatttagtttctctgctgggcttcatcaatggccgggtgcagcctgagggaagcatggcctcagggcaagcctgatggaggatccagggggacagcacccagtgctgggatacttatttgccaactgcacattctctagaaggagctctgactagtgtacttctgtggtcaccatacacctaacctcatttaaagctcacaacgcctcttccaggcattttattacctccaattaacaaaaaaggtaaacagtaagttgccccaaagcacacagctcttaagtggttgagctagctttcaaagccaggttcaaaagactccaaaaccagtgttgtgtctcctataatgtggtagattaaattattgttcaacaagtatttcctttcccacacctcctgatctccatggaaggatcattctctgccccactgccatggggttagctgtgcgttgtgttttagccatggaatataggtttaaagaactgtgggccagttcttgagtcttggctttgagaggcatcatgtgtttgcactcgtctctttcacaaagccatgtcagaaggtaataggcatagaatcagagtagcctagctgaccctctgcctgaagcaaagcaccatgcctctcacctagccaacctgcagactcaggagaaagaaaggtttgtaatggtaagctactgagataggtagggattttgtatacagcattactttggcaagagttgactgatacataccatgttgcctttacagaaggagccaggagccattgattctgcctgggggaaagggcaaaagattcatgaaagaagtaacatttgagcagattattattttttattttttttgagacaaggtcttgccctgttgcccaggctggagtgtggtggtgtgatcacagctcactgcagcctggacctcccgggctcaattgatcctcccacatcagctggccaagtagctgggactacaagcatggggcaccatgcctggatagtttttgtatttttttgcagagacggggtttcaccatgtcgcctaggctggtcttgaactcctgagctcaaacagtcctcccgccttgacctcccaaattgctggcattacaggcattataaacatgagccactgtgcccagccagattgttcttaaaaatataattgcatttttgaaaaaaaaagttgaatctcctttcattgtcaaaaatttggaaactatgggaagtagtaaaaataaagtcaaagagattacatatgttgattatatatatatattagactgctccatgcattctaggcctttatgtgctctggggttttgcctttttcgcctgacctattatcagcaacaatttgtgttcttacatatgatacaatattctttgaaggcatggtttgtaatggctgcagattgttcatagcaacaataattgttttaaggacaaggtgaagcacaccagaaggaattctttcattcacttattttaaagtactacttattgagtacttactacatgtcaggcactgtttgaggcactaggaaaacaactgtaacaaaatagataaagccccaatatctatcaacaggtaattgaataagcaagttgtagtatatccatacaatggaatactactcagcaataaaaaagaactaattactgatacatactacaatgtggatgaaactcaaaaacattatgctaagtgaaaggagtgacaccaaaaactacatgttgtatgattgcatttatataaaaatccagataattcaaagaagtcttacagtgacagaaagcagatcagtgattgccaaggaggagggcacggagagagagaaaagaagtataaggggcatgagaaaccttttgtgagtgatagatgtgttcatgaatgtgtacatatgtcaaaactttaaatatgtgcagtttactgcatgtcaatgatacctccgtagagctgtttaaaaagtgatgggagtacagtgagggctgaagaagtggtggacaagcattctgagcagaaggaaaagcacatgcaaagaaatagaggcattttgtttaataagcctgtaggacttaccatctgcgaggcagtgtttcaagagctgtataaatattaactcattttatcctaacaacatccctctgagataagtactattaatgccatccttattttgcagataaattgaggcacagaattactaagtaacttgcccaaaggaacagtaattgtcaaagctgggctttgaatccaagagcctaggtctagagttcatagtcttaattactacaacatgctgcctctacatgtctgggaacatatttggtaatatctgtgtgtatatttgaaaagtcacatgactatagccaaaagtggagagggaagagagggaggggaagaccttggaaatgtaggttgaggtaagctcatttaagtatgcgaagtccaggccatataatgagaagatatattggaaccctcctgagtgatatctttattttgaatggaaaaatccattcattatcaaaggctagttatatcctcaatggaacacatctgaaagcaaaatttccaccacccttataaaggacttagtcctgaatgcacaaattgatcagatagtgtattatgctcccaaagtagcttaagaattaggtgacattattcgcaaaaagatacacgttccgtttcaaagcatgcattcacatgcttcctttttttttttttttttttttttaagacggagtctcactctgtcgcccaggctgagtacagtggcgtgatctcggctcactgcaacctccgcctcctgggttcaagcgattctcctgcctcagcctctcgagtagctgggactacaggcgcatgccaccacgcctggctaattttttgtatttttagtagagacggggtttctccgtgttagccaggatggtctccatctcctgaccctgtgatccgcccgcctcggcctcccaaagtgctgggattataggcatgagccaccttgcctggccaggcttccttttaaatccgcttcaggagacgcagatggaaggagaaaggccgaagcacaaaggctccctatcaacacttacagaactgctgttgcttttctctctggctttaagagagatcacctacaaaatcgtatttgtgaaagctgaatctggctgccaaagaatccagggcttgaagctaaatctctaaggtcatgaattgtcttcttatgcactccatgccagtcagaactcaccgatgtgcagagagagctcacatcttaccatttcacaaacttcatcaatagcacatctatctccccagggctctgcacattgccagagaatcccatcaccctgaattatttcccttctctctccttcctccttcctccttcatcctagaccctctaactgctcagtagactccagtagactcttaaccaagccccacccccagagaactggtttccaaagatggcttggagacagtatgcccaattccacagtagattacagttttttgtttcattttgtgtttatcggcaaaatgacatataggtcacttcaacttgtggaaaattcctgatccactacaagtatattcaaataaatctttcagaagtaggaaatcttattacaagctaccctcatgcacagtgaacagggaaaggaagtgggctagaacaagaagtctgctgcaagggagaaatccagactgctaattctaccacatcaccaactttctgtggactcacaccaagggaattcttcttccgagagctcaatttccgcatgtgtagaataagctgaggagggtgggcgagggtcttgggacctcccctaatcttcattgcatggccctggtgcatttactatgggaaatgagaattcaggctctgtctctgccccacctatggtagatatatggtccctcaagtctcccttcacctgagtagtcccattcatccaggcacatctagaagacaaaaatactattactgctgcaccaacagcctgcagtgattggttttactttttcaagccagagcccagctggctgtgaaacaccaaagagaggagggctctgtgtttatagctcaactatgaagatgagttcacgtcaagcatatttgtcagctcatcttattctgacacaggcccaaagaaccgggcttgtgggaagtgcaaggagaagagtcgggactctgataaaaaagatgggtctttttgaaatatttgtccaaggctggttctttgcatatataaaacactatattatttaagtcgtcttcacattaatgatctcactagaggctcagaggataacataattccatttaacaaatgtggaaattaaaacagagttatgaatgctataccaagttcacactatttagtgaaagaggtggagctaaaaccctagggacctgatcccaagcccagtcttattgcagcaaattggcccaaactgtgatcagggaaccgtggcactgtgggatgccaataggtgttatgcaaagcaaataataaataaaattatggaagaaattaaaggcttcaggatcaaaaagatttggaaagtttttgattaaacaaagtccagcattttacaggacttctcagagacttgaacatattattatcactgcaaagtttcaagagtttgggatatagcactttcccaaatcaagactacataacccatttttagggatgtttgacgtaactagtattcttgaggacatgctttgagaaactttcctaggtcaactgtgggttacatccagtcgtgagtgataccacagccccttgacctggtcattctcgaggctgagtggtattgcatctagggacacagaattagaacagaagctcatttgaaatatggaaaatatttcgtgttcataaatagtcactagtgttctctttcttggttttgttgttgttgttgttggtttttgttgttttttgagacagtgtcttgctctgtctcccaggctggagtgcagtgccacgatcatagctcactgcagccttgaactcctgggctcaaacagtcttccctagtagctgggactacaggtgcgtgccaccatgcctagctaatattttttatttttttgtagagatggaggtctcactgtgttgccgaggctggtctcgagttcctaggctcaagcaatccttcctccttggccttctaaggtgctgggattacaggtgtaagcccctgtgcccatcttgtcactaatactctctaggggagggtcattcttccccactctgttgatgtttgacttggccgcatgacttgctttggtcaaaatatgagagtggacttgtcactaatactctctaggggagggtcattcttccccactctattgatgtttgacttggctacatgacttgctttggtcaaaatatgagagtggacacgacgtgtgggacttctgggcagaagattttgagccagcacgcggtttgccatgtgcatttccctctgccatcatgaccaaccatggttcaaatagaaatagcttcatcagcctggggcctggagtgaggaaaatatggaggcgagctgttgccaacccatgattggaaatagcccctgctgttgtaaaagcactaagatttgggggcattttttaccagaggataacctgtgccagcctgacctttacaatttccagaacatttatcatctcataattaagtattgataaggtatttctacagaaaacatctattcataatacagagtatttgaaaagtaatcagaactcagcagaaaattcagtggtcctaaatttaggagacctgtttctaacctgcttgcctttgataatgtctctgaacttccagttttttaaaaaacgccgaaacagctcacctcacgtgattgatgagacaattaaatgggaaatatatatatatatatacacacacacacacacgcacttacatatatatgtatattttaaactgtaaggtgttaaacgtaagatatatattcagtgtgctgtcctggctgggctggatttcagagctcctgccttgtcaacatgaatagcgttacctccaagtgaggaaacaggaagtcagatgctcttgattcatgtctgtggttccttttcatcatattccataaactttatagaaggagacttccaaattaacaaatattgaagtttctccatctatcaagatactttggtctctaagtaaaagaaatcctggctcagctgggcacagtggctcatacctgtaatcccaacacggggaggctgaggagggtggatcacctgaggtcgggagttcaagaccagcctggccaacatggcaaaaccccatctttgctaaaaatgcaaaaattagacaggcgtgatcacaggcacctgtaatcccagctacttaggaggctgacaggagaatcgcttgaacccaggaggcagaggttgcagtgagccaagatcacaccactgcactccagcctgggtgacagagcaagactccatcacaaaaaaaaaaaaaagaaacccttgctcacacagacttgagcaataaggatgtatttcatctactaaaacaccatgtccagtagtcaggtagtctatagaccatcaacagctcgttaatggcaaaaactctgactttctcagacccttctttctaccttcctcagcatcagcttgcccctaaagcagttttcctcacggtcactaaatggctgctggaagaaatcacatctagaagctacacacgagagagaggagatacaaacattccacccacacacaagttgtaagtccttcctcagtttgcaaaaaacatgggccaagggcttgatggactaacggtggagaagtcacctcaggagctccgatgaggatatcagagcaaaatcaagatttgttagtaatgaggaaaagagaaacaggcaagaaagtaatactctgaaaagcagctcaacagaagaaaatctagcaccgcatgcatttccacagacccatgaactgtttcaggttcagatttgcaaacctgataactgggcataagtaatatctcctaacacttagctttaccatctgttgctgacataacaattttacacaataccaaaaatgccagatggaagctacacattagccatgtccaagatgtttcgtgctcacaacatatatggaatagctttgttccatacactgttgagtttgtagttctccacttataattctggccattgatggagaaggacaactccgaagcttcccaattacgtgcctccttgatctttggaaagctgtgcacactgctggcctcagaatttctatccaggatagacttagaagctacaatatatttggagctagggggtggggaagggatggcacacatatttgaaactgtgtttgcacagcgaatacacagtttttattttagaatttatattatggtaaataagaatagcaaagttttctaaagattttttaaaatttttactgtatgtaagattgagaaaatgccagttgcccttatcgtagactaagaagtcagggaatagctattgctatggagcaaaggtaatggaagaggtactaagggaaataagattcctacataaacctcccaccagcttaaagaagaatatagagactgggcatggtggctcatgcctgtaatcccggcactttgggaggccaaggtgggtggatcgcttgagctcaggagttcaagaccagcctgggtaacatgatgaaacttcatctctataaaaaatagaaaaaattacccaggtatggtgacacgctactgtggtcccagctactcgggaggcagtggcgggaggatcacctgggcccagggaggtctaagctgcagtgagccgtgctcatgccactgcactccaacccaggtgacagagcaaaacccctgtctctaaaaaaaataaaatgtataaagtataatcaacaatttccccatttttattgtaagatgttttaaacatatattaatatacagagtgatataacagatacccatgtgctcaacactcagatgtaacagatattaacattttgacattccccaggccctcttcctggttcctacccttcctcttgctgtggaggccacccccatctggatcaatcttctccatattttacactattaccataaatgcatgtatccacagtaagactctagttttgaaaatggcatcctatcaggcattatgaggagcttgccttttcattggttgttttgatgaatcttacctatgttgttctagttccctcgtttgatttgctctgtaatattccatcgctgaatatagtacaatctacatatctgttgtttggttggtgaacatttaagttacttccatttttcaccattacaaacatgctgcaaaaaccaatctggtgtgtgattcactgtgcacatgtcagataacctctctaggttaaagattcacaaaggtagagtgagaactttcattccagcatgatttatcaacttataccaccaatgtatgaaagtttcttttccttcattttgcaaatctgttggctgtgaaatggcatattcttgtttagtttgcatttcctaaaaactagagaaatagagcaacattccattcatttggtattcaagtttcctcttctgtgaatttgctttttcatatattttgcccatttggagtatttgtctttttcttgctgaattgtaaacatttttttacatattttaaataccaacatttgttgattatatgcattgcaaatatcttcttcctgtctataatttcttttaattttaaggtgcttttttcttgtatttaagtttgtaattttagtgtagttatatttgtctattttttccttaattaagggttttgttttcttgtgcttgtctatggaagatttaagattataaagattttctcctttattttcttccagaagtttacatggtttcttttgacatttaaatctttgtctggaatttatctttgtgtgatataagctagtgacttaattttcttttcagaaggataactaatttcccagactcgtttgttgaatagtttatacttgccccactaatttgtaagatcttctctgtcacgcatcaaatctctgtgtatgcctggatctgttttgtccaactctgcacaagtagcatgctatctaaattactatattttaaaaagtaagtcttgatatttggtagggcaagtttcatgtgtcttaactattatggtctctttctcatctatatgaatgttaaggtcagctcatcagtttccacagaaaatcctttctagattttgatttgaattacattgcatttatagattagtttgagaagcatcatcttcccgatcttgtctttcctttcatgaacctgctatatttctgcatatatttaggccatcttacacatctttcagtactgttttgtatttttctccataaaaggttttgcataccttgtgtaaatttattcttaggcatcttttaggtcatataactgtggtaaatgagaactttattctaaaacattttctatgcctatcaacattttctccgctatttttttcttttatgttttatacctaatttttttttttttttttgagacgtagcttcactcttgttgcccaggctggagtgcaatggcgtgatcttggctcaccacaccctccacctcccgggttcaagcgattctcctgtctcagtctccagaatagctgggattacaggcatgcgccaccacaccgggctaattttgtatttttagtagagacggggtttctccatgttggtcaggctggtctcgaactcccaacctcaggtgatccgcctgcctcagcctcccaaagtgctgggattacaggcgtgagccactgcacccagcctgcttttatgttttatacctaattcttaaaagtatttgcattttattctttgcatgatgtgagatgtgaatataacactttcccccgagtcaattattttcaactctgacgaataatctcttaacccattggtttgtgagtcttcctttgttatctgttatcttctcatatatcaggactcttttttacaatcactttgttttcgttgatgatatatatccatttccatgccagtatatgatctcatttccgtagtttttaatgtgtctgtgtgtgtttgtgtgtgtatacatacacacaaaaaagtagaacaatgaaataatgtgtctctttctagaagaagtattaagaggcaggaagattgcttgagcccaggagtttgagactgcagtgtgctactatgattggacctgtgaatagccactatactccaaactgagcaacacagtcaggtcccatctctttttttcttttttctttttctttttttttgagcctgagtctcgttctgttgcccaggctggagtgcagtggcgtgatctctgctcactgcaacttccacctcccaggttcaagcgattctcctgtctcagcctcctgagtagctgggattacaggtgcgccaccatgcctggctaatttttatatttttagtagagacgggatttcaccatgttggccaggctggtctcggactcctgacctcaaatgatctgcttgcctcggcctcccaaagtgctgggattacaggcgtgagccacccaccgcacccgtcctgaggtcccatctctaaaaaaataaaaagtattgaaccaaggtcctctcacgtaatttttcacaatttatattatgctttaatatctagcagagcagctcaattaattactcttggagtgtgttaaaccaatatgctaatttgggaaaaatttacctccataatattcagtcttcttattctgtattcatccaatcatcttattctatattcatatattcatgttttcttgtaactttctcagttgcagtttgtaattttcctcacatagattcagttttaaaattaacattatgtctagacattttagggtggagtgttgtttccccaacacctcatatatcttggttagttacttcagggagagcaggagagctggttacttttgttcacttatctttaaccagtcattttactaaactcccataaagatagccactttttaattatcttggggtttctcagtaggcaattatatcatctctaataatactttttgttttctcatttccaatagcaacgtccctatatctgttttagaattatattaactaatacaatggcagtaaggatctttgttttctttctgatgttatgggatcctgtttctattttggttctttgtcctgtagtgtgggtgctcattaaaggacttcctttgtgttttgtctggattattctccaggcagctggtaagctccttgtgaagacagcccatcctgttctaacatgtctgatactctgtgtctggtctctgcagctcctggcacacagcagggaacttgattagggcctgaaagaatgtgtcttatgctggattcttgggaggccctaaaagatctgcactgcttctttctggatgtggccatgtgtttagaaacatctgctctcctagaagtctggggttcctgttccagcttcgagcagacacttgggtttcccttacaggctactgtctgttgttgaccacatactcaggaataaatggaaattgcagcaattttgtcagtagggttttgacaaactgagagattccaaacagaaaataaagagattctaaacagaaatacttacttgttataaaatagcacatgcaaatttcccaccaatcccatcaccaaaggtaagcaccactaacaatttagggtttgtgtttatgcacacttgtacacataaatacatgcatttctagatgtgtgttctatgcttttcaaacatatgcatgtttgaataatgtgagcccatttttgtaacttctttccaattttatgtaaatattgtttattcgttttagcagctatatatgccaccatatggctagactataatcatcttttctcctattaatatatatttctagtttgtttccttgtgtcttaaaccaacttatatttaggatagatttctagaagtaggttgtcgaagtataaggtaaactttttttttaatttagcttaattttaacatactttcaattcattctttgaccataaaaatttagagtctggtccatgaaccatgacttattggtctgtgataagtacagacattaagagtaagtgtttagaagtgtttatcataatttgatatttctatgatatccaaacatgaattttatattttacaaaagcatcggactgaaaaagaaaacctgattattttaaaataacaatagtaatgctaaaacaaattgtggaaagggctcatttggacaatatgggttaagtgaggccaaaagcttttcactgtgaaaatcaaaatatttaaggagtagtgtcttagaagacatatgagggataaatgaaaaaaaatgttatttttaaaatatgatgttgaaaaaaaatatgctgtatttggagctggatatggggtatgaccaattatataataatttcttatcagaaaaaaagaataaaaggacctgattctgcaccatgaataattgggaagcactgcttccatgagcagtcaaagggagtttccattttcttttctgaatcctcacctctagctcacattgtcaaaaatcaaaatgtttgttttataatctgttggttataaacactctcactgttgttttgatgtgaatttctgtgattactaatgatgtccgtatctttactcgttatttgggtttcttcttgttatttatatcgtttgtgctattttttattggcttggagatttttcttttttttctggtatctgtggatttcacatacttatatttgagctcctctattatttcagaagtaattttgttatactttacccagtaaattctatgtgttgagagcatgaagaattggcctctcctctaggctccattatattttcttattgggcactgctggtttaatgatatagctatagatttttgtatagttgtctttcttttgcactctcttactgctaatagtagttttttagggaatacaattttctctttctctgtacctctttcttttctattctttccttacagcagtaccatatttactggacatgcctttacaaacaatttcaattctgtcagtaatgcacatcatggtccatagtcagttgacctgtcatcagagtctgtatgacggtcaaaaaacaaaatgaaagaaagcaaaacacagtttaaaactgaaaaattgctgttcattaagtcgaggttatttagaaaaagaaattgttagggattcccgtagggtcagtctctgatatcaggactgtccattctctcaaacaataatgctgtccagtctcttcagaggctttctgatttggccctgttcctatcctttgtccaggacttttctccacacactttctcttaagccaaatggcaggtcaaatgaagccctgaaatacagccatctgtgggtgttgaagtggggatgattgtggtcagccctgggaagctgggcatgcatgtcacagatttagaaagtactgctggctggcaagctgatggagggcaaaatgtgcacatggaagcaaatgcacagcttcaagtgatcaagtgtcagtgcagacagcaggtgatgagggtggctcacaccacctgctggagcacagctgtcagaaaggggatagccacgtgtggggccacaggcagtgccaacccaacaggtgaaagcccaggacagagaagagcccagaagctctgaggcagacatttgggtcacagcctgggatgcacagtcatgccttgtgcccaaaatgaaatgccagcaagtgtttctctctctgtgttctcaaaagatctcttcctcatgtatcttaattagttaagatttggggtcttggggcagcctcttgaatgccatcagacataataagttctacagccagggtcattggcctgacttccaggattatgaagggtcaaaaagtcccacatgtcctaactacaaggcaggcgccagtgaagacaagctgttaggtaagacataatatttttggagagatataaaggacagaggtcagttgtgagggcaggcatggacccagcatcgaaccagcaaggcacaggttaagtgagacactgagcagggcccagttctgttcagcagcagaacagaaatcacctgacaaatccagaagtcacatcagaaggggttaactgggaaagacagctcaggaactagggtgttacacagtctgaccataggctactttttacaggcccaaagtcccatcaccatggacaaattttgatggttgctttaaatatgctcatttgtgaatccagtgtctgatgaataacgtgtggtctcttgatatgtggggcctgtaattaagtggaatataaaatagtaaatcattttgaccattagcaaagtttctctttgttcatttaatgaaaatgctcagtattggcaaaagagcagagaaacaggtgtcctcatatacaacctatgagaggtaaactgaggcctttccaaggaataatgtggtgactagaatcaaaaccctttcaatgcacataccttttaatctagcaactccacttctatgaacatatcataacatatatataatagtttaagtgcaggctggatgcagtggctcacggctataatcccaacactttcggaggctgaggaggaggattgcttaagctcaggagatcgagaccggcctgggaaacaaagtgagactgcctctctacaaaacaaatggaaaaaaaaaattagccaggcatggtagcgtacacctatagtcccagctactcagcaggctgaggcagaaggagtgcttgagcctggaaggtcaaggctgcagtgagctgtgattgcactactacatttcagcctgggagacacagagtgagaccttgtctaaaataaaaaaaaattaaaaaaataaataaaaagtctaagtgcaaagatgtttgatgctctgttgtatataatagcaaaatatgacaccactgaagcaagatagattcttcacaccactaccctcagccccttgcttttagtacacctgtggtggacagtttcatgcatggtcccagcctttcactgtgggcttaccttgctggctcaaggcttttctgcttcagagttttcttggatcccacagaaggccattctgcctgtgttggatgtggcagagaaaagtggggtagttaatattcccaggggaccacagtgcagcaatgagagaaagaaatggaggacgaatgctccaacctctccatccagagaccattttgaggactattctacgtgattcctccaagggaccccatgggattgagcttcagttgcccacagcgatcagcaactcactaacacacctttgtggctttgctctttccttgacttactctccccacccctctcttctgcttctctcacataaattcttgcaaatccttgtctcggatctcagactttactttcaagggaactcaaatcatgagtcaatctaaacatcagaaataggggttaaattaacaagggtacattcatacaatggaatataatgcagccactaaaattacctaagatccaaggaaaaagaaagcatatggcctcacaaacgtgtacataaatgttaaaagaagatgtatttcaaatagcccaaaactggaaacaatacaaatgtccacatttgcatgtgagtggataaataaattgtggtatatccatataacagaatattcttcagtgataaaagggattgaactattgatataggtaacaatatgaacctcaaaataagtatgctgagtcaaagaatgcagacacaaagagtgcatagtataatattccatttatataaaattctttttttttttttgagatggagtcttgctgtgtcgcccagactggagtacagtggcataatctcggctcactgcaacccccacttcctgggttcaagcaattctcctgcctcagccttccaagtagctgggattacaggcacctgccaccacactcagctaatttttgtatttatagtagagacagggtttcgccatgttggccaggctggctctaactgctgactgcaggtgatccacctgcctcggcctcccatagtgctgggattacagacgtgagccatcgtgcctggcccatttatataaaattctaatgcaaactaatctatactgacagcatttcagtggttacctggggtaggggttggggtgggtgtggacagaaagaagaaagtgggattacaaagaggcacaagaaaacttttaggggagatggacatgttccttatcttgattgcagtgttggtttcatgggtataagcataggttaaaacttatcagaatataccctttaactatgtgtggcttactttttgccagttatacctcagtaagtttgttaaagatgaaaaatgaccttggataaaaataattaatgacactaaaattattcatgttaaagtattagtttgaaataaaaggctagctttaaatcaatatttatgagcatagatacccatacaaattcgtagattaatgatcaaaatggaaaagtccaaaacgttactagtgttcatctcagagtctgggatgacatgcattttcattttttttcttttcatatacctgtatcttcctaatattgataaatatatattacttctgtaaaatagaaaatcagtagataaaacacaacacaaggtatcttatgctacatgctaggaaaatggtagaggccaaagatttttcaaatttgttgttttagagccctgggagtttcatgaaagtgcctcagggattatcccaggaggaaaattagaatacataggccagtgtcttcatggcacctctaaatagaggagctgttttcatttaaggaacaaatgtgaaggtctgaagaaggctaattattggggcctggggcagttgtggaatgctttgaggttaagacagaagtgagtaggaaagatgggccttgactaggcaaagaacagaaagtgagtcttctagaaaagtctgagcaaaattactaatggcacctgttaccctctgtagcatatttttttctgcttccattactattcaactcttcactcaaatgagaacttaccactgcaaaacatctgggcaaattctaggcctactcaaaatcacttgggttaggaatccaagggactcaatagcactgccacgggtgctggtgggaacactaaaaaggagtggagtttatctcccttcccaatctccatcagatccccttccccgtttttgatgtgtaccactaatattttctcaaggtaatatgaatttctttgctaacgtaactaaaaggccctgccagcctttcaaataggtctctgttctcctagagctgccatggaaagaactgaaaatctggaaaggaccacattgagtcattgtcctcatgtgaagttctccaaagagccttttaagatgccagaaggatcttctactggtgttcttttctccctttagcagcccttgagcctgctgcaataaactcataacttttttggactcaaccaaatggggcatagggagggcatgtggcatgaactactgccaaggcatgcatgaggcaatgagctggctatgcaaagactcatcccaaagtccatgaggcagcatgtgctccttggaccaagaggagggagaaagggatgtgcactggggcttactgtctcctccatcctcatcatcctagctcaatactagacaaagtgtcttcgctagcactgaaatctgagtgtcttgttaggtcgatgtttggaagacagtcaaaagtacgtgacaggccaagggttgccaaggaatagaaaagcagtggatttgtttcctggctgatggccagctgcaaggctttcttaaatgacagccaagaagcagtaaatcaggtacaatggagtcctatccatggagagattgtctctacaaagtgttatacttcaagttaaatggtcacagacaattcagcttcagaataacttaaaacagcatttccatctgcttgaacccgggttccaattaaaacagagaagtattagtctaacccagtcctccactgttaccaactaagacatgctctggaagatttaaaaagcagcacagccatgaactgaggaacgggtttcaaatttacttacagaaaatacagtttattttcatctccctagagagagacaatcctgttaaaatcacagttttatatgtagcctgtaggaccaagaaaaaggagcagttgaatatattaatatttctcagtttagatgagagcgaatagttaaatttagctttatcgaagaaacaactattccatgtatcactatccaaggaatttcagtaactttttttatttattgattgatttatttattgagacagggtctttctctgtcacccaggctggagtgcagtggcacaatcatggctcactgtgcagactcgaactcttgggctcaggcaatcctctcccctcaggctctcaagtagctgggactacaggcacgtgccaccacgcctgcctaactggtggcatttgcctgtagtatgctgaagtgccagtaactttagcataatgtttgcatttgcggctacgtatttcctaagtggatgcttctcagcctttcatgtacatgtggaagatgagcacatttttaggacacactagggtaaaggaatagtagggctgcttacaggaggccccacctggccactccagggattgagaaatcagtatctctccaggctgggatccccatcagtttccaggtggctgcttcctgagttttagaacaggcattgtcaaccttggccgcacattggactcacctgaggaactttaaaatatgcatgacctggtcccaccccagagttcctaatttaattggtctgaggtatggcctaggcctcaggatttgaaaaagctccccaggtaatactgatggccagccaagaatgagaagcactgttttagagcaggggtcaccagcctgtttttgcaaataaagttgtattgaaacacagccaccatttggttacatactgcctatggtggcgctcatgctaccacggaagagttcagtagttacaacggagatcttataacctgaaaaacaaaaaatatttactatctgcttctttacagaaaatgtttgctgagcctgttttaaagggaagcttcaggaggactttcagtgtcatatgaaaaatagtttacaaggatttttgctcaaggtagtggcagaattctcataagggactctcacagggacaaaatattcaaagtacacaaacattcaggtaccacgaaggtaaatgagcattcatagcctttcttgttttcccctcgccttacaaggcacatgctgttttcaagtttttgttgaacaagacgaggggtagcaatagggaagtcaggagaaaggaaaggctaggctggtttatgttaggaaaagcagggaactgctcttaggaagaaacaatcctgaaaagaaaaagctacaagtcagaggagaggcagggaggagtgagcttcagggaagagtttgggaaagtttctagagatgggagactagagagctgtcaccctgtgttgagtggcactgtagaggttaatggttctagtgatttttagaaatgtggctgtgtgatatgaatcataatccccttagtctaagagatttctgtaaagttgtatacattttccatacttttttagatgtcagattagtctttttgcagtgaaactctgtactatgattggccacaatggaagctggaaatattgggctacaggatgaatacgccttaaaactaccaattattgacagcatcataatagttggaatagcacatctaagagttagcagcaggaaaataaaaaaggaatgagatgggaatctgaaagcttacaaatggcagcgtgatattgctgggtcagtttccccaactctaagctctaagtatctctgataggaacctgtggagaggagcgtctgctctcctcttggtcactggagcccaagatcgcaatgttcacacttccatttattgtgaggaatagaacaccagcacttaagtgattgtccaaaccaacatcaccaaagcaacagctttgcataacacccttgccaatactcagaatcaagggccttaaaaaatgaaggaaagtaactggaatgaatgcaaatacttgcacctagagaagcctttccggaattattagcaaacactccactcattccctgacttggcaattctcccaaaaagagaggaggggtttaggtacctgcattcctcaagaccctgtatggcctggtgaacttggaggtgatctaggaccaaggtaaatcatgtggctgggcagcctgagaacaaagatcaaatcagaagtcagagaggcagcaagcaaatctgggctgttttacggtatcccagcatcctggactgacaacatgagctggtatttatctctccaattcagatatcagtagccagacattgccattgattcatcatcacattcttcttcccgtagggttggactctgagaacatctaactcaaaagagcactgccgtaaaatactgtaggaaatgtacatgcattgagtgcatttcaaaagaacaatccttcagtttcgactatttttctatttgtttgtaattgcttatctatgtacatgcttatcatattgtgtcataaatatggaaagccttcattgcccaagcgtaatttgtctctgcaagagtccatttaaaattaaaccacctgtaacattcccagcgggtcggcaaagaaaaacagtaccacatcacataggacccagcaactaggaagagaaatatcagttaggacagaatactcaagagcaaaagaggcatatgacaacatgaatgcaacaaccataagcacacttaaggagactcaagagtacaaagaaaaaagtttctggagttagaaagaaaaattaaagtgaagaagaggctaacatttttggtacttgaattagaggtatgggtgagcaatataaaaaaaattaatccacccaaaatagaaaccaaatgtcacagtaagtactggaaaaaaagattaggattttattctaaaaagaaaaccaatttgttttaaaaagtaggaaaatacatttatattttcttatttgcgaaaaattcaggatataattgccatatcctaactcttaaaatgaacaacaatgacgtaagtgttgatttttcttttgacacagttgttctggcaaaaccgtatgatagttttgtgcaccctgtcttcacagttgactttcgcgcacagtcataagtaaggtcatctttacaaaaacgtttgaggtttcaccagtttccccacagacctctccgaagcctttgatattcaaattgttttctgactcccatcttctgacatcatctttgttaagtttctttttttcccaaattaaccttaccagattcttattttggctttgccaatgatttgagccattctccaacatcatcagctttgtgaactccttcatgttagcaacatttgtgatttcagtttaacaactgttttcattgcatcattagattttacagcagccacattcaatggcacagttacttacaaagctcctttgttagactatgaactctttaatggagaagctgtgacttatttatcttctaccaccaatgattgccataaagtagatactgattagtattagctgaatttaacggcttttcatttaaggtcttcatgtttaaatattgactagcatagatgctcacacaatattgattgaggacaaactttattaagtggttaattccttagcatatttttaaaatgttatgttgacttttgcttccctgtctcttctgtgagtatctagataagtatttggaccattagcatgcaccaatattgtttacttaacagcctctttaatggaggagctgtgacttattcatcttctacctccaatgactgccgtcaagtaggtatcaattaacagtattgcactgaatgtcttttcgtttacgatcttcatctttcaatatttccaggccaaccagaaacacatcataagcagcacatgcctcaattaaatcattggcaagattagaaagacagcctagaagtaactttgggcacacacagagtatttcacaaatgttatttgaattgaaaaatggatcttcaaacaagacagaaaaggttttattttacctataattttgcatggaagtcttgggtgaccagagtaattctcggtttctttccttccttccctctctccctccctcccttcctcccttccttcctgccttccttccttccttccttctccctttccccccttcccccttattttcttctttatttctttcactctttcagcataaagaggttaggtcagcattagcatcctgaaggaccaagataattgattgcaagggccaatgtccacgataatagagagtcaagatgacccccaaagaaaggaaatttgctaatctgggtgttagttgctctccatccaatagagagtctttaatatgctcattcatctctccagtcttcaggagcatttccagccatctggctcgcttgctgacccttgccctttcaggtagcagccataaatgcaaagctctcaaataggaaagtctgttggtctcatttagaaggcctactctaggcaaggttaggaagatgggagataatgatcctttgccatctccctagaatttaaatacacaaattaaaaagcacattaactctttgtttaaaaagaaaaacaaaatgtcatcaaaggcaggcttgattcaaatgcagtttaggctaatgaaggagctgtgtcctttcactatttgttctgggatcttttcaatcagttagcattggcaaagcttctgaacaaagacagtaattaccagataaaaattgccttcagtgcattgtctaactgtgttcagtttggcatgaatggatttatgatcctttcattccaataggaactaccagtccgcctttcacttcaaatagcctattcatctcagcataaaaacagctaaaatatactagcagaatatgctgcctctgcaacccaagctgcacacagcaggagtcagcttcttccaacaggcacaaatatagctggctttgaaaaactataaaacaaaggctctagaaaactcttgcataattttttaaaaacagcaattatttggttccaatcccttttactactctgtatcttttatccaatattaaattaattccattgtgtataaaatggtcaaaaccacaaattacagcagggaatttatgcttaaataatgatctgtggttgctattcagatacatagattaatactttctattccttagggggaaatggcacagagaggtgtttttgttttgttttgctttgtttttaatagataaggcataaagaatcactttatcagaaataaattaattggtggcaatttacttgactcccaacatccatctgcagtgcattatctcttctaccctctatcctgtgtgtgaggtaaatgtctatgtacacacaaaccatgtattacaagcatagagtagtactcataaaggaagtttctatagaaaattaagaccttcatgcagagctttgtgctgcagtaatataatacagagcatgctaaaatgttgacctgagtctgtcttcaagtatagtggtttcgagatcagttccaatcacaactttctcattggtcagcatcacatgatgtcttcatggtggtatgagttttgcaattgatcccgttggctttggttatcaacagtgtttcattggatgtataagaactgctcatgttggtttgtcccaaatgcatcctagaaatgataactatttaactaacacaagtatataactgtaacagagtggagtcctgaaaaagtactctccaaaatttgacagacttgtttctatgccttgacgtgttactaagtctacatatgagtaactctctatctctgtgaacttcagaatgctattcttaaaaactagaggagggagttggtccagaatattccttttgtctcaaagtatttcatgataagatacagcactgcatatgcttgttactatgccctgctggaagaatcaagcctctgagaatccctgcaataaataaatttgcttaactttttagctcagcattataagaatttatatgactaatgaagtccttttattctttagtggaacagtcctaacattcccaccctgattgtttctcaaacacacttggggaaacactaaactagagtgtctgcaagctcccttccagacctaatctaattctaggctcagtccccactttgtggactaatggcaatgaaccccatcatggccaattgctagagagtctgagaattttttaaatgcagtgcaattttttccagcctccaacattcatagggacacaaaagacctccctctccctattcttcatcctcccaagtacacagaaagtatctataatcaccagagagagtccagggcccttagtcatgtaaatctacattctttaagtgtgttcttgtttgtggtcccttggtagatgtagattaaagctcagccctgagtaatttgaatatatatggagtaatgatactttgccttgtccatctcttgccttttgacatcaatacaaattatacctttaaaaaatctacccaaacaccataatctccacctttaacttcccaacaactctctcacagattttgtcaagactttgctggcaaatctgttttaaatcccaattgctcccatttttgctcactcccactttttttattctctcgtatacccagagaacaactgtcagctaccacccatataacagtggtttccatattcaaagtctaattctcccttagcattctgttcttcatttcatttaccatttcttctagaattccaccatcctaacttctaatggctttgattgcttttctctggattttctccaagttctacatctctcccttgaactaaagttcccaatttgaacacagcgcttccatggagatatgactaataatgcattggctcttaaatctggctgaacatcagaatcatattttttgaaactatggattactgagcccacacagccatgtacaaaacattaaattgttatttttgattcctatacttgttaaacaacaggatccaattaagctaaagaagagcttcagcctattttctcaccacttctgtgatcatgaacaaccagccacagtgggtctccctccagtattaacttccttgggttgataaagctttcaggaaagagagttatcatatcacaaataccacaatgatttttatctgaatggcttccttccaaaattccagatccatctaaacttttacttcattggagggtccttcctgacccatgcaactcaacaaaaaactctcacagtttttatatgctttgttggggattaacccatcttgcattgcattgctagcttagtatgtctagcatgggcatgcctgctgaagtttggaacttcccatcaaggaaacaggaaaatgccattggcaatgagctgaagactgatttactctaccaggtatgactttaatgactaactgcttgtacaccctttagaagcttttagattgtagagccccttactcttgtatttgtcttctgaccccagtcctggggataaatctgtttcagttaaaattaacatttcatacaagtcctcactatattcctctgcatacatttcctgccaaatagcagctagaatgaaggtcccctcaactttgaggacagaacatttataacctccctatcaccaccacaagatgtagcatatactagctatttttttaaaaaaaatttcccaacaagattgcatgcattctgagaggaagtgttatgtcttaaaatttttgcatttcttataggggactgtacctagtaaatagtcttcggtaaatacaccatcagaatgcaaaaatcaaagtgggaataagcattctaacctctcattttatagatgaagaaacaggttcagagaattgaaaagatttgcccagataaaagtacgtagtcaaaattagatctcagactactctgttccccgggctgtttttgtttactccatgtatcctctgttaattgaccagattgattgattgacttcctagctctatcaccaggaagtcaaagtaaaactccaccactgaactcttgaaaggcgtgtcttctgaagggtaggatttcccatcaaagaaacaggaaaatgccattggcaatgagctgaagactgactttgatttaccctaccaagcatgattttaatgactacttgtacaaacatgtaggtacatcaatattgggtagattcatagtgttaggataaattaggtaattgagtagaaaatacaggcacaagctagactaggtccaaacacctggcctcatatcagttgaaaccatcatatcaagaataaacaatagaaagacatgatcactttcattgacttcagctggaaacatttacaatccaatttcaatttagcaagatttcatcagaaggtatctcccacaaattgaggtccatcttactgttattatttgaaatctttttgtatatgtgtagtttggaacatctgttattgctgctactacggtttctatcactgtttgatgctgggactcttaagctccaaccacgttttcaccgagctgagtcgccttcttatcacccctttctggtg

SEQ ID NO: 3052 - DNA, 63953 bp, human
cgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccaggtgagtgtctgactggcgattggcttccccccacccccggcctgaggtcccgctttggggccccatgtctttgcaggcacccccgcgtgtatgggtgtgagtgtgcacgtgtgcctgtgcgcgctgcgacgggatttaacctggataccaggccgggagcgcccacgggctttcctccctgctctcctgtggcggggctttgcacctagttagctccttttgcatcagctgtgccccacctggctgcgtccggagggttgcaggaggagggaggctctgcacgcagacccgtgggtgcgtgcgggcttgatggtctgcagacctgctgtaggggcaggtgtgtgagggttggtatgcgtgtcggtgggtgggttctgtgtctgtgcggttttgtgttttccactctattcacaggacaccaagtgcttgtcagtcgctagttttgctggggaaggagggaaagaaaccgaggacgataaagcatttactgttcttgagctgagccagccgggctgctctcctcactgctctctgattagggttgatgaactggaaagaaaggacacggttgtcagatgacaaccattctcattcttgctatggcaatgcagactctgaagccgttccctactgcccttaagcttagctgagacctgaaatattttttccagagatcggcaaagacgcttagtaaatgcacgcttacatggtgactgtcgacctggcactgttctaagcacttcaggactattaacctacccaaagccataatggctctgtgtgtaaggtactattatcatcatctccgtgttgtagaagagaaaaacgaggcacagagaggtaaagtaatttgcctgaggaagcatagccagtaagagatggagccagggtgcaaacctaggtattctggcccaaagtctgttcttcaccagggcactagggcagccttccggcaacggaagaggttttctggttctctaactgtgatgtcttgctttctacttaggtgtccactagaatatggtttttccaccgcagcattattgacctttcgggctgggctggataattatttgttggggtgatgggctgccctgtgcattgtaggatgtttagcagcacctgtggcctctactcactagatactagtagcaaccttgaccccaccccaccccccaccaccaccaccaccaccaagttgtggcaacaaaaaaaaggtttgggatattgcccaaggtccctggagggcacaattgctcctagcggagactgctgaactatagaaatttttcagtgatgattcctgaggagagtaggataagagctttggtttggtacaggcttctcgaaggtttgcctatctttgtttgacttacaggaaaaaatatttcatcagagttagccatggtattaaaggatttcgaagttaaaacagaacaaacctcaaaccaggttcttagaatgtatgatcgcaagtttcaatttccttttcatgataaaaatgtaagcagatgcaatttgctcataatcacattttccttgaatgctagaggttcttgcgttgctagaaagcccacttaaaaaagaccaaatgctgtttggagatgagattaatagttctttagcggccagcaaactgacctccaggagcttcactttcaaagtgccaccaaattaaattaaaagccaaaagcccctggataaaccaaagcatattaaactggagaatccatgtcaggattctgcaattctgcagttttcaagatgtgaaccatggtttctttagacgattatcaagtttatgagctggtgtgtttattatttgctcaatgtgcttggaaatgtcaagtggtcagctcttcaggaatgtccaggacccatgtttaatcagctctagattccacattatggataagacactgttacagagaaggcaaggcacccattgcagaaaactgtgtctactggttatttcctggggtttcacaacttataggaaaaactgtggctgctgtatagagatttccagtataagcatcagttctttttaattgaaacactgcactatgattttataacctagaaaattatgtgcttcttaaatggtatttagtgcatagtacacaattaacgctcatcaaatgaataaatcattagctccatgcatgtacctgcccttaagcttcagaatttggcttgccttatattttttatgtcctttgggtattggaactatttagataccctagacctgtccaatacagcaaagatggtaaccaggagccccaagtggctattgaatacctgaaatgtgaccagtccaagttgagatgtgctgcaaaaagtatcaaatacacatctaattttcaaaaaaaagaacaggaactatctcactaatcatttgatattgattacatgttgaaatggtaatgtggatatactgcattagataaaattgttattaagattaattgcttctgtttctttagcatttaaaaaatgtggctactagaaaattttaaatggcatatatggatatttatttctattggacagtgctggtctagaacacttattgatctgaactccatctcgagtgttctaagtcctaacactgggatctttttgccttgagtacctaagataaatatattattaactttgctattctggagattaacgtttggagcaactccttccttacaacatatttctgttttatatttttttctctactgaattcaagtaaaaataatgtgagagaggagggaatgactaggttcctgctgagaggctttacttacagagaccacatgctatgtgggtaattgatttttctcaaagccctggtagcaaagtgccactgtaaaaattggccacaaattccatggcttaaaacaagagaagtttattgtcttacagttctgaagaccggaagtccataatgaatcttatggggctaagattaaggcatcagcaggactggtttcttctggaggctccagggaggttccatttcttgtatcttccagcttctagaggctgccaacagtccttagcttgtggcacaatatctttttcctttgtcactttgccttctctctgattcttccttgttttcttcctcctaagaagaacccttgtgattatatcaggcccactcggataattcaggataatctgctcattgcaagagccctcactcgatcacatctggaaagtcccttttgatatataagataacatttacaggttccggggattaggatgtatacctctgcggggtgggggcgttattcagcctttcacaggaagcctgagctgtaagtctgttgttcttatttctatgggctagattttatctttaaacatgattttggtgattttcgaatgattggtatatcatttatttctttattcttcaagctgtaatttgtgagaatgtacccaaaactaaagagctgtgtgtttctgggaaataataatcatctaattacaacttaaaaatcatttctgggcagccttatttcaatagttagtttcactggcttagaaagtgttaaagtcctatttatatgtaattcatgagcataaatcaaggctatgtaaacattacaatgaaaataagtgtattacctagtcttcataaatcagattggcattcaacagatattattgaggccctagtcagtgtcaaccattttcaatgttatttcaatcaatcctctcaacaaccctaagaaatgggtattgtgttcatttgacagacaagggaatggagaaacttgaagaaattaggtgatttcccaggaattacatttgatttggtcttctgctctaagaccagtgttgtcccactattccaaatttattccctcaaaaaaagtgaatacagaaaagctgacatttttacaaagggctttcttacaaatgatcaccagtgatcctgtttagcttgactctagttcagcacattcaagggacatatgtagagtaagtgctccatccacccagtaccaccactttcctttctaagtttgcattttctcagaagcagactctgtgtgtaatttatttgagaggtgaccccaggaagttctggtagagaagtggggaagtgggacagaaaagggaaagaagtgtcgtaaaaataagtcaccactctgtcaatcctgctggggaattctaggagacagtagaacacgagaatcctagttatcccttgtgaagacaagggagccggggtgtttgtaatcccaacagtcattggttgagggcttctggggaaggggattctgcactttcagcctactgtgcacacaggaagagctggctcctgccaagacaaaaagttctcaggaatcgtgaaatgaggctggtcaggttccacaatgtgccaacagctatttgccactgagccagtaaaacagggaactaccactgatgaacttgtgctcctggtgacaaatttcaggacaaaaactcctctgaggacagtgggggcaggacatgcaggtatcctgaggtgatgtggactgaattgtgtactccctcaagattcatatgttgaagccctaaccccactaccttagaatataattacatttggagatagggtctttaaaggagcagttaaattaaaatcagttcattatggtgggtccttatccaatatgactgctgtcataagaagaggagattagggcctttctccctccccagccatcttggtggatgctcttggctgggggccatcccacacctaagacaggaagactgtggctgcaaaaaagacaaaaaaaaaaaaaaatcaccggagtcaatcagctgtaggctccaactcattatgaaaagtgaaaagtacatgctggagtacaagaagactctgaagatgatcagacaaggcaaagtgaaactgtcatccttgccaacaattgtacagctttgaggaaatctgaaatagcattattacagcatattggcccaaactggtgtccatcactacagtggcaataataatgaattgtgcacagcatgcagaaaatactacagattctgcacactagctatcatttatccagatgattctgatatcattagaagcatgccataacaggctggtgaaaggtaaaccatacaagattattctttactaaaacttgccaaagcttatttaaaacaaacaaacaaacaaacaaacaaacaaacaaacaggccgggcatggtggctcatgcctgtaatcccagcactttgggagaccgaggcaggcagatcacctgaggttgggagtttgagaccagcctgaccaacatggagaaactctgtctctactaaaaatacaaaattagccaggcatggtggtgcattcctgtaatcccagctactcgggaggttgaggcaggagaatcacttgaacccaggaggcggaggttgtggtgagctgagatcatgccattctgtctcaaaaaacaagccaaaaagaggagattaggacacagacacacacacaggaaagaccatgtatggacacaaaaagaagacagccatcttcaagcaaaggagagaggcttcagaggaaaccaaccctaccaacaccttgatcttggtcttccagcctccagaactgtgagaggataaatgtgtgttgtttaagccacccagtctgtggtactttgttatggcagccccagcaaactaatacataaggtacgttcagaaaagatagaaaccgcataggatcaaaaaacaaaagtccacctgatctttattttcagttgaatgcaaattgaaaactggcctcacaagctatttgacattgggggttttaagcaggaaatgtcagaatatggataatgggcacatagcagctaactagcatggcaacattgctttttgatccttcagaattagctgcaagtgatagaaaactcaaataaccttggcttaagcaagatagacatgtgtttctctttcacaaaggtgtgggtagttgggctgatatggctggctttcaatggagtcagggacccagatgctgccattttatgggtccatcagaaggccctccccttgtggcctaagatggcttcttgagcttcagcaaacatgtccaaattccagccgtgttgggccgttcttgcattgctataaagaaatacctgagactgggtaatttataaagaaaagaggtttaattggctcaccgttctgcaggctttacaggaagcatagtggcttctgcctctggtgaggcctcaggaagcttccaatcatggcagaaggtgaagcgggagcaggtgtctcacatggcaaaagcaggagcaagggcggggaaaggtgccacacactcatacacttttaaacaaccaaatttcatgagaacacactcactaccatgaggacaacaccaaggggatggtgctaaaccattcatgagaaatccaccctcacgatccagtcacctcctgctgggccccacctccaactttggggattacatttaaacatgagatttgagagataaatatcccatctgtatcaccagccaataagaggaaataaatgaagaacatcatcctcccttcacagccacatcctggaagtgttgcacatggcacttctgtttacatcccattggccggaacttagttccatggccacatattattgaagtgaaggctgggaaatgtagtctatattctgagtagctatgtaataggggtcctattactaagaaggaaggggagaacagagattgaggtcccactggcaatgttgaccatgtgtaaattacagatcacatctccaattatatagatgagtaaactgaatttcaaaaggatagattgttaaatgatttgcccagaatctcacattgaacaagtgacagatttaaaagccatggtgtttcccaaggatgattaagtcacttttcatgaaatattttacccagagagatcagtagtacttctagtttcatcagttaacttgctgggtcccagtgggtaagttttaataactgacctgttttcaatgtgaaggtcttgtttatgaaaaaaaaatataaaaagtgttaaaattaattcagtttaatgcaacattaactgaacagttgatgtgcccaaacattcttctgaatgccagagattcataactactgcctccctcactagacaacttcatagggccatcaaaatgtctttctttcctttttggccagggaagccagggaggaaggatacaagtccaggttctagcccagtgcctggcacatagtaggtgctgaattaaaagttaggtaaattaataaatgaccaaggaagggggatggagaggcacataatgttatttatatatgaattttatatatatatatatatatatatatatatatatatatatatatacatacacacacacacatacagtatagcatttcaaacaatgaatatatgtctatatgcatatgtataaacatataaaactataagtttatatagggtgtatatatatacatattatatatatacatatatataaaaacatataaaacattccacagaatacagataagagagaaactgagtccacatgagagaatcagggaaaactgaatacagtggatgacacttatagtgttcttatggagcaaatgtgagcccacctgctataaaatgggcatagaaagcaaacattccaatgcttaattcctagtaggtattgcataagagtaaatgaatggatggatagatacatacctgcaaaaagaatgcataaggtgagcatcagcccaagatacagaaagtggactggccagaatcttaggtaataagcccagtggctgccaagaggcaaagaaggcaggctggaaccaggctgtgaggagcccagtacactgagccaaggagtttggacttggttctgacaacaatagcgagcaaacaggccattgcaggctctgtgttctttaaagttaacacgatcgtgactaattcatgcacagaattatgacaaaattgcacagaattattaaggtaatgagctatagtttagtttaattggcagcatttttcttttctaatgtacatagtaatagaatgcttataatctatgatatctcagatttaatgaatttaagtacaaaattaaaactcaaaataccaaagcaacaaacgtcaacaaagatcatcaccttgctcttcagtacgttctgcttggtttctggatatcacatttattagttatctattgctatgcaacagaatacttcaaaatttagtggcttacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattagacccagccatcccattactgggtatatacccaaaggattataaatcatgctgctataaagacacatgcacacgtatgtttattgcagcactattcacaatagcaaagacttggaagcaagccaaatgtccaacaatgatagactggattaagaaaatgtggcacatatacaccatggaatactatgcagccataaaaaatgatgagttcatatcctttgtagggacgtggatgaagctggaaaccatcattctcagcaaactatcgcaaggacaaaaaaccaaacaccgcatattctcactcataggtgggaattgaacaatgagaacacttggacacaggaaggggaacatcacacaccggggcctgtcgtggggtgggggcagcggggagggatagcattggtagatatacctaatgtaaatgacgagttaatgggtgcagcacaccaacatggcacatgtatacatatgtaacctgcacgttgtgcacatgtaccctaaaacttaaagtataataaaaataaataaataaataaataaaaatttagtggcttaaagcaacatttattatttcacacattttctgtgaatcaggaattcaggagcagcttagcaagatggggcttggggtttttttaagacattttttagggcagttttagattcatagcaaaagggcttggagtcttttaattcttattttaggttcaggggtacctgtgcaggtttgttatatagataaattcacgtcatggggggctgttttacagattattttgtgacccaggtactaaccctagtatccaataggtattttttctgctcctctccctcctcccaccctccactctcaaataggccctggtgtgtgttgttcccctctttgtgcccattggttctcatcatttagctcccacttataagtgagaacatgtggtatttggttttctgttcctgcattagtttgctaaggataatggcctccagctccacccatgttcttgcaaagaacatgatctcattctttttatggctgcatagtattccatggtgtatatgtaccatagtatctctgtccagtctatcactgatgggcattttggttgattccatgtctttgcttttgtgaatagtgctgcaatgaacactgtgtgcatgtgtctttatggtacaatgatttatattcctttggatatatacccagaaatgggattgctgggtcaaatagtagttctgtttttactatttacaaatagtagttctgtatctactatttcctcaaatagtagattctttgaggaatcgccatactgcttgggcttggagtttttcacaaggttacaatcaagttgttgatcaatgctatagtcatctgacatcttgactctggctggaggatctgcttccaagacggcgtactcacatggctgttggcaggaggcctcagcttctctctatgtggacctctccacagggctgcttgaatgttctcacaactgttagctgacttcccccatagtgactaatccaagagagagagcaaggaggaagctacaatgccttctgtgtcctaatttcggaagttacccccatcactcccacagtattctttgttagatatcagtcactaagtacaaccccacataaaaggaggggaattaaacttcaccttttgaaaggatgagcatcagatcatttatggacatattttaaaaccgtcacagcatacaacacattctggtttgccttcgcccacacttgttactcttcccttcttcaacaggatttaaagtgctgtatttccacagagattaatctctgaccctattttctttcttatttacactctccaggttatcttcccagtcccagcactttcaatgccatctatatgtatattcatgtcttcaaaatgtgaatctcaagccccagcctctttctgctgcattcttgaccgattcattgagatgtctcactgagcctaagacatccaaaactgaactcttgatcatcattcagaacttgcttccctccacttcaccctttctccccaccccagaacaaacagcatccaaactggctcaagccaaaaactggggtatcattgctgacaggtggggttcttcctccccacttgtattacatctgctactaagtcctgttacaaaccatgtctcaagtccatctccttctatccccactctctgcccctgcctaccatcatccagctacaccaccattatctctcacctgaaccaccacaatagcttccttttactttttcttttgctccctctagtccatgctccaaagtgttcctcttaacagttaaattagaccatgtcagccctcttcttaaaacttttcagtgactttccaccagattaagaataaaattcattctacttaaaatgacataaatggctctacttgacctagactttgactacttctctaactccatcttccatcttatatcattctcccccatgcttactatgaatgaatgaatgagagggagaataaatgtagctgtcttgataacacttgctttattgactgccttcccttcctagtctcacttccccactcctttatcaacgttcccttcacctcctaagtaaaccacttccatgcaaattcttgtctcatggtctgcttctggggtagccaaaaccaagacactccccatccccaatctccacataactcctgagcttggaagataaatgagggaaatagaggaagcaatggaaagttccaacttttgcctgaagtttactactatccctaccagtcatggcattagaaatttgaggacacatcaacacacactagtataggagagctttataacccaggcaagtttttcactgggcacataagcccctacacatctgggaaagtgagatgtcttggggtatccctggacccgctggacttgtactctgtttcttgatggtagatgggaacccagacttaattttaactggctaagtacagtgaacttgccatactgggagctatgataaaaaaaataacaaaaatcaaaaccaccgccaacaaaaatcttcatggctggaccttgttgtccctatttagaaaatcttttatttcatttatatggcaatatttaaatgtatttaaacatcggcaaaagaagtttaatttctcaatttgtcttggagaatatcatgaagttttctggaatctgaccataaacaaacatactaagaattctggcacagtatatttttgcagaaaataaggaatcctatgaagaaatactacactacttacacaatccctggaatgtttttaaattaacttcagctgtggagacggcgattttctgattaatttgatcaatgtagacagcaagctgtataatgcattaaagaaactgggcaattcagcatttagctaagactcccacagctcagggcttccactccacagagacttgttcacctacattagcatttccctgtctcaagactcggttccctgagcctcatatgtgcaaaatattgtttaggaagagacagagagagagtgagagagaagctggccagtccatctagaccttccaaggtggcagaggatgttgatgggattagtacagtccaaaattagatattctatttcttttctttttttttttttctttttgagatggagtctcactctgttgcccaggctgaagtgcagtggcgcaatctcggctgactgcaagctctgactcccgggttcacgccattctcctgcctcagcctcctgagtagctgggactacaggccctgctaccatgcccggctaattttttgtatttttagtagagacggggtttcaccatgttagccaggatgatctcgatctcctaacctcttgatccgcccacctcggcctcccaaagtgctgggattacaggcgtggcccactgcgcccggccgagttgattcttaaacaattacttccattttttaacaaatgagagtgatgtagatttgatggcaaatctcctatatctttcgacagaactataatactaagatgcttttgtgactgagaaaggaattccttacagcagataagaaatcttaatttattaacaaagttaataaatttttgatggcccaagtgttagtcattaacatttgggggagttttataagtaacactttatacgacatcaaaaacaatgatttgggagaaattaatacacctcagatttctcagtttcaccttttcacctgaaagcaggcatgtgaaagcaataaagattgagaaaatgaggatttctctggagagttgtggtaatgtcaaacagtatatgaattttatcttctggtaactgtctcctgttagttaaccccaggcagtattctttgcaatcccaagtaattgactttgactggtacatatgaagtaggtttgaccacctgtaccaaggactcgtggctggtttctgattaggctttttaaaaatatcagatttcaacaaatttctatttggttttgtgtgatttcacatctaactgtttcagaaatattgttggagcttagtgagctcaccctacttctaaggaggctgttttgtgtattacaaaattcttgatatttccaactgcttgaaatctacctgtcactgtctgaagcctgcaggagggacacaggcctttttcttttgccccctgctgtttccctgcgccttctctatcccaccattcccctgctgcccttctcactcctgctcctaacacacaccacgatctacactcaaattttcaggccaccaactccccatgttcttaatggtgctgtccttggcacaggctattttttctgcctggaacaccttccccaccatacagcctcctcccacttctcctaagttccatggctaagttccattcatattgagccccatttcctccagaacacccctcacccacccatcccaatgtactaacttccatatctccccctagctcctgagaacttgcccctttggtagggtcatatgttggaatataatggggcttctctcatatacctcctgtagtctcagtgcctagtacagtgcctgatgtgtgtagttacttaataaattttgggtagacaaatgagtaggtgaatagtttggtgaagtgtgttcccctctggctcctaataccaatgaaatactcagtttttcttggccttagtttcttcatgcacaaaatgataggttggaaccagatgatatctaaggttgctttctttaaggtgaaattctatgataatctccccttagaatgaacagttattcctacaaacataaaaaaggcaagtcacatggaacctgtgacagctatgaggatgtgcctcgcagacatccaactgcagggagcataattgacccagggtcccaactactctgctcttggaaatccagcaccacttttaagtgaggctgcaactcccacaggctgctgccaccaatgactgagcatggcagggatactaaggcaggtccttctgtgggaaacgtggctctcctctgaaggtcaacacatctgataatattaatcctactactacgaataataaaagcaatcaattagggagcatttactgtgttagtcaccattcacagccctttacatatatttaatgatttcattatcacaaatacccttaaggtaaatactgttgttttccctgttttagaaaagagatagctaaggcatagaaagacaaagtaacttgctgaaggtcagagttaatatatagtagagccagaattcaaacccaggaaggagaccatagtcctgaccaccatgttatgcagcctctcaacattcagagttgatcccactctcttactagaaaaactctcctcatttggctttcccaacaatgtactaacctggtgttcctctgagcattgcctgggcctctttctggaccttcctgctctttggtccatctcttacatgctggcatctttgggactgtgccctaagcctccttcttttcttacactacatccacttctgtagaatcagttaccatctacctgcagatgattcccaaatatagttctgcttcctggactcctcacccaaatatccaacttcctactcaacacctcttctaggttgtccgtctaatgagtactcaaaatcagcatgtgccaaagagaattcatcatctatcctattccctaacgtgttcctccacccatattcctcattccagaaatacagtgctaacatctacccgatggtgcatccctctgacgctctatatccaatcgactaggatataagctccatgaggacagaaatcttatttcccttttggttgctgatgaacttctggaaactagcccagtgtctgatacattataggcactcaataaatacttgttgaatgaatgaatgaatgaatcactctaatccattaccaaatcttttggtcccactttgatgccattcatttctccttacctccactgcttctgctccagtccaagcaaccagaatctatcttctgagccaactggtatcttttcttccattctgtctccctccaatctatcttccagactgctttcgtggtactgtttttcaagagaaaaaccttatcaaataacattcctacttaaaacccttcagtgctgttctattgccattaagatgtaaaacccaaagccctaacttgattcacaagaccctctgtgatgtagcctctgccaacctctcggggctcatctctcacaagctgactcctccctccctttgttgtaatcctctggtcatctactcattcctcaagcacaagcatggtgtcttttacctcttagtctgcactcattctattccctttgcctctaatattctttcactttatgtggttgaaccctgtttgtcttaagtctaatttaaagtttgcaccttcaaagggaacatctgggaccctttagactggattatgtttctttgatttaagcttctgtaatagactgaatatattgagtgcctctgttaccctgaaccccttgtctaaaagctcatgagtaggggaccctctatgccaggattataagtgtatcctcagcacctagcactatagtccatacatattaatgccctattgaggattatactgattttttttttggcatcaggaaataggtaaggtccttcctattgtgattggggagcatattgcttgcaaacctgcagtcaagaagttgacagatcatctctaagattttgttgctagattgaattctaattaaatgaatcccacatttcttataaaaatatgaaattaaaattccaaaggcagaatttcccccatacagcttttctttcatcatgttttcttttgaaatccaactcaaatgtcacctaccctgtgacattttcctcctctttcccaagcaaggttagttcctctctccattctgctcccccaggcatcagcttcatgttgttaaaggaagaggtaaaagcagattgtagtactttgtcaaggtttctcacagatgtgtatggttaagaaatggacttactgtttatctatgtggaaggggtttttcaccaaggtatggggatagttgtttttaccaacaaatttcaatcttgttttcaaatcttaaaaacatcaaaacaaataacccagttaaaaaatgggcaaaggacctgaatagacatttatccaaagaagatatacaaatggtctataaacacatgaaagacacttaatagagaaatgcacatcaaaacaagatgctacttctcaagcattaggatgtctagagtttttaaaaatgaacaataacaagtgctggtgaggatgtggagaaattggaactctcatatattgctgatgggaaagtaaaatgatatagccatgttggaaaacagtcgggcagttcttcagaaagttaaatatacaactataatatgtcttagtcagttcaggctgctataacaaattaccataggttgggtggcttataaacaatagaaatgtatttctcaccattctgaaggctggaattccaagactagggtgtcagcatggtcaggttctggtgagggcactcttgggttgcaggctgccgacttctcaagctctctagccttttcttattagggcactaatcccattcataaaggctccaaccccatgacctaattacctcccaaagaccccaccaccaaataccatcacattgggattagggtttcaatatatgaattttggaggacacaaacattctgtccattgcaccatatgacccaacaattccactcctgtgtatatacccaagagaaattaaaacatatgtccacacaaaaacttgtgcaccaatgttcatagcaacattattcatgatgaccaaaatgtagaaacaacttaaatgtctatcaactgatgagtggataaataaaatgtggtatatccatattatggaatattattcagcaataaaaagaaatacagtactgttacaagctacaacatggatcaaacttgaaaacatactaagttaaagaagccagatacggaaggctacatattgtgggattccatttatatgaaatatccagaacaggcaaatccagagacaaaaagcagatttgtggttgccaggagatgaagggagaagttagttaagatgaactgctcataggtatagggtttatttttggggtgatggaaatattctggaactaaatagaagtgatgagtgcataacatagtgaaaatactaaaaaccactgaagtgtatactttaagagggtgaattttacgttatgtaaattatatctcaatttttaaaatactaaagtaaaaaaattattaaggacatcactgtatttggactggcacttatttactcagcatactttatggttagttgcccatagtttcttcttttttactgatacaaaatattttacatatttatggggtacatgtgagtgttacatgcatagactatatcatgatccagttgtacttggggtacccatcaaatactcaaataccttgagtatttaccatttctatgtgttggtaatatttgacatcctctcttctagctacctggaaatttacaatacattgttgctaactgtagtcaccctgctgtgctacagaatattggagtttatcataggttctttggaaactgttaggcgcagactgggtcaagattgtggtatcccttgcagaattgttaggaatatacaaattagattagacacatggctgcattatttctcagtcaaaactctttagcagagcattttaataatatttagcatgctatcctatacttgaatgcatatgtttccaatagactgtgaacttaagagagcaaagaccaggcccttttcgtcactgtactctatgtgcctgagacagtacttggtacatagcaaatgcacaataaatgttttgctttaaagtactactacttaatgaaagaaaagtttaccttccaggggacatttggcaatgtctggagacattttcgtttgtcagaactagaggggtgtgtgctactggcaactgtagataaagaccattgttaaatatcctacaatgcacaggacacctcccaacaacaaacaatgatctggcccaaaatatcagttgtgtagaagttgagaaaccctattctaaatgtttgagtgacttatgaatccctaaaattaattccattaaaaaatgaaaaaaagttctcttcaagaaaaagtaaatgttaaaatcatcctcccatttggtgctctcagtaaatgaaatgtctcagaccatatctttatagctcttaactgagtaatcacatttgtgggagaggcagatcttgagggaaatctacaaggttgtttaacttcccgaccttgacttagatattattaacttgcatgaagttcagttctgtagcagaaagcacatggtaaaatgtgcattcctttgtctgttaaagagcccaggaaacatttttacagtgtatttaatatgtgtaaggaaataatcacagccctccactaaacatacaatgcaagtattttccttcaaagtctggtagcaaccctgtccaataccaggacagtaagtaggtaaacatgcagtgagcttcatccatggcggcactacttgggggcacttggtgggggacagggggctcacctttttcaggcatctagatcaggcaagctacagcctgctggccaaagctaggtgatcccctctttataaacagcccatgagcgaagaacagtttttacatttttaaatgttagaagatggagcaaaaggagaataccatatcatgacacaggaaaattatatgctattcaaattacagtgtccataaataaagttttattggaacacagtcatgcgcatctgtttactattgcctatggctgcttttgtacttggacagatatcttatggccctacaaagcctaaaatacttaccatctggctttttacagaaaatgtttgccgatctctgctctaaaattaagcagtttagcaaattgggtttccaggaggtcaatgggaacgagccctgggctagaattcccaacacccagctctgctggggatgtgactccactccattggactggagtttcctcctctgtaacataagagggctttgctgaacgagcccttccaactcttaatcatctatagtgtatgttgattccagtctattcaatggttcccaggtgccagtgggataaaagtgcagagctctggtctgggacaaagccacaggattagaaagtgactgaaatagacaaagaactggatagttgctgtgcgtatacagagcagatctgaaaagtgacactctacaaggttcaaaaacatatactttggacatcttcatgtgccctagttttatagattcttttaaccgtggggaagaaggaaatggttgaaactaattattgaggaaggctggcaaccccaaaattcaggttttcaaaatctaatttagcacttactgcgggttcgttgaaattaaccaggtaattgacatctctggttcttttagtagtagggaagagtttctgttgtcttttctattttctcaatactaacatgtagttctttatctgcagtgcaaggcatcacgggttgttagcatcggcacgtcagcctggggtctgtcactatggaactaaactggcctgctgctacggctggagaagaaacagcaagggagtctgtgaaggtaattttgtaaaaactcagaccctgcacttggatcagggcccttaggtttttatctgtcataccatgaactgccacaaaattgccagtggatctctcaggcaaggacatgcataactaccaataaccaaggtctgggttcctatgagatctcttcccagacaaaatgtggctgacgccatcatacttggcatgatttattttagaagactgtcttgtcaattatttttgtgattatcttaatgagtatgactgggttgtttgtttttggttttctttttaatctaaaggaactaagatgggcaaaagcaggctggtaaatttctcctctaattataatttaagtgatttccaatgcaataaactttaattattaatcacccaaccagtaggcttcagccacaaaataagtacaccttttagcttatagatttgtaactcacatttttaaaattcatactgccaatttctaaatgctttcaaggtacatatgcatatatgcaaagattttaagtattttgctgatttttttgtacattgcaaaccaaggaaccataatttgccttggacattgtttctcagactatgtgttaggaactccgagagaggcctctgatcatttcaaggaggttgggaagggcagagatgagcataaagtttttgccttgtttttctttttatgactttccataacgaccaacactggcagtgtagcagaaccaaatccacattcctcctgactgtctcaccaggggtgtattccttcagggcagtagtctactctcactgtccctgtgtccttcagtaggtagcatgtgcctcatcctaagttatttatctattaaatgggataacaacacagttgcaggtcccataaaagcactaacatgttagctatttttaggaataacaatgctaccttctttttgctagtctgttcctgccccaacctccttctctctggctggttaaaaaatatctggattgaccataagtggggtcagaacttgataatatccaaaatctataaaacaatagaaaacattgatatcgttcccacatgttccatattatgcaaaaccttctgccatcatagtttgcttgtgacaagatgacaagagcataaaaatactagacaaaaacaaagatcatcattgcccacttagataaaggaagttagaatatcctcctgggacttgtgtcaattaaaagggtgggtcctcatcctgattggattgatagtgtcatgatcaagggcattgagaaccagactgacgtgggtgaccttgggcaagctagctaaggtaagctagctaaggctcaatttcctcctctgcaacctggagagagcaatacctacctctgagagtaaggaatgtatgcattaaagggtgagttcattacctggcatgcatagaaaatacctcataaattaccattccttcaggaaggaccaataattctcatcacagacttctcgtcattaaagcaccaggtgatggggggattaaatgtggctttattcttttgctagacacaacataacacatttttatttgaagtcagtcaggtggaaaggggcaaaaaccacgtgaaacacatgatttagagtctctcttacagttgcacgaacatcagcgtctactgccataaaacttgtgagacccagcatgtcgctggtgaataaatgaaggcaaggtgttaaaagggcaagtgcagggggttcaagcaaaatgctcactatgcaagttttgcaagctgaagagacggtcagcacacctactgctccagtcaaatgttcaggtcttaaattgcaatgatttttagatctaaaatgtgtatcatgttttatccaatttgcatggtccttcttgatggtaaagtcatgtttcttgaagcaccaaataacagggtagttattccctgattgctgggtttctgatttctaagccagagttgtgggatgcatgataataagaatacacatcaacctgccccaacaaggagagccagaccccaggctgtgaggtcacagtctacccaggccttcccctctgtccatctatttgcccttcactccttttgaagccctgcctctatgtatcctggagccttctagctctcagcctctaccctgtctaaatctcctcccaaggcagggtctcatcagttcgatatcattaaccttaaaatgtatgccacttcagtgagatgaaatacagaattgtccataaacaagtacctgatgaaaagcttcagatagagaagtttgggggagaaccaaataagacttttactttgtctaaatcatgcttcaatctcaggccattttaaacacaaactgaatttcccttgctgtcgattggctgttgaagtcacagatccaaagttactgtaaattgaaaacatcttactgaagctttaaccttatagcaagggtattattcaccatttctcctatgttctatttggcatttatgctgggctttcctgtctggaccacattggaaatcagtttccagggaacaactagaggtcttcagggcttaaaaaaaaaaaaaaagatttatttttctaacatctgaatttaaagttgcaactccaagtacatatccataacaaagtagacactggaaattaaattctctctcttttgtctctaaaagtggaaaaaccttgctggggaagcatttttcccttatgatttgttcagggccataaaatgttcccccattaaaagttctacagtaattactttattcattattcaaaaatattcaaatatttaacatgtttacaacactatattaaatgctacaggggaaacaatgatgaatgtttaagtccctgtcctgaaggcacttggaaacaagtagtggatgaaagacaagcactgtagccaaatatatgcctcattatttaataagacaaaaactgatcagttgcacaggagaggcctgccaaagttctgtggagttctcgaagttgagtgggcattcataggtggctggagaaatctgtaaaggcttttagaagaaggggccatgcaaggtggtccttgaagaatggggaggatatgaactactggaaacccagggaagagtatcctagggaggggtaggaaaaggtagaaagtaaagggtaggtctagagaatagcaagcaatatcttttgcccacagtgttgcctttgtcgggggggtgggggggctagaaaagaagggggaggccagatcaggctaggttctttctttttttttttttttttgacagagtcttgctttgtcacccaggctggagtgcagcagcgcaatctcagctcactgcaacttctgcctcctgtgttcaagtgattctcctgcctcagtctcccaagtagctaggattacaggtgcccgccaccacgcctggctaatttttgtatttttagtagagatgtggttttactatgttggccgggctggtctcaaactcctgacctcaggtgatccaccctcctcggcctcccaaagtgctgggattacaggctggagccaccatgcctggccagatcatgctagttttaacttggttatgatacctgtactgtattcaggagggaacaaagattatattatgacctctgtgcaaggcgtggcatgatcagagctatgcttttggactattagtttaatgtcgtgtctgacataaagtttgctaggagcagagcctgaaagggggattcttgtacaaatattccattgaaaggtatcttacgagcaatttgcaagggagtgagggagcatgggaagcggctaggcagagatatggtttcagaagaagtctagcttcagcctgatcccacagggacctctagggggttaattgcaccagagtttgtcctgccaagaaacaaggaactaggctgttagactcctgcatcagtgaggcactggtcacaagctgtggtggggaaagcagggagagggattcagcatcatcttccaagtatctgtgggcaaggtagttcccattagctagatagatagttgttcaatgaatgagttggtggtagaaacagggataggatgttgcaactgagtggtctggagacaagaaaaaatagacaactgaattttttgagtccaggtaactggtagaggaatgatgataataacaaaaaataggatctggggttgtagggaaagatgctggtatctttaagaataggctttcttagaggtggacctactgtgagccaggggaattgatggatggagaagtaggcaccattcctgggcaattgctgagtcattctttcctattatggctatttcttgagctcctactatatccagaaactgctgagagtccttgataccctaaaagtctcctttctctctcatatattatatcctctccctttctactcttgaggctttcccattttccttttttcctatctactgctttttctccttataacctccctgtgagctggaatgaaattgtccatcatctttgactgtttgttttcttgcccccaactgaatcggttataacatcctacccctgttgtttttcctaccactttattcattgaacaaatatttattgtctactttgtgtcaggagttgggatacagaagtgaataaaatagaaaaacaaatcctacctttgtcatgctttctcatgcctccatcatcatcctcatcatcatcatgatgcttttagttcccatccttagggctagaagcagcaccttcctccctccaatctgttggttgttcagtctgactgataatgtgcagcattaaaagattttgatcatttaaaagagaaatggagaaaatatggaggagatgaaacgaggcaagagacagaaggaaggggaatgacgttggcatttgcccagggttactctggagtctcttccagttccaacattatacttattttattaaatcttttgtgtttgcatgcaaaactggctgactgtggtctggaaggctttatatttcattgaataccactggaagtgtggtattgcctcccttcaaagggaggcagattgtcctctgtatgtccccatggagttctctgccacacagaacgcagcgaagttttgcgtgcatttcactacactaactactgttcttttatcatcaagacatcttttccttccacagctacatgcgaacctggatgtaagtttggtgagtgcgtgggaccaaacaaatgcagatgctttccaggatacaccgggaaaacctgcagtcaaggtcagtaaggtagcccagggtcatagttcaaattcaatcattgcagcagggctggcgactcaatatggtacgcaggatttcttagggtttttttaaagtcaaatcttcaaatgaaggtgctttcaggacaagtttttcaatctcttctccttgaaaaatgtaaaaagtctgatgtttttgtcaagatgcccaataaaaggccttttttcttttcttttctttttttatcttttttaaataagctaaaggtcttttatattttttacttttttatttcatctctttccgtaacacagaaaaaaagagcctttttaaaaagtaaataattttattgctttttaaactacctatgtattataagtatatttttatttttaaaaatccagcagtgcaaaaaaatataaacttaaaagtgagagtgatcaccactagtttttactataagcatagttaagtttgtcttagatcctggaagtctttttctgtgatagtataaatgtaagtttttctcataggcatctttgcatgtcagcacacacagaactactttacattttttaaggctgtatcctagtccctagtgtgaatacttttatcctttgtgcaaaaatgtgctttatttaaccattatcatttatgttgtctccaattttttgccattacaaacagtgctaaatctaacattgttctctgcatagccctgctttcttgaatgaatatttttgtaggaaaaatatttaaaagtggaattgttgggttgaacaacgtgcatatttttattatacttcatatactttttttttttttttgagacagagtctcgctctgtcacccagggtagagtgcagtggcgtgatcatggctcactgcagcctcagccacctgggctctagcaatcctcccatctcagccttctgagtagcagggaccacaggcacacaccaccatgcctggctactttttacagtttttgtatagacgaggtcccactacgttgcccaggctggtcttgaactcctgggctcaagccatcctcccgccttgccctcccaaagtgctggaattaaaggcttagccaccacacctggccttgatatatcataacagataatttataactttcatcctagattgtttgtctgaaaacattaaagagatgataatatctataacagtggttctcaacctgggtaattttgtctcccaggaagcgttgccagataaaatacagataccaagttagatttaaatttcagataaacaacaaataattttatagtatatgtttgttcaaaatagtatataggggatgtgagggtgatctggctgtgacatctgtcaccccattgctcacctgggttgatttggctgatctggctggctaggcagatgtccccttcctccctcactgctccatgtgtgtccctcctgaagctgcgcgctcgtgtggagaggacgaccatccccgatagaggaggacttaccttcagtcaagggtatattagctgtgctcccctgctagcacctccaaacaagctctcaaaatagtatatgagaagtgtgtatactttaaaagtattagtcatttatctgacattcaaatttatctgagaatcctttactgttttgtttagagatgggggtctcactatgttgcctaggctggagtgcagtgactatactgcatccatgatctcctggcctcaaagcaatcctctcgcctcagactcctgactacaggcacacaccaccacacccagctggaatcttgtatttttatttgccaaatctgggagccttatcccgggcaacatctggcagtgtctgaggacatttggagggggtgctactggtgtctaatgggtagagatcagggatgctgcaaagcaccttacacaatgcacaggatagcagcacccacaacaaagaatgatcagacccaaatgtcagtagtgccaaggctgaaaaaccctgctgtaaacgtggtgaataaaagtgcctcattggagcaagggatatggtctttgctatagatcagcagatttcaacttggctgattttgtcatccacaggatacttgacaatgactggggacaattttggttgtcataactggatgtgggaggtactcccggcatctagtgaatggagcccagggatgccgctaaacatcctgcagtgcacaggacagtccccacaacaaataatgatttgtgtcaacggaagttaagaaaccctggcatgaagaaatcttcaataattcagaaagggtccccagtcctataaggaagttgaacaaagagcagtaaatccaattcagctgcccttggagaatggagtttcagagaagactggacacccactccactctaccactcccagcccttgctgccaagcccagaggttagccccataaactgaaatagccgctctttgagctgccagccctacagtctcggagagcaatctggctctctgcgtcctgccaccagcatagaggccagagccctggagatgtttcttagaattgcatgcaattgcttgagagaggtgcttcaagaatcgtgcattcagggtgggcacagtggctcacacctgtaattccggcacttagggaggtcgaggtgggtggatcacttgaggtcaagagtttgagaccagcctggccaacatggcaaaaccccatctctactaaaaatacaaaaattagccaggcgtggtggcgaatgcctgtaatcctagctactcgggaggctgaggcaggagaatcacatgaacctgggaggtggaggttgcagtgagctgagatcgcgccactgcactgcagcctgggcaacagagcgagactccatctcagaaaaaaaaatcatgctttcataagtaataattcagctatacccttcaccagaggttttacagcagaaaacttggttttccatatgttttggattctgaaccaagatactgtctcaagagatttggaatagagacaatattttccacgctagttttaaagtctcagcaaaatattaacgttgagggagtggtccagttggatcaagttttgaggcagtctgttttcttcccacagcctccctgccctgtggcagcctgatcaaagtccacgtacatccattaatggtgacaggcctcagccctcaactcatgtctttcccaaaacactcttccaagaaatgagtgagtcacctcagagttagggccaagctatgggatattcctgggtttcccgttatgtccaatcagcatttttcaatttccccatttgaagaggttaggttctatgagggagatggtagggtaaaggggataggcagtggagaagagggtttcaaatgtccagctagggcactggaaaatccccatataaggatattttcagagatgaaagcagctccttattttcaagaatctgttaccatgctgaccttttgccttccatggaatttgtttgtttttttcctctctgtatgttccctggtagagttaagatatgaaaccctcacatgaccacatttccaaaggcgacatcctctacagataatcctttttaaagttctattttccttctgtgtcattttttattttaataaaaatgttacttattcttaagttgttgttgttgttgttgttgttgttgttgttttagaaaacaaaaaagcacagagaagaaagtcaccctcgatcttaccacctgaagataaccattagtcgcatttagagcataccctcctaggcttttcttttcctatgtattttttaaaccaattttggaatgatctgtacacagagttttgtaaccttcttttatcacgtaacatcctgtgaacgtcatatgtatatatttcatatatatataattcacatatatataattcatatatatatttcatatatataattcacatatataattcatatatatttcatatatataattcacatatatataattcatatatatatttcatatatataattcacatatatataattcatatatatatatatatttttttaaatcatccagcccaaatgtcatcctgtgaacatctttacttaggattaaatattgtcctccaacttcaccactaagagctgtctgacagggctccctctagaggaatgtgagccaaggcaatttggccagtgcaggggccagccaaaataataatcgacaggaggctgtgctgtcagcttatgtcagcggctgcttgggatagcatgaaaggcagaaatatataaattatctatttctaaattattgttcaagtagtatacacatagaattgtgcatatataaaaaatgtatggctcgatgaatttttctaaatgcccatgtcactagtatctagatcaaaagccagaaacttggcccttcagaagactccctcacacaccttccagtcacttccactgccagtgagagaaccatatgttgacctcttatatcacagattagctgtgcttattttttaactgtatataaatggactcatacagtatatacacgtttatatccagcttccactcaatatcatgtttgtgagattcatccattgttgcctatagttgtcgtttgttcagtttcattgctatatagtattccattgtgtgaatatacaagtcatttatctattcttctgttgggaggtgtttggattacttctagtttggggctatctagtatcatgctattatgagcattttagtatgtaggggaaatcccaggactggaatttccaggtcatgagtatgtctaaatatagctctagtagattctgccaagcagttttccaaagtgttgtaccaatttacattccttccagtggtgtataattattccatttgctacacattgtcaccaatcctttaaaatggaatttgatggtcagagagaaggtgggtaagtggtggtgttcagggaagctaacccagttgtcctttccaagactggggtctaatattccccatctggaagtttcctgattcagttcacctttccctgttttctaaatgtccctgcagatgtgaatgagtgtggaatgaaaccccggccatgccaacacagatgtgtgaatacacacggaagctacaagtgcttttgcctcagtggccacatgctcatgccagatgctacgtgtgtgagtaagtttcaacagccaggctgatctcagtcaatgtttaaggcttggcttttgccatttgatgcttggggaaaagctgacttcagtgattttttaaaaaatctctaatattgcccccagctaaaatgttttgtggcacttgtttctttctttcttttccttcctttctttccttctttctttcttcttttttttttttttttttttttttgagacagagtctcgctctgtcacccaggctggagtgcagtggtgcaatctgagctcactgcaacttctgcctcctgagttcaagcaattctcctgcctcagcctcccgactagctgggactataggcacatgccaccacgcctggctactttttgtatttttagtagagatggggtttcttcgtgttggtcaggctggtctcaaactcttgacctcaggtgatccacccacttcggcctctcaaagtcctgggattacaggcgtgagccaccatgcccagcttccataatttttttaaaaaagtaagtgctgattgggcacagtggctcacacctgtaattccaacactttgggaggctgaggcaggtggactacctgaggtcaggagttcaagaccagcctggccaacatgacgaaaccctgtctctactaaaaaaaaaaaaaaaaaatacaaaaattagctgggcatggtagggcacctgtaatctcagaaagaaaaaaaaaagcggtaaaataatgtgaaattcacattattttaaatttcaagtgaacaattcagtggcttttagtacattcacagtgttgtacaaccatcacccctatcgagttccagaagatcttcatcactccaaaaggaaaccagacccagtcactcctcactccccctcctccagcccctggcaactacaaatctgccttccttctctagggatttgcctattctggatgcttactttataaataaaaaggcaaactaggagaaaaattaattatatatctatatctgcatctatatatatgcagagccctgttgagtttcctcatgaaaataagcacgttgaacaaaataagcagattgttttagggaagtgatacatttaaattccttctcggaacatcaattcttcccaccagctaactttctcacgccccttgccccactaccaaagattagtgatacttgttggaaatacattccgacttactcaattccttgaaagaaaagcccttctgtgataaagaaaaacccatgtcctgtgggagagtgagagtctatacccattcatttattgagagggaaggcttttcaggttttatgttccagttgaaagggaaacccaccctccctgcctgccttcccttctccccttttctctctccatctttctttcctctgccttgcagcccccaacaaacccagagcctgtgccttcagccagcttcctgtggttgcggagttgcacagactccccagcccatcctgggttttcccgagattataaaatcttgcctagtgcacgggctcctccttggcaaagtgtcccaacaccaccagtcacgtagatcttctgctagcaagcaagcatttgaaaatgggcattggaagggcctttttaaaaaatccttattattataaattaaacagaaactcacaggaaacaaatgcatagtttaatgaattcttataaggcaagcacccttgtaatcatcaccaaatagaactctgccagaacctcctcctcccacccctccctaaagggaaccactatccaggcttttatagtaatcacttaaaatttcaaaaaagatgtacgctaatggatgtttctgaaacattccatgaaaacccagtcagtgccaaaaaagatatctttcctcaaatggaaagatagaattaggttaattttgaagattaattttaaaagaagacaactaaagagaaaagatgaaagaataaaggagtaatataatcataggtagatgtttgttataatacattgggtctctttctgtatatctaggggttacctgtgcctccctgtttatagctcaaagtgtccagatagccctagaactctctcctggatgctgattggattccaccaggccccttgggtctcttttgtccagctgggtgattggcacgttctggagggggatggagggagggagtacattcaccatgcccctctgttatggacattgggctgaaaccatatgagtttcttagcccccctgcatttctaatccacacatactggactgctgctataaaaatgcatttgtgtaagataagttatatttagcaacaagtgacaaaaaagccaagtaaattgtctcatttactttaaaagctgaaggcaagcagttccagagcagctcaagaagaagtccatctctgtcatcctcagagtattgattttactctcacacttgtggcctcatagttacaatatggctgccctagctccagacatcacacacacatggaaaatagacaaaactaagtgggtacgggtgatgccaatgaaccaatgcctctttcatgcctgtctctttttatcatgcagtaatatcttttccagaagccccactccctccagtggacttatttttgtatctctttggccacactgcatcatatggccactccttgctgaaggaaagctgggaaaagcctcagtgctgggaatggcaagagaagagtccagaatggctttcagatagctgatcagctatatctgccacacgttttagttcagtcacctaaaatatcgagtcttgtgacttaagtgactctcactgaggctagatatgtatggagagctctccagagtagattcttttaccctgattactcaggttgataatctccatcagcagttgcaattcaacctactgaggccagccaggtgacataaaagagtggctagagcacacacaagtggagaaagtgatacagtttgaggggtgcatgctctgcctaaagacagtcaaattcagtgaagtggccaagaaagcagaccatgagtaggattcagtcccagggccaccaagatgccacccctactgatcccttttggctctccatttgggactcagacaatgaaacttgtcctataatgccatgcaacgtgttccattcaatggctcagaatttggtgatagtttcttagtaagctctttttatcatctcaagagagaaaggctaatccttgtctactttttcagactctaggacatgtgccatgataaactgtcagtacagctgtgaagacacagaagaagggccacagtgcctgtgtccatcctcaggactccgcctggccccaaatggaagagactgtctaggtacaacagcaggaatcacctctactcctccttctcctcccttgactccccttttactgaatcttttttcattcatcacaatcagcttgttgactagacattggaaacttctaaaagtacagatttatatcagtttctgagatacttttagccacatatgctctaaacatactttgggatgctaaaaaacacatttttctattattttgtattgccttaatgccatagtagaaaagggataattttagtatatttactatgtacattttatttaaattaccatccaatataaactccactacttatattttgtcatttaatgagtaaggtcctaaggaccattgggttttattctgggttctagctaatattttctggaaaaactatatttacttattttttagatataacattattgaaaatagtatacaccttctatataatttacattagcatgtaataaatttcatgttgtctttaaaacttgctccaagttatatgaactaagtataattaatttaactggagaaaatgagcagattaagtccataatattaattaagggaacataaaaattatttgtttataactttgaatttagtcaaattcattggcttagaactttcctctcttgttctcctttgtcttattttgtgtcttagttttgggttccacagaagctgaccctgagcaagtagttgatttgggaggtgatcccagcctgaaatcccagcctgaaattcattcactaaggaataaaatatttatttcacatagattagggcaatagctgactggtaccagaatcttatgagtaagattctggttgaggagtagggaagtaacccagggaaaggaaggcaccagtgttgggtaaatctgatgagcaggttaaatgagctgggggcacctctgggaggcagagagaagctgcccctgaattttccctctggggcaggagtgctggatattcatccaccaacttctgcccttcattgatgggaggctgctctgggacatgaccccccagcactcccagcctagcctgggtcgggagcaaagcacaatgttgtaggtgcagcaagcagcctttggcaggtatggaaacttgagtgctgaggagctatggatggagcacccacagggcaccctcagtgactgaagcaacacttttttcactttgtgctttggttcctttgtggatttgaattatgttcaaccatcaaattgccatcaaattgtatatactcataacacttaattacattgcacctaatatacataatatttagagtaagtgagcacttagcattaatgagggatgtcaaaccaaatcagaatgttgaaagagttcttaatctgtgatttaaagaagcacatatcagtatgatttcataatcttcttcactacaatagaaatatttttcagtcaaggtgctagatgtttatttatcctaactatacataatgtaaaaaaaactgcatttagaaagctcagccaaatggatcctaaattagctaaacactttttaaaaatatacatgtaaattaaaattttgtctctactctgagaataatcaaaggtttaattaggttcacaggatttactactttttagtataataagatttatatgacaaggctaattattgaccaaactgaatccaaatttccacccaactctttgagttgttgggtgccatttttattggaagggaaaggtgatgtgcatgaaaatgatcaccaaaaataattttgttcaacccaacacttatttattatttggaaaatgcaagaggccagcctgggcaatatagcaagactccatctctataaaaaacttttgttaaaaatagccgggcatggtgatgtgcacctgtagtcccagctatgctagaggctgaggtgggaggatagcttggactcaggagtttgagaccagcctgagcaacatagggagaccccatttctacaaaaaaaaaataataaaaaatagccaggcatggtggcacatgctttgtagtcccagctactcaggaggctgaggtgggaggatcacttgagcctggggaatttgtggctgtagtgagccatgattgttctgctatgctccagcatgggtgacagaccaggccttgtctcaaaaaaaaaaaaaaaaaaaagattgcaagggaaatagtaagacaacatcaacttgccggtttaagccaggttcagaagaacaaactaacatctatttgatttgacatctgaaagttaaaccaagcctgagtcttagtagattggtcagcatagctgtcagcccctctgttacctgactttcaatggtagaaaaggaacaacacacctattgttggctaaaattacatcattacataattacacctgacccacaatttatgcataagtgcatgccttcacaaccacatttctgtgagtcaatattgcaggggccttggacagtcttactcaagaaatagttattttgtaaaatgcaaattgtaaaagtctgtgtgtttggtttacttaaagtatagctatctgactctagtttcaaaaattgtatatgttatacaatatacaatattcactcagctggagaaaatattcactcagcacacacgtaatgtataggtaccaagtgtcagacacatgctccctgcctgagaacagccagggcctaacagaagatgtgaatgtaagtaatgacattatggaaagataatgcatcttaaaaaggtataaaataatataaatacataaagtgaagagctgtgtgtgtgcctgggggatctagaacacttgccagaggatatgatgttggcaccagtatactattatcagtttcccagataaagaaaagtagctgtgagtgtgcgtgcgtgcatgtatgtggctacttttcttgctatcactgacaccttctggtttttacaccctagatattgatgaatgtgcctctggtaaagtcatctgtccctacaatcgaagatgtgtgaacacatttggaagctactactgcaaatgtcacattggtttcgaactgcaatatatcagtggacgatatgactgtataggtaagattcgatggcaccttttcctttttttcctgtccccaccaaacctttgagccttctctgcagatattttgatgtcaattcaagctattagttgaacaatctactgtgctgaccagcttaacaataaggaaaggttatttttttaggtgtctggcatttagggaattccaatgacatcaattataaagctaggtcaataaagatttaaagtaaggaatacagctctcttgtggaaacgattatctcaagatgattctggtgggactctctttaatttggctttttgttttgtttatattttttgttttatctccagttacacatctaaaaatcagaacaataaagcagtatttatatttggtaaaaggaagaataacaaggtctatctaatcttgatctcagtgatctgtttataacagtctccatcaggggtggctttagagaaatgtatgagagacatgaaggcctatgctctttactttcccctctttcagccctttcatagttcaagctccaaatataatgttccctttccacagttaccaaaattgctctctgataagattctggtatcagtcagctattgccctaatctatgtgaaataaatattttattccttagtgaatgaatttcaggcctccatgaacaagtgaggtggggtatttggggagaccttggatgcattcccattgccctttatataatgtaggatggggcctgccctatagtgaagggaaattcgggctctctgtggatttctctgcccgtaacacgtgtaacaaagctatatgcatgacatggaaggctaatagttgagaaaaaataggatttctttcaaccctatactcagggcttcccaggacacgtcttgtgtaatcatgttgggacaacacacaattgctgggtttcgaaccatcttgtgaagcctctacaactcttccctcaaatttcaaacacaaagtccatcctagagaggatcataaaatccatatttctcgtggacttggaccccatgccctcctgcagaccaaaccagcccagtaatcctatgatgctgtgttacagagtttaatcctgtttcctgatacctaaggggaggttccacagaacagggtggaattcacatggaaaggttcaaaaggaaacaaatctttgagactttaaaggtgactaagattaacatctgagctcagctttgtggctaaattaaaaccaacagactattttgtacatacatgtctacaaatgcatagatagaaaatggggtggagaatacggcaaacaaacctctcgcttgggtgaaacttggcaaattttcctcctctaaacccagcagacaagctcaggccagcctgaccctttctcctggcagtcttagaacaaaatgcctgtgcctataagttagatgatgtcaacggttcctagttgatcttgcctttgtttgttaggagtttcaagaccttctgaatatagaattgattttctggtattgttatttagttctaagttagaggagaaagttaagagaaaaacctaaacatcttacagatttcaatagcattgataagcaggagattaaattgctgtgggggagggaagcagcaaacactccctacataccaggcagcaaacaaagccagggctgctggccaatgagcctgcagttctgaacacctctcagttctcaggcaatgcttggtttgtcaggggtgtttagtgcttggccctacagttgatcaagtgtaagggtgagtctttcagcaagctctgtaccacagagtcgttcactggaatgttcttttttagatataaatgaatgtactatggatagccatacgtgcagccaccatgccaattgcttcaatacccaagggtccttcaagtgtaaatgcaagcagggatataaaggcaatggacttcggtgttctggtaagtagcatttggtcatggtgtcttagctattcccaatgaagcattctccccatatctccttcctccctctatttctctcctttctttgtcttcctcgccttctccctctcccttactctcactctgtgtgtgtgtgcagtgtttaactctctgcctcagccttctcttctttgctaattggaccacatctccaatactcactgaagttgtaggcactaaacttaaagaacagcaagggtacttaatatctttctggccatgacatacttcaaatactgaacataacatttaaggacaaaagacactgagcaaatttatctatcaggatagactgagttatgatgcagtaacaagcaaacctaaaataacagtggcttaaaaccacaaaggttttttaaccaagtgaatccggacgttttccagaatgcacaaccaaaacaaagtaaggcaaagctgatcttcattaaagtatgattactttatctgtcatcctcaacgctggatccacttgttttaatgtatatagcagagagttccattgttcttgctggtgaattatttaatactttttgttaaaactttaaatttataaaccagacatctaacaataaaatgtcactgctattaataactacagcaacaataaaggtttatttctcactcatgtaatatgtccaaagagaatttttcaggggtttcttctcaataaaatcacttaaggacacaggctgacagaggccccatcattttatggtaccatggtctcaattcaaggccttaaggtttgtcacagcagagaaagaagcatgaacaatcatgcaccagctgttagtttattcagcttggaagtatctaacttcaagggacaaaaataatattaaacttgctgtgtgtcccaaaagagaagaaaactagaaatcttggtgaataccaggaatgtcttccaaggcaaggcagctatgattacagcacaatcacttccctaacaatatcttacaatgtttaaagtcatccaggttcggctgggcgtggcggctcacacctgtaatcctagcactttgggaggcccaggtgggcagatcacctaaggtcaggagttcaagaccagcctggccaacatcgtgaaaccctgtccctactaaaaatacaaaaaaattagccgggcatggtggtgcacgtctctaatcccaactactcaggaggctgaggcacaagaattgcttgaacctgggaggcagaggtttcagtgagccgagatcgcaccactgcactccagcctgggcaacagagtaagactccatctcaaaaaattaaaaaataaataaataaataaagtcatccaggtttatccctctggtcatgacccttttagcactagctcatagtgtgactagacttgttgactgccctgattcaactctcttatataccccttagcagagttcccgcatgttcaataaatatggctgcaaggtgtaccctaacttacgtcacattccatacacccatctggccaatgctcccaatgatgcaaatgactgtaacagtatctactcagtcatacaaaaataaactatatgtaccatgctagacattcagcgccacacccataaaaggttcacagtaccccagtgggctattgttgagcaccactggacaagagtatgtataaaagaatataaccaaagaaaatgagtctggaaatcaaattctgtgaagaactgccaaaagaacagggcagcatttagtctgggaaatatagtatggaaaagcataaattgtgcctgtaaatactttaagaaatatgaaataaaagtggctttctcaagcaaactaagtccagtgggtggaggttacattctctcttaaaaatggctgctaggtattgaagagtggagcagggagccccatggagtagggacattccactgcccctggcttgcaggctgggggctctgagacggattcctgcattgggctggagatggtattaaatgaccacttagtgtccagcaactggatgccatggtttctatccctctagatagaagtatccaatgatgtccttctgaaacttgattcagagagagagattggctgcccaggcagggctgtgcataggtaggttggggggaaggacaccataaccttgggagttccccagagaggagactgaataaatcagctttccatatcggatgagtgcccaagggacctgtgctcaaagctcctttatgccaccaaatttgaacatgcacattccaggttgggaaggcctgagtttaaatcttagctctgccctatgctggctgtgacctttagcaaatttcttaacctctctaagctcagtttcctcctgttcaaaatggggtttatggtagtactgtggtgggttcttgtaatgggccagtccacagtcccttggagctccctaatcctattgaggtagggtagacagttgcatgcgtatctctagcagtgctctctctgacaggagtctccagcttccacttcacggggtgggacagttctgaggtgtgttctgcactggctcccagatgtccccagcaggactgagccccacttacccacagagattacctgtccatctaagcaccatcttttggcttttctcccttcctgtctcactgtctcctctccccagtttctgcctcctggaatcaccttccaagtaagtcatctgcacccaaatccttgtctcaggctctgcttagaggaacccacactaagacaaatatgtctcacagaggttcattgtgaggtttaaatgaggtaatatagagagagagcttagtttagcgggaccatatagtagatgctcattaaagttcgctgtgattgttattgttattagtatcatttcaatcagctgtttgttaagggccacccactctgaaatttcacaaaggtaaatatgaaaatgttgtgcatacaaaaaaagacacctcaggaaagcatttgtttcaataagtgggcaactcacccccacatactcactctcctacccctagaggggaatcgaaggcccagagtaaacctggagccatctttcttcctcgtcatttgatccccttaaaccgcaatgtattattaatgttcaaatgaaggcaacatctttaagcatgcaattagatagttgtttgcagcctgtgttttctatattgtaactcagtgctttgaaattgtaaatcctacatcaacacaaacatttcttgtgtcaagaaaatgtctgtttttcttggaccatccaactttattttgggataaaagaaatttgtctttattctttgaaacctcaaattcatcacactgttctattcaatatctgaaaattatgcattttgttatccattctgcagctaaattatttctttagtctttcactggaatgtttatttaaaggagaaaactatctttgggtcatttactatattacttgtccaacccttttcattttgctttaattctctaattctccataaaataaacagccatgttactattgaaaattcatcttaacaaggtcttaacattcattgcttaaagaaggatgcctcaaaatccactctttttttttttaaatttttttagtatttattgatcattcttgggtgtttctcggagagggggatttggcagggtcataggataatagtggagggaaggtcagcagataaacatgtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaacccttagtggacacagcacatgtttcagagagcacggggttgggggtaaggttatagattaacagcatcccaaggcagaagaatttttcttagtacagaacaaaatggagtctcctatgtctacttctttctacacagacacagtaacaatctgatctctctttcttttccccacatttcccccttttctattcgacaaaaccgccatcgtcatcatggcccgttctcaatgagctgttgggtacacctcccagacggggtggcggccgggcagaggggctcctcacttcccagacggggcggctgggcagaggcaccccccacctcccagacggggcggctggccgggagggggctgccccccacctcccggacggggtggctagccgggccaaaatccacgcttatgtacatacaagagtcataaaaacaaaaatgagagaattgcatctagttagcattcagcattataaaacattataaaatgttatattacaaatacatttgtatgcacataaattgttattatataatctagggcataggccgggcgcagtagctcatgcctgtaatcctagcactttggaaggccgaggcgggtggattgcctgagctcaggggtgcaagaccagcctgggcaacacggtaaaaccccgcctctactaaaatacaaaaaattagccaggcatggtggtgtgcgcctgtagtcccagctactcgggaggctgaggtaggagaattgcttgaagccaggaggcagagattgcagtgagctgagatcgtaccactacactccagcctgggcgaccgagcgagacttcatctccataaatatatacatatatatatatatatatatatgtcatatatatggcattgatgtagcaacttttattaagttcattgttttgaaaatttcagactctacattgcaatatggaaaaagagttagattatcctaacccattctctgtacctaaaggaagaagcaccctaaatgtagatgtgtatatgttccactgttctaatatgagtattaatagtatactgccagataatttggtcttgatttgacagcagctacacctcattctaagaaaatcaaaacccagataacactcaatttggggagtaacagtcaacttaggaaaggaaactgtcattggcttacgaggagcacagcttctggaatcgtattaccttagcttgattcctgacttgctagcctactacctgtggagtgagaacaaattattcaacctttcagtgcctcagtttccacacctgcaaaatagggatgatagtatctagcccttaatattgttttgatgattaaatttattcacacagaataagtgagcgtccatctaaagagcttagcaccagcccagaatatatgaaatgttcaataagtatgtgctaggagtaggagtaatagtgacaaagccctccttaccaaaattcaacaatcatttctgttgaaaagcagcttctttagtcactaaaaatatgctgattgcttaattcagtttgtagggtgtgtattcaagaatatgggttttgctacaaccaggccatccccattttttttcttcaattataaacattagaaacttggaggtatggcctgggaatttttctaactctggaaaagattttaaacattctggtcatgaatgctaaaaataatagcacacatgctgagtgtgtgccaagcactaatcttagtaatcgatgtgtgttcacccatttaagcctcccaaaaaaatctgttcttatcccaattttataaatggagagactgaggcaaagagaagttaattattcatttgaggacatatggctagaagatgtgggagctaggagtcaaactcaggaaaatgggcttcaggattatgtgcttaaacacaggacaggtgtgttcatgaccaattggttgatcctctgtgatggagaactcacagagtttgccctcctcagcaaactctcttggctcatcttttgttctgtcctagccccttcctgtttcctgggtcccatgctggaacacattcttcatctgtgattaagcttcttcttccaggactgtgtccaaagctcagattagtagaacttttctcctcccagatgatagatcatctaatgcactaagcacagttgaatgaatgtcaaagtcatattcctcctgggtaagatattctcacctaagagtgatcttctataaagttttattccaaagatatgaaattaaaattagggttttcaggttgatagaagtgtttgacaacatgggtgtttggagaaatctcaaatacctcccgagagaaattgtcaactttacaaaaaactggcctgtgaacctgaagacctaagttttatatctgagttccccaaatgtgccaaagaccctcctactgcaactccctccatattttttttttttttttgacatggagtctcactctgttgcctaggctggagagtagtggcatgatctcagctcactgcaacctctgcttcctgggttcaagcaattctcctgcctcagcctcctgagtagctgggattacaggcacctgccaccactcccagctaatttttgtatttttagtagagacggtgtttcacgatgtatgttggccaggctggtctcaaacacctgacctcaagtgatccgcctgccttggcctcccaaagtgctgggattacaggcgtgagccaccatgcctggcccctcccacatttttatattctcaaaaagatgatgcaataatcaataaatctttaagagaaaaccgtcataatgtcaaatttgaaacagcaatacctagataaatccaaatctacttatgcatatgcatatcattaaagtgcatttttatccttgcccagctttctgtttacatactaagagaatgaaattgtcaacactatcaagattatgatgttttagtttttgtttcttttcaataggaacatttgaaacttcaaagcagaaactgaaagcagatgtttaggtttgcctggtgtgagctgaaaccctttcctcattatttattaaaggtctttagttttatgttactgattgcaaaaaggaaatttgcagggaataggggtttcctgttaatttttcttgccaggtgctggagaaagatgcagtcgaccatggatggaattacagtggggcctccagaggaaggtctatatatgatcacacattacggtcataacttaacatgcaatctctggcaaagtagctgaaacaggctatctgaaggtcaggaaaatgagtaatgatgcattacttgtattagtgcttgttggttttctacctatagtcaggctgtcacaatgataaataactagaatatttcattgaaaagaaaaatgttgctcttttgattccaaagtaaaagcaattattaattaagagcatacatattttcaaagcatttttcccccgtttggttaccccaaatattgtggacttctgcttgtttatttttctactactttgatatagattgaatcagccaaatgatggagaaggaacaaagcaggagaagaggttaaaacattgttaagaaaaatattctaataaaatcccactccaattttttatagtactctttttaggcatcaaaattaatgtctactccattgtttcacttctctctaaactatgtccaaataatagaattaagtgaattgattgaggtgttattagaccctttcttgcttagtcttagattagtacatgcctagatattttatagtgagacaatatatttgatttcaaatatcagtgtatttaattttttaaaaattaattacttctttacatcagttggatattctgaattatcatgagtatatccctgaaaaggagacatatatctttgaattatagatctcaaggaatttgaaacagtctagagaaaagtaaccttaatcttaaagcagaaataaatctatcatagaaataggactggaaaaaagagacattcatggccaggcatggtggctcacacctgtaatcccaacactttgggaggccgaggtgggtggatcacccgaggtcaggggttcgagactagcctggccaacatggcgaaaccccgtctctactaaaaatacaaaaattagccaggtgtggtggcacgcacctgtgatcccagatactggggaggctgacgcaggagaatcactgcaacccaggagggggaggttgcagtgagccgagatcatgccactgcactccagcctgggtgacaagagtgaaactctgtctcaaaaaaaaaaaaagaaagaaaagaaaagaaaaatagtcattcatatgctctactgccaaatcttagctccgtccctaacatgatgagtgcctttgggcaagtcacttaacacccagttgcctcatcgacaagacaagagtcctggactaaatgaacttttttgtacctcttgcgttcttcgacaccaacatttttcctccaagggtcattagtccactgagggataagaagaattgatctagaggtacatttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagagactagaggtacatttttaaagtaatttacttttgtggtgggaaatagaaaacgaatgaaaaatagtaagtatagaagcctctctgaaatatttaataaataaactcatttagctttagataatggttgactgaggtgaaaaaattcaaaggggagagagaagagagaaagaaaattgggtatgtgtatattgcaccataagtcaccatttttgtaggtcacaaatggtccattattagcaatttatatggttcaacctaatgctgtagctgtaatttttgaatatcaaatttggacaaatctatagggctatcaggacaataccagtttttgaagaataccacaatgaaagcagaaatattagacgaacatggcaaatccatgtctttgggatctgtagcccaactgggtagtaataagtgtttcactaaagtggtctccgaagcaaaacaaaagcaacaaaaggtaattaagataactaccataacagtggaactgcttaaaacaatacaaatatagttcttcctaatttatcatcaaatagtagagcctcatgtgggttcattctggaagcattcacttactacactttaacactttttaaatgctccattttgtgagtaatttaattatcttccaatttggaacatattgcctcttatttgttttagctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgttttgtgagtgttatttttattttatatgttttatgaaaaatgaattgcaatttctcctggcaaatgaaagaagacaaaaagccggtttcacagcttaagtaaaatgggttgggtcttaagtcctgagaagcaacattctctgtaatgtctagaaacgaataccttctgcaaatacccaatcaaacctgctgctctaggaaccaaggaggggaagtcctgttcccctacttggggggtttcctatttgacacagaccttctcttctagcttccagccaaggaagcctgctagtcctgcaagggcagtggtttggctgcccagctctccatgaggcatgcccccaaatcaaagagaggctcaccacatggatctgctaagctctacctttttatttcttgaaggcacttttacaggcctagtctatgaaaatggaacctcacagttgtatggttgtgattttaaaagccaaaatcgacaaatgtaggaggacaaattttatagtggagcttaagttttctatgtgaactagagaactgccgtaactcccttttcactagttgctgtgcagaacccaccataaggctcagtccccccaggagggtttccatattaacccaccctgcatctctacactgagactttcccattcattctggctgggcatttgttgctccctctatattttgccttatctagtctcggctctgtgactggtggtcatatatacaaatgccagatggatttaaccaaaggaaaagtagacacaggcccacccgtccaagaactagcatccggtgacattctctgccttaatagagagtgaaaaatctcaaaaaaagaaaaaaaaaaacatatttccaaaacctagtatgaagggatgtatcaagagtgtagatgcttagtttacccaaggaaatgtctggaaaagatgttttagatgaggaaactggatccaatgtgaattatttggaaatgttagggaaacactgctctaatatattctgtaattagaatacatgatctaaccttctttgtttggtcatttgattgataccttctgagcatgtgggctttaaggtttttttcttaactgaccaagtgttctttattagtccctaaggtgaatgaagcaggtgaattcggcctgattctggtccaaaggaaagcgctaacttccaaactggaacataaaggtaaataattctttctcccaagtgtatgctctttcatgttgtcctggtcgttttcatttcttcatacagtgaaatgattgtttatgaatccctgcttcattcgtaaacccccaagggaaaaatcattacatcacacacacagtgccagtattaaaatagtaggtccttgtgtgactggtactaatgattgaaatatagtaaggctattctcttctccccgccactcccacctgatgctgagagtgaatggttgaagcagactgtatatatggagatgggagaaacttacatattttcttcaactctactgcctgaggacccacaacctgaaagtcctcatgtactaaatttggcccaaagtgcctgtatcagttacctattgccataataatgctgtgtaacaaacaaccacaagccctcagtggcctacagcaataaatatttatttttgcttatgagtctatgggttggctggacggttctgctgccctgagctaggctgggtgggctcactcatgtgtccacatacagtcagttgtgggcctgcttcgtgatgttgctgatcttggctgtgctttcttacatgcctgaggcctcagttgggaggattggactcactcagctctgctccatgtggtctctcatcctccagcaggctagtccaagctgtttctcatgaggcaacagcagggtttcaggaaagagagcagcagcacacaagatattttgaggtctaggcccagaaatggcacaacatcacttctgccatattccattggccaagccaagtcacaaggccagcgtagacttcaaggttgtggaaggagctgtgaagtcatacaaagagtgtggatacagagagggataaaaatcaggaccatttttgcgatcattccaccaaagcctcataatctggagtttcttaggcatgatccctaattcctcttggtttatttagaacgttcaccactcatgacaaattacacagacctcagggaaaagcccatttatatatttatccctttcacttggtataagtatgaatgccttgatcatctctttccttttcaaagtttctttcacttaccactatacatgtggtaagtaaaagattagcataaccttttccttttcaaacttccttttacttaccactatacatgtggtaagtaaaagattagcataaccttgtgctaattgattcccttttgtgtttaccctgtgagtgcattgcccagttctatcactttggtttacaggaccatctctaccgcaaaaaaaaatgtacctctctaattcagtcctccaaattgtatctgagaagcttctactaaaactcttcaaagcctagtaacctatgacccaactcctacaggcattttgttttcttccatatttctcctaagtattctatgtttttgtttctctgcattagacaacttattgcccattttcctggttagaaagaaaatgtttcattgtacagggggtaagctacgttctccaggtgctcacaagttctgcccaagctctgtctacccttgataagtgacatgaaggaatccgttgactcctctttcgatccccaaaccaccagatttcttagtttactttctattccatgattcctaatgaaacacagaaaggttaaaattttgcacatgaccatatgaccctgtaatttcaacagtccttgagtaagttgtcttggaaagctcagtcccaatcagaagattcagatgcatactgcaactcttccactggttgtttgccttggacaagtcacttggatttgcagtgcctccttgctttcatacataaaattggaataagagcaatattcatctcttaggtgctgtcttaggctgggttccccagaaatagaccccaagataagaatttgtgtgcaagtggtttatgtggaagatgatcccaggaaatggtggttgggggtgtgcataagtgagatggggagacaaggaggcaataatgggtatgttatcaggcaagtttccactgtgggcaactggagctcaatcccattggggaactccagaagccagtgtagaacacatggctcataattatcctactgaaggagtaaggaggctggggcatatatataccaactcccatctggcattgattgaaggctgctcccaggagggtgctgattccttggtgctcctggcctggcatgaaagcaaggaagggcaccactggggcaacttgatctcaatcccacttggaccctcgacaagacaggggaagcctgaattccaaactgactttagtccacattcaattccagcacttagtggtcctttccaaaggcaaggaaatggaggtatctatccaacaactcctgtccatcactggttgagggctgtccctgggaaaataacttcccagcattctagctcacctggttgggccaagaatgctccagccagagaacaccctcacacagagagctgtgagtgtttccagtagaaagccaaatgcctgcaagagaatataagtactgacagatatttgtgtggcaccaagagcatctgcttcaaggcaggtgtggattaaaccagagaatatatgtgaaagcactttccaaaccatgaagtgctatacaaatgaaagaatgtgcctgtgagaccaaagccttgagttttatctctgtatggaatagtttgctatatactattccatcatcccaatttacacactcgctttccccatgtggaggaaggggaagagtttgggagaaacattccaccacaattgtaaaccaactgaaaagctgatattccactatttgtgggataataacatcaactatctaactagtattagcactcattgaagaatactgaagactggaagccagtattacctggcatcttttacttttaaaactgggactagaaagaaaatatatttgctgcacagagaaaaaatagggagttaagaagaaaggaaagtgaggaaagggaccgtatgtgctcacttaggatatgtgcaagatggaaggtcctggattgcagtctgatttgggattcaggtccaactccagcattcagtgtcagcagaacttgagccttagttttagtttcctgaaaatgagtctgatgctagacgtttttttaaacaacctaatcaaatgatataaaatatttggcaaatcaaaatgagtcaagaatcagctgctgctgtgtttctttttaccctattccctttccttaccattcctttcttccccagcattaaaacatataaagccccaaaatcagagccagaggctagccttagttataaataaaaaatatctcattcttcacccccgccctttcccagtggtatttatctacatcagaggtcagccaacttttttctataaagggctagatagtacatattttaagctttgtaggccataaactactttcacaactattcaactccgtcattgtagctcagatgcagtcattgatgttatgtgaatgaatgggcatagtgtgtttcaataaaactttataaaacagacagtgggccaggatctacataaaagtaaccacaggcactggttcaaaacttaaaactagctgaatgaactcttatatttctctgacacatctaaacaaggcagtcattaacagtttagaggccaggcacggtggctcacacctggaataccagcattttgggaggccaaggcaggtggatcgtttgagcccaggagttcaagaccagcctgggcaacacaatgagacccccatctgtacaaaaaaaaaatttaaaaattagctggcatggtagcatgtgtccatagtcccagctactcgggaagctgaagtgggaggatcacttgagcctaggaggtagaggctgtagtgagctgtgtttgtgccactacactccagcctgagtgacagagcaagaacctgtctcaaaaaaaaagaaaaagaaagtagaaagttccggcaaggtcttcactggtttatttgggtaggagatattttattttctggcctgaattcgataaacaattgcttatattctgtttctctttgtgcatggggttctcgcccattactaattttttttttttttaaaaaagggtttttgttttattttgggttttttttttttttttttttgagacagagtctcaccctgtcacccaggctggagtgcaatgatgtgatcttggctcactgcaacctccacctcctgggtgattctcctgcctcagcctcccgagtagctgggattacaggtgtctgccaccatgcccagctaatttttgtatttttagtagagacggagtttcaccatgttggccaggctggtcttgaactcctgacctcgtgatctgcctacctcagcctcccaaagctttttgtttttttaagatcacaactgaatttgttcagaatggcttcacagacataactcaaaacagggtatgtcatgatctgtactctgtgcgactgaaaacaaggtattgccttccaaagccccaaatgttagacaccttcctaatgcttttaggggttatgaaatatgttctttctttttagcagatttaaatatctcggttgactgcagcttcaatcatgggatctgtgactggaaacaggatagagaagatgattttgactggaatcctgctgatcgagataatggtatttatatttgacagtttcatgttctgcaatatggtgaagggatagaaagccctccatgagtgatgggttgttattcccattactcatcagagcagggttgtttgtcatttttggaaacttttagaccttctgagctctcccttgatagatgactaacttggtccagcatatattctcctacttaatccctctcccacacacctgccaccacaaaggatatgggagaaaacctcttccatattcactctcctgctgctgagggagagatgttgagatttgtataaagtttgggagagttagggaaaaggtagaaagaaatggtttcttcttcccagtttaccagccatggcatcttgtagtttttgttttttgttttgttttcatgggggaaataaatcttgaaaggaaatataacctccacctaaacctggtgttttagtagagtggcccctcaaagcatgaaaaccataatgaacatcaagtcaatgacctgaactcctgaactgagctttcccttctgtttgttgcttgaggatttctttcgagccacctgtccttgaatttttctcaatcttatctgtgagctgcggatttcccacccttcccattgcctacttaaacactattgacggaccctaactatccccttagtgtttgtcttgcagatcccatttagagcacaaattgaatctctgtctcctgaagactgactatataattaaagtcaactgttacaccttcagggactccagttacttatcaatcaaattatttctttggggatgtataggctcagccctcagttaaaagatctttcttttagatccttcctctagaccaattcctctccaacatctttcctttcatgccctcacatgcaatcagaaaacctagatatcccctaacaagaattcctttttgaacttggggttaggggagaggggttacatctcacacagcagttgtgtgaatgggacttttactaaagattcagtgtaagcaaagggcaaatttaaccaggctgaaaacatcatatcattggaaaagctatcttgttgataactaacctgagtttctcttttcttccataatggcatctctaaatttatgtctaccagagctatatcatattgggagcccataggttattccaggacctccacagctgatataaggttatgttaagtcttaagttgagtcttctgtccaagggaagttccctatttacaaacactcaattcacaaataaccccagggttctcagcttctgcatcattcaaatcatacccctgctcctcctgcacctccattggatttctaggtgagcttttcattccctctgtacagctaaatatgaaaaataaacatggccaaggcgggaggattacttgagcccaggagtttgagaccagcctgggcaacactgggggatcccatcgctacaaaaaattgaaaaaaaataggctgggtgcggtggctcatgtatgtaatcccagcactttgggagcactttgggaagccgaggcaggtggattacctgaggtcaggagttcaagaccagcctggctaacatggtgaaaccctgtctctactaaatatacaaaaattagccgggcgtggtggtgtgtgcctgtaatcccagctacttgggaggctgaggcaggagaatcgcttgaacccgggaggcggaggttgcagtgagctgagatcgcactattgcactccagcctgggcgacagaacaagactccatctccaagaaaataaataaataaaaaataaaacacaaaaaaatgaaaaagaaaaaaattagccaggtgtggcggcatacacctgtgatcccagctattcaggaggctgaagtggaaggatcacttgggcccaggcatttgaggctataatgagctatgatggcacccctgcactccagcctgggtgacagagtgagaccctgcctcaaaaaaaaaaaaaaaaaagaaaaagaaaaaaagaaaagagacatgaatgagttagcattattaaagggataaaaccacaaagacagctcaaagcggactttatctgggagagaaagggaaaccttccacagtaggtgacagaaagcgtagctgaaagagatgccagatgaaatataggatggctatatttcagacaggcaattaatactttttagtatgtcttggacatgtactttatctgaaattcaaactccactgggcatcctatatttttatttgctaaatctggataccctactagctggggaagaagaccagattctggatgcattgaaaactaaggcaatgtcagcctgggtcctgcaagtatctccgacttgcagtagcagaagacgacccattccccaatgtcttcttcctggcttctatagaaatttttccttcttatcaacttcttcagaccctactctttgagagtttttgcccaagttcatcaaagccacaacccgaagattggatatgagcaaaagtccactacaccacaggttaaaagatacttagaagatttgcaggatttgaaggagagtgttcctgtcatcctaaatcagaaattggagtgatatgttacacatggtagttgagctccatgaaaccactagtacaggtgcaggtgtgttttggattaaacaccacactctggacccatttaaggagctgatcatcttacatgtcattgactcagtggggaagtgcattctaagtttcaagtcaccaaaatggaaatgaaattatggaacacaagttctccatcaactgcagattacctgcagtgctaaaggatcatttaattagattcttaccccatatctttgtgtatgctttgtgtatgcaaaaaattcctcggtttctctgaccatcaatttgtctatataacaaaagatttcaattgtgtgatccctaaaatccattttagcatgaaacttttattcctatgttcaaaatgaaaaggacttcagctttccctataggagactattgtttactttttatagctttttttatacattaaagccaaactccttacaattgcctcattaattgtgcattttttcccttctcttaaagctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcgtaagtgggaaaaaaatgattaaactcaatatttgcattcttttgcaatgatttaacaaatgaaacaaaacatttactgaagtatgtaggcattaaggatacaacgataagactttttccctacacttaaagaatacgttctggagctgaataggcaaggtgattaatcggcacaactcatggatacttatctggcgtatgcatatcacgttctatggaaataacctgtttgtcaggctcctctcaccagcgtccttccaaatcaggctatacatgctatacattccgtagtatgtaaaagaatgtcatgctcattcattctatgcccagaacttactacaattaatggcagctagaaggtgatttcttttaaatatttttttaaacggaactgagagagtggctattgtcagtgtccccaggaccacccttaggttcagtgattccgtaaaaggactcacacagaagtcagaaaagctgttatattcacaagtacagtttgtatagattaaaatcagtagagggaaaagacacgtagggcagaatccaggagagaccaggcagaggcttgcagtttttgtctcccagtagagtcatatgggcagctattaattctcccagcaaccaagcatgatgacacttacaaagtattgcccaccagggaagctcacccaaactttcatgtccaaggtttttgttgggggtcagtctgcccatgtgatcacctgcatagctgactttagttatctagtctccagcctctctagtggtcaagttgataccatgtgactcaaggcccccaccataagtcacattgttaccataaactatctggcatggcccaaggcctcaggtaaacaaaggcactcttaatcaaagagggtattacaagggcttagaggttatctcctaagaaccagtcaagggccaaacctttctttggaatgtgtatggtttggacaacccagacctactgagttaatcttttattgcacagtgggtttaataaaggaaaaggaaacagagttttaagaggaagttggtcaagtggatgaaaccctgagaaagaacaagcagaataaaaatggcaaagagtctattcagtttgacccatcagaaggtggctagtgacctttgcaagagttctttctttggaggggaagggtcgaaggtcacacttcagaaagatgaaaagagaagggatcagagccttaaggcagccactgtggacgttataaagagtttggtcaaggtaggccagacgaggtgactcacgcctgtaatcccaacactttgggaggccgagacaggcagatcacctgaggttgggagttcaagaccagcctgaccaacatggagaaaccccatctctactaaaaatacaaaattagccaggtgtgcaagcctgtaatcccagctactcagaaggccgagtcaggagaattgctttaacccgggaggcggaggttgcagtgagccgagatcgtgccattgcactcaagcctgggcaacaagagtgaaactctatctcaaaaaaaaccccgaaaaaacaaacaaatgaaaagtttggtcaaggtgggaaggaaaaagggtgaaagctagaaaaaggtacattaagtggtgataataggaagagcaattagtagatccatgtattgggattccatttatactttgcttgtgaaagatgactaatgcaaatttaacatcttttcatttacatgtcatagtttaattaaagcagaacatcttgtttaaaatatgtcatgagacatgactataaataaaagtatatgttgggtaccagttaatgaatttcctaaccactcttcccctctgaggtaaaagcagccagtgcttgtttaggaatgacacatgcattaatttgagtttattcttatagcagtacatttaaatcaatacaaatccaatccacgtattttcttgttgtgtttgcagcatggtttggggactgtggcactgagccatgctatatatggatgatatcccctgctggagaattgaaacatgcctctgcacagcattcataatcactttcatgttgactgaattcatgtgatggagaatatttttaatataacatggtagcttgcagggagggtatactagcaaaacagtgattttttttttaaatgcacatttctgtagacatgcccccaaagagcctggccagcaatcacactggaacacagcagtgctttcataagaggcattctcagacccaggcatctgttccttgaattcttcagttctaggggaaatcttgatggggggatattgaagggtaaggaagctgactaatccagtctaaagaatatattccagtttagcaatgtcatattggctgtggacatttgtaacatatgtgactcttgctgcataaacttgggcatacaatgtaagtcacattgctttctcgaaatcaaactatttctgaatccaaagccccatcccattaggctgggggggaaatttaatcttggctatttcctcattcagggttgggataggggccccctccctagggtagcctgtgcttttgaaaggctaaaaatggtccagacattaagaagggggcaacacatctttacttcatcatgggggccatggatacccatatcttctgcacctacgtggcccttgaagtcactcatctcttcaacttccatgccaggcccagacacagaaacctttactggggttggaatcttgttgctgagaatctagcctcaataggaacatcaggcaaccattttctgcccagggctctgccagggagatgcagtggtacagcatcctagtcctggagaatctcatggctcccctcaccacttctccttttaaccttctaccttcagccacagtctcagaaagttaagcttgtgggtaacaaacgtcaggaaagggaccatcttccagaaaagtctgcttttgattgttatatcccaaatctccttgataaaaaagaacattaaaatcctgcctaattttgggggggatagaggaggtaaaaatatagtgaaaaacacaaaattagtatgtcaattaattatccggacatttatttctagttatccagtggttatcagtcaggggtcttagtgttggaaaagccaccatatgccaagatgtagacatagccaccctcattatcccacccattgcagctgctgtgaggggtctgctgtttggctcacccctactttttaaaaaaagttcctttgggtgcaaaaggaacatctttctgaaagcagttccctcctgagactagaggaaaaagaaacttctatacccagttgtgctatcactggctgcttagtaataacttgtttccaatagttctcaagaaaatgcactcagattgagagcaaaagagagcagcccaggtactgagcagtcatagacccttgtcatctccatttgttccctgaggtttctcttctttggagagccagagaaaactggatatggtgatgacagcaagcctaaagttgcttcatttctgaagactattctgtgattctttattaagcaaaaaagagatggtgctggggatagtgaataattgcatgatggcattgttgtgagcatgattcttaaagggtctttctttaaaatgccaatttatacaagtttgaatttatataagtttgagcttaaaaagtttagaaatgacaaaaggaaattacttttttgaaaataagaaaagattcataatcatactacagtaacatgagtgcttttatatttcacattttactttgcacatgaatgtatatttttatttatctgtaactgcagtatgcgtaggctattgttgaatttcattttgataggctatatgtgcatgttattttaaagaataccatgttccaaatgaaatattcttttccctctatgtttgttccagggtaacttttgtcatctttgaatcaggatcattttgttgtcctctaaatctgcttatttcggatattgaagattgtagaaaccctctaggcctagtctgctctttatgggaggcatgggagacatacttctctttagagtgaatgttactggataggtgctccataaattgtagctattattattttcataattattgaatttaacaaatatttctagtgttttatctgattataaaattaacatgaactatttttttttttaaattacaatattgaagaaacattcattcaggccgggcgcagtggctcatgcctgtaattccagcactttgggaggcctaggtgggtggatcacttggggccaggaattcgagactagcttggccaacatggtgaaaccctgtactaaaaatttaaaaaatttaaaaaattagctgggcatggtggcacatgtctataatcccagctactcagaggctgaggcacaagaatcacttgagcctggaaggcagaggttgcagtgagctgagattgtgccactgcattccagcctgggtgacagagcaagactccgtctcacaaaaaataaatataaatataaataaataaaacaaaatcttcattcagcaaatattgattttaattttatttatttgaaaacatgtttggataaatgaatgaatataaaatagtcactgtatatccttaattttgttaaatgagtcccctgtcattttgtgtccaatttgaagataatttttttagtattcatcctctgttctctctatatagaaatttctaaactataaagaagtttgtttctcttttgattactaataaatttattagacaaaagtgattatagcatattatgaaatattttcaacacgtgaaaacaacattccagataatctccaaatacattaaccaatattttaagaaaaataattaggccgggcacggtggctcacgcctgtaatcccagcaacagagtgagactccgtctcaaaaaaaaaaagaaaaataattacactcatataaactaccaaaatctaaatatatctttgactatatagttttgttttttggttttttttttttttttttttttgaggcagagtctcactctgtcgcccaggctggagtgcagtggcgcgatctcggctcactgcaagctccgcctcccgggttcacgccattctcctgcctcagcctccgaagtagctgggactacaggcgcccaccaccacgcccggctaatttgtttgtatttttagtagagacggggtttcactgtgtgttagccaggatgatcttgatctcctgacctcgtgatccgcccgcctcggcctcccaaagtgctgggattacaggtgtgagccaccgtgcccggccttgactatatagttttttattagatgttcaaggggaatatcaaatttcttctcacttggtttttgtaaagaaaaccatattttattttttgttttgcttttctttaaatgtgaattccaaaatttccttttaaatcttattcttctcagctttatggcgtttttcagaatctatgtgggctttgctatgaccttgttttcaccaaatgtagttctctcagcgcagacacctggcatctaaaaaataatctattacagtatattcaatgtcgaagccggtttctatgaaatagggacacgagttaatagctattaaatagcttgattatatcattgttttgaacagtttggagtaatttttttattctctctccattattagatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatca

SEQ ID NO: 3053 - DNA, 63969 bp, human
ccccgtccagcttcatccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccaggtgagtgtctgactggcgattggcttccccccacccccggcctgaggtcccgctttggggccccatgtctttgcaggcacccccgcgtgtatgggtgtgagtgtgcacgtgtgcctgtgcgcgctgcgacgggatttaacctggataccaggccgggagcgcccacgggctttcctccctgctctcctgtggcggggctttgcacctagttagctccttttgcatcagctgtgccccacctggctgcgtccggagggttgcaggaggagggaggctctgcacgcagacccgtgggtgcgtgcgggcttgatggtctgcagacctgctgtaggggcaggtgtgtgagggttggtatgcgtgtcggtgggtgggttctgtgtctgtgcggttttgtgttttccactctattcacaggacaccaagtgcttgtcagtcgctagttttgctggggaaggagggaaagaaaccgaggacgataaagcatttactgttcttgagctgagccagccgggctgctctcctcactgctctctgattagggttgatgaactggaaagaaaggacacggttgtcagatgacaaccattctcattcttgctatggcaatgcagactctgaagccgttccctactgcccttaagcttagctgagacctgaaatattttttccagagatcggcaaagacgcttagtaaatgcacgcttacatggtgactgtcgacctggcactgttctaagcacttcaggactattaacctacccaaagccataatggctctgtgtgtaaggtactattatcatcatctccgtgttgtagaagagaaaaacgaggcacagagaggtaaagtaatttgcctgaggaagcatagccagtaagagatggagccagggtgcaaacctaggtattctggcccaaagtctgttcttcaccagggcactagggcagccttccggcaacggaagaggttttctggttctctaactgtgatgtcttgctttctacttaggtgtccactagaatatggtttttccaccgcagcattattgacctttcgggctgggctggataattatttgttggggtgatgggctgccctgtgcattgtaggatgtttagcagcacctgtggcctctactcactagatactagtagcaaccttgaccccaccccaccccccaccaccaccaccaccaccaagttgtggcaacaaaaaaaaggtttgggatattgcccaaggtccctggagggcacaattgctcctagcggagactgctgaactatagaaatttttcagtgatgattcctgaggagagtaggataagagctttggtttggtacaggcttctcgaaggtttgcctatctttgtttgacttacaggaaaaaatatttcatcagagttagccatggtattaaaggatttcgaagttaaaacagaacaaacctcaaaccaggttcttagaatgtatgatcgcaagtttcaatttccttttcatgataaaaatgtaagcagatgcaatttgctcataatcacattttccttgaatgctagaggttcttgcgttgctagaaagcccacttaaaaaagaccaaatgctgtttggagatgagattaatagttctttagcggccagcaaactgacctccaggagcttcactttcaaagtgccaccaaattaaattaaaagccaaaagcccctggataaaccaaagcatattaaactggagaatccatgtcaggattctgcaattctgcagttttcaagatgtgaaccatggtttctttagacgattatcaagtttatgagctggtgtgtttattatttgctcaatgtgcttggaaatgtcaagtggtcagctcttcaggaatgtccaggacccatgtttaatcagctctagattccacattatggataagacactgttacagagaaggcaaggcacccattgcagaaaactgtgtctactggttatttcctggggtttcacaacttataggaaaaactgtggctgctgtatagagatttccagtataagcatcagttctttttaattgaaacactgcactatgattttataacctagaaaattatgtgcttcttaaatggtatttagtgcatagtacacaattaacgctcatcaaatgaataaatcattagctccatgcatgtacctgcccttaagcttcagaatttggcttgccttatattttttatgtcctttgggtattggaactatttagataccctagacctgtccaatacagcaaagatggtaaccaggagccccaagtggctattgaatacctgaaatgtgaccagtccaagttgagatgtgctgcaaaaagtatcaaatacacatctaattttcaaaaaaaagaacaggaactatctcactaatcatttgatattgattacatgttgaaatggtaatgtggatatactgcattagataaaattgttattaagattaattgcttctgtttctttagcatttaaaaaatgtggctactagaaaattttaaatggcatatatggatatttatttctattggacagtgctggtctagaacacttattgatctgaactccatctcgagtgttctaagtcctaacactgggatctttttgccttgagtacctaagataaatatattattaactttgctattctggagattaacgtttggagcaactccttccttacaacatatttctgttttatatttttttctctactgaattcaagtaaaaataatgtgagagaggagggaatgactaggttcctgctgagaggctttacttacagagaccacatgctatgtgggtaattgatttttctcaaagccctggtagcaaagtgccactgtaaaaattggccacaaattccatggcttaaaacaagagaagtttattgtcttacagttctgaagaccggaagtccataatgaatcttatggggctaagattaaggcatcagcaggactggtttcttctggaggctccagggaggttccatttcttgtatcttccagcttctagaggctgccaacagtccttagcttgtggcacaatatctttttcctttgtcactttgccttctctctgattcttccttgttttcttcctcctaagaagaacccttgtgattatatcaggcccactcggataattcaggataatctgctcattgcaagagccctcactcgatcacatctggaaagtcccttttgatatataagataacatttacaggttccggggattaggatgtatacctctgcggggtgggggcgttattcagcctttcacaggaagcctgagctgtaagtctgttgttcttatttctatgggctagattttatctttaaacatgattttggtgattttcgaatgattggtatatcatttatttctttattcttcaagctgtaatttgtgagaatgtacccaaaactaaagagctgtgtgtttctgggaaataataatcatctaattacaacttaaaaatcatttctgggcagccttatttcaatagttagtttcactggcttagaaagtgttaaagtcctatttatatgtaattcatgagcataaatcaaggctatgtaaacattacaatgaaaataagtgtattacctagtcttcataaatcagattggcattcaacagatattattgaggccctagtcagtgtcaaccattttcaatgttatttcaatcaatcctctcaacaaccctaagaaatgggtattgtgttcatttgacagacaagggaatggagaaacttgaagaaattaggtgatttcccaggaattacatttgatttggtcttctgctctaagaccagtgttgtcccactattccaaatttattccctcaaaaaaagtgaatacagaaaagctgacatttttacaaagggctttcttacaaatgatcaccagtgatcctgtttagcttgactctagttcagcacattcaagggacatatgtagagtaagtgctccatccacccagtaccaccactttcctttctaagtttgcattttctcagaagcagactctgtgtgtaatttatttgagaggtgaccccaggaagttctggtagagaagtggggaagtgggacagaaaagggaaagaagtgtcgtaaaaataagtcaccactctgtcaatcctgctggggaattctaggagacagtagaacacgagaatcctagttatcccttgtgaagacaagggagccggggtgtttgtaatcccaacagtcattggttgagggcttctggggaaggggattctgcactttcagcctactgtgcacacaggaagagctggctcctgccaagacaaaaagttctcaggaatcgtgaaatgaggctggtcaggttccacaatgtgccaacagctatttgccactgagccagtaaaacagggaactaccactgatgaacttgtgctcctggtgacaaatttcaggacaaaaactcctctgaggacagtgggggcaggacatgcaggtatcctgaggtgatgtggactgaattgtgtactccctcaagattcatatgttgaagccctaaccccactaccttagaatataattacatttggagatagggtctttaaaggagcagttaaattaaaatcagttcattatggtgggtccttatccaatatgactgctgtcataagaagaggagattagggcctttctccctccccagccatcttggtggatgctcttggctgggggccatcccacacctaagacaggaagactgtggctgcaaaaaagacaaaaaaaaaaaaaaatcaccggagtcaatcagctgtaggctccaactcattatgaaaagtgaaaagtacatgctggagtacaagaagactctgaagatgatcagacaaggcaaagtgaaactgtcatccttgccaacaattgtacagctttgaggaaatctgaaatagcattattacagcatattggcccaaactggtgtccatcactacagtggcaataataatgaattgtgcacagcatgcagaaaatactacagattctgcacactagctatcatttatccagatgattctgatatcattagaagcatgccataacaggctggtgaaaggtaaaccatacaagattattctttactaaaacttgccaaagcttatttaaaacaaacaaacaaacaaacaaacaaacaaacaaacaggccgggcatggtggctcatgcctgtaatcccagcactttgggagaccgaggcaggcagatcacctgaggttgggagtttgagaccagcctgaccaacatggagaaactctgtctctactaaaaatacaaaattagccaggcatggtggtgcattcctgtaatcccagctactcgggaggttgaggcaggagaatcacttgaacccaggaggcggaggttgtggtgagctgagatcatgccattctgtctcaaaaaacaagccaaaaagaggagattaggacacagacacacacacaggaaagaccatgtatggacacaaaaagaagacagccatcttcaagcaaaggagagaggcttcagaggaaaccaaccctaccaacaccttgatcttggtcttccagcctccagaactgtgagaggataaatgtgtgttgtttaagccacccagtctgtggtactttgttatggcagccccagcaaactaatacataaggtacgttcagaaaagatagaaaccgcataggatcaaaaaacaaaagtccacctgatctttattttcagttgaatgcaaattgaaaactggcctcacaagctatttgacattgggggttttaagcaggaaatgtcagaatatggataatgggcacatagcagctaactagcatggcaacattgctttttgatccttcagaattagctgcaagtgatagaaaactcaaataaccttggcttaagcaagatagacatgtgtttctctttcacaaaggtgtgggtagttgggctgatatggctggctttcaatggagtcagggacccagatgctgccattttatgggtccatcagaaggccctccccttgtggcctaagatggcttcttgagcttcagcaaacatgtccaaattccagccgtgttgggccgttcttgcattgctataaagaaatacctgagactgggtaatttataaagaaaagaggtttaattggctcaccgttctgcaggctttacaggaagcatagtggcttctgcctctggtgaggcctcaggaagcttccaatcatggcagaaggtgaagcgggagcaggtgtctcacatggcaaaagcaggagcaagggcggggaaaggtgccacacactcatacacttttaaacaaccaaatttcatgagaacacactcactaccatgaggacaacaccaaggggatggtgctaaaccattcatgagaaatccaccctcacgatccagtcacctcctgctgggccccacctccaactttggggattacatttaaacatgagatttgagagataaatatcccatctgtatcaccagccaataagaggaaataaatgaagaacatcatcctcccttcacagccacatcctggaagtgttgcacatggcacttctgtttacatcccattggccggaacttagttccatggccacatattattgaagtgaaggctgggaaatgtagtctatattctgagtagctatgtaataggggtcctattactaagaaggaaggggagaacagagattgaggtcccactggcaatgttgaccatgtgtaaattacagatcacatctccaattatatagatgagtaaactgaatttcaaaaggatagattgttaaatgatttgcccagaatctcacattgaacaagtgacagatttaaaagccatggtgtttcccaaggatgattaagtcacttttcatgaaatattttacccagagagatcagtagtacttctagtttcatcagttaacttgctgggtcccagtgggtaagttttaataactgacctgttttcaatgtgaaggtcttgtttatgaaaaaaaaatataaaaagtgttaaaattaattcagtttaatgcaacattaactgaacagttgatgtgcccaaacattcttctgaatgccagagattcataactactgcctccctcactagacaacttcatagggccatcaaaatgtctttctttcctttttggccagggaagccagggaggaaggatacaagtccaggttctagcccagtgcctggcacatagtaggtgctgaattaaaagttaggtaaattaataaatgaccaaggaagggggatggagaggcacataatgttatttatatatgaattttatatatatatatatatatatatatatatatatatatatatatacatacacacacacacatacagtatagcatttcaaacaatgaatatatgtctatatgcatatgtataaacatataaaactataagtttatatagggtgtatatatatacatattatatatatacatatatataaaaacatataaaacattccacagaatacagataagagagaaactgagtccacatgagagaatcagggaaaactgaatacagtggatgacacttatagtgttcttatggagcaaatgtgagcccacctgctataaaatgggcatagaaagcaaacattccaatgcttaattcctagtaggtattgcataagagtaaatgaatggatggatagatacatacctgcaaaaagaatgcataaggtgagcatcagcccaagatacagaaagtggactggccagaatcttaggtaataagcccagtggctgccaagaggcaaagaaggcaggctggaaccaggctgtgaggagcccagtacactgagccaaggagtttggacttggttctgacaacaatagcgagcaaacaggccattgcaggctctgtgttctttaaagttaacacgatcgtgactaattcatgcacagaattatgacaaaattgcacagaattattaaggtaatgagctatagtttagtttaattggcagcatttttcttttctaatgtacatagtaatagaatgcttataatctatgatatctcagatttaatgaatttaagtacaaaattaaaactcaaaataccaaagcaacaaacgtcaacaaagatcatcaccttgctcttcagtacgttctgcttggtttctggatatcacatttattagttatctattgctatgcaacagaatacttcaaaatttagtggcttacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattagacccagccatcccattactgggtatatacccaaaggattataaatcatgctgctataaagacacatgcacacgtatgtttattgcagcactattcacaatagcaaagacttggaagcaagccaaatgtccaacaatgatagactggattaagaaaatgtggcacatatacaccatggaatactatgcagccataaaaaatgatgagttcatatcctttgtagggacgtggatgaagctggaaaccatcattctcagcaaactatcgcaaggacaaaaaaccaaacaccgcatattctcactcataggtgggaattgaacaatgagaacacttggacacaggaaggggaacatcacacaccggggcctgtcgtggggtgggggcagcggggagggatagcattggtagatatacctaatgtaaatgacgagttaatgggtgcagcacaccaacatggcacatgtatacatatgtaacctgcacgttgtgcacatgtaccctaaaacttaaagtataataaaaataaataaataaataaataaaaatttagtggcttaaagcaacatttattatttcacacattttctgtgaatcaggaattcaggagcagcttagcaagatggggcttggggtttttttaagacattttttagggcagttttagattcatagcaaaagggcttggagtcttttaattcttattttaggttcaggggtacctgtgcaggtttgttatatagataaattcacgtcatggggggctgttttacagattattttgtgacccaggtactaaccctagtatccaataggtattttttctgctcctctccctcctcccaccctccactctcaaataggccctggtgtgtgttgttcccctctttgtgcccattggttctcatcatttagctcccacttataagtgagaacatgtggtatttggttttctgttcctgcattagtttgctaaggataatggcctccagctccacccatgttcttgcaaagaacatgatctcattctttttatggctgcatagtattccatggtgtatatgtaccatagtatctctgtccagtctatcactgatgggcattttggttgattccatgtctttgcttttgtgaatagtgctgcaatgaacactgtgtgcatgtgtctttatggtacaatgatttatattcctttggatatatacccagaaatgggattgctgggtcaaatagtagttctgtttttactatttacaaatagtagttctgtatctactatttcctcaaatagtagattctttgaggaatcgccatactgcttgggcttggagtttttcacaaggttacaatcaagttgttgatcaatgctatagtcatctgacatcttgactctggctggaggatctgcttccaagacggcgtactcacatggctgttggcaggaggcctcagcttctctctatgtggacctctccacagggctgcttgaatgttctcacaactgttagctgacttcccccatagtgactaatccaagagagagagcaaggaggaagctacaatgccttctgtgtcctaatttcggaagttacccccatcactcccacagtattctttgttagatatcagtcactaagtacaaccccacataaaaggaggggaattaaacttcaccttttgaaaggatgagcatcagatcatttatggacatattttaaaaccgtcacagcatacaacacattctggtttgccttcgcccacacttgttactcttcccttcttcaacaggatttaaagtgctgtatttccacagagattaatctctgaccctattttctttcttatttacactctccaggttatcttcccagtcccagcactttcaatgccatctatatgtatattcatgtcttcaaaatgtgaatctcaagccccagcctctttctgctgcattcttgaccgattcattgagatgtctcactgagcctaagacatccaaaactgaactcttgatcatcattcagaacttgcttccctccacttcaccctttctccccaccccagaacaaacagcatccaaactggctcaagccaaaaactggggtatcattgctgacaggtggggttcttcctccccacttgtattacatctgctactaagtcctgttacaaaccatgtctcaagtccatctccttctatccccactctctgcccctgcctaccatcatccagctacaccaccattatctctcacctgaaccaccacaatagcttccttttactttttcttttgctccctctagtccatgctccaaagtgttcctcttaacagttaaattagaccatgtcagccctcttcttaaaacttttcagtgactttccaccagattaagaataaaattcattctacttaaaatgacataaatggctctacttgacctagactttgactacttctctaactccatcttccatcttatatcattctcccccatgcttactatgaatgaatgaatgagagggagaataaatgtagctgtcttgataacacttgctttattgactgccttcccttcctagtctcacttccccactcctttatcaacgttcccttcacctcctaagtaaaccacttccatgcaaattcttgtctcatggtctgcttctggggtagccaaaaccaagacactccccatccccaatctccacataactcctgagcttggaagataaatgagggaaatagaggaagcaatggaaagttccaacttttgcctgaagtttactactatccctaccagtcatggcattagaaatttgaggacacatcaacacacactagtataggagagctttataacccaggcaagtttttcactgggcacataagcccctacacatctgggaaagtgagatgtcttggggtatccctggacccgctggacttgtactctgtttcttgatggtagatgggaacccagacttaattttaactggctaagtacagtgaacttgccatactgggagctatgataaaaaaaataacaaaaatcaaaaccaccgccaacaaaaatcttcatggctggaccttgttgtccctatttagaaaatcttttatttcatttatatggcaatatttaaatgtatttaaacatcggcaaaagaagtttaatttctcaatttgtcttggagaatatcatgaagttttctggaatctgaccataaacaaacatactaagaattctggcacagtatatttttgcagaaaataaggaatcctatgaagaaatactacactacttacacaatccctggaatgtttttaaattaacttcagctgtggagacggcgattttctgattaatttgatcaatgtagacagcaagctgtataatgcattaaagaaactgggcaattcagcatttagctaagactcccacagctcagggcttccactccacagagacttgttcacctacattagcatttccctgtctcaagactcggttccctgagcctcatatgtgcaaaatattgtttaggaagagacagagagagagtgagagagaagctggccagtccatctagaccttccaaggtggcagaggatgttgatgggattagtacagtccaaaattagatattctatttcttttctttttttttttttctttttgagatggagtctcactctgttgcccaggctgaagtgcagtggcgcaatctcggctgactgcaagctctgactcccgggttcacgccattctcctgcctcagcctcctgagtagctgggactacaggccctgctaccatgcccggctaattttttgtatttttagtagagacggggtttcaccatgttagccaggatgatctcgatctcctaacctcttgatccgcccacctcggcctcccaaagtgctgggattacaggcgtggcccactgcgcccggccgagttgattcttaaacaattacttccattttttaacaaatgagagtgatgtagatttgatggcaaatctcctatatctttcgacagaactataatactaagatgcttttgtgactgagaaaggaattccttacagcagataagaaatcttaatttattaacaaagttaataaatttttgatggcccaagtgttagtcattaacatttgggggagttttataagtaacactttatacgacatcaaaaacaatgatttgggagaaattaatacacctcagatttctcagtttcaccttttcacctgaaagcaggcatgtgaaagcaataaagattgagaaaatgaggatttctctggagagttgtggtaatgtcaaacagtatatgaattttatcttctggtaactgtctcctgttagttaaccccaggcagtattctttgcaatcccaagtaattgactttgactggtacatatgaagtaggtttgaccacctgtaccaaggactcgtggctggtttctgattaggctttttaaaaatatcagatttcaacaaatttctatttggttttgtgtgatttcacatctaactgtttcagaaatattgttggagcttagtgagctcaccctacttctaaggaggctgttttgtgtattacaaaattcttgatatttccaactgcttgaaatctacctgtcactgtctgaagcctgcaggagggacacaggcctttttcttttgccccctgctgtttccctgcgccttctctatcccaccattcccctgctgcccttctcactcctgctcctaacacacaccacgatctacactcaaattttcaggccaccaactccccatgttcttaatggtgctgtccttggcacaggctattttttctgcctggaacaccttccccaccatacagcctcctcccacttctcctaagttccatggctaagttccattcatattgagccccatttcctccagaacacccctcacccacccatcccaatgtactaacttccatatctccccctagctcctgagaacttgcccctttggtagggtcatatgttggaatataatggggcttctctcatatacctcctgtagtctcagtgcctagtacagtgcctgatgtgtgtagttacttaataaattttgggtagacaaatgagtaggtgaatagtttggtgaagtgtgttcccctctggctcctaataccaatgaaatactcagtttttcttggccttagtttcttcatgcacaaaatgataggttggaaccagatgatatctaaggttgctttctttaaggtgaaattctatgataatctccccttagaatgaacagttattcctacaaacataaaaaaggcaagtcacatggaacctgtgacagctatgaggatgtgcctcgcagacatccaactgcagggagcataattgacccagggtcccaactactctgctcttggaaatccagcaccacttttaagtgaggctgcaactcccacaggctgctgccaccaatgactgagcatggcagggatactaaggcaggtccttctgtgggaaacgtggctctcctctgaaggtcaacacatctgataatattaatcctactactacgaataataaaagcaatcaattagggagcatttactgtgttagtcaccattcacagccctttacatatatttaatgatttcattatcacaaatacccttaaggtaaatactgttgttttccctgttttagaaaagagatagctaaggcatagaaagacaaagtaacttgctgaaggtcagagttaatatatagtagagccagaattcaaacccaggaaggagaccatagtcctgaccaccatgttatgcagcctctcaacattcagagttgatcccactctcttactagaaaaactctcctcatttggctttcccaacaatgtactaacctggtgttcctctgagcattgcctgggcctctttctggaccttcctgctctttggtccatctcttacatgctggcatctttgggactgtgccctaagcctccttcttttcttacactacatccacttctgtagaatcagttaccatctacctgcagatgattcccaaatatagttctgcttcctggactcctcacccaaatatccaacttcctactcaacacctcttctaggttgtccgtctaatgagtactcaaaatcagcatgtgccaaagagaattcatcatctatcctattccctaacgtgttcctccacccatattcctcattccagaaatacagtgctaacatctacccgatggtgcatccctctgacgctctatatccaatcgactaggatataagctccatgaggacagaaatcttatttcccttttggttgctgatgaacttctggaaactagcccagtgtctgatacattataggcactcaataaatacttgttgaatgaatgaatgaatgaatcactctaatccattaccaaatcttttggtcccactttgatgccattcatttctccttacctccactgcttctgctccagtccaagcaaccagaatctatcttctgagccaactggtatcttttcttccattctgtctccctccaatctatcttccagactgctttcgtggtactgtttttcaagagaaaaaccttatcaaataacattcctacttaaaacccttcagtgctgttctattgccattaagatgtaaaacccaaagccctaacttgattcacaagaccctctgtgatgtagcctctgccaacctctcggggctcatctctcacaagctgactcctccctccctttgttgtaatcctctggtcatctactcattcctcaagcacaagcatggtgtcttttacctcttagtctgcactcattctattccctttgcctctaatattctttcactttatgtggttgaaccctgtttgtcttaagtctaatttaaagtttgcaccttcaaagggaacatctgggaccctttagactggattatgtttctttgatttaagcttctgtaatagactgaatatattgagtgcctctgttaccctgaaccccttgtctaaaagctcatgagtaggggaccctctatgccaggattataagtgtatcctcagcacctagcactatagtccatacatattaatgccctattgaggattatactgattttttttttggcatcaggaaataggtaaggtccttcctattgtgattggggagcatattgcttgcaaacctgcagtcaagaagttgacagatcatctctaagattttgttgctagattgaattctaattaaatgaatcccacatttcttataaaaatatgaaattaaaattccaaaggcagaatttcccccatacagcttttctttcatcatgttttcttttgaaatccaactcaaatgtcacctaccctgtgacattttcctcctctttcccaagcaaggttagttcctctctccattctgctcccccaggcatcagcttcatgttgttaaaggaagaggtaaaagcagattgtagtactttgtcaaggtttctcacagatgtgtatggttaagaaatggacttactgtttatctatgtggaaggggtttttcaccaaggtatggggatagttgtttttaccaacaaatttcaatcttgttttcaaatcttaaaaacatcaaaacaaataacccagttaaaaaatgggcaaaggacctgaatagacatttatccaaagaagatatacaaatggtctataaacacatgaaagacacttaatagagaaatgcacatcaaaacaagatgctacttctcaagcattaggatgtctagagtttttaaaaatgaacaataacaagtgctggtgaggatgtggagaaattggaactctcatatattgctgatgggaaagtaaaatgatatagccatgttggaaaacagtcgggcagttcttcagaaagttaaatatacaactataatatgtcttagtcagttcaggctgctataacaaattaccataggttgggtggcttataaacaatagaaatgtatttctcaccattctgaaggctggaattccaagactagggtgtcagcatggtcaggttctggtgagggcactcttgggttgcaggctgccgacttctcaagctctctagccttttcttattagggcactaatcccattcataaaggctccaaccccatgacctaattacctcccaaagaccccaccaccaaataccatcacattgggattagggtttcaatatatgaattttggaggacacaaacattctgtccattgcaccatatgacccaacaattccactcctgtgtatatacccaagagaaattaaaacatatgtccacacaaaaacttgtgcaccaatgttcatagcaacattattcatgatgaccaaaatgtagaaacaacttaaatgtctatcaactgatgagtggataaataaaatgtggtatatccatattatggaatattattcagcaataaaaagaaatacagtactgttacaagctacaacatggatcaaacttgaaaacatactaagttaaagaagccagatacggaaggctacatattgtgggattccatttatatgaaatatccagaacaggcaaatccagagacaaaaagcagatttgtggttgccaggagatgaagggagaagttagttaagatgaactgctcataggtatagggtttatttttggggtgatggaaatattctggaactaaatagaagtgatgagtgcataacatagtgaaaatactaaaaaccactgaagtgtatactttaagagggtgaattttacgttatgtaaattatatctcaatttttaaaatactaaagtaaaaaaattattaaggacatcactgtatttggactggcacttatttactcagcatactttatggttagttgcccatagtttcttcttttttactgatacaaaatattttacatatttatggggtacatgtgagtgttacatgcatagactatatcatgatccagttgtacttggggtacccatcaaatactcaaataccttgagtatttaccatttctatgtgttggtaatatttgacatcctctcttctagctacctggaaatttacaatacattgttgctaactgtagtcaccctgctgtgctacagaatattggagtttatcataggttctttggaaactgttaggcgcagactgggtcaagattgtggtatcccttgcagaattgttaggaatatacaaattagattagacacatggctgcattatttctcagtcaaaactctttagcagagcattttaataatatttagcatgctatcctatacttgaatgcatatgtttccaatagactgtgaacttaagagagcaaagaccaggcccttttcgtcactgtactctatgtgcctgagacagtacttggtacatagcaaatgcacaataaatgttttgctttaaagtactactacttaatgaaagaaaagtttaccttccaggggacatttggcaatgtctggagacattttcgtttgtcagaactagaggggtgtgtgctactggcaactgtagataaagaccattgttaaatatcctacaatgcacaggacacctcccaacaacaaacaatgatctggcccaaaatatcagttgtgtagaagttgagaaaccctattctaaatgtttgagtgacttatgaatccctaaaattaattccattaaaaaatgaaaaaaagttctcttcaagaaaaagtaaatgttaaaatcatcctcccatttggtgctctcagtaaatgaaatgtctcagaccatatctttatagctcttaactgagtaatcacatttgtgggagaggcagatcttgagggaaatctacaaggttgtttaacttcccgaccttgacttagatattattaacttgcatgaagttcagttctgtagcagaaagcacatggtaaaatgtgcattcctttgtctgttaaagagcccaggaaacatttttacagtgtatttaatatgtgtaaggaaataatcacagccctccactaaacatacaatgcaagtattttccttcaaagtctggtagcaaccctgtccaataccaggacagtaagtaggtaaacatgcagtgagcttcatccatggcggcactacttgggggcacttggtgggggacagggggctcacctttttcaggcatctagatcaggcaagctacagcctgctggccaaagctaggtgatcccctctttataaacagcccatgagcgaagaacagtttttacatttttaaatgttagaagatggagcaaaaggagaataccatatcatgacacaggaaaattatatgctattcaaattacagtgtccataaataaagttttattggaacacagtcatgcgcatctgtttactattgcctatggctgcttttgtacttggacagatatcttatggccctacaaagcctaaaatacttaccatctggctttttacagaaaatgtttgccgatctctgctctaaaattaagcagtttagcaaattgggtttccaggaggtcaatgggaacgagccctgggctagaattcccaacacccagctctgctggggatgtgactccactccattggactggagtttcctcctctgtaacataagagggctttgctgaacgagcccttccaactcttaatcatctatagtgtatgttgattccagtctattcaatggttcccaggtgccagtgggataaaagtgcagagctctggtctgggacaaagccacaggattagaaagtgactgaaatagacaaagaactggatagttgctgtgcgtatacagagcagatctgaaaagtgacactctacaaggttcaaaaacatatactttggacatcttcatgtgccctagttttatagattcttttaaccgtggggaagaaggaaatggttgaaactaattattgaggaaggctggcaaccccaaaattcaggttttcaaaatctaatttagcacttactgcgggttcgttgaaattaaccaggtaattgacatctctggttcttttagtagtagggaagagtttctgttgtcttttctattttctcaatactaacatgtagttctttatctgcagtgcaaggcatcacgggttgttagcatcggcacgtcagcctggggtctgtcactatggaactaaactggcctgctgctacggctggagaagaaacagcaagggagtctgtgaaggtaattttgtaaaaactcagaccctgcacttggatcagggcccttaggtttttatctgtcataccatgaactgccacaaaattgccagtggatctctcaggcaaggacatgcataactaccaataaccaaggtctgggttcctatgagatctcttcccagacaaaatgtggctgacgccatcatacttggcatgatttattttagaagactgtcttgtcaattatttttgtgattatcttaatgagtatgactgggttgtttgtttttggttttctttttaatctaaaggaactaagatgggcaaaagcaggctggtaaatttctcctctaattataatttaagtgatttccaatgcaataaactttaattattaatcacccaaccagtaggcttcagccacaaaataagtacaccttttagcttatagatttgtaactcacatttttaaaattcatactgccaatttctaaatgctttcaaggtacatatgcatatatgcaaagattttaagtattttgctgatttttttgtacattgcaaaccaaggaaccataatttgccttggacattgtttctcagactatgtgttaggaactccgagagaggcctctgatcatttcaaggaggttgggaagggcagagatgagcataaagtttttgccttgtttttctttttatgactttccataacgaccaacactggcagtgtagcagaaccaaatccacattcctcctgactgtctcaccaggggtgtattccttcagggcagtagtctactctcactgtccctgtgtccttcagtaggtagcatgtgcctcatcctaagttatttatctattaaatgggataacaacacagttgcaggtcccataaaagcactaacatgttagctatttttaggaataacaatgctaccttctttttgctagtctgttcctgccccaacctccttctctctggctggttaaaaaatatctggattgaccataagtggggtcagaacttgataatatccaaaatctataaaacaatagaaaacattgatatcgttcccacatgttccatattatgcaaaaccttctgccatcatagtttgcttgtgacaagatgacaagagcataaaaatactagacaaaaacaaagatcatcattgcccacttagataaaggaagttagaatatcctcctgggacttgtgtcaattaaaagggtgggtcctcatcctgattggattgatagtgtcatgatcaagggcattgagaaccagactgacgtgggtgaccttgggcaagctagctaaggtaagctagctaaggctcaatttcctcctctgcaacctggagagagcaatacctacctctgagagtaaggaatgtatgcattaaagggtgagttcattacctggcatgcatagaaaatacctcataaattaccattccttcaggaaggaccaataattctcatcacagacttctcgtcattaaagcaccaggtgatggggggattaaatgtggctttattcttttgctagacacaacataacacatttttatttgaagtcagtcaggtggaaaggggcaaaaaccacgtgaaacacatgatttagagtctctcttacagttgcacgaacatcagcgtctactgccataaaacttgtgagacccagcatgtcgctggtgaataaatgaaggcaaggtgttaaaagggcaagtgcagggggttcaagcaaaatgctcactatgcaagttttgcaagctgaagagacggtcagcacacctactgctccagtcaaatgttcaggtcttaaattgcaatgatttttagatctaaaatgtgtatcatgttttatccaatttgcatggtccttcttgatggtaaagtcatgtttcttgaagcaccaaataacagggtagttattccctgattgctgggtttctgatttctaagccagagttgtgggatgcatgataataagaatacacatcaacctgccccaacaaggagagccagaccccaggctgtgaggtcacagtctacccaggccttcccctctgtccatctatttgcccttcactccttttgaagccctgcctctatgtatcctggagccttctagctctcagcctctaccctgtctaaatctcctcccaaggcagggtctcatcagttcgatatcattaaccttaaaatgtatgccacttcagtgagatgaaatacagaattgtccataaacaagtacctgatgaaaagcttcagatagagaagtttgggggagaaccaaataagacttttactttgtctaaatcatgcttcaatctcaggccattttaaacacaaactgaatttcccttgctgtcgattggctgttgaagtcacagatccaaagttactgtaaattgaaaacatcttactgaagctttaaccttatagcaagggtattattcaccatttctcctatgttctatttggcatttatgctgggctttcctgtctggaccacattggaaatcagtttccagggaacaactagaggtcttcagggcttaaaaaaaaaaaaaaagatttatttttctaacatctgaatttaaagttgcaactccaagtacatatccataacaaagtagacactggaaattaaattctctctcttttgtctctaaaagtggaaaaaccttgctggggaagcatttttcccttatgatttgttcagggccataaaatgttcccccattaaaagttctacagtaattactttattcattattcaaaaatattcaaatatttaacatgtttacaacactatattaaatgctacaggggaaacaatgatgaatgtttaagtccctgtcctgaaggcacttggaaacaagtagtggatgaaagacaagcactgtagccaaatatatgcctcattatttaataagacaaaaactgatcagttgcacaggagaggcctgccaaagttctgtggagttctcgaagttgagtgggcattcataggtggctggagaaatctgtaaaggcttttagaagaaggggccatgcaaggtggtccttgaagaatggggaggatatgaactactggaaacccagggaagagtatcctagggaggggtaggaaaaggtagaaagtaaagggtaggtctagagaatagcaagcaatatcttttgcccacagtgttgcctttgtcgggggggtgggggggctagaaaagaagggggaggccagatcaggctaggttctttctttttttttttttttttgacagagtcttgctttgtcacccaggctggagtgcagcagcgcaatctcagctcactgcaacttctgcctcctgtgttcaagtgattctcctgcctcagtctcccaagtagctaggattacaggtgcccgccaccacgcctggctaatttttgtatttttagtagagatgtggttttactatgttggccgggctggtctcaaactcctgacctcaggtgatccaccctcctcggcctcccaaagtgctgggattacaggctggagccaccatgcctggccagatcatgctagttttaacttggttatgatacctgtactgtattcaggagggaacaaagattatattatgacctctgtgcaaggcgtggcatgatcagagctatgcttttggactattagtttaatgtcgtgtctgacataaagtttgctaggagcagagcctgaaagggggattcttgtacaaatattccattgaaaggtatcttacgagcaatttgcaagggagtgagggagcatgggaagcggctaggcagagatatggtttcagaagaagtctagcttcagcctgatcccacagggacctctagggggttaattgcaccagagtttgtcctgccaagaaacaaggaactaggctgttagactcctgcatcagtgaggcactggtcacaagctgtggtggggaaagcagggagagggattcagcatcatcttccaagtatctgtgggcaaggtagttcccattagctagatagatagttgttcaatgaatgagttggtggtagaaacagggataggatgttgcaactgagtggtctggagacaagaaaaaatagacaactgaattttttgagtccaggtaactggtagaggaatgatgataataacaaaaaataggatctggggttgtagggaaagatgctggtatctttaagaataggctttcttagaggtggacctactgtgagccaggggaattgatggatggagaagtaggcaccattcctgggcaattgctgagtcattctttcctattatggctatttcttgagctcctactatatccagaaactgctgagagtccttgataccctaaaagtctcctttctctctcatatattatatcctctccctttctactcttgaggctttcccattttccttttttcctatctactgctttttctccttataacctccctgtgagctggaatgaaattgtccatcatctttgactgtttgttttcttgcccccaactgaatcggttataacatcctacccctgttgtttttcctaccactttattcattgaacaaatatttattgtctactttgtgtcaggagttgggatacagaagtgaataaaatagaaaaacaaatcctacctttgtcatgctttctcatgcctccatcatcatcctcatcatcatcatgatgcttttagttcccatccttagggctagaagcagcaccttcctccctccaatctgttggttgttcagtctgactgataatgtgcagcattaaaagattttgatcatttaaaagagaaatggagaaaatatggaggagatgaaacgaggcaagagacagaaggaaggggaatgacgttggcatttgcccagggttactctggagtctcttccagttccaacattatacttattttattaaatcttttgtgtttgcatgcaaaactggctgactgtggtctggaaggctttatatttcattgaataccactggaagtgtggtattgcctcccttcaaagggaggcagattgtcctctgtatgtccccatggagttctctgccacacagaacgcagcgaagttttgcgtgcatttcactacactaactactgttcttttatcatcaagacatcttttccttccacagctacatgcgaacctggatgtaagtttggtgagtgcgtgggaccaaacaaatgcagatgctttccaggatacaccgggaaaacctgcagtcaaggtcagtaaggtagcccagggtcatagttcaaattcaatcattgcagcagggctggcgactcaatatggtacgcaggatttcttagggtttttttaaagtcaaatcttcaaatgaaggtgctttcaggacaagtttttcaatctcttctccttgaaaaatgtaaaaagtctgatgtttttgtcaagatgcccaataaaaggccttttttcttttcttttctttttttatcttttttaaataagctaaaggtcttttatattttttacttttttatttcatctctttccgtaacacagaaaaaaagagcctttttaaaaagtaaataattttattgctttttaaactacctatgtattataagtatatttttatttttaaaaatccagcagtgcaaaaaaatataaacttaaaagtgagagtgatcaccactagtttttactataagcatagttaagtttgtcttagatcctggaagtctttttctgtgatagtataaatgtaagtttttctcataggcatctttgcatgtcagcacacacagaactactttacattttttaaggctgtatcctagtccctagtgtgaatacttttatcctttgtgcaaaaatgtgctttatttaaccattatcatttatgttgtctccaattttttgccattacaaacagtgctaaatctaacattgttctctgcatagccctgctttcttgaatgaatatttttgtaggaaaaatatttaaaagtggaattgttgggttgaacaacgtgcatatttttattatacttcatatactttttttttttttttgagacagagtctcgctctgtcacccagggtagagtgcagtggcgtgatcatggctcactgcagcctcagccacctgggctctagcaatcctcccatctcagccttctgagtagcagggaccacaggcacacaccaccatgcctggctactttttacagtttttgtatagacgaggtcccactacgttgcccaggctggtcttgaactcctgggctcaagccatcctcccgccttgccctcccaaagtgctggaattaaaggcttagccaccacacctggccttgatatatcataacagataatttataactttcatcctagattgtttgtctgaaaacattaaagagatgataatatctataacagtggttctcaacctgggtaattttgtctcccaggaagcgttgccagataaaatacagataccaagttagatttaaatttcagataaacaacaaataattttatagtatatgtttgttcaaaatagtatataggggatgtgagggtgatctggctgtgacatctgtcaccccattgctcacctgggttgatttggctgatctggctggctaggcagatgtccccttcctccctcactgctccatgtgtgtccctcctgaagctgcgcgctcgtgtggagaggacgaccatccccgatagaggaggacttaccttcagtcaagggtatattagctgtgctcccctgctagcacctccaaacaagctctcaaaatagtatatgagaagtgtgtatactttaaaagtattagtcatttatctgacattcaaatttatctgagaatcctttactgttttgtttagagatgggggtctcactatgttgcctaggctggagtgcagtgactatactgcatccatgatctcctggcctcaaagcaatcctctcgcctcagactcctgactacaggcacacaccaccacacccagctggaatcttgtatttttatttgccaaatctgggagccttatcccgggcaacatctggcagtgtctgaggacatttggagggggtgctactggtgtctaatgggtagagatcagggatgctgcaaagcaccttacacaatgcacaggatagcagcacccacaacaaagaatgatcagacccaaatgtcagtagtgccaaggctgaaaaaccctgctgtaaacgtggtgaataaaagtgcctcattggagcaagggatatggtctttgctatagatcagcagatttcaacttggctgattttgtcatccacaggatacttgacaatgactggggacaattttggttgtcataactggatgtgggaggtactcccggcatctagtgaatggagcccagggatgccgctaaacatcctgcagtgcacaggacagtccccacaacaaataatgatttgtgtcaacggaagttaagaaaccctggcatgaagaaatcttcaataattcagaaagggtccccagtcctataaggaagttgaacaaagagcagtaaatccaattcagctgcccttggagaatggagtttcagagaagactggacacccactccactctaccactcccagcccttgctgccaagcccagaggttagccccataaactgaaatagccgctctttgagctgccagccctacagtctcggagagcaatctggctctctgcgtcctgccaccagcatagaggccagagccctggagatgtttcttagaattgcatgcaattgcttgagagaggtgcttcaagaatcgtgcattcagggtgggcacagtggctcacacctgtaattccggcacttagggaggtcgaggtgggtggatcacttgaggtcaagagtttgagaccagcctggccaacatggcaaaaccccatctctactaaaaatacaaaaattagccaggcgtggtggcgaatgcctgtaatcctagctactcgggaggctgaggcaggagaatcacatgaacctgggaggtggaggttgcagtgagctgagatcgcgccactgcactgcagcctgggcaacagagcgagactccatctcagaaaaaaaaatcatgctttcataagtaataattcagctatacccttcaccagaggttttacagcagaaaacttggttttccatatgttttggattctgaaccaagatactgtctcaagagatttggaatagagacaatattttccacgctagttttaaagtctcagcaaaatattaacgttgagggagtggtccagttggatcaagttttgaggcagtctgttttcttcccacagcctccctgccctgtggcagcctgatcaaagtccacgtacatccattaatggtgacaggcctcagccctcaactcatgtctttcccaaaacactcttccaagaaatgagtgagtcacctcagagttagggccaagctatgggatattcctgggtttcccgttatgtccaatcagcatttttcaatttccccatttgaagaggttaggttctatgagggagatggtagggtaaaggggataggcagtggagaagagggtttcaaatgtccagctagggcactggaaaatccccatataaggatattttcagagatgaaagcagctccttattttcaagaatctgttaccatgctgaccttttgccttccatggaatttgtttgtttttttcctctctgtatgttccctggtagagttaagatatgaaaccctcacatgaccacatttccaaaggcgacatcctctacagataatcctttttaaagttctattttccttctgtgtcattttttattttaataaaaatgttacttattcttaagttgttgttgttgttgttgttgttgttgttgttttagaaaacaaaaaagcacagagaagaaagtcaccctcgatcttaccacctgaagataaccattagtcgcatttagagcataccctcctaggcttttcttttcctatgtattttttaaaccaattttggaatgatctgtacacagagttttgtaaccttcttttatcacgtaacatcctgtgaacgtcatatgtatatatttcatatatatataattcacatatatataattcatatatatatttcatatatataattcacatatataattcatatatatttcatatatataattcacatatatataattcatatatatatttcatatatataattcacatatatataattcatatatatatatatatttttttaaatcatccagcccaaatgtcatcctgtgaacatctttacttaggattaaatattgtcctccaacttcaccactaagagctgtctgacagggctccctctagaggaatgtgagccaaggcaatttggccagtgcaggggccagccaaaataataatcgacaggaggctgtgctgtcagcttatgtcagcggctgcttgggatagcatgaaaggcagaaatatataaattatctatttctaaattattgttcaagtagtatacacatagaattgtgcatatataaaaaatgtatggctcgatgaatttttctaaatgcccatgtcactagtatctagatcaaaagccagaaacttggcccttcagaagactccctcacacaccttccagtcacttccactgccagtgagagaaccatatgttgacctcttatatcacagattagctgtgcttattttttaactgtatataaatggactcatacagtatatacacgtttatatccagcttccactcaatatcatgtttgtgagattcatccattgttgcctatagttgtcgtttgttcagtttcattgctatatagtattccattgtgtgaatatacaagtcatttatctattcttctgttgggaggtgtttggattacttctagtttggggctatctagtatcatgctattatgagcattttagtatgtaggggaaatcccaggactggaatttccaggtcatgagtatgtctaaatatagctctagtagattctgccaagcagttttccaaagtgttgtaccaatttacattccttccagtggtgtataattattccatttgctacacattgtcaccaatcctttaaaatggaatttgatggtcagagagaaggtgggtaagtggtggtgttcagggaagctaacccagttgtcctttccaagactggggtctaatattccccatctggaagtttcctgattcagttcacctttccctgttttctaaatgtccctgcagatgtgaatgagtgtggaatgaaaccccggccatgccaacacagatgtgtgaatacacacggaagctacaagtgcttttgcctcagtggccacatgctcatgccagatgctacgtgtgtgagtaagtttcaacagccaggctgatctcagtcaatgtttaaggcttggcttttgccatttgatgcttggggaaaagctgacttcagtgattttttaaaaaatctctaatattgcccccagctaaaatgttttgtggcacttgtttctttctttcttttccttcctttctttccttctttctttcttcttttttttttttttttttttttttgagacagagtctcgctctgtcacccaggctggagtgcagtggtgcaatctgagctcactgcaacttctgcctcctgagttcaagcaattctcctgcctcagcctcccgactagctgggactataggcacatgccaccacgcctggctactttttgtatttttagtagagatggggtttcttcgtgttggtcaggctggtctcaaactcttgacctcaggtgatccacccacttcggcctctcaaagtcctgggattacaggcgtgagccaccatgcccagcttccataatttttttaaaaaagtaagtgctgattgggcacagtggctcacacctgtaattccaacactttgggaggctgaggcaggtggactacctgaggtcaggagttcaagaccagcctggccaacatgacgaaaccctgtctctactaaaaaaaaaaaaaaaaaatacaaaaattagctgggcatggtagggcacctgtaatctcagaaagaaaaaaaaaagcggtaaaataatgtgaaattcacattattttaaatttcaagtgaacaattcagtggcttttagtacattcacagtgttgtacaaccatcacccctatcgagttccagaagatcttcatcactccaaaaggaaaccagacccagtcactcctcactccccctcctccagcccctggcaactacaaatctgccttccttctctagggatttgcctattctggatgcttactttataaataaaaaggcaaactaggagaaaaattaattatatatctatatctgcatctatatatatgcagagccctgttgagtttcctcatgaaaataagcacgttgaacaaaataagcagattgttttagggaagtgatacatttaaattccttctcggaacatcaattcttcccaccagctaactttctcacgccccttgccccactaccaaagattagtgatacttgttggaaatacattccgacttactcaattccttgaaagaaaagcccttctgtgataaagaaaaacccatgtcctgtgggagagtgagagtctatacccattcatttattgagagggaaggcttttcaggttttatgttccagttgaaagggaaacccaccctccctgcctgccttcccttctccccttttctctctccatctttctttcctctgccttgcagcccccaacaaacccagagcctgtgccttcagccagcttcctgtggttgcggagttgcacagactccccagcccatcctgggttttcccgagattataaaatcttgcctagtgcacgggctcctccttggcaaagtgtcccaacaccaccagtcacgtagatcttctgctagcaagcaagcatttgaaaatgggcattggaagggcctttttaaaaaatccttattattataaattaaacagaaactcacaggaaacaaatgcatagtttaatgaattcttataaggcaagcacccttgtaatcatcaccaaatagaactctgccagaacctcctcctcccacccctccctaaagggaaccactatccaggcttttatagtaatcacttaaaatttcaaaaaagatgtacgctaatggatgtttctgaaacattccatgaaaacccagtcagtgccaaaaaagatatctttcctcaaatggaaagatagaattaggttaattttgaagattaattttaaaagaagacaactaaagagaaaagatgaaagaataaaggagtaatataatcataggtagatgtttgttataatacattgggtctctttctgtatatctaggggttacctgtgcctccctgtttatagctcaaagtgtccagatagccctagaactctctcctggatgctgattggattccaccaggccccttgggtctcttttgtccagctgggtgattggcacgttctggagggggatggagggagggagtacattcaccatgcccctctgttatggacattgggctgaaaccatatgagtttcttagcccccctgcatttctaatccacacatactggactgctgctataaaaatgcatttgtgtaagataagttatatttagcaacaagtgacaaaaaagccaagtaaattgtctcatttactttaaaagctgaaggcaagcagttccagagcagctcaagaagaagtccatctctgtcatcctcagagtattgattttactctcacacttgtggcctcatagttacaatatggctgccctagctccagacatcacacacacatggaaaatagacaaaactaagtgggtacgggtgatgccaatgaaccaatgcctctttcatgcctgtctctttttatcatgcagtaatatcttttccagaagccccactccctccagtggacttatttttgtatctctttggccacactgcatcatatggccactccttgctgaaggaaagctgggaaaagcctcagtgctgggaatggcaagagaagagtccagaatggctttcagatagctgatcagctatatctgccacacgttttagttcagtcacctaaaatatcgagtcttgtgacttaagtgactctcactgaggctagatatgtatggagagctctccagagtagattcttttaccctgattactcaggttgataatctccatcagcagttgcaattcaacctactgaggccagccaggtgacataaaagagtggctagagcacacacaagtggagaaagtgatacagtttgaggggtgcatgctctgcctaaagacagtcaaattcagtgaagtggccaagaaagcagaccatgagtaggattcagtcccagggccaccaagatgccacccctactgatcccttttggctctccatttgggactcagacaatgaaacttgtcctataatgccatgcaacgtgttccattcaatggctcagaatttggtgatagtttcttagtaagctctttttatcatctcaagagagaaaggctaatccttgtctactttttcagactctaggacatgtgccatgataaactgtcagtacagctgtgaagacacagaagaagggccacagtgcctgtgtccatcctcaggactccgcctggccccaaatggaagagactgtctaggtacaacagcaggaatcacctctactcctccttctcctcccttgactccccttttactgaatcttttttcattcatcacaatcagcttgttgactagacattggaaacttctaaaagtacagatttatatcagtttctgagatacttttagccacatatgctctaaacatactttgggatgctaaaaaacacatttttctattattttgtattgccttaatgccatagtagaaaagggataattttagtatatttactatgtacattttatttaaattaccatccaatataaactccactacttatattttgtcatttaatgagtaaggtcctaaggaccattgggttttattctgggttctagctaatattttctggaaaaactatatttacttattttttagatataacattattgaaaatagtatacaccttctatataatttacattagcatgtaataaatttcatgttgtctttaaaacttgctccaagttatatgaactaagtataattaatttaactggagaaaatgagcagattaagtccataatattaattaagggaacataaaaattatttgtttataactttgaatttagtcaaattcattggcttagaactttcctctcttgttctcctttgtcttattttgtgtcttagttttgggttccacagaagctgaccctgagcaagtagttgatttgggaggtgatcccagcctgaaatcccagcctgaaattcattcactaaggaataaaatatttatttcacatagattagggcaatagctgactggtaccagaatcttatgagtaagattctggttgaggagtagggaagtaacccagggaaaggaaggcaccagtgttgggtaaatctgatgagcaggttaaatgagctgggggcacctctgggaggcagagagaagctgcccctgaattttccctctggggcaggagtgctggatattcatccaccaacttctgcccttcattgatgggaggctgctctgggacatgaccccccagcactcccagcctagcctgggtcgggagcaaagcacaatgttgtaggtgcagcaagcagcctttggcaggtatggaaacttgagtgctgaggagctatggatggagcacccacagggcaccctcagtgactgaagcaacacttttttcactttgtgctttggttcctttgtggatttgaattatgttcaaccatcaaattgccatcaaattgtatatactcataacacttaattacattgcacctaatatacataatatttagagtaagtgagcacttagcattaatgagggatgtcaaaccaaatcagaatgttgaaagagttcttaatctgtgatttaaagaagcacatatcagtatgatttcataatcttcttcactacaatagaaatatttttcagtcaaggtgctagatgtttatttatcctaactatacataatgtaaaaaaaactgcatttagaaagctcagccaaatggatcctaaattagctaaacactttttaaaaatatacatgtaaattaaaattttgtctctactctgagaataatcaaaggtttaattaggttcacaggatttactactttttagtataataagatttatatgacaaggctaattattgaccaaactgaatccaaatttccacccaactctttgagttgttgggtgccatttttattggaagggaaaggtgatgtgcatgaaaatgatcaccaaaaataattttgttcaacccaacacttatttattatttggaaaatgcaagaggccagcctgggcaatatagcaagactccatctctataaaaaacttttgttaaaaatagccgggcatggtgatgtgcacctgtagtcccagctatgctagaggctgaggtgggaggatagcttggactcaggagtttgagaccagcctgagcaacatagggagaccccatttctacaaaaaaaaaataataaaaaatagccaggcatggtggcacatgctttgtagtcccagctactcaggaggctgaggtgggaggatcacttgagcctggggaatttgtggctgtagtgagccatgattgttctgctatgctccagcatgggtgacagaccaggccttgtctcaaaaaaaaaaaaaaaaaaaagattgcaagggaaatagtaagacaacatcaacttgccggtttaagccaggttcagaagaacaaactaacatctatttgatttgacatctgaaagttaaaccaagcctgagtcttagtagattggtcagcatagctgtcagcccctctgttacctgactttcaatggtagaaaaggaacaacacacctattgttggctaaaattacatcattacataattacacctgacccacaatttatgcataagtgcatgccttcacaaccacatttctgtgagtcaatattgcaggggccttggacagtcttactcaagaaatagttattttgtaaaatgcaaattgtaaaagtctgtgtgtttggtttacttaaagtatagctatctgactctagtttcaaaaattgtatatgttatacaatatacaatattcactcagctggagaaaatattcactcagcacacacgtaatgtataggtaccaagtgtcagacacatgctccctgcctgagaacagccagggcctaacagaagatgtgaatgtaagtaatgacattatggaaagataatgcatcttaaaaaggtataaaataatataaatacataaagtgaagagctgtgtgtgtgcctgggggatctagaacacttgccagaggatatgatgttggcaccagtatactattatcagtttcccagataaagaaaagtagctgtgagtgtgcgtgcgtgcatgtatgtggctacttttcttgctatcactgacaccttctggtttttacaccctagatattgatgaatgtgcctctggtaaagtcatctgtccctacaatcgaagatgtgtgaacacatttggaagctactactgcaaatgtcacattggtttcgaactgcaatatatcagtggacgatatgactgtataggtaagattcgatggcaccttttcctttttttcctgtccccaccaaacctttgagccttctctgcagatattttgatgtcaattcaagctattagttgaacaatctactgtgctgaccagcttaacaataaggaaaggttatttttttaggtgtctggcatttagggaattccaatgacatcaattataaagctaggtcaataaagatttaaagtaaggaatacagctctcttgtggaaacgattatctcaagatgattctggtgggactctctttaatttggctttttgttttgtttatattttttgttttatctccagttacacatctaaaaatcagaacaataaagcagtatttatatttggtaaaaggaagaataacaaggtctatctaatcttgatctcagtgatctgtttataacagtctccatcaggggtggctttagagaaatgtatgagagacatgaaggcctatgctctttactttcccctctttcagccctttcatagttcaagctccaaatataatgttccctttccacagttaccaaaattgctctctgataagattctggtatcagtcagctattgccctaatctatgtgaaataaatattttattccttagtgaatgaatttcaggcctccatgaacaagtgaggtggggtatttggggagaccttggatgcattcccattgccctttatataatgtaggatggggcctgccctatagtgaagggaaattcgggctctctgtggatttctctgcccgtaacacgtgtaacaaagctatatgcatgacatggaaggctaatagttgagaaaaaataggatttctttcaaccctatactcagggcttcccaggacacgtcttgtgtaatcatgttgggacaacacacaattgctgggtttcgaaccatcttgtgaagcctctacaactcttccctcaaatttcaaacacaaagtccatcctagagaggatcataaaatccatatttctcgtggacttggaccccatgccctcctgcagaccaaaccagcccagtaatcctatgatgctgtgttacagagtttaatcctgtttcctgatacctaaggggaggttccacagaacagggtggaattcacatggaaaggttcaaaaggaaacaaatctttgagactttaaaggtgactaagattaacatctgagctcagctttgtggctaaattaaaaccaacagactattttgtacatacatgtctacaaatgcatagatagaaaatggggtggagaatacggcaaacaaacctctcgcttgggtgaaacttggcaaattttcctcctctaaacccagcagacaagctcaggccagcctgaccctttctcctggcagtcttagaacaaaatgcctgtgcctataagttagatgatgtcaacggttcctagttgatcttgcctttgtttgttaggagtttcaagaccttctgaatatagaattgattttctggtattgttatttagttctaagttagaggagaaagttaagagaaaaacctaaacatcttacagatttcaatagcattgataagcaggagattaaattgctgtgggggagggaagcagcaaacactccctacataccaggcagcaaacaaagccagggctgctggccaatgagcctgcagttctgaacacctctcagttctcaggcaatgcttggtttgtcaggggtgtttagtgcttggccctacagttgatcaagtgtaagggtgagtctttcagcaagctctgtaccacagagtcgttcactggaatgttcttttttagatataaatgaatgtactatggatagccatacgtgcagccaccatgccaattgcttcaatacccaagggtccttcaagtgtaaatgcaagcagggatataaaggcaatggacttcggtgttctggtaagtagcatttggtcatggtgtcttagctattcccaatgaagcattctccccatatctccttcctccctctatttctctcctttctttgtcttcctcgccttctccctctcccttactctcactctgtgtgtgtgtgcagtgtttaactctctgcctcagccttctcttctttgctaattggaccacatctccaatactcactgaagttgtaggcactaaacttaaagaacagcaagggtacttaatatctttctggccatgacatacttcaaatactgaacataacatttaaggacaaaagacactgagcaaatttatctatcaggatagactgagttatgatgcagtaacaagcaaacctaaaataacagtggcttaaaaccacaaaggttttttaaccaagtgaatccggacgttttccagaatgcacaaccaaaacaaagtaaggcaaagctgatcttcattaaagtatgattactttatctgtcatcctcaacgctggatccacttgttttaatgtatatagcagagagttccattgttcttgctggtgaattatttaatactttttgttaaaactttaaatttataaaccagacatctaacaataaaatgtcactgctattaataactacagcaacaataaaggtttatttctcactcatgtaatatgtccaaagagaatttttcaggggtttcttctcaataaaatcacttaaggacacaggctgacagaggccccatcattttatggtaccatggtctcaattcaaggccttaaggtttgtcacagcagagaaagaagcatgaacaatcatgcaccagctgttagtttattcagcttggaagtatctaacttcaagggacaaaaataatattaaacttgctgtgtgtcccaaaagagaagaaaactagaaatcttggtgaataccaggaatgtcttccaaggcaaggcagctatgattacagcacaatcacttccctaacaatatcttacaatgtttaaagtcatccaggttcggctgggcgtggcggctcacacctgtaatcctagcactttgggaggcccaggtgggcagatcacctaaggtcaggagttcaagaccagcctggccaacatcgtgaaaccctgtccctactaaaaatacaaaaaaattagccgggcatggtggtgcacgtctctaatcccaactactcaggaggctgaggcacaagaattgcttgaacctgggaggcagaggtttcagtgagccgagatcgcaccactgcactccagcctgggcaacagagtaagactccatctcaaaaaattaaaaaataaataaataaataaagtcatccaggtttatccctctggtcatgacccttttagcactagctcatagtgtgactagacttgttgactgccctgattcaactctcttatataccccttagcagagttcccgcatgttcaataaatatggctgcaaggtgtaccctaacttacgtcacattccatacacccatctggccaatgctcccaatgatgcaaatgactgtaacagtatctactcagtcatacaaaaataaactatatgtaccatgctagacattcagcgccacacccataaaaggttcacagtaccccagtgggctattgttgagcaccactggacaagagtatgtataaaagaatataaccaaagaaaatgagtctggaaatcaaattctgtgaagaactgccaaaagaacagggcagcatttagtctgggaaatatagtatggaaaagcataaattgtgcctgtaaatactttaagaaatatgaaataaaagtggctttctcaagcaaactaagtccagtgggtggaggttacattctctcttaaaaatggctgctaggtattgaagagtggagcagggagccccatggagtagggacattccactgcccctggcttgcaggctgggggctctgagacggattcctgcattgggctggagatggtattaaatgaccacttagtgtccagcaactggatgccatggtttctatccctctagatagaagtatccaatgatgtccttctgaaacttgattcagagagagagattggctgcccaggcagggctgtgcataggtaggttggggggaaggacaccataaccttgggagttccccagagaggagactgaataaatcagctttccatatcggatgagtgcccaagggacctgtgctcaaagctcctttatgccaccaaatttgaacatgcacattccaggttgggaaggcctgagtttaaatcttagctctgccctatgctggctgtgacctttagcaaatttcttaacctctctaagctcagtttcctcctgttcaaaatggggtttatggtagtactgtggtgggttcttgtaatgggccagtccacagtcccttggagctccctaatcctattgaggtagggtagacagttgcatgcgtatctctagcagtgctctctctgacaggagtctccagcttccacttcacggggtgggacagttctgaggtgtgttctgcactggctcccagatgtccccagcaggactgagccccacttacccacagagattacctgtccatctaagcaccatcttttggcttttctcccttcctgtctcactgtctcctctccccagtttctgcctcctggaatcaccttccaagtaagtcatctgcacccaaatccttgtctcaggctctgcttagaggaacccacactaagacaaatatgtctcacagaggttcattgtgaggtttaaatgaggtaatatagagagagagcttagtttagcgggaccatatagtagatgctcattaaagttcgctgtgattgttattgttattagtatcatttcaatcagctgtttgttaagggccacccactctgaaatttcacaaaggtaaatatgaaaatgttgtgcatacaaaaaaagacacctcaggaaagcatttgtttcaataagtgggcaactcacccccacatactcactctcctacccctagaggggaatcgaaggcccagagtaaacctggagccatctttcttcctcgtcatttgatccccttaaaccgcaatgtattattaatgttcaaatgaaggcaacatctttaagcatgcaattagatagttgtttgcagcctgtgttttctatattgtaactcagtgctttgaaattgtaaatcctacatcaacacaaacatttcttgtgtcaagaaaatgtctgtttttcttggaccatccaactttattttgggataaaagaaatttgtctttattctttgaaacctcaaattcatcacactgttctattcaatatctgaaaattatgcattttgttatccattctgcagctaaattatttctttagtctttcactggaatgtttatttaaaggagaaaactatctttgggtcatttactatattacttgtccaacccttttcattttgctttaattctctaattctccataaaataaacagccatgttactattgaaaattcatcttaacaaggtcttaacattcattgcttaaagaaggatgcctcaaaatccactctttttttttttaaatttttttagtatttattgatcattcttgggtgtttctcggagagggggatttggcagggtcataggataatagtggagggaaggtcagcagataaacatgtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaacccttagtggacacagcacatgtttcagagagcacggggttgggggtaaggttatagattaacagcatcccaaggcagaagaatttttcttagtacagaacaaaatggagtctcctatgtctacttctttctacacagacacagtaacaatctgatctctctttcttttccccacatttcccccttttctattcgacaaaaccgccatcgtcatcatggcccgttctcaatgagctgttgggtacacctcccagacggggtggcggccgggcagaggggctcctcacttcccagacggggcggctgggcagaggcaccccccacctcccagacggggcggctggccgggagggggctgccccccacctcccggacggggtggctagccgggccaaaatccacgcttatgtacatacaagagtcataaaaacaaaaatgagagaattgcatctagttagcattcagcattataaaacattataaaatgttatattacaaatacatttgtatgcacataaattgttattatataatctagggcataggccgggcgcagtagctcatgcctgtaatcctagcactttggaaggccgaggcgggtggattgcctgagctcaggggtgcaagaccagcctgggcaacacggtaaaaccccgcctctactaaaatacaaaaaattagccaggcatggtggtgtgcgcctgtagtcccagctactcgggaggctgaggtaggagaattgcttgaagccaggaggcagagattgcagtgagctgagatcgtaccactacactccagcctgggcgaccgagcgagacttcatctccataaatatatacatatatatatatatatatatatgtcatatatatggcattgatgtagcaacttttattaagttcattgttttgaaaatttcagactctacattgcaatatggaaaaagagttagattatcctaacccattctctgtacctaaaggaagaagcaccctaaatgtagatgtgtatatgttccactgttctaatatgagtattaatagtatactgccagataatttggtcttgatttgacagcagctacacctcattctaagaaaatcaaaacccagataacactcaatttggggagtaacagtcaacttaggaaaggaaactgtcattggcttacgaggagcacagcttctggaatcgtattaccttagcttgattcctgacttgctagcctactacctgtggagtgagaacaaattattcaacctttcagtgcctcagtttccacacctgcaaaatagggatgatagtatctagcccttaatattgttttgatgattaaatttattcacacagaataagtgagcgtccatctaaagagcttagcaccagcccagaatatatgaaatgttcaataagtatgtgctaggagtaggagtaatagtgacaaagccctccttaccaaaattcaacaatcatttctgttgaaaagcagcttctttagtcactaaaaatatgctgattgcttaattcagtttgtagggtgtgtattcaagaatatgggttttgctacaaccaggccatccccattttttttcttcaattataaacattagaaacttggaggtatggcctgggaatttttctaactctggaaaagattttaaacattctggtcatgaatgctaaaaataatagcacacatgctgagtgtgtgccaagcactaatcttagtaatcgatgtgtgttcacccatttaagcctcccaaaaaaatctgttcttatcccaattttataaatggagagactgaggcaaagagaagttaattattcatttgaggacatatggctagaagatgtgggagctaggagtcaaactcaggaaaatgggcttcaggattatgtgcttaaacacaggacaggtgtgttcatgaccaattggttgatcctctgtgatggagaactcacagagtttgccctcctcagcaaactctcttggctcatcttttgttctgtcctagccccttcctgtttcctgggtcccatgctggaacacattcttcatctgtgattaagcttcttcttccaggactgtgtccaaagctcagattagtagaacttttctcctcccagatgatagatcatctaatgcactaagcacagttgaatgaatgtcaaagtcatattcctcctgggtaagatattctcacctaagagtgatcttctataaagttttattccaaagatatgaaattaaaattagggttttcaggttgatagaagtgtttgacaacatgggtgtttggagaaatctcaaatacctcccgagagaaattgtcaactttacaaaaaactggcctgtgaacctgaagacctaagttttatatctgagttccccaaatgtgccaaagaccctcctactgcaactccctccatattttttttttttttttgacatggagtctcactctgttgcctaggctggagagtagtggcatgatctcagctcactgcaacctctgcttcctgggttcaagcaattctcctgcctcagcctcctgagtagctgggattacaggcacctgccaccactcccagctaatttttgtatttttagtagagacggtgtttcacgatgtatgttggccaggctggtctcaaacacctgacctcaagtgatccgcctgccttggcctcccaaagtgctgggattacaggcgtgagccaccatgcctggcccctcccacatttttatattctcaaaaagatgatgcaataatcaataaatctttaagagaaaaccgtcataatgtcaaatttgaaacagcaatacctagataaatccaaatctacttatgcatatgcatatcattaaagtgcatttttatccttgcccagctttctgtttacatactaagagaatgaaattgtcaacactatcaagattatgatgttttagtttttgtttcttttcaataggaacatttgaaacttcaaagcagaaactgaaagcagatgtttaggtttgcctggtgtgagctgaaaccctttcctcattatttattaaaggtctttagttttatgttactgattgcaaaaaggaaatttgcagggaataggggtttcctgttaatttttcttgccaggtgctggagaaagatgcagtcgaccatggatggaattacagtggggcctccagaggaaggtctatatatgatcacacattacggtcataacttaacatgcaatctctggcaaagtagctgaaacaggctatctgaaggtcaggaaaatgagtaatgatgcattacttgtattagtgcttgttggttttctacctatagtcaggctgtcacaatgataaataactagaatatttcattgaaaagaaaaatgttgctcttttgattccaaagtaaaagcaattattaattaagagcatacatattttcaaagcatttttcccccgtttggttaccccaaatattgtggacttctgcttgtttatttttctactactttgatatagattgaatcagccaaatgatggagaaggaacaaagcaggagaagaggttaaaacattgttaagaaaaatattctaataaaatcccactccaattttttatagtactctttttaggcatcaaaattaatgtctactccattgtttcacttctctctaaactatgtccaaataatagaattaagtgaattgattgaggtgttattagaccctttcttgcttagtcttagattagtacatgcctagatattttatagtgagacaatatatttgatttcaaatatcagtgtatttaattttttaaaaattaattacttctttacatcagttggatattctgaattatcatgagtatatccctgaaaaggagacatatatctttgaattatagatctcaaggaatttgaaacagtctagagaaaagtaaccttaatcttaaagcagaaataaatctatcatagaaataggactggaaaaaagagacattcatggccaggcatggtggctcacacctgtaatcccaacactttgggaggccgaggtgggtggatcacccgaggtcaggggttcgagactagcctggccaacatggcgaaaccccgtctctactaaaaatacaaaaattagccaggtgtggtggcacgcacctgtgatcccagatactggggaggctgacgcaggagaatcactgcaacccaggagggggaggttgcagtgagccgagatcatgccactgcactccagcctgggtgacaagagtgaaactctgtctcaaaaaaaaaaaaagaaagaaaagaaaagaaaaatagtcattcatatgctctactgccaaatcttagctccgtccctaacatgatgagtgcctttgggcaagtcacttaacacccagttgcctcatcgacaagacaagagtcctggactaaatgaacttttttgtacctcttgcgttcttcgacaccaacatttttcctccaagggtcattagtccactgagggataagaagaattgatctagaggtacatttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagagactagaggtacatttttaaagtaatttacttttgtggtgggaaatagaaaacgaatgaaaaatagtaagtatagaagcctctctgaaatatttaataaataaactcatttagctttagataatggttgactgaggtgaaaaaattcaaaggggagagagaagagagaaagaaaattgggtatgtgtatattgcaccataagtcaccatttttgtaggtcacaaatggtccattattagcaatttatatggttcaacctaatgctgtagctgtaatttttgaatatcaaatttggacaaatctatagggctatcaggacaataccagtttttgaagaataccacaatgaaagcagaaatattagacgaacatggcaaatccatgtctttgggatctgtagcccaactgggtagtaataagtgtttcactaaagtggtctccgaagcaaaacaaaagcaacaaaaggtaattaagataactaccataacagtggaactgcttaaaacaatacaaatatagttcttcctaatttatcatcaaatagtagagcctcatgtgggttcattctggaagcattcacttactacactttaacactttttaaatgctccattttgtgagtaatttaattatcttccaatttggaacatattgcctcttatttgttttagctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgttttgtgagtgttatttttattttatatgttttatgaaaaatgaattgcaatttctcctggcaaatgaaagaagacaaaaagccggtttcacagcttaagtaaaatgggttgggtcttaagtcctgagaagcaacattctctgtaatgtctagaaacgaataccttctgcaaatacccaatcaaacctgctgctctaggaaccaaggaggggaagtcctgttcccctacttggggggtttcctatttgacacagaccttctcttctagcttccagccaaggaagcctgctagtcctgcaagggcagtggtttggctgcccagctctccatgaggcatgcccccaaatcaaagagaggctcaccacatggatctgctaagctctacctttttatttcttgaaggcacttttacaggcctagtctatgaaaatggaacctcacagttgtatggttgtgattttaaaagccaaaatcgacaaatgtaggaggacaaattttatagtggagcttaagttttctatgtgaactagagaactgccgtaactcccttttcactagttgctgtgcagaacccaccataaggctcagtccccccaggagggtttccatattaacccaccctgcatctctacactgagactttcccattcattctggctgggcatttgttgctccctctatattttgccttatctagtctcggctctgtgactggtggtcatatatacaaatgccagatggatttaaccaaaggaaaagtagacacaggcccacccgtccaagaactagcatccggtgacattctctgccttaatagagagtgaaaaatctcaaaaaaagaaaaaaaaaaacatatttccaaaacctagtatgaagggatgtatcaagagtgtagatgcttagtttacccaaggaaatgtctggaaaagatgttttagatgaggaaactggatccaatgtgaattatttggaaatgttagggaaacactgctctaatatattctgtaattagaatacatgatctaaccttctttgtttggtcatttgattgataccttctgagcatgtgggctttaaggtttttttcttaactgaccaagtgttctttattagtccctaaggtgaatgaagcaggtgaattcggcctgattctggtccaaaggaaagcgctaacttccaaactggaacataaaggtaaataattctttctcccaagtgtatgctctttcatgttgtcctggtcgttttcatttcttcatacagtgaaatgattgtttatgaatccctgcttcattcgtaaacccccaagggaaaaatcattacatcacacacacagtgccagtattaaaatagtaggtccttgtgtgactggtactaatgattgaaatatagtaaggctattctcttctccccgccactcccacctgatgctgagagtgaatggttgaagcagactgtatatatggagatgggagaaacttacatattttcttcaactctactgcctgaggacccacaacctgaaagtcctcatgtactaaatttggcccaaagtgcctgtatcagttacctattgccataataatgctgtgtaacaaacaaccacaagccctcagtggcctacagcaataaatatttatttttgcttatgagtctatgggttggctggacggttctgctgccctgagctaggctgggtgggctcactcatgtgtccacatacagtcagttgtgggcctgcttcgtgatgttgctgatcttggctgtgctttcttacatgcctgaggcctcagttgggaggattggactcactcagctctgctccatgtggtctctcatcctccagcaggctagtccaagctgtttctcatgaggcaacagcagggtttcaggaaagagagcagcagcacacaagatattttgaggtctaggcccagaaatggcacaacatcacttctgccatattccattggccaagccaagtcacaaggccagcgtagacttcaaggttgtggaaggagctgtgaagtcatacaaagagtgtggatacagagagggataaaaatcaggaccatttttgcgatcattccaccaaagcctcataatctggagtttcttaggcatgatccctaattcctcttggtttatttagaacgttcaccactcatgacaaattacacagacctcagggaaaagcccatttatatatttatccctttcacttggtataagtatgaatgccttgatcatctctttccttttcaaagtttctttcacttaccactatacatgtggtaagtaaaagattagcataaccttttccttttcaaacttccttttacttaccactatacatgtggtaagtaaaagattagcataaccttgtgctaattgattcccttttgtgtttaccctgtgagtgcattgcccagttctatcactttggtttacaggaccatctctaccgcaaaaaaaaatgtacctctctaattcagtcctccaaattgtatctgagaagcttctactaaaactcttcaaagcctagtaacctatgacccaactcctacaggcattttgttttcttccatatttctcctaagtattctatgtttttgtttctctgcattagacaacttattgcccattttcctggttagaaagaaaatgtttcattgtacagggggtaagctacgttctccaggtgctcacaagttctgcccaagctctgtctacccttgataagtgacatgaaggaatccgttgactcctctttcgatccccaaaccaccagatttcttagtttactttctattccatgattcctaatgaaacacagaaaggttaaaattttgcacatgaccatatgaccctgtaatttcaacagtccttgagtaagttgtcttggaaagctcagtcccaatcagaagattcagatgcatactgcaactcttccactggttgtttgccttggacaagtcacttggatttgcagtgcctccttgctttcatacataaaattggaataagagcaatattcatctcttaggtgctgtcttaggctgggttccccagaaatagaccccaagataagaatttgtgtgcaagtggtttatgtggaagatgatcccaggaaatggtggttgggggtgtgcataagtgagatggggagacaaggaggcaataatgggtatgttatcaggcaagtttccactgtgggcaactggagctcaatcccattggggaactccagaagccagtgtagaacacatggctcataattatcctactgaaggagtaaggaggctggggcatatatataccaactcccatctggcattgattgaaggctgctcccaggagggtgctgattccttggtgctcctggcctggcatgaaagcaaggaagggcaccactggggcaacttgatctcaatcccacttggaccctcgacaagacaggggaagcctgaattccaaactgactttagtccacattcaattccagcacttagtggtcctttccaaaggcaaggaaatggaggtatctatccaacaactcctgtccatcactggttgagggctgtccctgggaaaataacttcccagcattctagctcacctggttgggccaagaatgctccagccagagaacaccctcacacagagagctgtgagtgtttccagtagaaagccaaatgcctgcaagagaatataagtactgacagatatttgtgtggcaccaagagcatctgcttcaaggcaggtgtggattaaaccagagaatatatgtgaaagcactttccaaaccatgaagtgctatacaaatgaaagaatgtgcctgtgagaccaaagccttgagttttatctctgtatggaatagtttgctatatactattccatcatcccaatttacacactcgctttccccatgtggaggaaggggaagagtttgggagaaacattccaccacaattgtaaaccaactgaaaagctgatattccactatttgtgggataataacatcaactatctaactagtattagcactcattgaagaatactgaagactggaagccagtattacctggcatcttttacttttaaaactgggactagaaagaaaatatatttgctgcacagagaaaaaatagggagttaagaagaaaggaaagtgaggaaagggaccgtatgtgctcacttaggatatgtgcaagatggaaggtcctggattgcagtctgatttgggattcaggtccaactccagcattcagtgtcagcagaacttgagccttagttttagtttcctgaaaatgagtctgatgctagacgtttttttaaacaacctaatcaaatgatataaaatatttggcaaatcaaaatgagtcaagaatcagctgctgctgtgtttctttttaccctattccctttccttaccattcctttcttccccagcattaaaacatataaagccccaaaatcagagccagaggctagccttagttataaataaaaaatatctcattcttcacccccgccctttcccagtggtatttatctacatcagaggtcagccaacttttttctataaagggctagatagtacatattttaagctttgtaggccataaactactttcacaactattcaactccgtcattgtagctcagatgcagtcattgatgttatgtgaatgaatgggcatagtgtgtttcaataaaactttataaaacagacagtgggccaggatctacataaaagtaaccacaggcactggttcaaaacttaaaactagctgaatgaactcttatatttctctgacacatctaaacaaggcagtcattaacagtttagaggccaggcacggtggctcacacctggaataccagcattttgggaggccaaggcaggtggatcgtttgagcccaggagttcaagaccagcctgggcaacacaatgagacccccatctgtacaaaaaaaaaatttaaaaattagctggcatggtagcatgtgtccatagtcccagctactcgggaagctgaagtgggaggatcacttgagcctaggaggtagaggctgtagtgagctgtgtttgtgccactacactccagcctgagtgacagagcaagaacctgtctcaaaaaaaaagaaaaagaaagtagaaagttccggcaaggtcttcactggtttatttgggtaggagatattttattttctggcctgaattcgataaacaattgcttatattctgtttctctttgtgcatggggttctcgcccattactaattttttttttttttaaaaaagggtttttgttttattttgggttttttttttttttttttttgagacagagtctcaccctgtcacccaggctggagtgcaatgatgtgatcttggctcactgcaacctccacctcctgggtgattctcctgcctcagcctcccgagtagctgggattacaggtgtctgccaccatgcccagctaatttttgtatttttagtagagacggagtttcaccatgttggccaggctggtcttgaactcctgacctcgtgatctgcctacctcagcctcccaaagctttttgtttttttaagatcacaactgaatttgttcagaatggcttcacagacataactcaaaacagggtatgtcatgatctgtactctgtgcgactgaaaacaaggtattgccttccaaagccccaaatgttagacaccttcctaatgcttttaggggttatgaaatatgttctttctttttagcagatttaaatatctcggttgactgcagcttcaatcatgggatctgtgactggaaacaggatagagaagatgattttgactggaatcctgctgatcgagataatggtatttatatttgacagtttcatgttctgcaatatggtgaagggatagaaagccctccatgagtgatgggttgttattcccattactcatcagagcagggttgtttgtcatttttggaaacttttagaccttctgagctctcccttgatagatgactaacttggtccagcatatattctcctacttaatccctctcccacacacctgccaccacaaaggatatgggagaaaacctcttccatattcactctcctgctgctgagggagagatgttgagatttgtataaagtttgggagagttagggaaaaggtagaaagaaatggtttcttcttcccagtttaccagccatggcatcttgtagtttttgttttttgttttgttttcatgggggaaataaatcttgaaaggaaatataacctccacctaaacctggtgttttagtagagtggcccctcaaagcatgaaaaccataatgaacatcaagtcaatgacctgaactcctgaactgagctttcccttctgtttgttgcttgaggatttctttcgagccacctgtccttgaatttttctcaatcttatctgtgagctgcggatttcccacccttcccattgcctacttaaacactattgacggaccctaactatccccttagtgtttgtcttgcagatcccatttagagcacaaattgaatctctgtctcctgaagactgactatataattaaagtcaactgttacaccttcagggactccagttacttatcaatcaaattatttctttggggatgtataggctcagccctcagttaaaagatctttcttttagatccttcctctagaccaattcctctccaacatctttcctttcatgccctcacatgcaatcagaaaacctagatatcccctaacaagaattcctttttgaacttggggttaggggagaggggttacatctcacacagcagttgtgtgaatgggacttttactaaagattcagtgtaagcaaagggcaaatttaaccaggctgaaaacatcatatcattggaaaagctatcttgttgataactaacctgagtttctcttttcttccataatggcatctctaaatttatgtctaccagagctatatcatattgggagcccataggttattccaggacctccacagctgatataaggttatgttaagtcttaagttgagtcttctgtccaagggaagttccctatttacaaacactcaattcacaaataaccccagggttctcagcttctgcatcattcaaatcatacccctgctcctcctgcacctccattggatttctaggtgagcttttcattccctctgtacagctaaatatgaaaaataaacatggccaaggcgggaggattacttgagcccaggagtttgagaccagcctgggcaacactgggggatcccatcgctacaaaaaattgaaaaaaaataggctgggtgcggtggctcatgtatgtaatcccagcactttgggagcactttgggaagccgaggcaggtggattacctgaggtcaggagttcaagaccagcctggctaacatggtgaaaccctgtctctactaaatatacaaaaattagccgggcgtggtggtgtgtgcctgtaatcccagctacttgggaggctgaggcaggagaatcgcttgaacccgggaggcggaggttgcagtgagctgagatcgcactattgcactccagcctgggcgacagaacaagactccatctccaagaaaataaataaataaaaaataaaacacaaaaaaatgaaaaagaaaaaaattagccaggtgtggcggcatacacctgtgatcccagctattcaggaggctgaagtggaaggatcacttgggcccaggcatttgaggctataatgagctatgatggcacccctgcactccagcctgggtgacagagtgagaccctgcctcaaaaaaaaaaaaaaaaaagaaaaagaaaaaaagaaaagagacatgaatgagttagcattattaaagggataaaaccacaaagacagctcaaagcggactttatctgggagagaaagggaaaccttccacagtaggtgacagaaagcgtagctgaaagagatgccagatgaaatataggatggctatatttcagacaggcaattaatactttttagtatgtcttggacatgtactttatctgaaattcaaactccactgggcatcctatatttttatttgctaaatctggataccctactagctggggaagaagaccagattctggatgcattgaaaactaaggcaatgtcagcctgggtcctgcaagtatctccgacttgcagtagcagaagacgacccattccccaatgtcttcttcctggcttctatagaaatttttccttcttatcaacttcttcagaccctactctttgagagtttttgcccaagttcatcaaagccacaacccgaagattggatatgagcaaaagtccactacaccacaggttaaaagatacttagaagatttgcaggatttgaaggagagtgttcctgtcatcctaaatcagaaattggagtgatatgttacacatggtagttgagctccatgaaaccactagtacaggtgcaggtgtgttttggattaaacaccacactctggacccatttaaggagctgatcatcttacatgtcattgactcagtggggaagtgcattctaagtttcaagtcaccaaaatggaaatgaaattatggaacacaagttctccatcaactgcagattacctgcagtgctaaaggatcatttaattagattcttaccccatatctttgtgtatgctttgtgtatgcaaaaaattcctcggtttctctgaccatcaatttgtctatataacaaaagatttcaattgtgtgatccctaaaatccattttagcatgaaacttttattcctatgttcaaaatgaaaaggacttcagctttccctataggagactattgtttactttttatagctttttttatacattaaagccaaactccttacaattgcctcattaattgtgcattttttcccttctcttaaagctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcgtaagtgggaaaaaaatgattaaactcaatatttgcattcttttgcaatgatttaacaaatgaaacaaaacatttactgaagtatgtaggcattaaggatacaacgataagactttttccctacacttaaagaatacgttctggagctgaataggcaaggtgattaatcggcacaactcatggatacttatctggcgtatgcatatcacgttctatggaaataacctgtttgtcaggctcctctcaccagcgtccttccaaatcaggctatacatgctatacattccgtagtatgtaaaagaatgtcatgctcattcattctatgcccagaacttactacaattaatggcagctagaaggtgatttcttttaaatatttttttaaacggaactgagagagtggctattgtcagtgtccccaggaccacccttaggttcagtgattccgtaaaaggactcacacagaagtcagaaaagctgttatattcacaagtacagtttgtatagattaaaatcagtagagggaaaagacacgtagggcagaatccaggagagaccaggcagaggcttgcagtttttgtctcccagtagagtcatatgggcagctattaattctcccagcaaccaagcatgatgacacttacaaagtattgcccaccagggaagctcacccaaactttcatgtccaaggtttttgttgggggtcagtctgcccatgtgatcacctgcatagctgactttagttatctagtctccagcctctctagtggtcaagttgataccatgtgactcaaggcccccaccataagtcacattgttaccataaactatctggcatggcccaaggcctcaggtaaacaaaggcactcttaatcaaagagggtattacaagggcttagaggttatctcctaagaaccagtcaagggccaaacctttctttggaatgtgtatggtttggacaacccagacctactgagttaatcttttattgcacagtgggtttaataaaggaaaaggaaacagagttttaagaggaagttggtcaagtggatgaaaccctgagaaagaacaagcagaataaaaatggcaaagagtctattcagtttgacccatcagaaggtggctagtgacctttgcaagagttctttctttggaggggaagggtcgaaggtcacacttcagaaagatgaaaagagaagggatcagagccttaaggcagccactgtggacgttataaagagtttggtcaaggtaggccagacgaggtgactcacgcctgtaatcccaacactttgggaggccgagacaggcagatcacctgaggttgggagttcaagaccagcctgaccaacatggagaaaccccatctctactaaaaatacaaaattagccaggtgtgcaagcctgtaatcccagctactcagaaggccgagtcaggagaattgctttaacccgggaggcggaggttgcagtgagccgagatcgtgccattgcactcaagcctgggcaacaagagtgaaactctatctcaaaaaaaaccccgaaaaaacaaacaaatgaaaagtttggtcaaggtgggaaggaaaaagggtgaaagctagaaaaaggtacattaagtggtgataataggaagagcaattagtagatccatgtattgggattccatttatactttgcttgtgaaagatgactaatgcaaatttaacatcttttcatttacatgtcatagtttaattaaagcagaacatcttgtttaaaatatgtcatgagacatgactataaataaaagtatatgttgggtaccagttaatgaatttcctaaccactcttcccctctgaggtaaaagcagccagtgcttgtttaggaatgacacatgcattaatttgagtttattcttatagcagtacatttaaatcaatacaaatccaatccacgtattttcttgttgtgtttgcagcatggtttggggactgtggcactgagccatgctatatatggatgatatcccctgctggagaattgaaacatgcctctgcacagcattcataatcactttcatgttgactgaattcatgtgatggagaatatttttaatataacatggtagcttgcagggagggtatactagcaaaacagtgattttttttttaaatgcacatttctgtagacatgcccccaaagagcctggccagcaatcacactggaacacagcagtgctttcataagaggcattctcagacccaggcatctgttccttgaattcttcagttctaggggaaatcttgatggggggatattgaagggtaaggaagctgactaatccagtctaaagaatatattccagtttagcaatgtcatattggctgtggacatttgtaacatatgtgactcttgctgcataaacttgggcatacaatgtaagtcacattgctttctcgaaatcaaactatttctgaatccaaagccccatcccattaggctgggggggaaatttaatcttggctatttcctcattcagggttgggataggggccccctccctagggtagcctgtgcttttgaaaggctaaaaatggtccagacattaagaagggggcaacacatctttacttcatcatgggggccatggatacccatatcttctgcacctacgtggcccttgaagtcactcatctcttcaacttccatgccaggcccagacacagaaacctttactggggttggaatcttgttgctgagaatctagcctcaataggaacatcaggcaaccattttctgcccagggctctgccagggagatgcagtggtacagcatcctagtcctggagaatctcatggctcccctcaccacttctccttttaaccttctaccttcagccacagtctcagaaagttaagcttgtgggtaacaaacgtcaggaaagggaccatcttccagaaaagtctgcttttgattgttatatcccaaatctccttgataaaaaagaacattaaaatcctgcctaattttgggggggatagaggaggtaaaaatatagtgaaaaacacaaaattagtatgtcaattaattatccggacatttatttctagttatccagtggttatcagtcaggggtcttagtgttggaaaagccaccatatgccaagatgtagacatagccaccctcattatcccacccattgcagctgctgtgaggggtctgctgtttggctcacccctactttttaaaaaaagttcctttgggtgcaaaaggaacatctttctgaaagcagttccctcctgagactagaggaaaaagaaacttctatacccagttgtgctatcactggctgcttagtaataacttgtttccaatagttctcaagaaaatgcactcagattgagagcaaaagagagcagcccaggtactgagcagtcatagacccttgtcatctccatttgttccctgaggtttctcttctttggagagccagagaaaactggatatggtgatgacagcaagcctaaagttgcttcatttctgaagactattctgtgattctttattaagcaaaaaagagatggtgctggggatagtgaataattgcatgatggcattgttgtgagcatgattcttaaagggtctttctttaaaatgccaatttatacaagtttgaatttatataagtttgagcttaaaaagtttagaaatgacaaaaggaaattacttttttgaaaataagaaaagattcataatcatactacagtaacatgagtgcttttatatttcacattttactttgcacatgaatgtatatttttatttatctgtaactgcagtatgcgtaggctattgttgaatttcattttgataggctatatgtgcatgttattttaaagaataccatgttccaaatgaaatattcttttccctctatgtttgttccagggtaacttttgtcatctttgaatcaggatcattttgttgtcctctaaatctgcttatttcggatattgaagattgtagaaaccctctaggcctagtctgctctttatgggaggcatgggagacatacttctctttagagtgaatgttactggataggtgctccataaattgtagctattattattttcataattattgaatttaacaaatatttctagtgttttatctgattataaaattaacatgaactatttttttttttaaattacaatattgaagaaacattcattcaggccgggcgcagtggctcatgcctgtaattccagcactttgggaggcctaggtgggtggatcacttggggccaggaattcgagactagcttggccaacatggtgaaaccctgtactaaaaatttaaaaaatttaaaaaattagctgggcatggtggcacatgtctataatcccagctactcagaggctgaggcacaagaatcacttgagcctggaaggcagaggttgcagtgagctgagattgtgccactgcattccagcctgggtgacagagcaagactccgtctcacaaaaaataaatataaatataaataaataaaacaaaatcttcattcagcaaatattgattttaattttatttatttgaaaacatgtttggataaatgaatgaatataaaatagtcactgtatatccttaattttgttaaatgagtcccctgtcattttgtgtccaatttgaagataatttttttagtattcatcctctgttctctctatatagaaatttctaaactataaagaagtttgtttctcttttgattactaataaatttattagacaaaagtgattatagcatattatgaaatattttcaacacgtgaaaacaacattccagataatctccaaatacattaaccaatattttaagaaaaataattaggccgggcacggtggctcacgcctgtaatcccagcaacagagtgagactccgtctcaaaaaaaaaaagaaaaataattacactcatataaactaccaaaatctaaatatatctttgactatatagttttgttttttggttttttttttttttttttttttgaggcagagtctcactctgtcgcccaggctggagtgcagtggcgcgatctcggctcactgcaagctccgcctcccgggttcacgccattctcctgcctcagcctccgaagtagctgggactacaggcgcccaccaccacgcccggctaatttgtttgtatttttagtagagacggggtttcactgtgtgttagccaggatgatcttgatctcctgacctcgtgatccgcccgcctcggcctcccaaagtgctgggattacaggtgtgagccaccgtgcccggccttgactatatagttttttattagatgttcaaggggaatatcaaatttcttctcacttggtttttgtaaagaaaaccatattttattttttgttttgcttttctttaaatgtgaattccaaaatttccttttaaatcttattcttctcagctttatggcgtttttcagaatctatgtgggctttgctatgaccttgttttcaccaaatgtagttctctcagcgcagacacctggcatctaaaaaataatctattacagtatattcaatgtcgaagccggtttctatgaaatagggacacgagttaatagctattaaatagcttgattatatcattgttttgaacagtttggagtaatttttttattctctctccattattagatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatc

SEQ ID NO: 3054 - DNA, 63953 bp, human; identical to SEQ ID NO: 3052

SEQ ID NO: 3055 - DNA, 63969 bp, human; identical to SEQ ID NO: 3053

SEQ ID NO: 3056 - DNA, 44370 bp, human
cttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggtacccagcgctctgacaatagcctgtttaaagcttttcactggggggtgcttaaaaagggttagctgggttttgtctctcttttaaaatggctctgagacaatccctatggcatggtcttgctttcagggttgatttttttcctgtgggctgatgttaagttaatagagcagcctttcttcaatccattcctgttccaaatctttctaccgacgtgatatttcatagagggatgtctatagtttgtcaccttgggctgatgcattggggaaactgtctttttttattaatataattaatcgtaacttaggtcttgtgtcctgcatgttatattccaggaacgtggaatgtgtagttttctgctaatgctgaggaggaactggaggggcatgcatgttaattctgctttggttccgctaatgctgtagtgatttgggcattctctaattttcttattctaatatgattgctctttcttgtatcaggccctgactacgacatgtaataatcatttacagttggagcttcagagaggggacatcagctctgtcacccagtgctgatggaaaggcagggcgggggatcttctgctaattatgacttggagactggggggaagaaaattgataaaggtcctatttcttaaagagaatcttagaacgtaccacaattttcatatacagaatggttttttggagaataaagtgtttttgcagtaagaaaatggcagaaaggaactaaaattaatctcttttttctaaataatgactgatttcaagtttgatgtcccatagaatcggctcagccactgttaggttaatggatctcactgcattgtaattttccctcactcaaagtcatagactgtcataaatgcccaaaaacatattctgtaaccgcagtggctctaatataaaaagccatcatgctaaggttatttctcacagcccttgcgtccactgatagtcactaaagagtaattcgccagtacggggacaaaacttcgttttatttataaagatacaggctgaaccatatgaaattgctgatagtcaaccattttaaacctacaaaaacggcaattacatgtacttcagcttcacagtatgctggggtaaagactgcttgtttttatataaaatttctttggtacacaataatattttatcctaaacagagcaattttactttttaaattaatttttttaggtatcacacaatacacataacataaaatttaccattttaagtatacgattcagtggcattaagtacatagcaccttaattttaaaatcgtttgtttagttcaatcctcttaccaaatctacacctccccaccaaaaacccagcctgtattttcttgtgtgtctttaaaaaaaaaaaatcttcatcaatgaccaaatagctataagagaagctcttgggaatatttatcaagatgaagaagtgagatcaaagttttttccatgatgactagagactaagttgattgcatgttgtcggggtatgataatgtaatagcattgtcccaaggaagcctatcacgattttatcctaaaatgatgattttacttagtacatacttttaatttttattaatgtggtattcaaccatggcagataaaaccgttttggtctttgcaaaaaaatcccttttttaaatttctctctgaaaggaagcaaaggtcatataaccaatataaaatcattactacacaactgtgtatcttatcacttagtcttatggactgctattattttatgtcaattaaatcttatttaataacagatctacaggttgctagtacatccctgacaacccgtatatgaaaagtcattagttgtgattttagagacaaaattagaagcaaaagataatttgtgaaggaactttaaaaattacctaaatgtataaacactagctgcttgttaaataattcaaaaatatcacactaccagaagctagtgtgacatgtatggtacatgcttgaataagaatacaagccaggggatttgtttttcctgatctacagcaagaggggttgtgattgttgtgtgacccaccataattgttgatctggagggtggcttatctaatctgcatttagatgaacaagttcatatgctggctacacaaaatcaaagcccacacaagacactttgtagtttcccaatttgctcacccatcatcattaaggtacacataggataaaatgatagccacaaatgtttctgcgtgattgtcacatcagtattccttcagatttaactttaagtttattaaaaaattatttttccattgaaattaacatttgaaaacttgacataattatttatagaatgtgttatataattcttgagctggtggatccgttttttatgtttttcttttaagcctttcagcaaaggattttattcattaaatttaatcctgtaaattttgtcactttacgcagagttttttatgcacatatatattttttttcctgtgtttctcctttcccatctgttttcagtggttggtgatggagtgatgcctgtctcttaatttggggcattattgcccaatggctaatacccaatagcatgtgaattaatatctttggataattattgcagtgtctattaagaactaagaatgtaaattaaacttagctttataaattgaccttgcttttctagttgggatctttcctgggagtttcagcgggacaacacaacccagctattgtgattcactaactcctacaaagagagctctttctttaaacttaatcacaatgactttgtttctactttagacaaaattaatccatgtccttaaaaaaggaaagcatttgtgttttttcagtctgatagttttcatcacagcatgctaccagataccaaaattcacaagagtatttagtagatatttagggatttttaaggaaaacaagcagattttcttagatggatgtaagaaatgccaaattattacaaatgatagtttttaaattaaaagcattaaagtgtgaagattgagtaagcagattcactgacatggaataagcagaggaaatgaataagacagaatcaaaagaaatagatcatggaacccaataataaaaagatggagagtcggtttccattgatttcagtggagtattacttgttgtcatttcatttgtgaaaataaatgcatctgaaattgctgagagtggataatcactgagtagaaaaacaattgaatcataacaactttgtatgctctattatgggggaaaaatctatctgttatgaaaattattttcattatatgtaggtaattgaattctactgaaacaattatagtcaggttagttaacttcctatgaatcgttgctgaaataaattacaggcatcaaattaaattcctaaccacacaggaagaaaaatatagtgaatgggaaacaatgtgtaatttaaaataaattacaggatatagtcaaagtaagaaatgaatttaaattattgacttccttaaaaaattaatacatctattttaatctttttgatcaaatagatataatttcttatttttttttttaatttagcaaaatgtatgcacttttggctctcatttttcgtttaggaagaaaagcactcctctagaatatacgacttgtgtgattaaaaacccaaagggacacataacacacgtcacactattcctgatgatctgcgaattattgcattttgaaatttgtgttgacattttctaacttggctatataaatatggtacagaggaagttttagatgcagttattatctgtaagaatttgccaaggtggacatctgaagagttggtgtctggggaataggctgtagagaaaagtggctggccagatggtgcggaacatatgtggtaggtatgatacagcttcctttgattttttttttttttttttagaacatttaaatgtggaaaagatctcaacgagccatttggtacatcttctacttttacattattaattccattaggatttttttaaagacttggccttgctatttcgttagaaaaagaattctgggccatttctggaaatttagatttgccttccctgaaattgagtgtaaaccctgaattaagattattatgattttcaagatcacatttctctgttatttggaagtacagggtcaatttagactaaatgatcttaataaagtgactttgtcttgatgtatctgagaacatgcaaaataaccagtgtccccatgacttaaacttcccctctctgtgactgtgatggattggattggattgttacaaagacactctcgcttttttctcctttggaccaaatgtacatacatgggagatagttggccaggagtagggatggccatggaacggaggaagaaagtgaccacaccgactgtttttaagagaggaaggttacaatcccagtttcacaaatgtgctttgttgttcattcatttattcgtttaatggtgttctctgccgggtgtggtggctcacgcctgtaatcccaccactttgggaggccgaggcgggcggatcaagaggtcaagagatcgagaccatcctggctaacatggtgaaacccagtctctactaaaaatacaaaaacaaaattagccgggcgtggtggtgtgtgcctgtaatcccagctactcaggaggctgaggcaggagaatggcgtgaacccgagaggcggaggttgcagtgagccgagatagtgccgctgcactccagcctgggtgacagagcgagactctgtctcaaaaaaaaaaaaaaaaaaagaaagaaaagaaaagtgttctcctttgaaatgtcattcttcctctgtcccttcagctcacgttacaggagtacaggggtgctaagtcatcgtagggaccattaggggtagtataatcttggttttaataataattttgctgattggtggcagattaaatagcagacaaaatgccatagacgagaattttgatccttagccagctgagtgatatttctcgtcaaagagtgtataagagaaaatgtaataatttcctatttgataagctgattttatcaattgcattaactgctttatgtagccaagccttattatgctgtatttaaaatcaagggtcaacacactttttccgtaaaggtcagatagtaagtattttaggtgctgcagaccactcagtgtctgttgtaactattcaaatctgccactatagcatgaaagcagccctagatagtatgtaaacaaatgggtgcaactgtgttccaataaaaccttataaataaaaacagatggctataatttaccaacctttactatatttatagcattgttatggcattccttaatattttaaataatagctaaaaatgaaagataacaaatatagctttgaaagaccttgctcagtgaatatggtctttcttggaagctcagtgtttgtcacttagttgcttccggtgataatttcctaggtgctaagaagcatgacagtctgaagttcatttgttcagccttctcgctaaattacattaaataagtaaatggggaaaaataaacaaggcattgttttgctttcctttttgcaatttccccttgtttcatgcccacctttggcaatgaccactcacagctgtgtctgtcttcataagccaccactggtcacctcatctctatcttcactctcttagggggaacattttgcagttttccctctgcagggcataaaccattttcccatttcttgccaggtgcccagaatcaagacattttaaaagaccttttgagccaaggcatcctcttggaatcctgtgactgccttttaggtgttgggatcctgtccttgggattaaaatgtatactgtgttttttgaaattttataaataactttatatttaatgcctttatttaaatttggctcaaaaatataaaatagaagtgatttttcttttctttcatatctaaagatttactgttgtaaaaaggcccctccagaagtgtaagtccaggggatttggaacacatccatccagttgccgatcccatcggtgtgtcttctggatctattctttttttttttttttttttttaaatcctgaattaagggtcttaggcatggctgccatgtttttctcagaaaacacgttaacattgagcagtccatggtttttcattgtcattgcctagcagcctatgcttgcttgcctgaacatctggagacttaccccatccatatgaggagatgagcacagagcatggatgaatcttctgcagagataccctgaattgcatggcctggcttgggtaaaagtcagcatggtgggggatctagaggtccatttctggtccacagggtcccagggtgctcccttcctttcaaccaaatatttattcagccagcgtttattgggcacctgtgtgctgagtatgtagagacaaattttttaaaaggataaaaatttccagatcaaaagtgatagaactacttagaatcctcttgcttaggggtctatgtggagggctcatagccccctttaccaagaggaaatcagatcataccatgaagtgccttgaccttctgttttttttctgtcagccccactgggttttcttgcctttggagaatgtagcaacatctatttctgagagagaatctcctgaacagtaaagcaaaaatctaaatctgttttttgggggttttttttctttctttttttgagacagagtctcaccctgtcacccaggctggagtgcagtggcatgatctcagctcactgcaacctccacctcccaggttaaagtgattctcctgcctcagcctccagagtagctgggactataggcgtatgccaccatgcccggctaattttttttttttttttcctgagatggagttttactctttttttttttttttttgcccaggctggaatgcagtggcgcgatctcaactcactgcaacctccatctcctgggttcaagcaattcttctgcctcagcctcctgggtagctgggactacaagtgtgcgccactatgcccagctaatttttgtatttttagtagagacagggtttcaccatgttggccaggctggtatcaaactcctcacctcaggtgatctggctgcctcggcctcccagagtgttggaattacaggcatgagccaccacacctggccaattttttaatttttattttttatatattttttttatttttagtacagacagagtttcaccatgttggccaggctggttttgaactcctgacctcaagtgatccgcccgccttggcctcccaaagtgctgggattacaggtgtgagccaccgcacccagcccacaaaaatctcaatctaaggaagactgaaagttaagaaattttaagaagcctgagataacatcagtagcttaggacctggaccgtttctttaggagacacagaagcacaactcaactgcaaatgcacctcagaaaaactctcattgggttaactgttgcctcagcagaagagtagaaaattgcaatacatgcagaggtcacagtaggatgtatggtggtttccaaagtgtgccctcttgagtgaaattgctaaggttcacattcaggcttctctacctcctggctgaaagatcttgggcaagtgatcattaccttctccttgcccttgggttgttcccttgtaaaaatggaataataatagtacctatttcagagggtggttgtgacaaatgtaataagtaccacatgctgagtgcagtgcatagtacatcataagcactccataaatttttgctgtcatcatcattgaccacaaaaatagtttcattgtgcagttctgatcttatcccagcatcttttctgtacctccctaccctggttttaaatgagttatgtataccttaccttgaagtcaaaaagattttttctaaaacattctagaaaagcaggtttctgcttccaaacttgaaataccttacaagttttcagagattgtggagagtggagttgggattttataaaggctttgtgaggttttacttgcctcacactgtggctttagtaggttcttctcctcagagacctgagctgccagatggtgcattatgacctgatcttctgatggaatcattacccacatcaatggcacaatttttttttaatccttaaatatttgtggtgccccagaggatataaccccttattaggttttatgggattctcggagataaactggccatagcgaccttatgatctctttgagatttcaagattgtaattcaactaacttttatgagaagcctactctgtgccaggcaaattggtaggtatttttctttgcaatcccctaagaagtgggaaatattgtatcatattaccagatagagacctgagtcctcagggagtgccagctgtcaccatgtgtgtaattaagcagtggttcgagcccaagaccagtagccctttctgtatagcacatgggagaaaattggaacaggatttaatccagaacattctagactctgacgttctgagtttaagataaggtgacagacaatactgcagacgtcaatgggaggacaagcatttcatccaagaaacagcagaccattaggttgtttgccaggttttctggactagagctgggtacccttacagagagggagcctgcgttcacctttgctagtgcagctggcaataattatagtgctctgttagtgctctgttggtctgaaaaggaaacagaaagaaaaatattattgtgaggagccaaattttcactataaatagtatcttccccaaatgagcattttaagaagcaggatatggtgtgtgttgggggaaagatgtagaaaataaagatcattttggtgatttacataaacttcaatttagaaacggaggacattctcaatggatcatgctggtactgaagggttgcatttcaatagcatattttttaaactccccatttcctttctatggtaaagaataaataaaaatgctgatatagaatctttgctggagatagagacactgactctttgccacctgaaattggcagtgaacagcagagctgaaatggaaattggcaggtaccactggatgtacccaggctcaaagaaccaccagtaccatcccgtgccaaccctgggggacagggctagccccttgagcagtccaggtaaatacagccttggggtgaattctaatagcaagtcaactgttatctttaatattatttgtaatggctcttgcagcttggtgatattttatgttttgcttggtgcattaatttgttcacacgggcatgggtggaattcgccctataaacattttttaatcatctttctttttctctctccctctccattccaccccatctttctccactttcttctccttcttccctcttccctctttcaccttcaatcacttcgtcttctcaaagggaacaatgtacagtgagatatgcctttggttaaccatgaaatttccaatgcctgaaccaataatgggggaggggggccacccacatcccccatgtggccaagaactgggccagggccttcaaggagccttggccctgagagtactgtgagtgtccccaaatgtcttcccagccctgctgctctgcaccaccctctcacctcagtcattgcctttgagaaagagaaatcaaagctgtgaaagtaggattggataaccatgtacccgattcccatcaggtaggttcagtgggtccggtttccattttccttgctcgtgaggaacattggccattcagaaccgctaggtgctggatctgggtgaggtgtgcgacagctgatttggggacctagaaggggcaaaaggtgaagcagtatgaacatccaacctcccacgttcccaaaaccaacacaagttgtaatgcccagctcagttagctaaaactcagtgattttgccagtgtacaaccatagttcaaactacataaaatgcagacataaagggctggtggtaggtcggataaacacagtaagaggcttaaagtatttctgtgattttgcatcaatccataacatttctcccaaatgcttgctaactttttcaggagtaaatgtagcatggtacagctccagaaagggcaatcccaaggtacaatgtaagttacccattgaattacaaagtcataaaatccatgattaataaaaccttttcctttaaaatctaaattgtgttgtcaggttaattaaaatgaaatctgacgttggatttagttctgtcttgggttatgcattccttcatctgtcctatggctatcaggtgttggttctgtgtgtgcctgtgcagcgctggctaaatagggtgagcatgaggtgacatcagccatccattctcatggatcctataaagaatatggagggttctggaatcttgatttaaaaaaagtcattagacgtgatatatccatacaatagctactattcagcaataaaaaggaatgaaatatttgtgcatgctacaacatggatgaacctcaaaaacatcatgctaagtgaaagaagccagacacaagagaccaaatgttctaccactctgtttatgttaaatttacagaattggtgagataagaagtaggttaatggttgccagaggctgagagaagggaggattggggagcaactacagatgggtacaagggatcatttttgctgtgatgaaaatgttctaaaattagattgtggcgatggtcacacaacgctgtacatttactcaaagtcattgaattgtatacttgaaacaggtgaattttatagaatataaattatatctcagtaaagctgcttttgaaaaaaaaagcagcaaaaaaaaccatgagatgtgcataattcaagggtggggagcggggaaaggggtattttttaacataacaagaagcccccaagttatcagaaacaactgcttgagggaggagtccctcttcatcttaagagtctttaagagtcttcattttaagagtgttgaatgacatcaggccagctggaaacccagaaaaatacttattcttttctgtattttagttcactaaactggtaaagaataaacacaatatcttattgggggggaataaaagaaacctctatcaattgctcttgaagagttttctccacttgttgagcagttccctgtaaaagcattgcaataatatttgtgtgcttttgatcctacggtgaaacaccagaatctgggcattcatagcagcagtggcagctgagaagaaaaatacgaggctccattttctgtttttctgaaactgatttctttcagaattccaaagaatttgggtttccaaaagataacatagtgcatacatcatgtactgcatgataccaccactgagtgtctctgcagatctaactcattaatctttctggagagcccaagactataaacaactccttgtccattcaggtgagattttggcaccaaggaagaggagatcagaacaggttttgctgccagatgagttaggggagaaaaaaaaattacttttcaagttttttggaattccataatgatatgatgaaagattgtggaagtctaatagtatcaggttgctggtgatactactgcaagcgagaattccatgaactaacaggttcttgcctgagggggagaaacaaaatcactgaatttgatttaaagaattatcttcccagatcctgaaacaatctccacctacacatagttttaactttttgtgtgcattgatggaaataattggaaaaaagatgcctccacggggactgttaatgtctggagctgtctgcagagaccttatgtgtgatagtgtaaagcctacagcgcaggccacagagtgaagggacccactctagccatgccatcgcctttccagacacttacagattttgttgggtcctaaatcaatgccgttgccattctatacttagatctccaaccccaaccagatggtatgaggcaaaaaatagggaattctgtatggctcttttttttttctttttttttttattaatttttttgcagagttgtcagcctttttccatgggggaaaaagaggttttgatacaggctgaccaggaaatttttgccaaaggaaaatgcctctcccactcatgcagttactgtagcagagactgcccttctccaggaacttccttattccccattggaaaggtcatggcggttccagggtccttttcatggttttctttttcttgctactacttcccagtagaattccatctttaggggttagatagttattctttccttatctctttttccttttcaatttttagctgcgttggacatgtagtgtccacatcttttctgccttcaggagatgaaatgatgtatgaccacatgggctacccccgccccccgccccccccgccgtccatgatgctgccctaggggcctggcctgaggtggtggtctgagatgcaggcaagcgatgaagcagggagtagttcatgctaagtctccagtcagtggcatattgtgcttaacattggagggagcacttccagactgttgtagattgtgttacacaggctccagaggatagcctaagacaatctagattctctattccaagtgcgggctgtggaccagcagaatcaacacctccaggagctcgttagaaatgcagagtcccaggtcccacccagccccactgaatcagaatctgcattttcataagacttccaggtagttcctatgcacattaaagcttgagaagcagtaattaagagcaaggtccaagagcaagaagggagaagacaggaaggaattgattatgtgaatttaccctcaagagatctagaaatctttatctttggaaaagataaagaattgctcaaggtattcatcctttcttctttccgtttctatttaggaagaggcatgtctaagcaatgccaaggcagtcattaatctgttgagtcctggctggtttgaaaaacagtgaccttgcttctcttacctgcttgtctcatgagggggtttggggaaggggcagtgaaggtgagaaaggtttgtttctttgtggcaaagtgagggccagaggagaaagtagttgatggaagcttgggagaaattctcaaatgtctctcatctccctctttaatataatccaatgacatgcaagatgccgtgactaaatataggctgccatttttagtggactaagaatggttctttatatacagttaaatctgtaattcagaattcagtctcacaaggaaggagtagaataaccacccacttcacatatcaccaatttccgcctctcaaatccaaaatgctctgatgtttcagttaaaatggccacagataattccagaagtcgggacaaagagcacaccctctacatagggactgtcacagaggatgtcgggagaggagggccctctggagtgttggtatttagcaagaagcccaagtgttgtgatttgcaccacagagaatggattcctgagtcgccacggggttgtggggtgggggcgggtagcagactgacggagggcccagcactgctgttaactcatgttgcaccttgtctgcccagatgtaaccacaggctggctcctgggaactgcagactttatcccttggcccccttctaggctgagcctgggacttctctctcactgatctgctttgtagagggacacctgtagctataagtcctgggaaatgctactggatttttgtcattgttctttagtgtcactctttcctaacctaaggttgtaaggccactaagttcgaggtcttctcccaaaccacttgaaatgtattttaagggggaagaaaaacccttaatccttctgcgtgtaccattccacctctggccatagttgggtgtcgaccataactgacagtctggtcgtgccgtgtgggttctgctggtggtatcattctgtccccagaggctggttgcagaagcttttgtagcttatccagcctaagccagtggatgctctcagtctgtctgatgccttccagttactcaagatatttctgattacatagaggtaaatggtgaacacagtggaagcacgttgtagctcaggctcatgccgtaaagtccctgagatttttagagtactttgccttttgttttctgaaatgtatcaattctttcattttcaaagcacctgcagttttcaccaaaaaagtgccatatacagcagttaacgattttatagtttatttactgactgctatggcagtctttatatatatatatataaaataatttatatatagctgtaaacaaatacttatcgatataagtaatttcttgattgtttttgaacgttccattgtttatgcgctatattgttagtctgtgattagcacctaattatgtaacaatggcttactgtgtgtgtgacatatcagctccctttgtcttttggtcttacctttgcttctcaccttagagtaggcagacagagaaagcagagataaaaagcagatcgatgagtattgagtgttgatctcgggctttctgtcagacatgtctgattgtagggacactgacttggattattcaagactgagtacttctcggtctttgagaagtagtgtcatctggtctttgctgcctttgaaatgtcccttatgttatatgttttcatataaatctaactagagtccattaaaattaattttgctttgaaatcttttgccacccttagaggtaactggaattactctgaagtagctggggagtagctgaaatcagccacttaggtcttcccacctcctcaggctgtgtccttttgggtgccgaagttcactcccaaataagccacatataccctcaccccctgagtgcgtccacgtctatgaaaagcttatatgaattggcttttgtactaaacggaatgctctgggtgtcagagtcatttaggtgggacaaatcttcctctgaagatcatcatgcttgtattttctggagacttccatgaacaatgctttcacccccaaggaccagctctaggggtgaaatgtcaggctggtaggagaggtaatgggatcgaaacaagacttcctgtgtcttgagaaaaccttgtttatattcatgtgctgtttcccagtggcaataaatcgagattcctgtgaggatttgacagacgaggctggtgatgccacccactgtttttgtaaagaaaatgttatcggaaccagccaggcccatttgattgtctgtggctgctttcgtactccactagcagagttgagaagctgcaactatacaccctgcaaagccaaaaatatttgccatctggtcctttacagaaaacaattgccaatccttgaattagaatttgcaaagtgtgtcaaaatgcaatactctatctactgatgttaggcaacacctaaaaactttgctcggcactcagtttcctaaaatcttctccatcaaacatccctcatcctctgccctccaggccccagaatccttgttctctgtggggaatagggactccctgctcacaggctgtcaactaaggctcagcccttcttcagagaatttcttggtactttctagaagctcagcccctctggcctctttcaggtccttctctgagttttcccataataaaccaagtcccgttaagtggatactgtgagctactttcatctagtgttctattcagtgcactttagcaagttttatttcctgtgtatagaaaagatatttgtggtttactaaatgtagtgctggggatcatttctttctttttttttttttttaagtatgaggttccaatgccctgaatcggaatcgctaagaatgctggttaaaaattcagatttcatatgggcatggtggcacacatctgtagtcccagctacttgggaggctaaggcaggaggatcacttgagcccagaagttcaagttcagcctgggcaacatagcaagacccgatctcttaaaaagaaaaatcagattcccagtccccacctaccctctctgcgatgggtcccagaaatttggcccattttaagaagctcccccaggcaattctaatgcacagtaaagtttgaccaccactgctatatacatagaaggccataacccctcattataacatctttggtaaagtatcgtttcagttcagcctgtgtatgtatatgttcaacctgtatatgtatttacagttaagatgctcaaagtcaaacctccacatccttagcagacagtactattgaatttgaagtaaattcctcttgaagtaatgtttcgctattgccactatatctttgtgtataagagccaatgcaaaaacattagattgtaaagctgtaggcaaacatcagagctcaggctgtgtgttagttatcaattgttgcataacaaattcctccaaaacatagtggctagaaacaaaaatgtatattatctcggcttccttaggtcaggagtctggactcagcttagctgtctcagaaactctaatgagatttcagtctcatctgaaggcctaactggggaaggatccacttccaagctcattcatgtggctactggcaggacttggttactttgggactgagggcctcagttcctcacaagctgctggcctaaaacctcccttgatttttttccatgtgtgggctctccatagctacttcatggcatagcagatgacttcatcagatagagagagcaagtgagcaggtaagagaatgtgccagccagagagacaatgctaacaggacagaagtcaattttttgaaacctaatcagggaagtgacatctcatcacttttgccatattctagtcctaagaagtaagctactaggtccagcccacattcaggggaaggaattacacaaggccatgaatgtaggtttgtggggatcattgggggtggtgtcttagctgcctgccacagtctgtataaacatttcacagtgcaaatgcatcctccatctccttaatgatcataacctcttcactttctcaaagcctcacctctcagagaatgtatcactgggttaaatgagtacctggcaggtgtttgacggccttcctgaggtactagactctaagctctctgtgagcagaggtcttcatgccttgctccctgctttggcctggctcgggacctaggaccaagaaagcagtcgttcatagtgttgaatgatgatcactttatttttagcactcatgatgtgtgactctatatgaaattgtctaattttagtgtccattgtgtacatggctcatttcctgggccaggctggtcaagaccttgcactctgagagttgcataggagctcagcaggtgtttgttaagtaagttcagattggctactcgttgtcaggagtttgagaccagtctggccaacatggtgaaaccccatctctactaaaaaaaaaataataataataataatacaaaaatcagccgggagtattggtgggtgcctgtagtcccagctacttgggaggctgagacaggagaatcacttgaacccaggaggcagaggttgcagtgagcagagattgtgccactgcactccagcctggacaacagagcaaggctctgtgtcaaaaaaaaaaaaaaaaaaaaaaaaaaaaaaaaaaaaaaaattaggttggctaatcgaggtttctagaatcatctgcatgtaaatagggttaactttgtgggatgattttcttgaataagaagttctcagcctgagcttcacagtagaaccctggaaggaaggggaggtcttttaaaattccgaagccacatccagaccaagtcattcagaatcttgagggtgggacccaggcatcagcgttcttgaaagctcccccaccaggtgatcctctgtgcagccaaggttgagaaccactgtggtagaccagtgtttcccaatccgggggagtttctgcctttcaggagatgccttttaggcatctagtggtgtagaggtcagggatgctgctaaacatcctacagtgcacaggacggcccctccccaacaaaggatggcccatgccaatagtaccaagagttgagaacccctgggctaggtcctacgctttgagtcaggaaattggttctaagtgaagcagtagaagtccatggggtagctttgtcccagatgttaagcttattgcaggcatggatagcttgataagtctggaatattatatacaatctatgtatcggtgtttcctgaagagaaactcactcttttaaaaggcacgcagtgcataaaccaatacatttaaacctacatatatttatttatgcaacataataccatacacgtgtgtttgcatatagcacgtgctataaacaccctatgcatacagagatgtatgcagggcatatgagtgtgttattgtggttagaggaacaggtatgtcttcctcagcgccctttattttccttccccctcactgtagcctcctgccctctgcttgtctagtaaaagccctaaggcctccctgacccttgctgtccttaccctcagtccagaggatgcctctgctgtgccttgctgcctggagggttcccatcacccaggttaatgtggctcttggctttcaccaccaatccttagtttctcaaaggggttcacaacctttttaaattactagtgtgtcttgtagaaattgaacttcacaaacaggtcttctgaaaacgctttcttgtggtgtaattgatatgcatatggtgcatctctttaaagtgtctgacaagccttgacatacgtgtgtgctcatgaaagcagcaccatgagcagcatggcaatgtggctgccactcccaactctttccatccttcctatgctcccactctccccaagcaaccactgatctgctctccttctctgtggattagtttgcattttctagaatggcccttgtgaagatgtgttcacataaattctctcaccctttctcacccgaatagaaaatgttgcatgatgttgattgcttaatagctccacagctttgtccaatttttatccttcctgcttttactgaagatgtcctgcccccatgaataaacctcagaagacccattctgccaccgcctaccactgaagagttgagcttgcacccactccagtccagcccacacaccagtgccagattcatctcttaaaagcacatcctgagtcacgcctcgcctgctcacaaaccttccctctcttccccttgctgcaaagtgaagcacagaggcttgaggctggcttggacatcttccatggaccaggcaatggggggacctaccttcctgacttctccccaccattaccctggtgtccttgatgaactcggctacaccctgaacgctccccacgtctcccacatcacatgggtcctgctgtccttcctttgtgcttttcatggaatccttctgttcttcaaggcctcttcacctcctgccatccataaacctttgccttagcaacccacaccaaccaaagagatctgtccctacctcactcccccatatccctgtgtcagcactctctttattctactttagtgataccttatgtgtctgtgtgtcttaccgcccccctcaccccacccacaaggatcaaagccaggagggcacacttgcagaccccaccacagtggcttgcacatggcaggtattggacagacactcattgaatggaatggaatccaggaaagtagagacactgtcgcccagatggtcaaggaaactgattgctgctaaagctcaaaattgcagatattaaatacttctcaaatgtctggagtagcctccagattgctgtgctcttaaaatctgtgtcatctggacttagagctggcttcccctactctccattgatctccatgattccttgctgtcccactttaccaggctaaaagcctttgggaaaaccaaagccagttcccacaaaaggcaaaggaagagactaacaagtatctggttgttggatttgtttattcccagtcatggaagcgtatcattgcttttattgacttgcttatcttctgctagtaccatattgcaaatgttagaggctcatctattttaagacttccatagtgttttcacaaaaatgaaaatcccttattaaacagattttaggacaagcttctaaaaggacctgccaaaaagtgatttcctttctatcattagaaatagtttccacattcttatcgttatgtagttgaacttttatgtccaggactgcatgaaagacgtgagaactgagaagcaacctatatttgatttcgcactttgttcttggacaggaagcccctgtcaactgacttcacatctttttaatgcactatattagtggttcacagaactttctgggtgttaggtccctttatgtgcttagaaacagttgaccccaaaacgcctttgctcttctgagttgtgcctataaatattttctatattagaagctagaactgagggctgggcatggtggctcatgcctgtaatcccagcactttgggaggccaacgtgggcagatcacctgaggtcgggagttcaaaaccagcctggtcaacatggcgaaaccccatctctactgaaaatacaaaaattagccaggccagccaggcacagtggctcacacctgtaatctcagcactttgggaggccgaggtgggcggatcacctgaggtcaggagttcgagaccagcctgaccaacatggagaaaccccgtctctactaaaaatacaaaattagccagcatggtggtgcgtgcctgtaatgccagctacttgggaggctgaggcaggagaatcgcttgaacctgggaggctgaggttgcagtgagccgagctggcaccattgcactccagcctgggcaacaagagtgaaactccatctcaaaataaaataaaataataaataaataagccaggcatggcagcatgtgccttaattccagctatttgggaggctgaggcaggagaatcacttgaacccgggaggcagaggttgcactgaactgagatcgtgccactgcactccagcctttgagttttttaagatggagcgagactccatcttaaaaaaaaaaaaaaaaaaagaaaagaaattagaactgagaagtttattacttaataataaacttagtcatttaaaataatagcaaatccattatatgtcaacctaagtaatgtttaggaaagataacgattttcaaaaagaaaataatattttagtgtgaggaataggactgttttacatttttgcaaatctctttaatatctggcttaacagtagacagctggactcttacatctgcctctgcattcattcagaggcatcttggggtatcttgctttggttgaagtatatgaagaaaactcaaatttctcacaggtatgtgcttggagaatggaggagtgttttaatggcctttgcagataattatgaaattcttccttgatactacaccaaaattcagcagctagtggtttcttaaagactacttgtaatgtggaatctgaaaccatattgatgatatttttgtactcttttccactaaaattcattgcttgatcttgcactttgattgactcttatattcaagaattattttcccttggctatttggaaaatattggttctctgagttgtgcagatcttccagacgttgacacatttaattaaaccatgtcaaaaaaatttcattggttaatgtcaccaccaatttcatcaagaagtctggtaagtatttggaagctgtcagtctcactatggcaggtacaagttttccaaaattgattggcaacagatactatcagttgttttctttgaagtgacaagctgttcatttttgggaaagtttctgccaaatacttaagtctaaaaaactatatcttgtcaggcattctttcaagaaagggggtgtttgcccccagaaaggtacaagtttggctcataactcagttacataagaatgtttcctgcagcccactgtcacacgctggtttgtggtagaagggctctctgcatcctctcactcatttcattacacaaactgttcgaaaggcacatactcgggggttgagatttaatcaaattaataattttttattgcatcgaggacatttggaagtgaaactggctttttaatttattttcttgcgagcgcgtggtagtgaggaatgtgttcctgctaagtacactatggagccactgcccgattcacgctcaggcatcagcagttttactgtgcaaatgtcaagcagtgaaaaaagtaaataacatcttggtgctattataaaaagttttggcttcacagtcctcctgcaaggatcttgaggtctgccggggctgcacagaccgtctttgagggcccactcctggctcagagtgagactggtgggcaggcaggatagaatctcttgggagctcaatgtcctttccagacctgcctgaacagaatctgcgttttaatgaagtcccgaggagatttatacgcaggttaaagttttcctgtagtcccagctatttgggaggctgaggcaggaggatggcttgagcccaggaggcagaagttgcagagagctgagattgcactgctgcacttgaacctgggtaacagagtgagattgtatctgggaaaaaaaaaaaaaagagagagagagagagaaccactgctctttaacagaggtctgcaaaactttcctttaaagggccacatagtaaatacctgtggcaacaactcaaccctgcctttgtagcttgaaagtagccatagaccatatgtaaatgaatgagcgtggctgtgtgccaatacaactttatttatagacacagaaatttgaattttgtgtacctttcatgtgtcacaaaataggttttttaatatattctaagcggttaaaaaagtaaccacttggaatcatgtcaaaatcattctgagtttgcaggccatgaggagagccagatttagctggtgggccacagtttgctgacctgtgctatataacactgagtgctcattgaagttaccgggggagcttcaaaaaaacaaaccccaaccctctaattcctgagtcccgtccccaataaattctgataaaattggtctggggtgaagccagggcatcaggattttcagatgctccccagattattccaatgtgtaggaaaaatggagaacctctgctctataatgttttccaagaaagttagttttcttttaagcatttctttttaagattttagaatttggcagtgtcaccaaatgtctgagaccagaattatgtattgtaaccttagagcagggtttctcactcttggcactgtgaacccaaagctatctgagataggtctcaatcaatttagaaagttaattttagcaagcttaagaacctgtgacacagcctcgggagatcctaataacatgtgcctaaggtggacggggcacagcttacttttataccttttagggagacatgagacatcaatcaatacctgtgagatgtacattggttcaatctggaaaggcaggacaactcaaagggggtcagagggtggcttgcaggttataggaagatttaaaaattatgtaaagacctggaatccatagaaaggaatgtctgggttatgatgataaggggttgtggagagcaaagttttatcctgtaggtgaagcctccaggtagcaggcttcagagagaatagattgtaaatgtctcttagcagatttaaggtctgttgatgttaatgctggttggcttttcctgaattccagaagggaggagggtataatgaggtatgtttgactctcccttccaatcatggcctgaactagttttttcaggctaactttggaatccccctggcagagaccaggaatctattcagatggttgggggtggggtggggggtgcttagaatttttttttttttttttttttaaacggagtctcgctctgtcgccaggctggagtgcagtggcacaatctcagctcactgccacctccaactccctggttcaagcgattctcctgcctcagcctcccaagtagctgggattacaggcatgcgccaccacacccagctaatttttgtgtttttagtagagacggggtttcaccatgttggctgggatggtgtcgatctcctgacctcgtgatctgcctgccctggtctcccaaagtgctgggattacaggcgtgagccaccccgcccggcccagagttttatttttggtttatagcactattggcattttgggtgtgaccattctttatttggggatgggggctgtcctgtgtattctaggaggtttaggagcatccctggcctctacccactagatgccagtagtgtcccccaccctcagttgtaacaaccaaaactgtctccagacaccgctaaatgtccctgggtggcaaaattgcctggattaggaaccagtggtctaaacgatgtagatgttttttgtgctacttcagagaatctccacattggagctattgacatctggggctgggtaattctttgttataagagcatattctgtacactgtgggtgttgagcagcatccctggtctctactcactagatgccagaagcaccctctcccccagctttggcaacgaaaaatatctccagatattgccaaatgtcccctgaggggcacagtcaccccctgttgagaattgcttggccagctcagaatcagggaagcttctgtccactgacattcactgctgcttctcttaggattttcgccctctccattttcccattgcttgttgcttgaaagttgtaaagcttggttcctgcatcttttctttttaattttgtggctcattaggaatcagtaatatagcaaggaaggccccatgtagagaggtaagggggtggtttttttgtgtggtgtttgttggggggtgtttgggagggtgtgtgtgtgtgtgtatgtatgtgtgacattcattccctggggaagaatctgagcccttgttcctgccagccctacgtctgagccagcattaaatctgcagccaagatcacagacaacttgggcaaatcacttggccattatgaactcacagccatggcaacggccatccacaagcctgaggacaaaaggtgttttattctgttgttctgcacaaaaggttctagggatactggagacaaaatagcctttgagacttaaaggcattgatgtgtattttttttttccctactacatggcttatatttaaactgtcttaggctaatgtacactgtaatttttgtgtgaatcaaaacctaaaattctttttatccagaggccagctaaatgaaggcataagacagcccaacagaggcttttagggtttggtgagaggtattgagaattactagtaaaatgtgctagaaagcctggcattctagcctggccaacatggcaagaccccgtctgtactaaaaatacaaaaaattagctggatgtggtggcatgtgcctgtaatgccagctactagggaggctgaggcataagactcacttgaacccaggaggttgaggctgcagtgagcggagatcacaccactcactccagcctgggcaatagagtgagactctttctcaggaaagaaagaaaaaaaaaaaacctggcattgattattatttttttacatgaatacatcacagtcatcaaaaaaatgctttccttattttttctcgttcacgttacccaatgttgtcattgctggtttgaagcttgggaaaattcagtctgtggatttataggagcatccaagaaaagcactgatcttccttagctatcgtaaacttttaacagcatggtgttctgctggtacttggcaccacccctatatttaaaaacatcagcttgcctatgactactaaggacagcctgaatcccagatctacttcctttttgtgcacaggcactcccagcactttagggggtggttggagtgtgtgtgtttagaaatctgctttctcaggtgactcaattcccgtcttctcagaccctgtctatggcatgacactaaagcatgaaaaattccaaggttaacagtacttgtttggctcacaaaaatgcactctagctgcactcttttcaagatggctggacaacttggaacattttgtttttcttaactgtagtccttggaacttgccatttgattcacaagtgactggagggttatggccaaacccagtgggccacgtcttagagaaaaaacatcacacaccatcgaatatgaaagcaggcacttcaaacagactcaggatgccacacctgagaccgggaagatgccactgttgactagaaatgggcttctcaaattttcatgtgcacacaaatcaccccagaggccttgttaaaatgcagattctgactcagtctggggtcacttccaacattctttatttctcacaagttcctccctgctgaagctgacactgctggtccaatgaacacactttgcaaagcacatggaattgacaaatgacaaatggtccactcatatcttttcttgacctctgatagttttccttgttgcccagtagaagctgccagcatccaagttcagctcttctcagctacagatccatatatcccttcacatcatccagagtgatctttcacaaccccaatctgtttcccatgcttaaaaatgctccctggcagaccaggcatggtggctcacacctgtaattgcagcactttgggaggccgaggcgggaggatcacttgagcccaagagtttgagaacagcctgggtaacataaggagaccctgtcactacaaaaaaattaaaaaataaaaaatgagctgggtgcagtggcatgggcctgtggtcccagctacttgggaggctgaggtgggaggatcgcttgagccagagagttcaacaccgcagtgagcagtgattgtgccactgcactccaacctaggcaacagagcaagaccctgtttcaaaaaacaaaacaaaacaaaaaaaaaacgcagtggcttcccatgattttgttttttttgtctttttgtttttgtttttgtttttgttttgagatggagtcttgctctgtcacccaggctggagtgcagtggtgcaatctcggctcactgcaccctccgccttccgggttcacgccattctcctgcctcagcctcccgagtagctgggactacaggcgcccaccaccacgcccagctaattttttgtatttttagtagagacggggtttcaccgtgttagccaggatggtctcgatctcctgacctcgtgatccgcccgtcttggcctcccaaagtgctgggattacaggcgtgagccacggcgcctggtcaaggcttcccatgattttgaagataaagtccagaattcttaaggtggcctggaaagccctaggtggtctagctcctatattacctatatcctctagctcctaaataaacacatttagctttttcttactaactttttgcagcagttttggttcctctaggatgagtgtgtgatatgtgactaaattgcccagtgttcaaagatatcatgcacactgtgaccagaggtggcttctatactgacatagaagatacagtggagagtgatccatttatagattgttggatatctaccacacatgcaatcttaaccctgaagataactggtcaaccaagctagaataagctctacatccagctgtattatgtcctataaatttttcccatattttatgtcactagcttctagtcatgttggctggcacagtccgtaagagttttatctgtgccagtggagcaaagatggtgatttctgttctataggagccagggttcctacagccacaaataaaatcatctgctgaaaacctaagagcattggcatctgctgagagagcatgattcattgaagtgatcccccaaattcttgagttcctggttttccctgctgttataaaactagatccacagcatgaggtatatacagagtccttgagagatataaattggagggaaactttagctttgatctagtattgaatttgggattgaacagcatcattcttctaaccccacttggctttttgagcctgggagagctgtgatatttctttggaatgctctaaccatttggatgaaagaccgtttgaagtggcaactgtggatttggaaggatgagttctatcgttaaagggcgagtgtgctgcaccataacacctaaccctaactccaaatgatgaaaaagggtgtgggtttagtttaaaaatatatatagatgtatacatctatatatacacacagagaattaatgaacaattttatctggttatatatcagtgtcaccacatcagctgtttaagtattctggatactagatctttctgtagaaggacccatccagtatgaattatttgcccttctgatcttccctgtcccccttctctccactctctttccactggctctgcaggggtctgtatctttgcccccatcatgctggactataataattgtgttacttgtctgcctgcagtattggatttatcttgaagccagaaaggtatcttatttcagttttgtgtacttggcacccagtaggtcttcacaaaatactgaattaatgaaatccaacagaaaacccagttagaacccagctcctgggttatagaaaatcaaatatgtgacaattcaaaatgtatcttccaaagcagtgtgttctgtgatgatgaaatgtcctatatctgtgttgtccaatacggtagccactagtccatgtggcttttgagcatatgaaatgtggtttgtgcaacagaggacctgaaattttcattttatttaattttaaataaacgtaaatagctacatgtcttagtggctaccattttggaccacacagccccaaggcctcacatctttatcctttaagaaccagatacaactttgttagccaggaaagcaggcattcatctttttcttaacatgatcatagaggctgagaatgtggggaggttgtggatgatacaatacccatgtctgttttctctttataatgagatacgtcaaggccaaggattctagtttctcttagtttgggaacctggagagaatttggactttgagttgcattcctctcacctcagtccccagaaagtcatgtgacaaaataagattgagctctaacatctctgctcacaaatcccaagtgtctgaagctctttaagatactgacttgctagtgaacttgaaccatattgtgcactggttccctttttctttttttgagacggagtcttgctctgtcgcccaggctggaagttcagtggcgcaatctcggctcaccgcaacctcttcctcctgggttcaagcgattcccttgcctcagcctcccaagtagctgggactacaggtgcccaccaccacacccggctaattttttgtatttttagtagagacggggttttactgtgttagccaggatggttcccattttatatagtttccccaatccacttcagggaagttggtcttcctaaaaacagctgctcatcttttgaaattaaaggaagcacagctttcttatgaagccctgatattttttattttctaatgaactaaagagaaatctagtaatgagttttcatagtcactttccataggtttaagcgaatgctagtttaaaaggaatgctcactaaaatgaaaacattcatctatggtgttttatgctgggttgtcattccatgacaactatgaagaccatttgggggattttttttttttttttttttttttttttgctggcttaatgtgcttgccctaaagtaatgaagtgcccttgattgctgctaaacaccataatgcgtttaaagttcaatttccccgacaagccatttacttaagggtctggataatataaacagagacaggaggttaggagaggtactgacattatcctgaggccagtgctgcctttactgaaacgtaaatgtctccaaactgaaaacgtcacctggctctgcccctgaggcaggtctttatggacatctcaagtaaaagtttattttaaaaatgaatacaagtctcgtcttttcaagattaagagtgacttacggctgtctctccttcattccacttcatggatgttcattttggttttgtttttttcttctgttcttttttctccttcaagtacttaaatatcacccaccagttctgggttctgactctgaacgtgtgtgtcggggaagggggcaggtggaagccggggaggaggaggactgtgaatgaattgcttgggctgactgggctggggggaagcatttttattaaaaatttgagataatttctgatgtcaacttgaatgaaacttgagtagacccacttgagtggctcttggtgactttgttcttcactgaattatggaccaaaatacctgtgacctttccaaaacaatcaccttgctatttgtttgaacctggcgacggcataattgctgtatcagattctcccagttgccccggaggtccagggcttggggaaagccgttggttgccacagcagcagacgtattgaaaccccagaactgtgaggctggagacgacctgactgttgcttttcttcacagagctgcagcttcactgctgtcctctcttttgactgtgttagtggaatgagtgcttcttgttggcacttgagcggggctccccccaccactcagtcgatcaggaagctctagaactgtaactaccttataactctttgtcaattgactgctctgccattcactacccttccagattctgagcaaattaagttacattcccttttggagcctcagggtcctcaccgcagaatgtgagatcacggtaactaccacactggcccttgggatgtcgaagtattaatattaaccatagagcctgagaggggagatggaaaattgtaagccttctctgtgaatatggggtattcttgaagaccagaggtgttcttgcccgtaacggctatattttctctcctttgggttcaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgtaagtatccggttccctttaaaaatgcatctaaggcctggcgtggtggctcatgcctgtcatcccagcaatttgggaggctgaggcaggcagatcacctgaagtcaggagttcaagaccagcctggccaacatggtgaaacgccacctctactaaaaatacaaaaaaaaatttagctgggcgtggtggtgcgtgcctgtaatcctagctacttgggaggctgaggcaggagaaccagttgaacccaggaggtggatgttgcggtgagctggtgagccgagatggcaacactgcactccagcctgggtgacagagtgatactttgtttaaaaaaaaagtatctgagatgcaaccacctcatgatgtttttcagaaagactacagtgtgctttcctagcagaagatgaatgcttttacttaaagctcactttatgtagttagaaaaaggttcatgagagaaggaaaaagaaagggcctagaatatggtagctgtttaggccccagggtggaatgttacttgggaatggtaaggtgcacacataggacactccacacatggtagctgtggacatggggagctgtgacatggtgataggtgatgctgccgattgtctcaacagaattgtgttgttcccaagtaacagatgcctccagctttctcccaggaagtgaccatccctggaatggtaggagccctgttgaggactgaccccaactctaagcctacaggagcagtattttaacattaactcttccagcagaagagcagatcccagggcatcctccattgcagaagagcagatcccagggcatcctccattgcagaagagaggaaggtccaggggtttagcagcagatctctgcctttctttctggaaacattctcaatggagtcgcagtgactcccacacatagattcttgtagctgtgcaagctcagcagcaatctacttatttccttcacatgtcttcccctttctccatttccttctaccgtttctttttcttcccttgaatcccaaagttccagtgttagtgtgtcttatgattataagaaacttcttcaccagactgaaaaagacatgaatgaatttttatggaatggtcatggagtcatgttggagactcttcagtccttagggaattttattctttcttatctgttcacaaatgacctccaaagaaatgaacacaggttggggagattataaggagggctcaagcaggacaggggactcactgagttccaactatgtgcaaagaagaaatgtttaccaagactgaacctgggaaaggtgtgttgatttaattaggtagtgatctcagtctgtggctctcaaacttctgagaagctttaagaaaatccccatgccttaccccagaccaattaggacataatctctgggggcgggatccaggtaccagtattttccaagctccccaggtgattccagtgggcagccgaaggctgaggacatgtcatttgtctttgttagcttttgtgggacaaactgcattgtgaattaactttctgtatcttaaacctactcgacctactactatttgtgtggtgggagtcacagtgcaaaagacatctccccagattaccccctaaagaagccctgagtgcctacttaggggttttatcagagtgacattaaccactaggcctggttgggaggcattttgaaagggcagaaagaacatgttgtccattgggccagggttcagatgctggctttgccactaactgtgtatcctccgatgaggagcttaactcctcaatgcctgtgttttacttatgtgcaaaatgaggattctaacccttgccgcccaggactcaggtaaggattaaaagattacaactggatgctgccctgagcaaaggaaacatcattcccaccttggaaggaaggcccaggttgctgggacatgggcagggatgccgcccaggatgccccacaagtccatcaaagccatcagtggggcgagtgacgcactcacaggaacatccccctcatgtcctctctccagcgtccagaaacgtagtcactaccaggcagtgaatttaatggttcaggatctcttcttctctttgtaggatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatggtgagttgaacctctgataactgattgtttgatatacaaccagagccatgccttgatgtatttccttgtatttggcaaaagctaccaggtatcgagcgtgaatggagggtccatgacacaaatattggctttaccaatttagagttaggactataaaaaccttcaacatgctattgatagtaaactaaagtctatggctggcagaaataaatcaaatgttttcatcagtgtaaaggtgaaaagggtgctgaagatttttcaaatgccaagttcccactatagaaggaggtaactttcatgtggtctcagtgctcccctttggttgtctttaaatatggatcatagccataaagacatacatgaaccatggaaaatcgtcctgatccttctgtaaatacttaccagtacctgctgtacagagcgcctagctgggctttgctagccactagaggtgcaaagattaaaacacaggctgctttctcaagcagcttatagtctaagacaggggttagcaaactaggggctgtgggccaaatttgacctactacctgtttttgtacagctcaagagccaagaatttttttttttttcttttttttttttttttgagacggagcatcactctgtctccaaggctggggagggcagtgtcgcgatctccactaactgcaacctctgcctcccgggttcaagcgattctcctgcctcagcctcctgtacaagtcaggggaatggttacttttgtaggggaaggaggcagctgttaaataaaatgcctgtggaaagcagagggaaaatagccacaaatagtgggaatcctcctccaaaggaaaaaaaaaccaaaaacatctcctcacagctttaaaatgacagctttccccctcacttctacccatcaagtttcaaaaatagaggtctagtttccaccagggcacagcattaagtcatccactgcctgatgtttaacatatttggatcctttgagcattggtcaggacacagtacatggtggagaggagaggagcttgtttgtacttgagctagtggcacttcacctagagatggggacactgtgagggatccacagcccacctagcatggcccgcttttagctcttatgtcagattttgttggagaaagtcgaaagcccccttagactggagaggagcttgaccatcttgcttgatttcattgccagtcattcatgcgctgtctgcatctctggccactggcacctcatgtgcttccgtttcatccatacgcttaacagatcacaatgctgacctgccttggagggtgtgaggaagatgcaggtgacggggcagggctgaggatgctggggacagaaacaggacagaaagtcatgtgaggtggagaaggtggatgagatctgcccgctagggaagcaaagctgccactccatcaccaaaggcctttgtctcctcagtcctgtgaacccaaaagtatctgaaacaggtatcagccaatttagaaagtttattttgccaaagttaaggatgcacccatgacacagcctcaggaggtccggacaacatgggcccaaggtggtcagggcacagcttggttttatacattttagggagacgtgagacatttatcaatgaatgtaagatgtacattggttccgtccagaaaggtggggacaactcgaagcagggagggggcttccaggtcacaagtaggtgagagacaactggttgcattcttttgggtctctgattagcctttcattgaatatacaattcacatgggagaggagggtagaggaatagtcacttatgcctggtctggcttggtgaaaagacagggcagaggaagcaatcagatatgcatttgtctcacatgagcctcagagggatgactttgagctctgtcctttgtccacgaggaatttccttgtgggcaaattgtgagggaggtatgtagctttatctttgtgctatcttgtttaggaatagaatgggggatttgcctgtcgcagttcccagcttgacttttccctttggcttagtgatttgggggtctggagatttttctttcgtagtcctgtgtgggaggtttgtgcccaggaactcactgaggaagcagctctggacgctagaggcctccatgacagggccagctcgcagcggggacctctgggagggggacagtggccttccctctggagtcctggcctctgacagaagggaaggctcactgaagccaagaaccaccagctccctcctgctcaggtcctgttttcttttgaagggaaagaaacctagtctggagcagcagtgggaggaagtgggaggtggaactgctgaaatctgcttctctgaatatttttggagatgcaaatgcttccttgcagtgcaagggaaagtgtctcgtttctgcagtttcctggcattgtgaccatcaggaggtggcctccaaccgcccaggtatctcctgcagcacagaaagttaggggtgaccatcaggtctccaccatcagcttcaaaatagaaaagccaaactagcactccacaccctctgtgggcgcgccttctgagaacacaaataccacgtttttgaggccgcctcacaaagctctctgaaaagtggtcaaggcagaggaaagccaagcaacgggattctattcttcctggattgcccatgacagtgtgtgggtgaacacctgaagctttttccctaagccgttgctttgcttgcaaagctgctgtgaatcttagagacaaaagaaaagtagaggaaaatgagaattttatagatcgagcattaagcttgtattcgtgattatttgaaacttttggtaattttgcagaatcaggaaactagcaaagttctttttgagagggcttcttgtggcaattgctattctctgtgagccaacctgttacgaaaaataaaggtaacttttgagaaattaatatgaagttataattcagtggtatatggaatacatccagaatctatcccatgttaagtagcatgttctgcattttcagaacggctatttagaaagagcacctcttgagaggctgccactgattagctctgtgaccttggatgagtgagatcacctcttggggtctcctgtccttgttagttaagagtgacccgaaaggccctgacattgcttcgggcactccaattctagatcctctagctctggggaatgtggctggctcttacttcccctgctcccgtgctggcttttccttcttgctaccaatgccggggcgagggtccccacaatgtgttccacaggtcagtattgggcctgaaaatgcacaatccttccacttaggggacacacatctacctgtttcagtgatgattgtccttcctcttgttttggcctagttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtacttccttctaattcacccctcccccagttatttcattatcctctcgtgcatatgtctggacctaattattacatgcgcatccttttaattgtcatgatctgtttcatcccttctattagagtaattttatacttttcccttcaatatgctattttctgggtggaaacttcagggaggcttttagcttgctaggtatcaaaatttcgttatattttcatgttaagtgtgtagtgaaagaagcttttcttaatatgaaactactttataatgcagttcaatcaaaaaagacttctggatctccgctacaaaaagattgtattttttctttattttcagttttataacatccaactttccattcaaaataatattgcacacattgtataattcaattaatttgcacatccaactcctcaaatctggtctttttaaaatgaccaactgcttaaacttcatctgtattgaaaaatacaacattagatccagccatattttaaagtcatcagaacatactctataaatcattatcagctgttagaaaccagttcaaacattttctaatgagtgagatccttacaatggggatctaaggttggttcattgtgacaaaccccagaagagaccactggctcctcctgtcagttaatttgggacttgacttcgctgctgagtaagagagggcagctgagtaagagggcagcatcctgagggaggagtctaattactgcttccagccaccatggtaggaaatcttttcttggcagaaacaaccgggggtgggggggaatagctttcatcagaattgaagaggaaataactgtccttccagagcttttctgaagagagatgactatttcatttttgctgtttttctcatgtggcttagtctcaacatcttaccttacaacataatactaaatttgcttgaaactacctatcagactaacctcttctcacaaagaccaaggctgaacaacactgttctttatgatagagctaaaaacggagcctaaagttggctgttaaagttatttgtaaatgaatatctaaatgtatatcattctcctattccttaaaagtaagtgttttgccacaaatttttggtaatcagcaatcatctttttaaatcctctatatttgcctatttattgttatagttactggtttcactgataatttggggtaatttcccatgcttctgaagtataaagatgtactcttggcccgtgtcaaggatgaaaggaataaggattttttttcttctaatactcctttccttaacctcctaggagtgtttaatatttaagcacaaacttatgcattaaaggggaaaaaaagcagcagcccactggacaactgtcattgcagaggagcctcagggtttaagtgagagagaaatcatagactctgcttgtcccaccctctggggtaaaggacagtagtgttttttctttttaaaaaatttccggccacgcacgatggctcatgcctgtaatcccagcactttgggaggctgaggcgggtggatcacgaggtcgggagttcaaagaccagcctggctaagatggtgaaaccccgtctctactaaaaatacaaaacttagctgggcatggcggcaggcacctgtaatcccagctagttgggaggctgaggcagagaactgcttgaacccgggaggtggaggctgcagtgagccaatattgcagcactccactccagcctgggcgacagagcaagactgtctcaaaaaaaaaaaaaaacaaaccaatttgattttcagtccaaaaatattttctaatacgtttataagacataataaaaatgaatataaaaacaaagacaaagtacaaatccagagttttttattggattcccacaaacataaattactccgtcaaattgccatgaaagtttgagtgtatacttgcaattttggaacttaactcctggcagaccagtaacagagcttggacagcaaggccacagaccacagcattcatgaggaaatgtattttgacctcaatgtgataaaatgctttatgagggggttgtcctgcagtaactatagggaaagcctggctttgaaaattaatgtttacaaatatgaacttccaaatgtgaaccctcactgaataaagcacaatttgtaggggaaaaaaatatcaggctgtttaaatctcttatggactagttggctttgcttttggcctattgttcaaatggggctatttattccaaaatgcttgttctgcagacagcagatccatcaattcttaatgaagaacatagcctacaattacactgtaactggcatccgaagtggtggggtctgttaagaacatgaggcgctatagtttgtactaacatcctattggggttcattttacaggtatcattccttggaatgctttccccggaaaaatatgtggctctgccctggagaacatctgcaacacaaacgaggtaaactcatcacagttcagaataacccttgagtattaggctgagaaaaaagggttctcccagctgtagaaagagcgagagagatggttaaaatgccattaaggaaagctccttgtttagaatctttaagatagagctatatgtaaccatcactattcagccatttttgacctacaaaaatggtcacttcatatggtccaacacatttggtgagaatccttaagaagtggagggcttttcctttgggcaataatttagaggtgatcccaaacctagaaatctaataatatatctagattcttctctcacctcttctacttctactctttctactttgaaagattttcaaagtagaacacctgtcacagaacggatgtaagttaattttcatagaggagtccctctatttcatagaggaatttgtgtatatacccaacttttaataaatgaggccacagttaatcatttatatttctggaatgacttgctacttctctaattctcattcgtccttactagggagtgtgtcctaacaatttggtttaaattgtctcagccctagaacattcttcagtcattggcttgtaactgtttataaaggaaaattcttaaatgcattcgtaggtgcttgtatatttaagaaaatcctggcaagcttttaagaagcagtgagttacagaaataatcagctcctaccctatctgacttgtcaatttgtatatccataatatgcagtggcttgaagcagggctccccaccgtggctgcatgttacagccatcaaggcagcactatgttatactgatggctgaggcccagcccttaggtattcagatttaatcgatttggggggcagtctgggcatcagaaagtttttaaagctcctcgggtgattccaccatgaggccagagcatgaagagaaggcaggcctgtgcccagtcttgcagagaagagctgcaaaggagacagatgaagcagcaccccacaatgagtgtaggccatttcatttaacatcaaatgcttatgttgatgccctgttcttttgtagttctacatgtcctatcacctgttcattgtggcctgtgcaggagctggtgccaccgtcattgccctggtgagtaatggccccaagaccaccctagtctagcctcctccctccagcttctaaatgacagatttcccttccagcttttaccagcctattgaagccaatgattctggcactcaaccttggttaactggcgcctgtgttaacttaccacatgtagtttacagaaagtattagttggttgccttggcactgattgtaggtgatgtaatttggactctggaaagaaaagagggtatcaacacctatcaactaggcctagcatattaccttgttgcactgagcacttagcttcatgacttcagtcgcagacagatgcaatgctcacgtgaggcattacccatttctttgccaagggatattaatttacaagtggagatatgcacatatacatacatttatatagtcactcatacagggtagctgtgttccataaagtcacctcaagcaatgaattagcgaatgctggaccactgctcctaggggaaatacatggctaggtttctgtgagcctctggtcacatcattttcagcaacctatcaacacataagcttgtttcgtgtgtttctgtgtaaatacaccgtatttaatatatattgttgattccttaatattgaattcatggccaatagctctatccctatgcctgaatgaagcttctctaatgaacattttctctggtcaggcagtttgcaaccttcttgcacttagggactctagacagcactgcagcactatgcttgggagccattttaagcagcaaaatcacccacaaaatgcacaaaaatgtgaaaaacgtggcactaaatatacttcgagtatacttatttacagtctgagagctgaaacaagaaggcagagtattgccttgttcagcctcagctgggaatgtgcataccgggcaactcaactttcaccgctctgcacatgtctgctaataactgcgaaagaagtgcctcaagtattaaggattacaaatgaatcttagcaagtaggcagtcacaaatgtggaatctacaagtaatgaaaatcaactgtataaatacacgctcttatgtatgtatgtttgtatacatgtaattttggagggcttggtttgtgatttcaggaaaaccaactaagattggtagagcaagggaaaaatctcagctgcttgtaaattattcattcccagtttttctgaccattaaatccccttagaatctatgaaaaaaaccacctttaaaatcatggggtgacctgttcttttggttgagcaacagggaggaaagataactgcctgctgctgagcaggtggttttggaaagatgagaggattaaggcatttagcttcatccttctcatgctgttgacccagctctctgtcttgttattcttgaaacgcatccaagtccttttagtaaactcactgagggcagaaccaatgacttacattgtacatgtgtgatgagaaaaagtttgtgtgtgctagataggaaaattgtctgttgtgattttaagtgggaaaaaaacaccttagactatgagcaggcacccgtccccacccaagtttagaagtgtcatggcatcggccctcactgcctgtatcttactgtcctgttttgttctcttccaccagctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcatttttgctttttcttaacaatacctttggccatttttttccagttcactatgtttgtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttcttt

SEQ ID NO: 3057 - DNA, 43115 bp, human
cttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggtacccagcgctctgacaatagcctgtttaaagcttttcactggggggtgcttaaaaagggttagctgggttttgtctctcttttaaaatggctctgagacaatccctatggcatggtcttgctttcagggttgatttttttcctgtgggctgatgttaagttaatagagcagcctttcttcaatccattcctgttccaaatctttctaccgacgtgatatttcatagagggatgtctatagtttgtcaccttgggctgatgcattggggaaactgtctttttttattaatataattaatcgtaacttaggtcttgtgtcctgcatgttatattccaggaacgtggaatgtgtagttttctgctaatgctgaggaggaactggaggggcatgcatgttaattctgctttggttccgctaatgctgtagtgatttgggcattctctaattttcttattctaatatgattgctctttcttgtatcaggccctgactacgacatgtaataatcatttacagttggagcttcagagaggggacatcagctctgtcacccagtgctgatggaaaggcagggcgggggatcttctgctaattatgacttggagactggggggaagaaaattgataaaggtcctatttcttaaagagaatcttagaacgtaccacaattttcatatacagaatggttttttggagaataaagtgtttttgcagtaagaaaatggcagaaaggaactaaaattaatctcttttttctaaataatgactgatttcaagtttgatgtcccatagaatcggctcagccactgttaggttaatggatctcactgcattgtaattttccctcactcaaagtcatagactgtcataaatgcccaaaaacatattctgtaaccgcagtggctctaatataaaaagccatcatgctaaggttatttctcacagcccttgcgtccactgatagtcactaaagagtaattcgccagtacggggacaaaacttcgttttatttataaagatacaggctgaaccatatgaaattgctgatagtcaaccattttaaacctacaaaaacggcaattacatgtacttcagcttcacagtatgctggggtaaagactgcttgtttttatataaaatttctttggtacacaataatattttatcctaaacagagcaattttactttttaaattaatttttttaggtatcacacaatacacataacataaaatttaccattttaagtatacgattcagtggcattaagtacatagcaccttaattttaaaatcgtttgtttagttcaatcctcttaccaaatctacacctccccaccaaaaacccagcctgtattttcttgtgtgtctttaaaaaaaaaaaatcttcatcaatgaccaaatagctataagagaagctcttgggaatatttatcaagatgaagaagtgagatcaaagttttttccatgatgactagagactaagttgattgcatgttgtcggggtatgataatgtaatagcattgtcccaaggaagcctatcacgattttatcctaaaatgatgattttacttagtacatacttttaatttttattaatgtggtattcaaccatggcagataaaaccgttttggtctttgcaaaaaaatcccttttttaaatttctctctgaaaggaagcaaaggtcatataaccaatataaaatcattactacacaactgtgtatcttatcacttagtcttatggactgctattattttatgtcaattaaatcttatttaataacagatctacaggttgctagtacatccctgacaacccgtatatgaaaagtcattagttgtgattttagagacaaaattagaagcaaaagataatttgtgaaggaactttaaaaattacctaaatgtataaacactagctgcttgttaaataattcaaaaatatcacactaccagaagctagtgtgacatgtatggtacatgcttgaataagaatacaagccaggggatttgtttttcctgatctacagcaagaggggttgtgattgttgtgtgacccaccataattgttgatctggagggtggcttatctaatctgcatttagatgaacaagttcatatgctggctacacaaaatcaaagcccacacaagacactttgtagtttcccaatttgctcacccatcatcattaaggtacacataggataaaatgatagccacaaatgtttctgcgtgattgtcacatcagtattccttcagatttaactttaagtttattaaaaaattatttttccattgaaattaacatttgaaaacttgacataattatttatagaatgtgttatataattcttgagctggtggatccgttttttatgtttttcttttaagcctttcagcaaaggattttattcattaaatttaatcctgtaaattttgtcactttacgcagagttttttatgcacatatatattttttttcctgtgtttctcctttcccatctgttttcagtggttggtgatggagtgatgcctgtctcttaatttggggcattattgcccaatggctaatacccaatagcatgtgaattaatatctttggataattattgcagtgtctattaagaactaagaatgtaaattaaacttagctttataaattgaccttgcttttctagttgggatctttcctgggagtttcagcgggacaacacaacccagctattgtgattcactaactcctacaaagagagctctttctttaaacttaatcacaatgactttgtttctactttagacaaaattaatccatgtccttaaaaaaggaaagcatttgtgttttttcagtctgatagttttcatcacagcatgctaccagataccaaaattcacaagagtatttagtagatatttagggatttttaaggaaaacaagcagattttcttagatggatgtaagaaatgccaaattattacaaatgatagtttttaaattaaaagcattaaagtgtgaagattgagtaagcagattcactgacatggaataagcagaggaaatgaataagacagaatcaaaagaaatagatcatggaacccaataataaaaagatggagagtcggtttccattgatttcagtggagtattacttgttgtcatttcatttgtgaaaataaatgcatctgaaattgctgagagtggataatcactgagtagaaaaacaattgaatcataacaactttgtatgctctattatgggggaaaaatctatctgttatgaaaattattttcattatatgtaggtaattgaattctactgaaacaattatagtcaggttagttaacttcctatgaatcgttgctgaaataaattacaggcatcaaattaaattcctaaccacacaggaagaaaaatatagtgaatgggaaacaatgtgtaatttaaaataaattacaggatatagtcaaagtaagaaatgaatttaaattattgacttccttaaaaaattaatacatctattttaatctttttgatcaaatagatataatttcttatttttttttttaatttagcaaaatgtatgcacttttggctctcatttttcgtttaggaagaaaagcactcctctagaatatacgacttgtgtgattaaaaacccaaagggacacataacacacgtcacactattcctgatgatctgcgaattattgcattttgaaatttgtgttgacattttctaacttggctatataaatatggtacagaggaagttttagatgcagttattatctgtaagaatttgccaaggtggacatctgaagagttggtgtctggggaataggctgtagagaaaagtggctggccagatggtgcggaacatatgtggtaggtatgatacagcttcctttgattttttttttttttttttagaacatttaaatgtggaaaagatctcaacgagccatttggtacatcttctacttttacattattaattccattaggatttttttaaagacttggccttgctatttcgttagaaaaagaattctgggccatttctggaaatttagatttgccttccctgaaattgagtgtaaaccctgaattaagattattatgattttcaagatcacatttctctgttatttggaagtacagggtcaatttagactaaatgatcttaataaagtgactttgtcttgatgtatctgagaacatgcaaaataaccagtgtccccatgacttaaacttcccctctctgtgactgtgatggattggattggattgttacaaagacactctcgcttttttctcctttggaccaaatgtacatacatgggagatagttggccaggagtagggatggccatggaacggaggaagaaagtgaccacaccgactgtttttaagagaggaaggttacaatcccagtttcacaaatgtgctttgttgttcattcatttattcgtttaatggtgttctctgccgggtgtggtggctcacgcctgtaatcccaccactttgggaggccgaggcgggcggatcaagaggtcaagagatcgagaccatcctggctaacatggtgaaacccagtctctactaaaaatacaaaaacaaaattagccgggcgtggtggtgtgtgcctgtaatcccagctactcaggaggctgaggcaggagaatggcgtgaacccgagaggcggaggttgcagtgagccgagatagtgccgctgcactccagcctgggtgacagagcgagactctgtctcaaaaaaaaaaaaaaaaaaagaaagaaaagaaaagtgttctcctttgaaatgtcattcttcctctgtcccttcagctcacgttacaggagtacaggggtgctaagtcatcgtagggaccattaggggtagtataatcttggttttaataataattttgctgattggtggcagattaaatagcagacaaaatgccatagacgagaattttgatccttagccagctgagtgatatttctcgtcaaagagtgtataagagaaaatgtaataatttcctatttgataagctgattttatcaattgcattaactgctttatgtagccaagccttattatgctgtatttaaaatcaagggtcaacacactttttccgtaaaggtcagatagtaagtattttaggtgctgcagaccactcagtgtctgttgtaactattcaaatctgccactatagcatgaaagcagccctagatagtatgtaaacaaatgggtgcaactgtgttccaataaaaccttataaataaaaacagatggctataatttaccaacctttactatatttatagcattgttatggcattccttaatattttaaataatagctaaaaatgaaagataacaaatatagctttgaaagaccttgctcagtgaatatggtctttcttggaagctcagtgtttgtcacttagttgcttccggtgataatttcctaggtgctaagaagcatgacagtctgaagttcatttgttcagccttctcgctaaattacattaaataagtaaatggggaaaaataaacaaggcattgttttgctttcctttttgcaatttccccttgtttcatgcccacctttggcaatgaccactcacagctgtgtctgtcttcataagccaccactggtcacctcatctctatcttcactctcttagggggaacattttgcagttttccctctgcagggcataaaccattttcccatttcttgccaggtgcccagaatcaagacattttaaaagaccttttgagccaaggcatcctcttggaatcctgtgactgccttttaggtgttgggatcctgtccttgggattaaaatgtatactgtgttttttgaaattttataaataactttatatttaatgcctttatttaaatttggctcaaaaatataaaatagaagtgatttttcttttctttcatatctaaagatttactgttgtaaaaaggcccctccagaagtgtaagtccaggggatttggaacacatccatccagttgccgatcccatcggtgtgtcttctggatctattctttttttttttttttttttttaaatcctgaattaagggtcttaggcatggctgccatgtttttctcagaaaacacgttaacattgagcagtccatggtttttcattgtcattgcctagcagcctatgcttgcttgcctgaacatctggagacttaccccatccatatgaggagatgagcacagagcatggatgaatcttctgcagagataccctgaattgcatggcctggcttgggtaaaagtcagcatggtgggggatctagaggtccatttctggtccacagggtcccagggtgctcccttcctttcaaccaaatatttattcagccagcgtttattgggcacctgtgtgctgagtatgtagagacaaattttttaaaaggataaaaatttccagatcaaaagtgatagaactacttagaatcctcttgcttaggggtctatgtggagggctcatagccccctttaccaagaggaaatcagatcataccatgaagtgccttgaccttctgttttttttctgtcagccccactgggttttcttgcctttggagaatgtagcaacatctatttctgagagagaatctcctgaacagtaaagcaaaaatctaaatctgttttttgggggttttttttctttctttttttgagacagagtctcaccctgtcacccaggctggagtgcagtggcatgatctcagctcactgcaacctccacctcccaggttaaagtgattctcctgcctcagcctccagagtagctgggactataggcgtatgccaccatgcccggctaattttttttttttttttcctgagatggagttttactctttttttttttttttttgcccaggctggaatgcagtggcgcgatctcaactcactgcaacctccatctcctgggttcaagcaattcttctgcctcagcctcctgggtagctgggactacaagtgtgcgccactatgcccagctaatttttgtatttttagtagagacagggtttcaccatgttggccaggctggtatcaaactcctcacctcaggtgatctggctgcctcggcctcccagagtgttggaattacaggcatgagccaccacacctggccaattttttaatttttattttttatatattttttttatttttagtacagacagagtttcaccatgttggccaggctggttttgaactcctgacctcaagtgatccgcccgccttggcctcccaaagtgctgggattacaggtgtgagccaccgcacccagcccacaaaaatctcaatctaaggaagactgaaagttaagaaattttaagaagcctgagataacatcagtagcttaggacctggaccgtttctttaggagacacagaagcacaactcaactgcaaatgcacctcagaaaaactctcattgggttaactgttgcctcagcagaagagtagaaaattgcaatacatgcagaggtcacagtaggatgtatggtggtttccaaagtgtgccctcttgagtgaaattgctaaggttcacattcaggcttctctacctcctggctgaaagatcttgggcaagtgatcattaccttctccttgcccttgggttgttcccttgtaaaaatggaataataatagtacctatttcagagggtggttgtgacaaatgtaataagtaccacatgctgagtgcagtgcatagtacatcataagcactccataaatttttgctgtcatcatcattgaccacaaaaatagtttcattgtgcagttctgatcttatcccagcatcttttctgtacctccctaccctggttttaaatgagttatgtataccttaccttgaagtcaaaaagattttttctaaaacattctagaaaagcaggtttctgcttccaaacttgaaataccttacaagttttcagagattgtggagagtggagttgggattttataaaggctttgtgaggttttacttgcctcacactgtggctttagtaggttcttctcctcagagacctgagctgccagatggtgcattatgacctgatcttctgatggaatcattacccacatcaatggcacaatttttttttaatccttaaatatttgtggtgccccagaggatataaccccttattaggttttatgggattctcggagataaactggccatagcgaccttatgatctctttgagatttcaagattgtaattcaactaacttttatgagaagcctactctgtgccaggcaaattggtaggtatttttctttgcaatcccctaagaagtgggaaatattgtatcatattaccagatagagacctgagtcctcagggagtgccagctgtcaccatgtgtgtaattaagcagtggttcgagcccaagaccagtagccctttctgtatagcacatgggagaaaattggaacaggatttaatccagaacattctagactctgacgttctgagtttaagataaggtgacagacaatactgcagacgtcaatgggaggacaagcatttcatccaagaaacagcagaccattaggttgtttgccaggttttctggactagagctgggtacccttacagagagggagcctgcgttcacctttgctagtgcagctggcaataattatagtgctctgttagtgctctgttggtctgaaaaggaaacagaaagaaaaatattattgtgaggagccaaattttcactataaatagtatcttccccaaatgagcattttaagaagcaggatatggtgtgtgttgggggaaagatgtagaaaataaagatcattttggtgatttacataaacttcaatttagaaacggaggacattctcaatggatcatgctggtactgaagggttgcatttcaatagcatattttttaaactccccatttcctttctatggtaaagaataaataaaaatgctgatatagaatctttgctggagatagagacactgactctttgccacctgaaattggcagtgaacagcagagctgaaatggaaattggcaggtaccactggatgtacccaggctcaaagaaccaccagtaccatcccgtgccaaccctgggggacagggctagccccttgagcagtccaggtaaatacagccttggggtgaattctaatagcaagtcaactgttatctttaatattatttgtaatggctcttgcagcttggtgatattttatgttttgcttggtgcattaatttgttcacacgggcatgggtggaattcgccctataaacattttttaatcatctttctttttctctctccctctccattccaccccatctttctccactttcttctccttcttccctcttccctctttcaccttcaatcacttcgtcttctcaaagggaacaatgtacagtgagatatgcctttggttaaccatgaaatttccaatgcctgaaccaataatgggggaggggggccacccacatcccccatgtggccaagaactgggccagggccttcaaggagccttggccctgagagtactgtgagtgtccccaaatgtcttcccagccctgctgctctgcaccaccctctcacctcagtcattgcctttgagaaagagaaatcaaagctgtgaaagtaggattggataaccatgtacccgattcccatcaggtaggttcagtgggtccggtttccattttccttgctcgtgaggaacattggccattcagaaccgctaggtgctggatctgggtgaggtgtgcgacagctgatttggggacctagaaggggcaaaaggtgaagcagtatgaacatccaacctcccacgttcccaaaaccaacacaagttgtaatgcccagctcagttagctaaaactcagtgattttgccagtgtacaaccatagttcaaactacataaaatgcagacataaagggctggtggtaggtcggataaacacagtaagaggcttaaagtatttctgtgattttgcatcaatccataacatttctcccaaatgcttgctaactttttcaggagtaaatgtagcatggtacagctccagaaagggcaatcccaaggtacaatgtaagttacccattgaattacaaagtcataaaatccatgattaataaaaccttttcctttaaaatctaaattgtgttgtcaggttaattaaaatgaaatctgacgttggatttagttctgtcttgggttatgcattccttcatctgtcctatggctatcaggtgttggttctgtgtgtgcctgtgcagcgctggctaaatagggtgagcatgaggtgacatcagccatccattctcatggatcctataaagaatatggagggttctggaatcttgatttaaaaaaagtcattagacgtgatatatccatacaatagctactattcagcaataaaaaggaatgaaatatttgtgcatgctacaacatggatgaacctcaaaaacatcatgctaagtgaaagaagccagacacaagagaccaaatgttctaccactctgtttatgttaaatttacagaattggtgagataagaagtaggttaatggttgccagaggctgagagaagggaggattggggagcaactacagatgggtacaagggatcatttttgctgtgatgaaaatgttctaaaattagattgtggcgatggtcacacaacgctgtacatttactcaaagtcattgaattgtatacttgaaacaggtgaattttatagaatataaattatatctcagtaaagctgcttttgaaaaaaaaagcagcaaaaaaaaccatgagatgtgcataattcaagggtggggagcggggaaaggggtattttttaacataacaagaagcccccaagttatcagaaacaactgcttgagggaggagtccctcttcatcttaagagtctttaagagtcttcattttaagagtgttgaatgacatcaggccagctggaaacccagaaaaatacttattcttttctgtattttagttcactaaactggtaaagaataaacacaatatcttattgggggggaataaaagaaacctctatcaattgctcttgaagagttttctccacttgttgagcagttccctgtaaaagcattgcaataatatttgtgtgcttttgatcctacggtgaaacaccagaatctgggcattcatagcagcagtggcagctgagaagaaaaatacgaggctccattttctgtttttctgaaactgatttctttcagaattccaaagaatttgggtttccaaaagataacatagtgcatacatcatgtactgcatgataccaccactgagtgtctctgcagatctaactcattaatctttctggagagcccaagactataaacaactccttgtccattcaggtgagattttggcaccaaggaagaggagatcagaacaggttttgctgccagatgagttaggggagaaaaaaaaattacttttcaagttttttggaattccataatgatatgatgaaagattgtggaagtctaatagtatcaggttgctggtgatactactgcaagcgagaattccatgaactaacaggttcttgcctgagggggagaaacaaaatcactgaatttgatttaaagaattatcttcccagatcctgaaacaatctccacctacacatagttttaactttttgtgtgcattgatggaaataattggaaaaaagatgcctccacggggactgttaatgtctggagctgtctgcagagaccttatgtgtgatagtgtaaagcctacagcgcaggccacagagtgaagggacccactctagccatgccatcgcctttccagacacttacagattttgttgggtcctaaatcaatgccgttgccattctatacttagatctccaaccccaaccagatggtatgaggcaaaaaatagggaattctgtatggctcttttttttttctttttttttttattaatttttttgcagagttgtcagcctttttccatgggggaaaaagaggttttgatacaggctgaccaggaaatttttgccaaaggaaaatgcctctcccactcatgcagttactgtagcagagactgcccttctccaggaacttccttattccccattggaaaggtcatggcggttccagggtccttttcatggttttctttttcttgctactacttcccagtagaattccatctttaggggttagatagttattctttccttatctctttttccttttcaatttttagctgcgttggacatgtagtgtccacatcttttctgccttcaggagatgaaatgatgtatgaccacatgggctacccccgccccccgccccccccgccgtccatgatgctgccctaggggcctggcctgaggtggtggtctgagatgcaggcaagcgatgaagcagggagtagttcatgctaagtctccagtcagtggcatattgtgcttaacattggagggagcacttccagactgttgtagattgtgttacacaggctccagaggatagcctaagacaatctagattctctattccaagtgcgggctgtggaccagcagaatcaacacctccaggagctcgttagaaatgcagagtcccaggtcccacccagccccactgaatcagaatctgcattttcataagacttccaggtagttcctatgcacattaaagcttgagaagcagtaattaagagcaaggtccaagagcaagaagggagaagacaggaaggaattgattatgtgaatttaccctcaagagatctagaaatctttatctttggaaaagataaagaattgctcaaggtattcatcctttcttctttccgtttctatttaggaagaggcatgtctaagcaatgccaaggcagtcattaatctgttgagtcctggctggtttgaaaaacagtgaccttgcttctcttacctgcttgtctcatgagggggtttggggaaggggcagtgaaggtgagaaaggtttgtttctttgtggcaaagtgagggccagaggagaaagtagttgatggaagcttgggagaaattctcaaatgtctctcatctccctctttaatataatccaatgacatgcaagatgccgtgactaaatataggctgccatttttagtggactaagaatggttctttatatacagttaaatctgtaattcagaattcagtctcacaaggaaggagtagaataaccacccacttcacatatcaccaatttccgcctctcaaatccaaaatgctctgatgtttcagttaaaatggccacagataattccagaagtcgggacaaagagcacaccctctacatagggactgtcacagaggatgtcgggagaggagggccctctggagtgttggtatttagcaagaagcccaagtgttgtgatttgcaccacagagaatggattcctgagtcgccacggggttgtggggtgggggcgggtagcagactgacggagggcccagcactgctgttaactcatgttgcaccttgtctgcccagatgtaaccacaggctggctcctgggaactgcagactttatcccttggcccccttctaggctgagcctgggacttctctctcactgatctgctttgtagagggacacctgtagctataagtcctgggaaatgctactggatttttgtcattgttctttagtgtcactctttcctaacctaaggttgtaaggccactaagttcgaggtcttctcccaaaccacttgaaatgtattttaagggggaagaaaaacccttaatccttctgcgtgtaccattccacctctggccatagttgggtgtcgaccataactgacagtctggtcgtgccgtgtgggttctgctggtggtatcattctgtccccagaggctggttgcagaagcttttgtagcttatccagcctaagccagtggatgctctcagtctgtctgatgccttccagttactcaagatatttctgattacatagaggtaaatggtgaacacagtggaagcacgttgtagctcaggctcatgccgtaaagtccctgagatttttagagtactttgccttttgttttctgaaatgtatcaattctttcattttcaaagcacctgcagttttcaccaaaaaagtgccatatacagcagttaacgattttatagtttatttactgactgctatggcagtctttatatatatatatataaaataatttatatatagctgtaaacaaatacttatcgatataagtaatttcttgattgtttttgaacgttccattgtttatgcgctatattgttagtctgtgattagcacctaattatgtaacaatggcttactgtgtgtgtgacatatcagctccctttgtcttttggtcttacctttgcttctcaccttagagtaggcagacagagaaagcagagataaaaagcagatcgatgagtattgagtgttgatctcgggctttctgtcagacatgtctgattgtagggacactgacttggattattcaagactgagtacttctcggtctttgagaagtagtgtcatctggtctttgctgcctttgaaatgtcccttatgttatatgttttcatataaatctaactagagtccattaaaattaattttgctttgaaatcttttgccacccttagaggtaactggaattactctgaagtagctggggagtagctgaaatcagccacttaggtcttcccacctcctcaggctgtgtccttttgggtgccgaagttcactcccaaataagccacatataccctcaccccctgagtgcgtccacgtctatgaaaagcttatatgaattggcttttgtactaaacggaatgctctgggtgtcagagtcatttaggtgggacaaatcttcctctgaagatcatcatgcttgtattttctggagacttccatgaacaatgctttcacccccaaggaccagctctaggggtgaaatgtcaggctggtaggagaggtaatgggatcgaaacaagacttcctgtgtcttgagaaaaccttgtttatattcatgtgctgtttcccagtggcaataaatcgagattcctgtgaggatttgacagacgaggctggtgatgccacccactgtttttgtaaagaaaatgttatcggaaccagccaggcccatttgattgtctgtggctgctttcgtactccactagcagagttgagaagctgcaactatacaccctgcaaagccaaaaatatttgccatctggtcctttacagaaaacaattgccaatccttgaattagaatttgcaaagtgtgtcaaaatgcaatactctatctactgatgttaggcaacacctaaaaactttgctcggcactcagtttcctaaaatcttctccatcaaacatccctcatcctctgccctccaggccccagaatccttgttctctgtggggaatagggactccctgctcacaggctgtcaactaaggctcagcccttcttcagagaatttcttggtactttctagaagctcagcccctctggcctctttcaggtccttctctgagttttcccataataaaccaagtcccgttaagtggatactgtgagctactttcatctagtgttctattcagtgcactttagcaagttttatttcctgtgtatagaaaagatatttgtggtttactaaatgtagtgctggggatcatttctttctttttttttttttttaagtatgaggttccaatgccctgaatcggaatcgctaagaatgctggttaaaaattcagatttcatatgggcatggtggcacacatctgtagtcccagctacttgggaggctaaggcaggaggatcacttgagcccagaagttcaagttcagcctgggcaacatagcaagacccgatctcttaaaaagaaaaatcagattcccagtccccacctaccctctctgcgatgggtcccagaaatttggcccattttaagaagctcccccaggcaattctaatgcacagtaaagtttgaccaccactgctatatacatagaaggccataacccctcattataacatctttggtaaagtatcgtttcagttcagcctgtgtatgtatatgttcaacctgtatatgtatttacagttaagatgctcaaagtcaaacctccacatccttagcagacagtactattgaatttgaagtaaattcctcttgaagtaatgtttcgctattgccactatatctttgtgtataagagccaatgcaaaaacattagattgtaaagctgtaggcaaacatcagagctcaggctgtgtgttagttatcaattgttgcataacaaattcctccaaaacatagtggctagaaacaaaaatgtatattatctcggcttccttaggtcaggagtctggactcagcttagctgtctcagaaactctaatgagatttcagtctcatctgaaggcctaactggggaaggatccacttccaagctcattcatgtggctactggcaggacttggttactttgggactgagggcctcagttcctcacaagctgctggcctaaaacctcccttgatttttttccatgtgtgggctctccatagctacttcatggcatagcagatgacttcatcagatagagagagcaagtgagcaggtaagagaatgtgccagccagagagacaatgctaacaggacagaagtcaattttttgaaacctaatcagggaagtgacatctcatcacttttgccatattctagtcctaagaagtaagctactaggtccagcccacattcaggggaaggaattacacaaggccatgaatgtaggtttgtggggatcattgggggtggtgtcttagctgcctgccacagtctgtataaacatttcacagtgcaaatgcatcctccatctccttaatgatcataacctcttcactttctcaaagcctcacctctcagagaatgtatcactgggttaaatgagtacctggcaggtgtttgacggccttcctgaggtactagactctaagctctctgtgagcagaggtcttcatgccttgctccctgctttggcctggctcgggacctaggaccaagaaagcagtcgttcatagtgttgaatgatgatcactttatttttagcactcatgatgtgtgactctatatgaaattgtctaattttagtgtccattgtgtacatggctcatttcctgggccaggctggtcaagaccttgcactctgagagttgcataggagctcagcaggtgtttgttaagtaagttcagattggctactcgttgtcaggagtttgagaccagtctggccaacatggtgaaaccccatctctactaaaaaaaaaataataataataataatacaaaaatcagccgggagtattggtgggtgcctgtagtcccagctacttgggaggctgagacaggagaatcacttgaacccaggaggcagaggttgcagtgagcagagattgtgccactgcactccagcctggacaacagagcaaggctctgtgtcaaaaaaaaaaaaaaaaaaaaaaaaaaaaaaaaaaaaaaaattaggttggctaatcgaggtttctagaatcatctgcatgtaaatagggttaactttgtgggatgattttcttgaataagaagttctcagcctgagcttcacagtagaaccctggaaggaaggggaggtcttttaaaattccgaagccacatccagaccaagtcattcagaatcttgagggtgggacccaggcatcagcgttcttgaaagctcccccaccaggtgatcctctgtgcagccaaggttgagaaccactgtggtagaccagtgtttcccaatccgggggagtttctgcctttcaggagatgccttttaggcatctagtggtgtagaggtcagggatgctgctaaacatcctacagtgcacaggacggcccctccccaacaaaggatggcccatgccaatagtaccaagagttgagaacccctgggctaggtcctacgctttgagtcaggaaattggttctaagtgaagcagtagaagtccatggggtagctttgtcccagatgttaagcttattgcaggcatggatagcttgataagtctggaatattatatacaatctatgtatcggtgtttcctgaagagaaactcactcttttaaaaggcacgcagtgcataaaccaatacatttaaacctacatatatttatttatgcaacataataccatacacgtgtgtttgcatatagcacgtgctataaacaccctatgcatacagagatgtatgcagggcatatgagtgtgttattgtggttagaggaacaggtatgtcttcctcagcgccctttattttccttccccctcactgtagcctcctgccctctgcttgtctagtaaaagccctaaggcctccctgacccttgctgtccttaccctcagtccagaggatgcctctgctgtgccttgctgcctggagggttcccatcacccaggttaatgtggctcttggctttcaccaccaatccttagtttctcaaaggggttcacaacctttttaaattactagtgtgtcttgtagaaattgaacttcacaaacaggtcttctgaaaacgctttcttgtggtgtaattgatatgcatatggtgcatctctttaaagtgtctgacaagccttgacatacgtgtgtgctcatgaaagcagcaccatgagcagcatggcaatgtggctgccactcccaactctttccatccttcctatgctcccactctccccaagcaaccactgatctgctctccttctctgtggattagtttgcattttctagaatggcccttgtgaagatgtgttcacataaattctctcaccctttctcacccgaatagaaaatgttgcatgatgttgattgcttaatagctccacagctttgtccaatttttatccttcctgcttttactgaagatgtcctgcccccatgaataaacctcagaagacccattctgccaccgcctaccactgaagagttgagcttgcacccactccagtccagcccacacaccagtgccagattcatctcttaaaagcacatcctgagtcacgcctcgcctgctcacaaaccttccctctcttccccttgctgcaaagtgaagcacagaggcttgaggctggcttggacatcttccatggaccaggcaatggggggacctaccttcctgacttctccccaccattaccctggtgtccttgatgaactcggctacaccctgaacgctccccacgtctcccacatcacatgggtcctgctgtccttcctttgtgcttttcatggaatccttctgttcttcaaggcctcttcacctcctgccatccataaacctttgccttagcaacccacaccaaccaaagagatctgtccctacctcactcccccatatccctgtgtcagcactctctttattctactttagtgataccttatgtgtctgtgtgtcttaccgcccccctcaccccacccacaaggatcaaagccaggagggcacacttgcagaccccaccacagtggcttgcacatggcaggtattggacagacactcattgaatggaatggaatccaggaaagtagagacactgtcgcccagatggtcaaggaaactgattgctgctaaagctcaaaattgcagatattaaatacttctcaaatgtctggagtagcctccagattgctgtgctcttaaaatctgtgtcatctggacttagagctggcttcccctactctccattgatctccatgattccttgctgtcccactttaccaggctaaaagcctttgggaaaaccaaagccagttcccacaaaaggcaaaggaagagactaacaagtatctggttgttggatttgtttattcccagtcatggaagcgtatcattgcttttattgacttgcttatcttctgctagtaccatattgcaaatgttagaggctcatctattttaagacttccatagtgttttcacaaaaatgaaaatcccttattaaacagattttaggacaagcttctaaaaggacctgccaaaaagtgatttcctttctatcattagaaatagtttccacattcttatcgttatgtagttgaacttttatgtccaggactgcatgaaagacgtgagaactgagaagcaacctatatttgatttcgcactttgttcttggacaggaagcccctgtcaactgacttcacatctttttaatgcactatattagtggttcacagaactttctgggtgttaggtccctttatgtgcttagaaacagttgaccccaaaacgcctttgctcttctgagttgtgcctataaatattttctatattagaagctagaactgagggctgggcatggtggctcatgcctgtaatcccagcactttgggaggccaacgtgggcagatcacctgaggtcgggagttcaaaaccagcctggtcaacatggcgaaaccccatctctactgaaaatacaaaaattagccaggccagccaggcacagtggctcacacctgtaatctcagcactttgggaggccgaggtgggcggatcacctgaggtcaggagttcgagaccagcctgaccaacatggagaaaccccgtctctactaaaaatacaaaattagccagcatggtggtgcgtgcctgtaatgccagctacttgggaggctgaggcaggagaatcgcttgaacctgggaggctgaggttgcagtgagccgagctggcaccattgcactccagcctgggcaacaagagtgaaactccatctcaaaataaaataaaataataaataaataagccaggcatggcagcatgtgccttaattccagctatttgggaggctgaggcaggagaatcacttgaacccgggaggcagaggttgcactgaactgagatcgtgccactgcactccagcctttgagttttttaagatggagcgagactccatcttaaaaaaaaaaaaaaaaaaagaaaagaaattagaactgagaagtttattacttaataataaacttagtcatttaaaataatagcaaatccattatatgtcaacctaagtaatgtttaggaaagataacgattttcaaaaagaaaataatattttagtgtgaggaataggactgttttacatttttgcaaatctctttaatatctggcttaacagtagacagctggactcttacatctgcctctgcattcattcagaggcatcttggggtatcttgctttggttgaagtatatgaagaaaactcaaatttctcacaggtatgtgcttggagaatggaggagtgttttaatggcctttgcagataattatgaaattcttccttgatactacaccaaaattcagcagctagtggtttcttaaagactacttgtaatgtggaatctgaaaccatattgatgatatttttgtactcttttccactaaaattcattgcttgatcttgcactttgattgactcttatattcaagaattattttcccttggctatttggaaaatattggttctctgagttgtgcagatcttccagacgttgacacatttaattaaaccatgtcaaaaaaatttcattggttaatgtcaccaccaatttcatcaagaagtctggtaagtatttggaagctgtcagtctcactatggcaggtacaagttttccaaaattgattggcaacagatactatcagttgttttctttgaagtgacaagctgttcatttttgggaaagtttctgccaaatacttaagtctaaaaaactatatcttgtcaggcattctttcaagaaagggggtgtttgcccccagaaaggtacaagtttggctcataactcagttacataagaatgtttcctgcagcccactgtcacacgctggtttgtggtagaagggctctctgcatcctctcactcatttcattacacaaactgttcgaaaggcacatactcgggggttgagatttaatcaaattaataattttttattgcatcgaggacatttggaagtgaaactggctttttaatttattttcttgcgagcgcgtggtagtgaggaatgtgttcctgctaagtacactatggagccactgcccgattcacgctcaggcatcagcagttttactgtgcaaatgtcaagcagtgaaaaaagtaaataacatcttggtgctattataaaaagttttggcttcacagtcctcctgcaaggatcttgaggtctgccggggctgcacagaccgtctttgagggcccactcctggctcagagtgagactggtgggcaggcaggatagaatctcttgggagctcaatgtcctttccagacctgcctgaacagaatctgcgttttaatgaagtcccgaggagatttatacgcaggttaaagttttcctgtagtcccagctatttgggaggctgaggcaggaggatggcttgagcccaggaggcagaagttgcagagagctgagattgcactgctgcacttgaacctgggtaacagagtgagattgtatctgggaaaaaaaaaaaaaagagagagagagagagaaccactgctctttaacagaggtctgcaaaactttcctttaaagggccacatagtaaatacctgtggcaacaactcaaccctgcctttgtagcttgaaagtagccatagaccatatgtaaatgaatgagcgtggctgtgtgccaatacaactttatttatagacacagaaatttgaattttgtgtacctttcatgtgtcacaaaataggttttttaatatattctaagcggttaaaaaagtaaccacttggaatcatgtcaaaatcattctgagtttgcaggccatgaggagagccagatttagctggtgggccacagtttgctgacctgtgctatataacactgagtgctcattgaagttaccgggggagcttcaaaaaaacaaaccccaaccctctaattcctgagtcccgtccccaataaattctgataaaattggtctggggtgaagccagggcatcaggattttcagatgctccccagattattccaatgtgtaggaaaaatggagaacctctgctctataatgttttccaagaaagttagttttcttttaagcatttctttttaagattttagaatttggcagtgtcaccaaatgtctgagaccagaattatgtattgtaaccttagagcagggtttctcactcttggcactgtgaacccaaagctatctgagataggtctcaatcaatttagaaagttaattttagcaagcttaagaacctgtgacacagcctcgggagatcctaataacatgtgcctaaggtggacggggcacagcttacttttataccttttagggagacatgagacatcaatcaatacctgtgagatgtacattggttcaatctggaaaggcaggacaactcaaagggggtcagagggtggcttgcaggttataggaagatttaaaaattatgtaaagacctggaatccatagaaaggaatgtctgggttatgatgataaggggttgtggagagcaaagttttatcctgtaggtgaagcctccaggtagcaggcttcagagagaatagattgtaaatgtctcttagcagatttaaggtctgttgatgttaatgctggttggcttttcctgaattccagaagggaggagggtataatgaggtatgtttgactctcccttccaatcatggcctgaactagttttttcaggctaactttggaatccccctggcagagaccaggaatctattcagatggttgggggtggggtggggggtgcttagaatttttttttttttttttttttaaacggagtctcgctctgtcgccaggctggagtgcagtggcacaatctcagctcactgccacctccaactccctggttcaagcgattctcctgcctcagcctcccaagtagctgggattacaggcatgcgccaccacacccagctaatttttgtgtttttagtagagacggggtttcaccatgttggctgggatggtgtcgatctcctgacctcgtgatctgcctgccctggtctcccaaagtgctgggattacaggcgtgagccaccccgcccggcccagagttttatttttggtttatagcactattggcattttgggtgtgaccattctttatttggggatgggggctgtcctgtgtattctaggaggtttaggagcatccctggcctctacccactagatgccagtagtgtcccccaccctcagttgtaacaaccaaaactgtctccagacaccgctaaatgtccctgggtggcaaaattgcctggattaggaaccagtggtctaaacgatgtagatgttttttgtgctacttcagagaatctccacattggagctattgacatctggggctgggtaattctttgttataagagcatattctgtacactgtgggtgttgagcagcatccctggtctctactcactagatgccagaagcaccctctcccccagctttggcaacgaaaaatatctccagatattgccaaatgtcccctgaggggcacagtcaccccctgttgagaattgcttggccagctcagaatcagggaagcttctgtccactgacattcactgctgcttctcttaggattttcgccctctccattttcccattgcttgttgcttgaaagttgtaaagcttggttcctgcatcttttctttttaattttgtggctcattaggaatcagtaatatagcaaggaaggccccatgtagagaggtaagggggtggtttttttgtgtggtgtttgttggggggtgtttgggagggtgtgtgtgtgtgtgtatgtatgtgtgacattcattccctggggaagaatctgagcccttgttcctgccagccctacgtctgagccagcattaaatctgcagccaagatcacagacaacttgggcaaatcacttggccattatgaactcacagccatggcaacggccatccacaagcctgaggacaaaaggtgttttattctgttgttctgcacaaaaggttctagggatactggagacaaaatagcctttgagacttaaaggcattgatgtgtattttttttttccctactacatggcttatatttaaactgtcttaggctaatgtacactgtaatttttgtgtgaatcaaaacctaaaattctttttatccagaggccagctaaatgaaggcataagacagcccaacagaggcttttagggtttggtgagaggtattgagaattactagtaaaatgtgctagaaagcctggcattctagcctggccaacatggcaagaccccgtctgtactaaaaatacaaaaaattagctggatgtggtggcatgtgcctgtaatgccagctactagggaggctgaggcataagactcacttgaacccaggaggttgaggctgcagtgagcggagatcacaccactcactccagcctgggcaatagagtgagactctttctcaggaaagaaagaaaaaaaaaaaacctggcattgattattatttttttacatgaatacatcacagtcatcaaaaaaatgctttccttattttttctcgttcacgttacccaatgttgtcattgctggtttgaagcttgggaaaattcagtctgtggatttataggagcatccaagaaaagcactgatcttccttagctatcgtaaacttttaacagcatggtgttctgctggtacttggcaccacccctatatttaaaaacatcagcttgcctatgactactaaggacagcctgaatcccagatctacttcctttttgtgcacaggcactcccagcactttagggggtggttggagtgtgtgtgtttagaaatctgctttctcaggtgactcaattcccgtcttctcagaccctgtctatggcatgacactaaagcatgaaaaattccaaggttaacagtacttgtttggctcacaaaaatgcactctagctgcactcttttcaagatggctggacaacttggaacattttgtttttcttaactgtagtccttggaacttgccatttgattcacaagtgactggagggttatggccaaacccagtgggccacgtcttagagaaaaaacatcacacaccatcgaatatgaaagcaggcacttcaaacagactcaggatgccacacctgagaccgggaagatgccactgttgactagaaatgggcttctcaaattttcatgtgcacacaaatcaccccagaggccttgttaaaatgcagattctgactcagtctggggtcacttccaacattctttatttctcacaagttcctccctgctgaagctgacactgctggtccaatgaacacactttgcaaagcacatggaattgacaaatgacaaatggtccactcatatcttttcttgacctctgatagttttccttgttgcccagtagaagctgccagcatccaagttcagctcttctcagctacagatccatatatcccttcacatcatccagagtgatctttcacaaccccaatctgtttcccatgcttaaaaatgctccctggcagaccaggcatggtggctcacacctgtaattgcagcactttgggaggccgaggcgggaggatcacttgagcccaagagtttgagaacagcctgggtaacataaggagaccctgtcactacaaaaaaattaaaaaataaaaaatgagctgggtgcagtggcatgggcctgtggtcccagctacttgggaggctgaggtgggaggatcgcttgagccagagagttcaacaccgcagtgagcagtgattgtgccactgcactccaacctaggcaacagagcaagaccctgtttcaaaaaacaaaacaaaacaaaaaaaaaacgcagtggcttcccatgattttgttttttttgtctttttgtttttgtttttgtttttgttttgagatggagtcttgctctgtcacccaggctggagtgcagtggtgcaatctcggctcactgcaccctccgccttccgggttcacgccattctcctgcctcagcctcccgagtagctgggactacaggcgcccaccaccacgcccagctaattttttgtatttttagtagagacggggtttcaccgtgttagccaggatggtctcgatctcctgacctcgtgatccgcccgtcttggcctcccaaagtgctgggattacaggcgtgagccacggcgcctggtcaaggcttcccatgattttgaagataaagtccagaattcttaaggtggcctggaaagccctaggtggtctagctcctatattacctatatcctctagctcctaaataaacacatttagctttttcttactaactttttgcagcagttttggttcctctaggatgagtgtgtgatatgtgactaaattgcccagtgttcaaagatatcatgcacactgtgaccagaggtggcttctatactgacatagaagatacagtggagagtgatccatttatagattgttggatatctaccacacatgcaatcttaaccctgaagataactggtcaaccaagctagaataagctctacatccagctgtattatgtcctataaatttttcccatattttatgtcactagcttctagtcatgttggctggcacagtccgtaagagttttatctgtgccagtggagcaaagatggtgatttctgttctataggagccagggttcctacagccacaaataaaatcatctgctgaaaacctaagagcattggcatctgctgagagagcatgattcattgaagtgatcccccaaattcttgagttcctggttttccctgctgttataaaactagatccacagcatgaggtatatacagagtccttgagagatataaattggagggaaactttagctttgatctagtattgaatttgggattgaacagcatcattcttctaaccccacttggctttttgagcctgggagagctgtgatatttctttggaatgctctaaccatttggatgaaagaccgtttgaagtggcaactgtggatttggaaggatgagttctatcgttaaagggcgagtgtgctgcaccataacacctaaccctaactccaaatgatgaaaaagggtgtgggtttagtttaaaaatatatatagatgtatacatctatatatacacacagagaattaatgaacaattttatctggttatatatcagtgtcaccacatcagctgtttaagtattctggatactagatctttctgtagaaggacccatccagtatgaattatttgcccttctgatcttccctgtcccccttctctccactctctttccactggctctgcaggggtctgtatctttgcccccatcatgctggactataataattgtgttacttgtctgcctgcagtattggatttatcttgaagccagaaaggtatcttatttcagttttgtgtacttggcacccagtaggtcttcacaaaatactgaattaatgaaatccaacagaaaacccagttagaacccagctcctgggttatagaaaatcaaatatgtgacaattcaaaatgtatcttccaaagcagtgtgttctgtgatgatgaaatgtcctatatctgtgttgtccaatacggtagccactagtccatgtggcttttgagcatatgaaatgtggtttgtgcaacagaggacctgaaattttcattttatttaattttaaataaacgtaaatagctacatgtcttagtggctaccattttggaccacacagccccaaggcctcacatctttatcctttaagaaccagatacaactttgttagccaggaaagcaggcattcatctttttcttaacatgatcatagaggctgagaatgtggggaggttgtggatgatacaatacccatgtctgttttctctttataatgagatacgtcaaggccaaggattctagtttctcttagtttgggaacctggagagaatttggactttgagttgcattcctctcacctcagtccccagaaagtcatgtgacaaaataagattgagctctaacatctctgctcacaaatcccaagtgtctgaagctctttaagatactgacttgctagtgaacttgaaccatattgtgcactggttccctttttctttttttgagacggagtcttgctctgtcgcccaggctggaagttcagtggcgcaatctcggctcaccgcaacctcttcctcctgggttcaagcgattcccttgcctcagcctcccaagtagctgggactacaggtgcccaccaccacacccggctaattttttgtatttttagtagagacggggttttactgtgttagccaggatggttcccattttatatagtttccccaatccacttcagggaagttggtcttcctaaaaacagctgctcatcttttgaaattaaaggaagcacagctttcttatgaagccctgatattttttattttctaatgaactaaagagaaatctagtaatgagttttcatagtcactttccataggtttaagcgaatgctagtttaaaaggaatgctcactaaaatgaaaacattcatctatggtgttttatgctgggttgtcattccatgacaactatgaagaccatttgggggattttttttttttttttttttttttttttgctggcttaatgtgcttgccctaaagtaatgaagtgcccttgattgctgctaaacaccataatgcgtttaaagttcaatttccccgacaagccatttacttaagggtctggataatataaacagagacaggaggttaggagaggtactgacattatcctgaggccagtgctgcctttactgaaacgtaaatgtctccaaactgaaaacgtcacctggctctgcccctgaggcaggtctttatggacatctcaagtaaaagtttattttaaaaatgaatacaagtctcgtcttttcaagattaagagtgacttacggctgtctctccttcattccacttcatggatgttcattttggttttgtttttttcttctgttcttttttctccttcaagtacttaaatatcacccaccagttctgggttctgactctgaacgtgtgtgtcggggaagggggcaggtggaagccggggaggaggaggactgtgaatgaattgcttgggctgactgggctggggggaagcatttttattaaaaatttgagataatttctgatgtcaacttgaatgaaacttgagtagacccacttgagtggctcttggtgactttgttcttcactgaattatggaccaaaatacctgtgacctttccaaaacaatcaccttgctatttgtttgaacctggcgacggcataattgctgtatcagattctcccagttgccccggaggtccagggcttggggaaagccgttggttgccacagcagcagacgtattgaaaccccagaactgtgaggctggagacgacctgactgttgcttttcttcacagagctgcagcttcactgctgtcctctcttttgactgtgttagtggaatgagtgcttcttgttggcacttgagcggggctccccccaccactcagtcgatcaggaagctctagaactgtaactaccttataactctttgtcaattgactgctctgccattcactacccttccagattctgagcaaattaagttacattcccttttggagcctcagggtcctcaccgcagaatgtgagatcacggtaactaccacactggcccttgggatgtcgaagtattaatattaaccatagagcctgagaggggagatggaaaattgtaagccttctctgtgaatatggggtattcttgaagaccagaggtgttcttgcccgtaacggctatattttctctcctttgggttcaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgtaagtatccggttccctttaaaaatgcatctaaggcctggcgtggtggctcatgcctgtcatcccagcaatttgggaggctgaggcaggcagatcacctgaagtcaggagttcaagaccagcctggccaacatggtgaaacgccacctctactaaaaatacaaaaaaaaatttagctgggcgtggtggtgcgtgcctgtaatcctagctacttgggaggctgaggcaggagaaccagttgaacccaggaggtggatgttgcggtgagctggtgagccgagatggcaacactgcactccagcctgggtgacagagtgatactttgtttaaaaaaaaagtatctgagatgcaaccacctcatgatgtttttcagaaagactacagtgtgctttcctagcagaagatgaatgcttttacttaaagctcactttatgtagttagaaaaaggttcatgagagaaggaaaaagaaagggcctagaatatggtagctgtttaggccccagggtggaatgttacttgggaatggtaaggtgcacacataggacactccacacatggtagctgtggacatggggagctgtgacatggtgataggtgatgctgccgattgtctcaacagaattgtgttgttcccaagtaacagatgcctccagctttctcccaggaagtgaccatccctggaatggtaggagccctgttgaggactgaccccaactctaagcctacaggagcagtattttaacattaactcttccagcagaagagcagatcccagggcatcctccattgcagaagagcagatcccagggcatcctccattgcagaagagaggaaggtccaggggtttagcagcagatctctgcctttctttctggaaacattctcaatggagtcgcagtgactcccacacatagattcttgtagctgtgcaagctcagcagcaatctacttatttccttcacatgtcttcccctttctccatttccttctaccgtttctttttcttcccttgaatcccaaagttccagtgttagtgtgtcttatgattataagaaacttcttcaccagactgaaaaagacatgaatgaatttttatggaatggtcatggagtcatgttggagactcttcagtccttagggaattttattctttcttatctgttcacaaatgacctccaaagaaatgaacacaggttggggagattataaggagggctcaagcaggacaggggactcactgagttccaactatgtgcaaagaagaaatgtttaccaagactgaacctgggaaaggtgtgttgatttaattaggtagtgatctcagtctgtggctctcaaacttctgagaagctttaagaaaatccccatgccttaccccagaccaattaggacataatctctgggggcgggatccaggtaccagtattttccaagctccccaggtgattccagtgggcagccgaaggctgaggacatgtcatttgtctttgttagcttttgtgggacaaactgcattgtgaattaactttctgtatcttaaacctactcgacctactactatttgtgtggtgggagtcacagtgcaaaagacatctccccagattaccccctaaagaagccctgagtgcctacttaggggttttatcagagtgacattaaccactaggcctggttgggaggcattttgaaagggcagaaagaacatgttgtccattgggccagggttcagatgctggctttgccactaactgtgtatcctccgatgaggagcttaactcctcaatgcctgtgttttacttatgtgcaaaatgaggattctaacccttgccgcccaggactcaggtaaggattaaaagattacaactggatgctgccctgagcaaaggaaacatcattcccaccttggaaggaaggcccaggttgctgggacatgggcagggatgccgcccaggatgccccacaagtccatcaaagccatcagtggggcgagtgacgcactcacaggaacatccccctcatgtcctctctccagcgtccagaaacgtagtcactaccaggcagtgaatttaatggttcaggatctcttcttctctttgtaggatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatggtgagttgaacctctgataactgattgtttgatatacaaccagagccatgccttgatgtatttccttgtatttggcaaaagctaccaggtatcgagcgtgaatggagggtccatgacacaaatattggctttaccaatttagagttaggactataaaaaccttcaacatgctattgatagtaaactaaagtctatggctggcagaaataaatcaaatgttttcatcagtgtaaaggtgaaaagggtgctgaagatttttcaaatgccaagttcccactatagaaggaggtaactttcatgtggtctcagtgctcccctttggttgtctttaaatatggatcatagccataaagacatacatgaaccatggaaaatcgtcctgatccttctgtaaatacttaccagtacctgctgtacagagcgcctagctgggctttgctagccactagaggtgcaaagattaaaacacaggctgctttctcaagcagcttatagtctaagacaggggttagcaaactaggggctgtgggccaaatttgacctactacctgtttttgtacagctcaagagccaagaatttttttttttttcttttttttttttttttgagacggagcatcactctgtctccaaggctggggagggcagtgtcgcgatctccactaactgcaacctctgcctcccgggttcaagcgattctcctgcctcagcctcctgtacaagtcaggggaatggttacttttgtaggggaaggaggcagctgttaaataaaatgcctgtggaaagcagagggaaaatagccacaaatagtgggaatcctcctccaaaggaaaaaaaaaccaaaaacatctcctcacagctttaaaatgacagctttccccctcacttctacccatcaagtttcaaaaatagaggtctagtttccaccagggcacagcattaagtcatccactgcctgatgtttaacatatttggatcctttgagcattggtcaggacacagtacatggtggagaggagaggagcttgtttgtacttgagctagtggcacttcacctagagatggggacactgtgagggatccacagcccacctagcatggcccgcttttagctcttatgtcagattttgttggagaaagtcgaaagcccccttagactggagaggagcttgaccatcttgcttgatttcattgccagtcattcatgcgctgtctgcatctctggccactggcacctcatgtgcttccgtttcatccatacgcttaacagatcacaatgctgacctgccttggagggtgtgaggaagatgcaggtgacggggcagggctgaggatgctggggacagaaacaggacagaaagtcatgtgaggtggagaaggtggatgagatctgcccgctagggaagcaaagctgccactccatcaccaaaggcctttgtctcctcagtcctgtgaacccaaaagtatctgaaacaggtatcagccaatttagaaagtttattttgccaaagttaaggatgcacccatgacacagcctcaggaggtccggacaacatgggcccaaggtggtcagggcacagcttggttttatacattttagggagacgtgagacatttatcaatgaatgtaagatgtacattggttccgtccagaaaggtggggacaactcgaagcagggagggggcttccaggtcacaagtaggtgagagacaactggttgcattcttttgggtctctgattagcctttcattgaatatacaattcacatgggagaggagggtagaggaatagtcacttatgcctggtctggcttggtgaaaagacagggcagaggaagcaatcagatatgcatttgtctcacatgagcctcagagggatgactttgagctctgtcctttgtccacgaggaatttccttgtgggcaaattgtgagggaggtatgtagctttatctttgtgctatcttgtttaggaatagaatgggggatttgcctgtcgcagttcccagcttgacttttccctttggcttagtgatttgggggtctggagatttttctttcgtagtcctgtgtgggaggtttgtgcccaggaactcactgaggaagcagctctggacgctagaggcctccatgacagggccagctcgcagcggggacctctgggagggggacagtggccttccctctggagtcctggcctctgacagaagggaaggctcactgaagccaagaaccaccagctccctcctgctcaggtcctgttttcttttgaagggaaagaaacctagtctggagcagcagtgggaggaagtgggaggtggaactgctgaaatctgcttctctgaatatttttggagatgcaaatgcttccttgcagtgcaagggaaagtgtctcgtttctgcagtttcctggcattgtgaccatcaggaggtggcctccaaccgcccaggtatctcctgcagcacagaaagttaggggtgaccatcaggtctccaccatcagcttcaaaatagaaaagccaaactagcactccacaccctctgtgggcgcgccttctgagaacacaaataccacgtttttgaggccgcctcacaaagctctctgaaaagtggtcaaggcagaggaaagccaagcaacgggattctattcttcctggattgcccatgacagtgtgtgggtgaacacctgaagctttttccctaagccgttgctttgcttgcaaagctgctgtgaatcttagagacaaaagaaaagtagaggaaaatgagaattttatagatcgagcattaagcttgtattcgtgattatttgaaacttttggtaattttgcagaatcaggaaactagcaaagttctttttgagagggcttcttgtggcaattgctattctctgtgagccaacctgttacgaaaaataaaggtaacttttgagaaattaatatgaagttataattcagtggtatatggaatacatccagaatctatcccatgttaagtagcatgttctgcattttcagaacggctatttagaaagagcacctcttgagaggctgccactgattagctctgtgaccttggatgagtgagatcacctcttggggtctcctgtccttgttagttaagagtgacccgaaaggccctgacattgcttcgggcactccaattctagatcctctagctctggggaatgtggctggctcttacttcccctgctcccgtgctggcttttccttcttgctaccaatgccggggcgagggtccccacaatgtgttccacaggtcagtattgggcctgaaaatgcacaatccttccacttaggggacacacatctacctgtttcagtgatgattgtccttcctcttgttttggcctagttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtacttccttctaattcacccctcccccagttatttcattatcctctcgtgcatatgtctggacctaattattacatgcgcatccttttaattgtcatgatctgtttcatcccttctattagagtaattttatacttttcccttcaatatgctattttctgggtggaaacttcagggaggcttttagcttgctaggtatcaaaatttcgttatattttcatgttaagtgtgtagtgaaagaagcttttcttaatatgaaactactttataatgcagttcaatcaaaaaagacttctggatctccgctacaaaaagattgtattttttctttattttcagttttataacatccaactttccattcaaaataatattgcacacattgtataattcaattaatttgcacatccaactcctcaaatctggtctttttaaaatgaccaactgcttaaacttcatctgtattgaaaaatacaacattagatccagccatattttaaagtcatcagaacatactctataaatcattatcagctgttagaaaccagttcaaacattttctaatgagtgagatccttacaatggggatctaaggttggttcattgtgacaaaccccagaagagaccactggctcctcctgtcagttaatttgggacttgacttcgctgctgagtaagagagggcagctgagtaagagggcagcatcctgagggaggagtctaattactgcttccagccaccatggtaggaaatcttttcttggcagaaacaaccgggggtgggggggaatagctttcatcagaattgaagaggaaataactgtccttccagagcttttctgaagagagatgactatttcatttttgctgtttttctcatgtggcttagtctcaacatcttaccttacaacataatactaaatttgcttgaaactacctatcagactaacctcttctcacaaagaccaaggctgaacaacactgttctttatgatagagctaaaaacggagcctaaagttggctgttaaagttatttgtaaatgaatatctaaatgtatatcattctcctattccttaaaagtaagtgttttgccacaaatttttggtaatcagcaatcatctttttaaatcctctatatttgcctatttattgttatagttactggtttcactgataatttggggtaatttcccatgcttctgaagtataaagatgtactcttggcccgtgtcaaggatgaaaggaataaggattttttttcttctaatactcctttccttaacctcctaggagtgtttaatatttaagcacaaacttatgcattaaaggggaaaaaaagcagcagcccactggacaactgtcattgcagaggagcctcagggtttaagtgagagagaaatcatagactctgcttgtcccaccctctggggtaaaggacagtagtgttttttctttttaaaaaatttccggccacgcacgatggctcatgcctgtaatcccagcactttgggaggctgaggcgggtggatcacgaggtcgggagttcaaagaccagcctggctaagatggtgaaaccccgtctctactaaaaatacaaaacttagctgggcatggcggcaggcacctgtaatcccagctagttgggaggctgaggcagagaactgcttgaacccgggaggtggaggctgcagtgagccaatattgcagcactccactccagcctgggcgacagagcaagactgtctcaaaaaaaaaaaaaaacaaaccaatttgattttcagtccaaaaatattttctaatacgtttataagacataataaaaatgaatataaaaacaaagacaaagtacaaatccagagttttttattggattcccacaaacataaattactccgtcaaattgccatgaaagtttgagtgtatacttgcaattttggaacttaactcctggcagaccagtaacagagcttggacagcaaggccacagaccacagcattcatgaggaaatgtattttgacctcaatgtgataaaatgctttatgagggggttgtcctgcagtaactatagggaaagcctggctttgaaaattaatgtttacaaatatgaacttccaaatgtgaaccctcactgaataaagcacaatttgtaggggaaaaaaatatcaggctgtttaaatctcttatggactagttggctttgcttttggcctattgttcaaatggggctatttattccaaaatgcttgttctgcagacagcagatccatcaattcttaatgaagaacatagcctacaattacactgtaactggcatccgaagtggtggggtctgttaagaacatgaggcgctatagtttgtactaacatcctattggggttcattttacaggtatcattccttggaatgctttccccggaaaaatatgtggctctgccctggagaacatctgcaacacaaacgaggtaaactcatcacagttcagaataacccttgagtattaggctgagaaaaaagggttctcccagctgtagaaagagcgagagagatggttaaaatgccattaaggaaagctccttgtttagaatctttaagatagagctatatgtaaccatcactattcagccatttttgacctacaaaaatggtcacttcatatggtccaacacatttggtgagaatccttaagaagtggagggcttttcctttgggcaataatttagaggtgatcccaaacctagaaatctaataatatatctagattcttctctcacctcttctacttctactctttctactttgaaagattttcaaagtagaacacctgtcacagaacggatgtaagttaattttcatagaggagtccctctatttcatagaggaatttgtgtatatacccaacttttaataaatgaggccacagttaatcatttatatttctggaatgacttgctacttctctaattctcattcgtccttactagggagtgtgtcctaacaatttggtttaaattgtctcagccctagaacattcttcagtcattggcttgtaactgtttataaaggaaaattcttaaatgcattcgtaggtgcttgtatatttaagaaaatcctggcaagcttttaagaagcagtgagttacagaaataatcagctcctaccctatctgacttgtcaatttgtatatccataatatgcagtggcttgaagcagggctccccaccgtggctgcatgttacagccatcaaggcagcactatgttatactgatggctgaggcccagcccttaggtattcagatttaatcgatttggggggcagtctgggcatcagaaagtttttaaagctcctcgggtgattccaccatgaggccagagcatgaagagaaggcaggcctgtgcccagtcttgcagagaagagctgcaaaggagacagatgaagcagcaccccacaatgagtgtaggccatttcatttaacatcaaatgcttatgttgatgccctgttcttttgtagttctacatgtcctatcacctgttcattgtggcctgtgcaggagctggtgccaccgtcattgccctggtgagtaatggccccaagaccaccctagtctagcctcctccctccagcttctaaatgacagatttcccttccagcttttaccagcctattgaagccaatgattctggcactcaaccttggttaactggcgcctgtgttaacttaccacatgtagtttacagaaagtattagttggttgccttggcactgattgtaggtgatgtaatttggactctggaaagaaaagagggtatcaacacctatcaactaggcctagcatattaccttgttgcactgagcacttagcttcatgacttcagtcgcagacagatgcaatgctcacgtgaggcattacccatttctttgccaagggatattaatttacaagtggagatatgcacatatacatacatttatatagtcactcatacagggtagctgtgttccataaagtcacctcaagcaatgaattagcgaatgctggaccactgctcctaggggaaatacatggctaggtttctgtgagcctctggtcacatcattttcagcaacctatcaacacataagcttgtttcgtgtgtttctgtgtaaatacaccgtatttaatatatattgttgattccttaatattgaattcatggccaatagctctatccctatgcctgaatgaagcttctctaatgaacattttctctggtcaggcagtttgcaaccttcttgcacttagggactctagacagcactgcagcactatgcttgggagccattttaagcagcaaaatcacccacaaaatgcacaaaaatgtgaaaaacgtggcactaaatatacttcgagtatacttatttacagtctgagagctgaaacaagaaggcagagtattgccttgttcagcctcagctgggaatgtgcataccgggcaactcaactttcaccgctctgcacatgtctgctaataactgcgaaagaagtgcctcaagtattaaggattacaaatgaatcttagcaagtaggcagtcacaaatgtggaatctacaagtaatgaaaatcaactgtataaatacacgctcttatgtatgtatgtttgtatacatgtaattttggagggcttggtttgtgatttcaggaaaaccaactaagattggtagagcaagggaaaaatctcagctgcttgtaaattattcattcccagtttttctgaccattaaatccccttagaatctatgaaaaaaaccacctttaaaatcatggggtgacctgttcttttggttgagcaacagggaggaaagataactgcctgctgctgagcaggtggttttggaaagatgagaggattaaggcatttagcttcatccttctcatgctgttgacccagctctctgtcttgttattcttgaaacgcatccaagtccttttagtaaactcactgagggcagaaccaatgacttacattgtacatgtgtgatgagaaaaagtttgtgtgtgctagataggaaaattgtctgttgtgattttaagtgggaaaaaaacaccttagactatgagcaggcacccgtccccacccaagtttagaagtgtcatggcatcggccctcactgcctgtatcttactgtcctgttttgttctcttccaccagctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaa

SEQ ID NO: 3058 - DNA, 46311 bp, human
agaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggtacccagcgctctgacaatagcctgtttaaagcttttcactggggggtgcttaaaaagggttagctgggttttgtctctcttttaaaatggctctgagacaatccctatggcatggtcttgctttcagggttgatttttttcctgtgggctgatgttaagttaatagagcagcctttcttcaatccattcctgttccaaatctttctaccgacgtgatatttcatagagggatgtctatagtttgtcaccttgggctgatgcattggggaaactgtctttttttattaatataattaatcgtaacttaggtcttgtgtcctgcatgttatattccaggaacgtggaatgtgtagttttctgctaatgctgaggaggaactggaggggcatgcatgttaattctgctttggttccgctaatgctgtagtgatttgggcattctctaattttcttattctaatatgattgctctttcttgtatcaggccctgactacgacatgtaataatcatttacagttggagcttcagagaggggacatcagctctgtcacccagtgctgatggaaaggcagggcgggggatcttctgctaattatgacttggagactggggggaagaaaattgataaaggtcctatttcttaaagagaatcttagaacgtaccacaattttcatatacagaatggttttttggagaataaagtgtttttgcagtaagaaaatggcagaaaggaactaaaattaatctcttttttctaaataatgactgatttcaagtttgatgtcccatagaatcggctcagccactgttaggttaatggatctcactgcattgtaattttccctcactcaaagtcatagactgtcataaatgcccaaaaacatattctgtaaccgcagtggctctaatataaaaagccatcatgctaaggttatttctcacagcccttgcgtccactgatagtcactaaagagtaattcgccagtacggggacaaaacttcgttttatttataaagatacaggctgaaccatatgaaattgctgatagtcaaccattttaaacctacaaaaacggcaattacatgtacttcagcttcacagtatgctggggtaaagactgcttgtttttatataaaatttctttggtacacaataatattttatcctaaacagagcaattttactttttaaattaatttttttaggtatcacacaatacacataacataaaatttaccattttaagtatacgattcagtggcattaagtacatagcaccttaattttaaaatcgtttgtttagttcaatcctcttaccaaatctacacctccccaccaaaaacccagcctgtattttcttgtgtgtctttaaaaaaaaaaaatcttcatcaatgaccaaatagctataagagaagctcttgggaatatttatcaagatgaagaagtgagatcaaagttttttccatgatgactagagactaagttgattgcatgttgtcggggtatgataatgtaatagcattgtcccaaggaagcctatcacgattttatcctaaaatgatgattttacttagtacatacttttaatttttattaatgtggtattcaaccatggcagataaaaccgttttggtctttgcaaaaaaatcccttttttaaatttctctctgaaaggaagcaaaggtcatataaccaatataaaatcattactacacaactgtgtatcttatcacttagtcttatggactgctattattttatgtcaattaaatcttatttaataacagatctacaggttgctagtacatccctgacaacccgtatatgaaaagtcattagttgtgattttagagacaaaattagaagcaaaagataatttgtgaaggaactttaaaaattacctaaatgtataaacactagctgcttgttaaataattcaaaaatatcacactaccagaagctagtgtgacatgtatggtacatgcttgaataagaatacaagccaggggatttgtttttcctgatctacagcaagaggggttgtgattgttgtgtgacccaccataattgttgatctggagggtggcttatctaatctgcatttagatgaacaagttcatatgctggctacacaaaatcaaagcccacacaagacactttgtagtttcccaatttgctcacccatcatcattaaggtacacataggataaaatgatagccacaaatgtttctgcgtgattgtcacatcagtattccttcagatttaactttaagtttattaaaaaattatttttccattgaaattaacatttgaaaacttgacataattatttatagaatgtgttatataattcttgagctggtggatccgttttttatgtttttcttttaagcctttcagcaaaggattttattcattaaatttaatcctgtaaattttgtcactttacgcagagttttttatgcacatatatattttttttcctgtgtttctcctttcccatctgttttcagtggttggtgatggagtgatgcctgtctcttaatttggggcattattgcccaatggctaatacccaatagcatgtgaattaatatctttggataattattgcagtgtctattaagaactaagaatgtaaattaaacttagctttataaattgaccttgcttttctagttgggatctttcctgggagtttcagcgggacaacacaacccagctattgtgattcactaactcctacaaagagagctctttctttaaacttaatcacaatgactttgtttctactttagacaaaattaatccatgtccttaaaaaaggaaagcatttgtgttttttcagtctgatagttttcatcacagcatgctaccagataccaaaattcacaagagtatttagtagatatttagggatttttaaggaaaacaagcagattttcttagatggatgtaagaaatgccaaattattacaaatgatagtttttaaattaaaagcattaaagtgtgaagattgagtaagcagattcactgacatggaataagcagaggaaatgaataagacagaatcaaaagaaatagatcatggaacccaataataaaaagatggagagtcggtttccattgatttcagtggagtattacttgttgtcatttcatttgtgaaaataaatgcatctgaaattgctgagagtggataatcactgagtagaaaaacaattgaatcataacaactttgtatgctctattatgggggaaaaatctatctgttatgaaaattattttcattatatgtaggtaattgaattctactgaaacaattatagtcaggttagttaacttcctatgaatcgttgctgaaataaattacaggcatcaaattaaattcctaaccacacaggaagaaaaatatagtgaatgggaaacaatgtgtaatttaaaataaattacaggatatagtcaaagtaagaaatgaatttaaattattgacttccttaaaaaattaatacatctattttaatctttttgatcaaatagatataatttcttatttttttttttaatttagcaaaatgtatgcacttttggctctcatttttcgtttaggaagaaaagcactcctctagaatatacgacttgtgtgattaaaaacccaaagggacacataacacacgtcacactattcctgatgatctgcgaattattgcattttgaaatttgtgttgacattttctaacttggctatataaatatggtacagaggaagttttagatgcagttattatctgtaagaatttgccaaggtggacatctgaagagttggtgtctggggaataggctgtagagaaaagtggctggccagatggtgcggaacatatgtggtaggtatgatacagcttcctttgattttttttttttttttttagaacatttaaatgtggaaaagatctcaacgagccatttggtacatcttctacttttacattattaattccattaggatttttttaaagacttggccttgctatttcgttagaaaaagaattctgggccatttctggaaatttagatttgccttccctgaaattgagtgtaaaccctgaattaagattattatgattttcaagatcacatttctctgttatttggaagtacagggtcaatttagactaaatgatcttaataaagtgactttgtcttgatgtatctgagaacatgcaaaataaccagtgtccccatgacttaaacttcccctctctgtgactgtgatggattggattggattgttacaaagacactctcgcttttttctcctttggaccaaatgtacatacatgggagatagttggccaggagtagggatggccatggaacggaggaagaaagtgaccacaccgactgtttttaagagaggaaggttacaatcccagtttcacaaatgtgctttgttgttcattcatttattcgtttaatggtgttctctgccgggtgtggtggctcacgcctgtaatcccaccactttgggaggccgaggcgggcggatcaagaggtcaagagatcgagaccatcctggctaacatggtgaaacccagtctctactaaaaatacaaaaacaaaattagccgggcgtggtggtgtgtgcctgtaatcccagctactcaggaggctgaggcaggagaatggcgtgaacccgagaggcggaggttgcagtgagccgagatagtgccgctgcactccagcctgggtgacagagcgagactctgtctcaaaaaaaaaaaaaaaaaaagaaagaaaagaaaagtgttctcctttgaaatgtcattcttcctctgtcccttcagctcacgttacaggagtacaggggtgctaagtcatcgtagggaccattaggggtagtataatcttggttttaataataattttgctgattggtggcagattaaatagcagacaaaatgccatagacgagaattttgatccttagccagctgagtgatatttctcgtcaaagagtgtataagagaaaatgtaataatttcctatttgataagctgattttatcaattgcattaactgctttatgtagccaagccttattatgctgtatttaaaatcaagggtcaacacactttttccgtaaaggtcagatagtaagtattttaggtgctgcagaccactcagtgtctgttgtaactattcaaatctgccactatagcatgaaagcagccctagatagtatgtaaacaaatgggtgcaactgtgttccaataaaaccttataaataaaaacagatggctataatttaccaacctttactatatttatagcattgttatggcattccttaatattttaaataatagctaaaaatgaaagataacaaatatagctttgaaagaccttgctcagtgaatatggtctttcttggaagctcagtgtttgtcacttagttgcttccggtgataatttcctaggtgctaagaagcatgacagtctgaagttcatttgttcagccttctcgctaaattacattaaataagtaaatggggaaaaataaacaaggcattgttttgctttcctttttgcaatttccccttgtttcatgcccacctttggcaatgaccactcacagctgtgtctgtcttcataagccaccactggtcacctcatctctatcttcactctcttagggggaacattttgcagttttccctctgcagggcataaaccattttcccatttcttgccaggtgcccagaatcaagacattttaaaagaccttttgagccaaggcatcctcttggaatcctgtgactgccttttaggtgttgggatcctgtccttgggattaaaatgtatactgtgttttttgaaattttataaataactttatatttaatgcctttatttaaatttggctcaaaaatataaaatagaagtgatttttcttttctttcatatctaaagatttactgttgtaaaaaggcccctccagaagtgtaagtccaggggatttggaacacatccatccagttgccgatcccatcggtgtgtcttctggatctattctttttttttttttttttttttaaatcctgaattaagggtcttaggcatggctgccatgtttttctcagaaaacacgttaacattgagcagtccatggtttttcattgtcattgcctagcagcctatgcttgcttgcctgaacatctggagacttaccccatccatatgaggagatgagcacagagcatggatgaatcttctgcagagataccctgaattgcatggcctggcttgggtaaaagtcagcatggtgggggatctagaggtccatttctggtccacagggtcccagggtgctcccttcctttcaaccaaatatttattcagccagcgtttattgggcacctgtgtgctgagtatgtagagacaaattttttaaaaggataaaaatttccagatcaaaagtgatagaactacttagaatcctcttgcttaggggtctatgtggagggctcatagccccctttaccaagaggaaatcagatcataccatgaagtgccttgaccttctgttttttttctgtcagccccactgggttttcttgcctttggagaatgtagcaacatctatttctgagagagaatctcctgaacagtaaagcaaaaatctaaatctgttttttgggggttttttttctttctttttttgagacagagtctcaccctgtcacccaggctggagtgcagtggcatgatctcagctcactgcaacctccacctcccaggttaaagtgattctcctgcctcagcctccagagtagctgggactataggcgtatgccaccatgcccggctaattttttttttttttttcctgagatggagttttactctttttttttttttttttgcccaggctggaatgcagtggcgcgatctcaactcactgcaacctccatctcctgggttcaagcaattcttctgcctcagcctcctgggtagctgggactacaagtgtgcgccactatgcccagctaatttttgtatttttagtagagacagggtttcaccatgttggccaggctggtatcaaactcctcacctcaggtgatctggctgcctcggcctcccagagtgttggaattacaggcatgagccaccacacctggccaattttttaatttttattttttatatattttttttatttttagtacagacagagtttcaccatgttggccaggctggttttgaactcctgacctcaagtgatccgcccgccttggcctcccaaagtgctgggattacaggtgtgagccaccgcacccagcccacaaaaatctcaatctaaggaagactgaaagttaagaaattttaagaagcctgagataacatcagtagcttaggacctggaccgtttctttaggagacacagaagcacaactcaactgcaaatgcacctcagaaaaactctcattgggttaactgttgcctcagcagaagagtagaaaattgcaatacatgcagaggtcacagtaggatgtatggtggtttccaaagtgtgccctcttgagtgaaattgctaaggttcacattcaggcttctctacctcctggctgaaagatcttgggcaagtgatcattaccttctccttgcccttgggttgttcccttgtaaaaatggaataataatagtacctatttcagagggtggttgtgacaaatgtaataagtaccacatgctgagtgcagtgcatagtacatcataagcactccataaatttttgctgtcatcatcattgaccacaaaaatagtttcattgtgcagttctgatcttatcccagcatcttttctgtacctccctaccctggttttaaatgagttatgtataccttaccttgaagtcaaaaagattttttctaaaacattctagaaaagcaggtttctgcttccaaacttgaaataccttacaagttttcagagattgtggagagtggagttgggattttataaaggctttgtgaggttttacttgcctcacactgtggctttagtaggttcttctcctcagagacctgagctgccagatggtgcattatgacctgatcttctgatggaatcattacccacatcaatggcacaatttttttttaatccttaaatatttgtggtgccccagaggatataaccccttattaggttttatgggattctcggagataaactggccatagcgaccttatgatctctttgagatttcaagattgtaattcaactaacttttatgagaagcctactctgtgccaggcaaattggtaggtatttttctttgcaatcccctaagaagtgggaaatattgtatcatattaccagatagagacctgagtcctcagggagtgccagctgtcaccatgtgtgtaattaagcagtggttcgagcccaagaccagtagccctttctgtatagcacatgggagaaaattggaacaggatttaatccagaacattctagactctgacgttctgagtttaagataaggtgacagacaatactgcagacgtcaatgggaggacaagcatttcatccaagaaacagcagaccattaggttgtttgccaggttttctggactagagctgggtacccttacagagagggagcctgcgttcacctttgctagtgcagctggcaataattatagtgctctgttagtgctctgttggtctgaaaaggaaacagaaagaaaaatattattgtgaggagccaaattttcactataaatagtatcttccccaaatgagcattttaagaagcaggatatggtgtgtgttgggggaaagatgtagaaaataaagatcattttggtgatttacataaacttcaatttagaaacggaggacattctcaatggatcatgctggtactgaagggttgcatttcaatagcatattttttaaactccccatttcctttctatggtaaagaataaataaaaatgctgatatagaatctttgctggagatagagacactgactctttgccacctgaaattggcagtgaacagcagagctgaaatggaaattggcaggtaccactggatgtacccaggctcaaagaaccaccagtaccatcccgtgccaaccctgggggacagggctagccccttgagcagtccaggtaaatacagccttggggtgaattctaatagcaagtcaactgttatctttaatattatttgtaatggctcttgcagcttggtgatattttatgttttgcttggtgcattaatttgttcacacgggcatgggtggaattcgccctataaacattttttaatcatctttctttttctctctccctctccattccaccccatctttctccactttcttctccttcttccctcttccctctttcaccttcaatcacttcgtcttctcaaagggaacaatgtacagtgagatatgcctttggttaaccatgaaatttccaatgcctgaaccaataatgggggaggggggccacccacatcccccatgtggccaagaactgggccagggccttcaaggagccttggccctgagagtactgtgagtgtccccaaatgtcttcccagccctgctgctctgcaccaccctctcacctcagtcattgcctttgagaaagagaaatcaaagctgtgaaagtaggattggataaccatgtacccgattcccatcaggtaggttcagtgggtccggtttccattttccttgctcgtgaggaacattggccattcagaaccgctaggtgctggatctgggtgaggtgtgcgacagctgatttggggacctagaaggggcaaaaggtgaagcagtatgaacatccaacctcccacgttcccaaaaccaacacaagttgtaatgcccagctcagttagctaaaactcagtgattttgccagtgtacaaccatagttcaaactacataaaatgcagacataaagggctggtggtaggtcggataaacacagtaagaggcttaaagtatttctgtgattttgcatcaatccataacatttctcccaaatgcttgctaactttttcaggagtaaatgtagcatggtacagctccagaaagggcaatcccaaggtacaatgtaagttacccattgaattacaaagtcataaaatccatgattaataaaaccttttcctttaaaatctaaattgtgttgtcaggttaattaaaatgaaatctgacgttggatttagttctgtcttgggttatgcattccttcatctgtcctatggctatcaggtgttggttctgtgtgtgcctgtgcagcgctggctaaatagggtgagcatgaggtgacatcagccatccattctcatggatcctataaagaatatggagggttctggaatcttgatttaaaaaaagtcattagacgtgatatatccatacaatagctactattcagcaataaaaaggaatgaaatatttgtgcatgctacaacatggatgaacctcaaaaacatcatgctaagtgaaagaagccagacacaagagaccaaatgttctaccactctgtttatgttaaatttacagaattggtgagataagaagtaggttaatggttgccagaggctgagagaagggaggattggggagcaactacagatgggtacaagggatcatttttgctgtgatgaaaatgttctaaaattagattgtggcgatggtcacacaacgctgtacatttactcaaagtcattgaattgtatacttgaaacaggtgaattttatagaatataaattatatctcagtaaagctgcttttgaaaaaaaaagcagcaaaaaaaaccatgagatgtgcataattcaagggtggggagcggggaaaggggtattttttaacataacaagaagcccccaagttatcagaaacaactgcttgagggaggagtccctcttcatcttaagagtctttaagagtcttcattttaagagtgttgaatgacatcaggccagctggaaacccagaaaaatacttattcttttctgtattttagttcactaaactggtaaagaataaacacaatatcttattgggggggaataaaagaaacctctatcaattgctcttgaagagttttctccacttgttgagcagttccctgtaaaagcattgcaataatatttgtgtgcttttgatcctacggtgaaacaccagaatctgggcattcatagcagcagtggcagctgagaagaaaaatacgaggctccattttctgtttttctgaaactgatttctttcagaattccaaagaatttgggtttccaaaagataacatagtgcatacatcatgtactgcatgataccaccactgagtgtctctgcagatctaactcattaatctttctggagagcccaagactataaacaactccttgtccattcaggtgagattttggcaccaaggaagaggagatcagaacaggttttgctgccagatgagttaggggagaaaaaaaaattacttttcaagttttttggaattccataatgatatgatgaaagattgtggaagtctaatagtatcaggttgctggtgatactactgcaagcgagaattccatgaactaacaggttcttgcctgagggggagaaacaaaatcactgaatttgatttaaagaattatcttcccagatcctgaaacaatctccacctacacatagttttaactttttgtgtgcattgatggaaataattggaaaaaagatgcctccacggggactgttaatgtctggagctgtctgcagagaccttatgtgtgatagtgtaaagcctacagcgcaggccacagagtgaagggacccactctagccatgccatcgcctttccagacacttacagattttgttgggtcctaaatcaatgccgttgccattctatacttagatctccaaccccaaccagatggtatgaggcaaaaaatagggaattctgtatggctcttttttttttctttttttttttattaatttttttgcagagttgtcagcctttttccatgggggaaaaagaggttttgatacaggctgaccaggaaatttttgccaaaggaaaatgcctctcccactcatgcagttactgtagcagagactgcccttctccaggaacttccttattccccattggaaaggtcatggcggttccagggtccttttcatggttttctttttcttgctactacttcccagtagaattccatctttaggggttagatagttattctttccttatctctttttccttttcaatttttagctgcgttggacatgtagtgtccacatcttttctgccttcaggagatgaaatgatgtatgaccacatgggctacccccgccccccgccccccccgccgtccatgatgctgccctaggggcctggcctgaggtggtggtctgagatgcaggcaagcgatgaagcagggagtagttcatgctaagtctccagtcagtggcatattgtgcttaacattggagggagcacttccagactgttgtagattgtgttacacaggctccagaggatagcctaagacaatctagattctctattccaagtgcgggctgtggaccagcagaatcaacacctccaggagctcgttagaaatgcagagtcccaggtcccacccagccccactgaatcagaatctgcattttcataagacttccaggtagttcctatgcacattaaagcttgagaagcagtaattaagagcaaggtccaagagcaagaagggagaagacaggaaggaattgattatgtgaatttaccctcaagagatctagaaatctttatctttggaaaagataaagaattgctcaaggtattcatcctttcttctttccgtttctatttaggaagaggcatgtctaagcaatgccaaggcagtcattaatctgttgagtcctggctggtttgaaaaacagtgaccttgcttctcttacctgcttgtctcatgagggggtttggggaaggggcagtgaaggtgagaaaggtttgtttctttgtggcaaagtgagggccagaggagaaagtagttgatggaagcttgggagaaattctcaaatgtctctcatctccctctttaatataatccaatgacatgcaagatgccgtgactaaatataggctgccatttttagtggactaagaatggttctttatatacagttaaatctgtaattcagaattcagtctcacaaggaaggagtagaataaccacccacttcacatatcaccaatttccgcctctcaaatccaaaatgctctgatgtttcagttaaaatggccacagataattccagaagtcgggacaaagagcacaccctctacatagggactgtcacagaggatgtcgggagaggagggccctctggagtgttggtatttagcaagaagcccaagtgttgtgatttgcaccacagagaatggattcctgagtcgccacggggttgtggggtgggggcgggtagcagactgacggagggcccagcactgctgttaactcatgttgcaccttgtctgcccagatgtaaccacaggctggctcctgggaactgcagactttatcccttggcccccttctaggctgagcctgggacttctctctcactgatctgctttgtagagggacacctgtagctataagtcctgggaaatgctactggatttttgtcattgttctttagtgtcactctttcctaacctaaggttgtaaggccactaagttcgaggtcttctcccaaaccacttgaaatgtattttaagggggaagaaaaacccttaatccttctgcgtgtaccattccacctctggccatagttgggtgtcgaccataactgacagtctggtcgtgccgtgtgggttctgctggtggtatcattctgtccccagaggctggttgcagaagcttttgtagcttatccagcctaagccagtggatgctctcagtctgtctgatgccttccagttactcaagatatttctgattacatagaggtaaatggtgaacacagtggaagcacgttgtagctcaggctcatgccgtaaagtccctgagatttttagagtactttgccttttgttttctgaaatgtatcaattctttcattttcaaagcacctgcagttttcaccaaaaaagtgccatatacagcagttaacgattttatagtttatttactgactgctatggcagtctttatatatatatatataaaataatttatatatagctgtaaacaaatacttatcgatataagtaatttcttgattgtttttgaacgttccattgtttatgcgctatattgttagtctgtgattagcacctaattatgtaacaatggcttactgtgtgtgtgacatatcagctccctttgtcttttggtcttacctttgcttctcaccttagagtaggcagacagagaaagcagagataaaaagcagatcgatgagtattgagtgttgatctcgggctttctgtcagacatgtctgattgtagggacactgacttggattattcaagactgagtacttctcggtctttgagaagtagtgtcatctggtctttgctgcctttgaaatgtcccttatgttatatgttttcatataaatctaactagagtccattaaaattaattttgctttgaaatcttttgccacccttagaggtaactggaattactctgaagtagctggggagtagctgaaatcagccacttaggtcttcccacctcctcaggctgtgtccttttgggtgccgaagttcactcccaaataagccacatataccctcaccccctgagtgcgtccacgtctatgaaaagcttatatgaattggcttttgtactaaacggaatgctctgggtgtcagagtcatttaggtgggacaaatcttcctctgaagatcatcatgcttgtattttctggagacttccatgaacaatgctttcacccccaaggaccagctctaggggtgaaatgtcaggctggtaggagaggtaatgggatcgaaacaagacttcctgtgtcttgagaaaaccttgtttatattcatgtgctgtttcccagtggcaataaatcgagattcctgtgaggatttgacagacgaggctggtgatgccacccactgtttttgtaaagaaaatgttatcggaaccagccaggcccatttgattgtctgtggctgctttcgtactccactagcagagttgagaagctgcaactatacaccctgcaaagccaaaaatatttgccatctggtcctttacagaaaacaattgccaatccttgaattagaatttgcaaagtgtgtcaaaatgcaatactctatctactgatgttaggcaacacctaaaaactttgctcggcactcagtttcctaaaatcttctccatcaaacatccctcatcctctgccctccaggccccagaatccttgttctctgtggggaatagggactccctgctcacaggctgtcaactaaggctcagcccttcttcagagaatttcttggtactttctagaagctcagcccctctggcctctttcaggtccttctctgagttttcccataataaaccaagtcccgttaagtggatactgtgagctactttcatctagtgttctattcagtgcactttagcaagttttatttcctgtgtatagaaaagatatttgtggtttactaaatgtagtgctggggatcatttctttctttttttttttttttaagtatgaggttccaatgccctgaatcggaatcgctaagaatgctggttaaaaattcagatttcatatgggcatggtggcacacatctgtagtcccagctacttgggaggctaaggcaggaggatcacttgagcccagaagttcaagttcagcctgggcaacatagcaagacccgatctcttaaaaagaaaaatcagattcccagtccccacctaccctctctgcgatgggtcccagaaatttggcccattttaagaagctcccccaggcaattctaatgcacagtaaagtttgaccaccactgctatatacatagaaggccataacccctcattataacatctttggtaaagtatcgtttcagttcagcctgtgtatgtatatgttcaacctgtatatgtatttacagttaagatgctcaaagtcaaacctccacatccttagcagacagtactattgaatttgaagtaaattcctcttgaagtaatgtttcgctattgccactatatctttgtgtataagagccaatgcaaaaacattagattgtaaagctgtaggcaaacatcagagctcaggctgtgtgttagttatcaattgttgcataacaaattcctccaaaacatagtggctagaaacaaaaatgtatattatctcggcttccttaggtcaggagtctggactcagcttagctgtctcagaaactctaatgagatttcagtctcatctgaaggcctaactggggaaggatccacttccaagctcattcatgtggctactggcaggacttggttactttgggactgagggcctcagttcctcacaagctgctggcctaaaacctcccttgatttttttccatgtgtgggctctccatagctacttcatggcatagcagatgacttcatcagatagagagagcaagtgagcaggtaagagaatgtgccagccagagagacaatgctaacaggacagaagtcaattttttgaaacctaatcagggaagtgacatctcatcacttttgccatattctagtcctaagaagtaagctactaggtccagcccacattcaggggaaggaattacacaaggccatgaatgtaggtttgtggggatcattgggggtggtgtcttagctgcctgccacagtctgtataaacatttcacagtgcaaatgcatcctccatctccttaatgatcataacctcttcactttctcaaagcctcacctctcagagaatgtatcactgggttaaatgagtacctggcaggtgtttgacggccttcctgaggtactagactctaagctctctgtgagcagaggtcttcatgccttgctccctgctttggcctggctcgggacctaggaccaagaaagcagtcgttcatagtgttgaatgatgatcactttatttttagcactcatgatgtgtgactctatatgaaattgtctaattttagtgtccattgtgtacatggctcatttcctgggccaggctggtcaagaccttgcactctgagagttgcataggagctcagcaggtgtttgttaagtaagttcagattggctactcgttgtcaggagtttgagaccagtctggccaacatggtgaaaccccatctctactaaaaaaaaaataataataataataatacaaaaatcagccgggagtattggtgggtgcctgtagtcccagctacttgggaggctgagacaggagaatcacttgaacccaggaggcagaggttgcagtgagcagagattgtgccactgcactccagcctggacaacagagcaaggctctgtgtcaaaaaaaaaaaaaaaaaaaaaaaaaaaaaaaaaaaaaaaattaggttggctaatcgaggtttctagaatcatctgcatgtaaatagggttaactttgtgggatgattttcttgaataagaagttctcagcctgagcttcacagtagaaccctggaaggaaggggaggtcttttaaaattccgaagccacatccagaccaagtcattcagaatcttgagggtgggacccaggcatcagcgttcttgaaagctcccccaccaggtgatcctctgtgcagccaaggttgagaaccactgtggtagaccagtgtttcccaatccgggggagtttctgcctttcaggagatgccttttaggcatctagtggtgtagaggtcagggatgctgctaaacatcctacagtgcacaggacggcccctccccaacaaaggatggcccatgccaatagtaccaagagttgagaacccctgggctaggtcctacgctttgagtcaggaaattggttctaagtgaagcagtagaagtccatggggtagctttgtcccagatgttaagcttattgcaggcatggatagcttgataagtctggaatattatatacaatctatgtatcggtgtttcctgaagagaaactcactcttttaaaaggcacgcagtgcataaaccaatacatttaaacctacatatatttatttatgcaacataataccatacacgtgtgtttgcatatagcacgtgctataaacaccctatgcatacagagatgtatgcagggcatatgagtgtgttattgtggttagaggaacaggtatgtcttcctcagcgccctttattttccttccccctcactgtagcctcctgccctctgcttgtctagtaaaagccctaaggcctccctgacccttgctgtccttaccctcagtccagaggatgcctctgctgtgccttgctgcctggagggttcccatcacccaggttaatgtggctcttggctttcaccaccaatccttagtttctcaaaggggttcacaacctttttaaattactagtgtgtcttgtagaaattgaacttcacaaacaggtcttctgaaaacgctttcttgtggtgtaattgatatgcatatggtgcatctctttaaagtgtctgacaagccttgacatacgtgtgtgctcatgaaagcagcaccatgagcagcatggcaatgtggctgccactcccaactctttccatccttcctatgctcccactctccccaagcaaccactgatctgctctccttctctgtggattagtttgcattttctagaatggcccttgtgaagatgtgttcacataaattctctcaccctttctcacccgaatagaaaatgttgcatgatgttgattgcttaatagctccacagctttgtccaatttttatccttcctgcttttactgaagatgtcctgcccccatgaataaacctcagaagacccattctgccaccgcctaccactgaagagttgagcttgcacccactccagtccagcccacacaccagtgccagattcatctcttaaaagcacatcctgagtcacgcctcgcctgctcacaaaccttccctctcttccccttgctgcaaagtgaagcacagaggcttgaggctggcttggacatcttccatggaccaggcaatggggggacctaccttcctgacttctccccaccattaccctggtgtccttgatgaactcggctacaccctgaacgctccccacgtctcccacatcacatgggtcctgctgtccttcctttgtgcttttcatggaatccttctgttcttcaaggcctcttcacctcctgccatccataaacctttgccttagcaacccacaccaaccaaagagatctgtccctacctcactcccccatatccctgtgtcagcactctctttattctactttagtgataccttatgtgtctgtgtgtcttaccgcccccctcaccccacccacaaggatcaaagccaggagggcacacttgcagaccccaccacagtggcttgcacatggcaggtattggacagacactcattgaatggaatggaatccaggaaagtagagacactgtcgcccagatggtcaaggaaactgattgctgctaaagctcaaaattgcagatattaaatacttctcaaatgtctggagtagcctccagattgctgtgctcttaaaatctgtgtcatctggacttagagctggcttcccctactctccattgatctccatgattccttgctgtcccactttaccaggctaaaagcctttgggaaaaccaaagccagttcccacaaaaggcaaaggaagagactaacaagtatctggttgttggatttgtttattcccagtcatggaagcgtatcattgcttttattgacttgcttatcttctgctagtaccatattgcaaatgttagaggctcatctattttaagacttccatagtgttttcacaaaaatgaaaatcccttattaaacagattttaggacaagcttctaaaaggacctgccaaaaagtgatttcctttctatcattagaaatagtttccacattcttatcgttatgtagttgaacttttatgtccaggactgcatgaaagacgtgagaactgagaagcaacctatatttgatttcgcactttgttcttggacaggaagcccctgtcaactgacttcacatctttttaatgcactatattagtggttcacagaactttctgggtgttaggtccctttatgtgcttagaaacagttgaccccaaaacgcctttgctcttctgagttgtgcctataaatattttctatattagaagctagaactgagggctgggcatggtggctcatgcctgtaatcccagcactttgggaggccaacgtgggcagatcacctgaggtcgggagttcaaaaccagcctggtcaacatggcgaaaccccatctctactgaaaatacaaaaattagccaggccagccaggcacagtggctcacacctgtaatctcagcactttgggaggccgaggtgggcggatcacctgaggtcaggagttcgagaccagcctgaccaacatggagaaaccccgtctctactaaaaatacaaaattagccagcatggtggtgcgtgcctgtaatgccagctacttgggaggctgaggcaggagaatcgcttgaacctgggaggctgaggttgcagtgagccgagctggcaccattgcactccagcctgggcaacaagagtgaaactccatctcaaaataaaataaaataataaataaataagccaggcatggcagcatgtgccttaattccagctatttgggaggctgaggcaggagaatcacttgaacccgggaggcagaggttgcactgaactgagatcgtgccactgcactccagcctttgagttttttaagatggagcgagactccatcttaaaaaaaaaaaaaaaaaaagaaaagaaattagaactgagaagtttattacttaataataaacttagtcatttaaaataatagcaaatccattatatgtcaacctaagtaatgtttaggaaagataacgattttcaaaaagaaaataatattttagtgtgaggaataggactgttttacatttttgcaaatctctttaatatctggcttaacagtagacagctggactcttacatctgcctctgcattcattcagaggcatcttggggtatcttgctttggttgaagtatatgaagaaaactcaaatttctcacaggtatgtgcttggagaatggaggagtgttttaatggcctttgcagataattatgaaattcttccttgatactacaccaaaattcagcagctagtggtttcttaaagactacttgtaatgtggaatctgaaaccatattgatgatatttttgtactcttttccactaaaattcattgcttgatcttgcactttgattgactcttatattcaagaattattttcccttggctatttggaaaatattggttctctgagttgtgcagatcttccagacgttgacacatttaattaaaccatgtcaaaaaaatttcattggttaatgtcaccaccaatttcatcaagaagtctggtaagtatttggaagctgtcagtctcactatggcaggtacaagttttccaaaattgattggcaacagatactatcagttgttttctttgaagtgacaagctgttcatttttgggaaagtttctgccaaatacttaagtctaaaaaactatatcttgtcaggcattctttcaagaaagggggtgtttgcccccagaaaggtacaagtttggctcataactcagttacataagaatgtttcctgcagcccactgtcacacgctggtttgtggtagaagggctctctgcatcctctcactcatttcattacacaaactgttcgaaaggcacatactcgggggttgagatttaatcaaattaataattttttattgcatcgaggacatttggaagtgaaactggctttttaatttattttcttgcgagcgcgtggtagtgaggaatgtgttcctgctaagtacactatggagccactgcccgattcacgctcaggcatcagcagttttactgtgcaaatgtcaagcagtgaaaaaagtaaataacatcttggtgctattataaaaagttttggcttcacagtcctcctgcaaggatcttgaggtctgccggggctgcacagaccgtctttgagggcccactcctggctcagagtgagactggtgggcaggcaggatagaatctcttgggagctcaatgtcctttccagacctgcctgaacagaatctgcgttttaatgaagtcccgaggagatttatacgcaggttaaagttttcctgtagtcccagctatttgggaggctgaggcaggaggatggcttgagcccaggaggcagaagttgcagagagctgagattgcactgctgcacttgaacctgggtaacagagtgagattgtatctgggaaaaaaaaaaaaaagagagagagagagagaaccactgctctttaacagaggtctgcaaaactttcctttaaagggccacatagtaaatacctgtggcaacaactcaaccctgcctttgtagcttgaaagtagccatagaccatatgtaaatgaatgagcgtggctgtgtgccaatacaactttatttatagacacagaaatttgaattttgtgtacctttcatgtgtcacaaaataggttttttaatatattctaagcggttaaaaaagtaaccacttggaatcatgtcaaaatcattctgagtttgcaggccatgaggagagccagatttagctggtgggccacagtttgctgacctgtgctatataacactgagtgctcattgaagttaccgggggagcttcaaaaaaacaaaccccaaccctctaattcctgagtcccgtccccaataaattctgataaaattggtctggggtgaagccagggcatcaggattttcagatgctccccagattattccaatgtgtaggaaaaatggagaacctctgctctataatgttttccaagaaagttagttttcttttaagcatttctttttaagattttagaatttggcagtgtcaccaaatgtctgagaccagaattatgtattgtaaccttagagcagggtttctcactcttggcactgtgaacccaaagctatctgagataggtctcaatcaatttagaaagttaattttagcaagcttaagaacctgtgacacagcctcgggagatcctaataacatgtgcctaaggtggacggggcacagcttacttttataccttttagggagacatgagacatcaatcaatacctgtgagatgtacattggttcaatctggaaaggcaggacaactcaaagggggtcagagggtggcttgcaggttataggaagatttaaaaattatgtaaagacctggaatccatagaaaggaatgtctgggttatgatgataaggggttgtggagagcaaagttttatcctgtaggtgaagcctccaggtagcaggcttcagagagaatagattgtaaatgtctcttagcagatttaaggtctgttgatgttaatgctggttggcttttcctgaattccagaagggaggagggtataatgaggtatgtttgactctcccttccaatcatggcctgaactagttttttcaggctaactttggaatccccctggcagagaccaggaatctattcagatggttgggggtggggtggggggtgcttagaatttttttttttttttttttttaaacggagtctcgctctgtcgccaggctggagtgcagtggcacaatctcagctcactgccacctccaactccctggttcaagcgattctcctgcctcagcctcccaagtagctgggattacaggcatgcgccaccacacccagctaatttttgtgtttttagtagagacggggtttcaccatgttggctgggatggtgtcgatctcctgacctcgtgatctgcctgccctggtctcccaaagtgctgggattacaggcgtgagccaccccgcccggcccagagttttatttttggtttatagcactattggcattttgggtgtgaccattctttatttggggatgggggctgtcctgtgtattctaggaggtttaggagcatccctggcctctacccactagatgccagtagtgtcccccaccctcagttgtaacaaccaaaactgtctccagacaccgctaaatgtccctgggtggcaaaattgcctggattaggaaccagtggtctaaacgatgtagatgttttttgtgctacttcagagaatctccacattggagctattgacatctggggctgggtaattctttgttataagagcatattctgtacactgtgggtgttgagcagcatccctggtctctactcactagatgccagaagcaccctctcccccagctttggcaacgaaaaatatctccagatattgccaaatgtcccctgaggggcacagtcaccccctgttgagaattgcttggccagctcagaatcagggaagcttctgtccactgacattcactgctgcttctcttaggattttcgccctctccattttcccattgcttgttgcttgaaagttgtaaagcttggttcctgcatcttttctttttaattttgtggctcattaggaatcagtaatatagcaaggaaggccccatgtagagaggtaagggggtggtttttttgtgtggtgtttgttggggggtgtttgggagggtgtgtgtgtgtgtgtatgtatgtgtgacattcattccctggggaagaatctgagcccttgttcctgccagccctacgtctgagccagcattaaatctgcagccaagatcacagacaacttgggcaaatcacttggccattatgaactcacagccatggcaacggccatccacaagcctgaggacaaaaggtgttttattctgttgttctgcacaaaaggttctagggatactggagacaaaatagcctttgagacttaaaggcattgatgtgtattttttttttccctactacatggcttatatttaaactgtcttaggctaatgtacactgtaatttttgtgtgaatcaaaacctaaaattctttttatccagaggccagctaaatgaaggcataagacagcccaacagaggcttttagggtttggtgagaggtattgagaattactagtaaaatgtgctagaaagcctggcattctagcctggccaacatggcaagaccccgtctgtactaaaaatacaaaaaattagctggatgtggtggcatgtgcctgtaatgccagctactagggaggctgaggcataagactcacttgaacccaggaggttgaggctgcagtgagcggagatcacaccactcactccagcctgggcaatagagtgagactctttctcaggaaagaaagaaaaaaaaaaaacctggcattgattattatttttttacatgaatacatcacagtcatcaaaaaaatgctttccttattttttctcgttcacgttacccaatgttgtcattgctggtttgaagcttgggaaaattcagtctgtggatttataggagcatccaagaaaagcactgatcttccttagctatcgtaaacttttaacagcatggtgttctgctggtacttggcaccacccctatatttaaaaacatcagcttgcctatgactactaaggacagcctgaatcccagatctacttcctttttgtgcacaggcactcccagcactttagggggtggttggagtgtgtgtgtttagaaatctgctttctcaggtgactcaattcccgtcttctcagaccctgtctatggcatgacactaaagcatgaaaaattccaaggttaacagtacttgtttggctcacaaaaatgcactctagctgcactcttttcaagatggctggacaacttggaacattttgtttttcttaactgtagtccttggaacttgccatttgattcacaagtgactggagggttatggccaaacccagtgggccacgtcttagagaaaaaacatcacacaccatcgaatatgaaagcaggcacttcaaacagactcaggatgccacacctgagaccgggaagatgccactgttgactagaaatgggcttctcaaattttcatgtgcacacaaatcaccccagaggccttgttaaaatgcagattctgactcagtctggggtcacttccaacattctttatttctcacaagttcctccctgctgaagctgacactgctggtccaatgaacacactttgcaaagcacatggaattgacaaatgacaaatggtccactcatatcttttcttgacctctgatagttttccttgttgcccagtagaagctgccagcatccaagttcagctcttctcagctacagatccatatatcccttcacatcatccagagtgatctttcacaaccccaatctgtttcccatgcttaaaaatgctccctggcagaccaggcatggtggctcacacctgtaattgcagcactttgggaggccgaggcgggaggatcacttgagcccaagagtttgagaacagcctgggtaacataaggagaccctgtcactacaaaaaaattaaaaaataaaaaatgagctgggtgcagtggcatgggcctgtggtcccagctacttgggaggctgaggtgggaggatcgcttgagccagagagttcaacaccgcagtgagcagtgattgtgccactgcactccaacctaggcaacagagcaagaccctgtttcaaaaaacaaaacaaaacaaaaaaaaaacgcagtggcttcccatgattttgttttttttgtctttttgtttttgtttttgtttttgttttgagatggagtcttgctctgtcacccaggctggagtgcagtggtgcaatctcggctcactgcaccctccgccttccgggttcacgccattctcctgcctcagcctcccgagtagctgggactacaggcgcccaccaccacgcccagctaattttttgtatttttagtagagacggggtttcaccgtgttagccaggatggtctcgatctcctgacctcgtgatccgcccgtcttggcctcccaaagtgctgggattacaggcgtgagccacggcgcctggtcaaggcttcccatgattttgaagataaagtccagaattcttaaggtggcctggaaagccctaggtggtctagctcctatattacctatatcctctagctcctaaataaacacatttagctttttcttactaactttttgcagcagttttggttcctctaggatgagtgtgtgatatgtgactaaattgcccagtgttcaaagatatcatgcacactgtgaccagaggtggcttctatactgacatagaagatacagtggagagtgatccatttatagattgttggatatctaccacacatgcaatcttaaccctgaagataactggtcaaccaagctagaataagctctacatccagctgtattatgtcctataaatttttcccatattttatgtcactagcttctagtcatgttggctggcacagtccgtaagagttttatctgtgccagtggagcaaagatggtgatttctgttctataggagccagggttcctacagccacaaataaaatcatctgctgaaaacctaagagcattggcatctgctgagagagcatgattcattgaagtgatcccccaaattcttgagttcctggttttccctgctgttataaaactagatccacagcatgaggtatatacagagtccttgagagatataaattggagggaaactttagctttgatctagtattgaatttgggattgaacagcatcattcttctaaccccacttggctttttgagcctgggagagctgtgatatttctttggaatgctctaaccatttggatgaaagaccgtttgaagtggcaactgtggatttggaaggatgagttctatcgttaaagggcgagtgtgctgcaccataacacctaaccctaactccaaatgatgaaaaagggtgtgggtttagtttaaaaatatatatagatgtatacatctatatatacacacagagaattaatgaacaattttatctggttatatatcagtgtcaccacatcagctgtttaagtattctggatactagatctttctgtagaaggacccatccagtatgaattatttgcccttctgatcttccctgtcccccttctctccactctctttccactggctctgcaggggtctgtatctttgcccccatcatgctggactataataattgtgttacttgtctgcctgcagtattggatttatcttgaagccagaaaggtatcttatttcagttttgtgtacttggcacccagtaggtcttcacaaaatactgaattaatgaaatccaacagaaaacccagttagaacccagctcctgggttatagaaaatcaaatatgtgacaattcaaaatgtatcttccaaagcagtgtgttctgtgatgatgaaatgtcctatatctgtgttgtccaatacggtagccactagtccatgtggcttttgagcatatgaaatgtggtttgtgcaacagaggacctgaaattttcattttatttaattttaaataaacgtaaatagctacatgtcttagtggctaccattttggaccacacagccccaaggcctcacatctttatcctttaagaaccagatacaactttgttagccaggaaagcaggcattcatctttttcttaacatgatcatagaggctgagaatgtggggaggttgtggatgatacaatacccatgtctgttttctctttataatgagatacgtcaaggccaaggattctagtttctcttagtttgggaacctggagagaatttggactttgagttgcattcctctcacctcagtccccagaaagtcatgtgacaaaataagattgagctctaacatctctgctcacaaatcccaagtgtctgaagctctttaagatactgacttgctagtgaacttgaaccatattgtgcactggttccctttttctttttttgagacggagtcttgctctgtcgcccaggctggaagttcagtggcgcaatctcggctcaccgcaacctcttcctcctgggttcaagcgattcccttgcctcagcctcccaagtagctgggactacaggtgcccaccaccacacccggctaattttttgtatttttagtagagacggggttttactgtgttagccaggatggttcccattttatatagtttccccaatccacttcagggaagttggtcttcctaaaaacagctgctcatcttttgaaattaaaggaagcacagctttcttatgaagccctgatattttttattttctaatgaactaaagagaaatctagtaatgagttttcatagtcactttccataggtttaagcgaatgctagtttaaaaggaatgctcactaaaatgaaaacattcatctatggtgttttatgctgggttgtcattccatgacaactatgaagaccatttgggggattttttttttttttttttttttttttttgctggcttaatgtgcttgccctaaagtaatgaagtgcccttgattgctgctaaacaccataatgcgtttaaagttcaatttccccgacaagccatttacttaagggtctggataatataaacagagacaggaggttaggagaggtactgacattatcctgaggccagtgctgcctttactgaaacgtaaatgtctccaaactgaaaacgtcacctggctctgcccctgaggcaggtctttatggacatctcaagtaaaagtttattttaaaaatgaatacaagtctcgtcttttcaagattaagagtgacttacggctgtctctccttcattccacttcatggatgttcattttggttttgtttttttcttctgttcttttttctccttcaagtacttaaatatcacccaccagttctgggttctgactctgaacgtgtgtgtcggggaagggggcaggtggaagccggggaggaggaggactgtgaatgaattgcttgggctgactgggctggggggaagcatttttattaaaaatttgagataatttctgatgtcaacttgaatgaaacttgagtagacccacttgagtggctcttggtgactttgttcttcactgaattatggaccaaaatacctgtgacctttccaaaacaatcaccttgctatttgtttgaacctggcgacggcataattgctgtatcagattctcccagttgccccggaggtccagggcttggggaaagccgttggttgccacagcagcagacgtattgaaaccccagaactgtgaggctggagacgacctgactgttgcttttcttcacagagctgcagcttcactgctgtcctctcttttgactgtgttagtggaatgagtgcttcttgttggcacttgagcggggctccccccaccactcagtcgatcaggaagctctagaactgtaactaccttataactctttgtcaattgactgctctgccattcactacccttccagattctgagcaaattaagttacattcccttttggagcctcagggtcctcaccgcagaatgtgagatcacggtaactaccacactggcccttgggatgtcgaagtattaatattaaccatagagcctgagaggggagatggaaaattgtaagccttctctgtgaatatggggtattcttgaagaccagaggtgttcttgcccgtaacggctatattttctctcctttgggttcaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgtaagtatccggttccctttaaaaatgcatctaaggcctggcgtggtggctcatgcctgtcatcccagcaatttgggaggctgaggcaggcagatcacctgaagtcaggagttcaagaccagcctggccaacatggtgaaacgccacctctactaaaaatacaaaaaaaaatttagctgggcgtggtggtgcgtgcctgtaatcctagctacttgggaggctgaggcaggagaaccagttgaacccaggaggtggatgttgcggtgagctggtgagccgagatggcaacactgcactccagcctgggtgacagagtgatactttgtttaaaaaaaaagtatctgagatgcaaccacctcatgatgtttttcagaaagactacagtgtgctttcctagcagaagatgaatgcttttacttaaagctcactttatgtagttagaaaaaggttcatgagagaaggaaaaagaaagggcctagaatatggtagctgtttaggccccagggtggaatgttacttgggaatggtaaggtgcacacataggacactccacacatggtagctgtggacatggggagctgtgacatggtgataggtgatgctgccgattgtctcaacagaattgtgttgttcccaagtaacagatgcctccagctttctcccaggaagtgaccatccctggaatggtaggagccctgttgaggactgaccccaactctaagcctacaggagcagtattttaacattaactcttccagcagaagagcagatcccagggcatcctccattgcagaagagcagatcccagggcatcctccattgcagaagagaggaaggtccaggggtttagcagcagatctctgcctttctttctggaaacattctcaatggagtcgcagtgactcccacacatagattcttgtagctgtgcaagctcagcagcaatctacttatttccttcacatgtcttcccctttctccatttccttctaccgtttctttttcttcccttgaatcccaaagttccagtgttagtgtgtcttatgattataagaaacttcttcaccagactgaaaaagacatgaatgaatttttatggaatggtcatggagtcatgttggagactcttcagtccttagggaattttattctttcttatctgttcacaaatgacctccaaagaaatgaacacaggttggggagattataaggagggctcaagcaggacaggggactcactgagttccaactatgtgcaaagaagaaatgtttaccaagactgaacctgggaaaggtgtgttgatttaattaggtagtgatctcagtctgtggctctcaaacttctgagaagctttaagaaaatccccatgccttaccccagaccaattaggacataatctctgggggcgggatccaggtaccagtattttccaagctccccaggtgattccagtgggcagccgaaggctgaggacatgtcatttgtctttgttagcttttgtgggacaaactgcattgtgaattaactttctgtatcttaaacctactcgacctactactatttgtgtggtgggagtcacagtgcaaaagacatctccccagattaccccctaaagaagccctgagtgcctacttaggggttttatcagagtgacattaaccactaggcctggttgggaggcattttgaaagggcagaaagaacatgttgtccattgggccagggttcagatgctggctttgccactaactgtgtatcctccgatgaggagcttaactcctcaatgcctgtgttttacttatgtgcaaaatgaggattctaacccttgccgcccaggactcaggtaaggattaaaagattacaactggatgctgccctgagcaaaggaaacatcattcccaccttggaaggaaggcccaggttgctgggacatgggcagggatgccgcccaggatgccccacaagtccatcaaagccatcagtggggcgagtgacgcactcacaggaacatccccctcatgtcctctctccagcgtccagaaacgtagtcactaccaggcagtgaatttaatggttcaggatctcttcttctctttgtaggatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatggtgagttgaacctctgataactgattgtttgatatacaaccagagccatgccttgatgtatttccttgtatttggcaaaagctaccaggtatcgagcgtgaatggagggtccatgacacaaatattggctttaccaatttagagttaggactataaaaaccttcaacatgctattgatagtaaactaaagtctatggctggcagaaataaatcaaatgttttcatcagtgtaaaggtgaaaagggtgctgaagatttttcaaatgccaagttcccactatagaaggaggtaactttcatgtggtctcagtgctcccctttggttgtctttaaatatggatcatagccataaagacatacatgaaccatggaaaatcgtcctgatccttctgtaaatacttaccagtacctgctgtacagagcgcctagctgggctttgctagccactagaggtgcaaagattaaaacacaggctgctttctcaagcagcttatagtctaagacaggggttagcaaactaggggctgtgggccaaatttgacctactacctgtttttgtacagctcaagagccaagaatttttttttttttcttttttttttttttttgagacggagcatcactctgtctccaaggctggggagggcagtgtcgcgatctccactaactgcaacctctgcctcccgggttcaagcgattctcctgcctcagcctcctgtacaagtcaggggaatggttacttttgtaggggaaggaggcagctgttaaataaaatgcctgtggaaagcagagggaaaatagccacaaatagtgggaatcctcctccaaaggaaaaaaaaaccaaaaacatctcctcacagctttaaaatgacagctttccccctcacttctacccatcaagtttcaaaaatagaggtctagtttccaccagggcacagcattaagtcatccactgcctgatgtttaacatatttggatcctttgagcattggtcaggacacagtacatggtggagaggagaggagcttgtttgtacttgagctagtggcacttcacctagagatggggacactgtgagggatccacagcccacctagcatggcccgcttttagctcttatgtcagattttgttggagaaagtcgaaagcccccttagactggagaggagcttgaccatcttgcttgatttcattgccagtcattcatgcgctgtctgcatctctggccactggcacctcatgtgcttccgtttcatccatacgcttaacagatcacaatgctgacctgccttggagggtgtgaggaagatgcaggtgacggggcagggctgaggatgctggggacagaaacaggacagaaagtcatgtgaggtggagaaggtggatgagatctgcccgctagggaagcaaagctgccactccatcaccaaaggcctttgtctcctcagtcctgtgaacccaaaagtatctgaaacaggtatcagccaatttagaaagtttattttgccaaagttaaggatgcacccatgacacagcctcaggaggtccggacaacatgggcccaaggtggtcagggcacagcttggttttatacattttagggagacgtgagacatttatcaatgaatgtaagatgtacattggttccgtccagaaaggtggggacaactcgaagcagggagggggcttccaggtcacaagtaggtgagagacaactggttgcattcttttgggtctctgattagcctttcattgaatatacaattcacatgggagaggagggtagaggaatagtcacttatgcctggtctggcttggtgaaaagacagggcagaggaagcaatcagatatgcatttgtctcacatgagcctcagagggatgactttgagctctgtcctttgtccacgaggaatttccttgtgggcaaattgtgagggaggtatgtagctttatctttgtgctatcttgtttaggaatagaatgggggatttgcctgtcgcagttcccagcttgacttttccctttggcttagtgatttgggggtctggagatttttctttcgtagtcctgtgtgggaggtttgtgcccaggaactcactgaggaagcagctctggacgctagaggcctccatgacagggccagctcgcagcggggacctctgggagggggacagtggccttccctctggagtcctggcctctgacagaagggaaggctcactgaagccaagaaccaccagctccctcctgctcaggtcctgttttcttttgaagggaaagaaacctagtctggagcagcagtgggaggaagtgggaggtggaactgctgaaatctgcttctctgaatatttttggagatgcaaatgcttccttgcagtgcaagggaaagtgtctcgtttctgcagtttcctggcattgtgaccatcaggaggtggcctccaaccgcccaggtatctcctgcagcacagaaagttaggggtgaccatcaggtctccaccatcagcttcaaaatagaaaagccaaactagcactccacaccctctgtgggcgcgccttctgagaacacaaataccacgtttttgaggccgcctcacaaagctctctgaaaagtggtcaaggcagaggaaagccaagcaacgggattctattcttcctggattgcccatgacagtgtgtgggtgaacacctgaagctttttccctaagccgttgctttgcttgcaaagctgctgtgaatcttagagacaaaagaaaagtagaggaaaatgagaattttatagatcgagcattaagcttgtattcgtgattatttgaaacttttggtaattttgcagaatcaggaaactagcaaagttctttttgagagggcttcttgtggcaattgctattctctgtgagccaacctgttacgaaaaataaaggtaacttttgagaaattaatatgaagttataattcagtggtatatggaatacatccagaatctatcccatgttaagtagcatgttctgcattttcagaacggctatttagaaagagcacctcttgagaggctgccactgattagctctgtgaccttggatgagtgagatcacctcttggggtctcctgtccttgttagttaagagtgacccgaaaggccctgacattgcttcgggcactccaattctagatcctctagctctggggaatgtggctggctcttacttcccctgctcccgtgctggcttttccttcttgctaccaatgccggggcgagggtccccacaatgtgttccacaggtcagtattgggcctgaaaatgcacaatccttccacttaggggacacacatctacctgtttcagtgatgattgtccttcctcttgttttggcctagttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtacttccttctaattcacccctcccccagttatttcattatcctctcgtgcatatgtctggacctaattattacatgcgcatccttttaattgtcatgatctgtttcatcccttctattagagtaattttatacttttcccttcaatatgctattttctgggtggaaacttcagggaggcttttagcttgctaggtatcaaaatttcgttatattttcatgttaagtgtgtagtgaaagaagcttttcttaatatgaaactactttataatgcagttcaatcaaaaaagacttctggatctccgctacaaaaagattgtattttttctttattttcagttttataacatccaactttccattcaaaataatattgcacacattgtataattcaattaatttgcacatccaactcctcaaatctggtctttttaaaatgaccaactgcttaaacttcatctgtattgaaaaatacaacattagatccagccatattttaaagtcatcagaacatactctataaatcattatcagctgttagaaaccagttcaaacattttctaatgagtgagatccttacaatggggatctaaggttggttcattgtgacaaaccccagaagagaccactggctcctcctgtcagttaatttgggacttgacttcgctgctgagtaagagagggcagctgagtaagagggcagcatcctgagggaggagtctaattactgcttccagccaccatggtaggaaatcttttcttggcagaaacaaccgggggtgggggggaatagctttcatcagaattgaagaggaaataactgtccttccagagcttttctgaagagagatgactatttcatttttgctgtttttctcatgtggcttagtctcaacatcttaccttacaacataatactaaatttgcttgaaactacctatcagactaacctcttctcacaaagaccaaggctgaacaacactgttctttatgatagagctaaaaacggagcctaaagttggctgttaaagttatttgtaaatgaatatctaaatgtatatcattctcctattccttaaaagtaagtgttttgccacaaatttttggtaatcagcaatcatctttttaaatcctctatatttgcctatttattgttatagttactggtttcactgataatttggggtaatttcccatgcttctgaagtataaagatgtactcttggcccgtgtcaaggatgaaaggaataaggattttttttcttctaatactcctttccttaacctcctaggagtgtttaatatttaagcacaaacttatgcattaaaggggaaaaaaagcagcagcccactggacaactgtcattgcagaggagcctcagggtttaagtgagagagaaatcatagactctgcttgtcccaccctctggggtaaaggacagtagtgttttttctttttaaaaaatttccggccacgcacgatggctcatgcctgtaatcccagcactttgggaggctgaggcgggtggatcacgaggtcgggagttcaaagaccagcctggctaagatggtgaaaccccgtctctactaaaaatacaaaacttagctgggcatggcggcaggcacctgtaatcccagctagttgggaggctgaggcagagaactgcttgaacccgggaggtggaggctgcagtgagccaatattgcagcactccactccagcctgggcgacagagcaagactgtctcaaaaaaaaaaaaaaacaaaccaatttgattttcagtccaaaaatattttctaatacgtttataagacataataaaaatgaatataaaaacaaagacaaagtacaaatccagagttttttattggattcccacaaacataaattactccgtcaaattgccatgaaagtttgagtgtatacttgcaattttggaacttaactcctggcagaccagtaacagagcttggacagcaaggccacagaccacagcattcatgaggaaatgtattttgacctcaatgtgataaaatgctttatgagggggttgtcctgcagtaactatagggaaagcctggctttgaaaattaatgtttacaaatatgaacttccaaatgtgaaccctcactgaataaagcacaatttgtaggggaaaaaaatatcaggctgtttaaatctcttatggactagttggctttgcttttggcctattgttcaaatggggctatttattccaaaatgcttgttctgcagacagcagatccatcaattcttaatgaagaacatagcctacaattacactgtaactggcatccgaagtggtggggtctgttaagaacatgaggcgctatagtttgtactaacatcctattggggttcattttacaggtatcattccttggaatgctttccccggaaaaatatgtggctctgccctggagaacatctgcaacacaaacgaggtaaactcatcacagttcagaataacccttgagtattaggctgagaaaaaagggttctcccagctgtagaaagagcgagagagatggttaaaatgccattaaggaaagctccttgtttagaatctttaagatagagctatatgtaaccatcactattcagccatttttgacctacaaaaatggtcacttcatatggtccaacacatttggtgagaatccttaagaagtggagggcttttcctttgggcaataatttagaggtgatcccaaacctagaaatctaataatatatctagattcttctctcacctcttctacttctactctttctactttgaaagattttcaaagtagaacacctgtcacagaacggatgtaagttaattttcatagaggagtccctctatttcatagaggaatttgtgtatatacccaacttttaataaatgaggccacagttaatcatttatatttctggaatgacttgctacttctctaattctcattcgtccttactagggagtgtgtcctaacaatttggtttaaattgtctcagccctagaacattcttcagtcattggcttgtaactgtttataaaggaaaattcttaaatgcattcgtaggtgcttgtatatttaagaaaatcctggcaagcttttaagaagcagtgagttacagaaataatcagctcctaccctatctgacttgtcaatttgtatatccataatatgcagtggcttgaagcagggctccccaccgtggctgcatgttacagccatcaaggcagcactatgttatactgatggctgaggcccagcccttaggtattcagatttaatcgatttggggggcagtctgggcatcagaaagtttttaaagctcctcgggtgattccaccatgaggccagagcatgaagagaaggcaggcctgtgcccagtcttgcagagaagagctgcaaaggagacagatgaagcagcaccccacaatgagtgtaggccatttcatttaacatcaaatgcttatgttgatgccctgttcttttgtagttctacatgtcctatcacctgttcattgtggcctgtgcaggagctggtgccaccgtcattgccctggtgagtaatggccccaagaccaccctagtctagcctcctccctccagcttctaaatgacagatttcccttccagcttttaccagcctattgaagccaatgattctggcactcaaccttggttaactggcgcctgtgttaacttaccacatgtagtttacagaaagtattagttggttgccttggcactgattgtaggtgatgtaatttggactctggaaagaaaagagggtatcaacacctatcaactaggcctagcatattaccttgttgcactgagcacttagcttcatgacttcagtcgcagacagatgcaatgctcacgtgaggcattacccatttctttgccaagggatattaatttacaagtggagatatgcacatatacatacatttatatagtcactcatacagggtagctgtgttccataaagtcacctcaagcaatgaattagcgaatgctggaccactgctcctaggggaaatacatggctaggtttctgtgagcctctggtcacatcattttcagcaacctatcaacacataagcttgtttcgtgtgtttctgtgtaaatacaccgtatttaatatatattgttgattccttaatattgaattcatggccaatagctctatccctatgcctgaatgaagcttctctaatgaacattttctctggtcaggcagtttgcaaccttcttgcacttagggactctagacagcactgcagcactatgcttgggagccattttaagcagcaaaatcacccacaaaatgcacaaaaatgtgaaaaacgtggcactaaatatacttcgagtatacttatttacagtctgagagctgaaacaagaaggcagagtattgccttgttcagcctcagctgggaatgtgcataccgggcaactcaactttcaccgctctgcacatgtctgctaataactgcgaaagaagtgcctcaagtattaaggattacaaatgaatcttagcaagtaggcagtcacaaatgtggaatctacaagtaatgaaaatcaactgtataaatacacgctcttatgtatgtatgtttgtatacatgtaattttggagggcttggtttgtgatttcaggaaaaccaactaagattggtagagcaagggaaaaatctcagctgcttgtaaattattcattcccagtttttctgaccattaaatccccttagaatctatgaaaaaaaccacctttaaaatcatggggtgacctgttcttttggttgagcaacagggaggaaagataactgcctgctgctgagcaggtggttttggaaagatgagaggattaaggcatttagcttcatccttctcatgctgttgacccagctctctgtcttgttattcttgaaacgcatccaagtccttttagtaaactcactgagggcagaaccaatgacttacattgtacatgtgtgatgagaaaaagtttgtgtgtgctagataggaaaattgtctgttgtgattttaagtgggaaaaaaacaccttagactatgagcaggcacccgtccccacccaagtttagaagtgtcatggcatcggccctcactgcctgtatcttactgtcctgttttgttctcttccaccagctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcatttttgctttttcttaacaatacctttggccatttttttccagttcactatgtttgtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcctatttgggatttttttttttttttaaattaagagaagctctcttctgtgtagaacagttgttccaaaatagcttagtgttttgttttcctgttgcatgacagatttaactattctttccagcagtggaggtgctgtcagagtccagtgttctagaagaggcagtgtctaaagcctaattttacttttctaattctggtagctattaccaggaatttttgaaagttttgtttaagtagtctaatattttttatgtaaagagcattaaattttgctatgtataaatttttgtaacctaacagtgaatcaatattttctatcagtgccaagggcttcctgtagttctattcaagtgttacaataaatatttgtagataatagt

SEQ ID NO: 3059 - DNA, 7754 bp, human
gaacatgttgtccattgggccagggttcagatgctggctttgccactaactgtgtatcctccgatgaggagcttaactcctcaatgcctgtgttttacttatgtgcaaaatgaggattctaacccttgccgcccaggactcaggtaaggattaaaagattacaactggatgctgccctgagcaaaggaaacatcattcccaccttggaaggaaggcccaggttgctgggacatgggcagggatgccgcccaggatgccccacaagtccatcaaagccatcagtggggcgagtgacgcactcacaggaacatccccctcatgtcctctctccagcgtccagaaacgtagtcactaccaggcagtgaatttaatggttcaggatctcttcttctctttgtaggatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatggtgagttgaacctctgataactgattgtttgatatacaaccagagccatgccttgatgtatttccttgtatttggcaaaagctaccaggtatcgagcgtgaatggagggtccatgacacaaatattggctttaccaatttagagttaggactataaaaaccttcaacatgctattgatagtaaactaaagtctatggctggcagaaataaatcaaatgttttcatcagtgtaaaggtgaaaagggtgctgaagatttttcaaatgccaagttcccactatagaaggaggtaactttcatgtggtctcagtgctcccctttggttgtctttaaatatggatcatagccataaagacatacatgaaccatggaaaatcgtcctgatccttctgtaaatacttaccagtacctgctgtacagagcgcctagctgggctttgctagccactagaggtgcaaagattaaaacacaggctgctttctcaagcagcttatagtctaagacaggggttagcaaactaggggctgtgggccaaatttgacctactacctgtttttgtacagctcaagagccaagaatttttttttttttcttttttttttttttttgagacggagcatcactctgtctccaaggctggggagggcagtgtcgcgatctccactaactgcaacctctgcctcccgggttcaagcgattctcctgcctcagcctcctgtacaagtcaggggaatggttacttttgtaggggaaggaggcagctgttaaataaaatgcctgtggaaagcagagggaaaatagccacaaatagtgggaatcctcctccaaaggaaaaaaaaaccaaaaacatctcctcacagctttaaaatgacagctttccccctcacttctacccatcaagtttcaaaaatagaggtctagtttccaccagggcacagcattaagtcatccactgcctgatgtttaacatatttggatcctttgagcattggtcaggacacagtacatggtggagaggagaggagcttgtttgtacttgagctagtggcacttcacctagagatggggacactgtgagggatccacagcccacctagcatggcccgcttttagctcttatgtcagattttgttggagaaagtcgaaagcccccttagactggagaggagcttgaccatcttgcttgatttcattgccagtcattcatgcgctgtctgcatctctggccactggcacctcatgtgcttccgtttcatccatacgcttaacagatcacaatgctgacctgccttggagggtgtgaggaagatgcaggtgacggggcagggctgaggatgctggggacagaaacaggacagaaagtcatgtgaggtggagaaggtggatgagatctgcccgctagggaagcaaagctgccactccatcaccaaaggcctttgtctcctcagtcctgtgaacccaaaagtatctgaaacaggtatcagccaatttagaaagtttattttgccaaagttaaggatgcacccatgacacagcctcaggaggtccggacaacatgggcccaaggtggtcagggcacagcttggttttatacattttagggagacgtgagacatttatcaatgaatgtaagatgtacattggttccgtccagaaaggtggggacaactcgaagcagggagggggcttccaggtcacaagtaggtgagagacaactggttgcattcttttgggtctctgattagcctttcattgaatatacaattcacatgggagaggagggtagaggaatagtcacttatgcctggtctggcttggtgaaaagacagggcagaggaagcaatcagatatgcatttgtctcacatgagcctcagagggatgactttgagctctgtcctttgtccacgaggaatttccttgtgggcaaattgtgagggaggtatgtagctttatctttgtgctatcttgtttaggaatagaatgggggatttgcctgtcgcagttcccagcttgacttttccctttggcttagtgatttgggggtctggagatttttctttcgtagtcctgtgtgggaggtttgtgcccaggaactcactgaggaagcagctctggacgctagaggcctccatgacagggccagctcgcagcggggacctctgggagggggacagtggccttccctctggagtcctggcctctgacagaagggaaggctcactgaagccaagaaccaccagctccctcctgctcaggtcctgttttcttttgaagggaaagaaacctagtctggagcagcagtgggaggaagtgggaggtggaactgctgaaatctgcttctctgaatatttttggagatgcaaatgcttccttgcagtgcaagggaaagtgtctcgtttctgcagtttcctggcattgtgaccatcaggaggtggcctccaaccgcccaggtatctcctgcagcacagaaagttaggggtgaccatcaggtctccaccatcagcttcaaaatagaaaagccaaactagcactccacaccctctgtgggcgcgccttctgagaacacaaataccacgtttttgaggccgcctcacaaagctctctgaaaagtggtcaaggcagaggaaagccaagcaacgggattctattcttcctggattgcccatgacagtgtgtgggtgaacacctgaagctttttccctaagccgttgctttgcttgcaaagctgctgtgaatcttagagacaaaagaaaagtagaggaaaatgagaattttatagatcgagcattaagcttgtattcgtgattatttgaaacttttggtaattttgcagaatcaggaaactagcaaagttctttttgagagggcttcttgtggcaattgctattctctgtgagccaacctgttacgaaaaataaaggtaacttttgagaaattaatatgaagttataattcagtggtatatggaatacatccagaatctatcccatgttaagtagcatgttctgcattttcagaacggctatttagaaagagcacctcttgagaggctgccactgattagctctgtgaccttggatgagtgagatcacctcttggggtctcctgtccttgttagttaagagtgacccgaaaggccctgacattgcttcgggcactccaattctagatcctctagctctggggaatgtggctggctcttacttcccctgctcccgtgctggcttttccttcttgctaccaatgccggggcgagggtccccacaatgtgttccacaggtcagtattgggcctgaaaatgcacaatccttccacttaggggacacacatctacctgtttcagtgatgattgtccttcctcttgttttggcctagttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtacttccttctaattcacccctcccccagttatttcattatcctctcgtgcatatgtctggacctaattattacatgcgcatccttttaattgtcatgatctgtttcatcccttctattagagtaattttatacttttcccttcaatatgctattttctgggtggaaacttcagggaggcttttagcttgctaggtatcaaaatttcgttatattttcatgttaagtgtgtagtgaaagaagcttttcttaatatgaaactactttataatgcagttcaatcaaaaaagacttctggatctccgctacaaaaagattgtattttttctttattttcagttttataacatccaactttccattcaaaataatattgcacacattgtataattcaattaatttgcacatccaactcctcaaatctggtctttttaaaatgaccaactgcttaaacttcatctgtattgaaaaatacaacattagatccagccatattttaaagtcatcagaacatactctataaatcattatcagctgttagaaaccagttcaaacattttctaatgagtgagatccttacaatggggatctaaggttggttcattgtgacaaaccccagaagagaccactggctcctcctgtcagttaatttgggacttgacttcgctgctgagtaagagagggcagctgagtaagagggcagcatcctgagggaggagtctaattactgcttccagccaccatggtaggaaatcttttcttggcagaaacaaccgggggtgggggggaatagctttcatcagaattgaagaggaaataactgtccttccagagcttttctgaagagagatgactatttcatttttgctgtttttctcatgtggcttagtctcaacatcttaccttacaacataatactaaatttgcttgaaactacctatcagactaacctcttctcacaaagaccaaggctgaacaacactgttctttatgatagagctaaaaacggagcctaaagttggctgttaaagttatttgtaaatgaatatctaaatgtatatcattctcctattccttaaaagtaagtgttttgccacaaatttttggtaatcagcaatcatctttttaaatcctctatatttgcctatttattgttatagttactggtttcactgataatttggggtaatttcccatgcttctgaagtataaagatgtactcttggcccgtgtcaaggatgaaaggaataaggattttttttcttctaatactcctttccttaacctcctaggagtgtttaatatttaagcacaaacttatgcattaaaggggaaaaaaagcagcagcccactggacaactgtcattgcagaggagcctcagggtttaagtgagagagaaatcatagactctgcttgtcccaccctctggggtaaaggacagtagtgttttttctttttaaaaaatttccggccacgcacgatggctcatgcctgtaatcccagcactttgggaggctgaggcgggtggatcacgaggtcgggagttcaaagaccagcctggctaagatggtgaaaccccgtctctactaaaaatacaaaacttagctgggcatggcggcaggcacctgtaatcccagctagttgggaggctgaggcagagaactgcttgaacccgggaggtggaggctgcagtgagccaatattgcagcactccactccagcctgggcgacagagcaagactgtctcaaaaaaaaaaaaaaacaaaccaatttgattttcagtccaaaaatattttctaatacgtttataagacataataaaaatgaatataaaaacaaagacaaagtacaaatccagagttttttattggattcccacaaacataaattactccgtcaaattgccatgaaagtttgagtgtatacttgcaattttggaacttaactcctggcagaccagtaacagagcttggacagcaaggccacagaccacagcattcatgaggaaatgtattttgacctcaatgtgataaaatgctttatgagggggttgtcctgcagtaactatagggaaagcctggctttgaaaattaatgtttacaaatatgaacttccaaatgtgaaccctcactgaataaagcacaatttgtaggggaaaaaaatatcaggctgtttaaatctcttatggactagttggctttgcttttggcctattgttcaaatggggctatttattccaaaatgcttgttctgcagacagcagatccatcaattcttaatgaagaacatagcctacaattacactgtaactggcatccgaagtggtggggtctgttaagaacatgaggcgctatagtttgtactaacatcctattggggttcattttacaggtatcattccttggaatgctttccccggaaaaatatgtggctctgccctggagaacatctgcaacacaaacgaggtaaactcatcacagttcagaataacccttgagtattaggctgagaaaaaagggttctcccagctgtagaaagagcgagagagatggttaaaatgccattaaggaaagctccttgtttagaatctttaagatagagctatatgtaaccatcactattcagccatttttgacctacaaaaatggtcacttcatatggtccaacacatttggtgagaatccttaagaagtggagggcttttcctttgggcaataatttagaggtgatcccaaacctagaaatctaataatatatctagattcttctctcacctcttctacttctactctttctactttgaaagattttcaaagtagaacacctgtcacagaacggatgtaagttaattttcatagaggagtccctctatttcatagaggaatttgtgtatatacccaacttttaataaatgaggccacagttaatcatttatatttctggaatgacttgctacttctctaattctcattcgtccttactagggagtgtgtcctaacaatttggtttaaattgtctcagccctagaacattcttcagtcattggcttgtaactgtttataaaggaaaattcttaaatgcattcgtaggtgcttgtatatttaagaaaatcctggcaagcttttaagaagcagtgagttacagaaataatcagctcctaccctatctgacttgtcaatttgtatatccataatatgcagtggcttgaagcagggctccccaccgtggctgcatgttacagccatcaaggcagcactatgttatactgatggctgaggcccagcccttaggtattcagatttaatcgatttggggggcagtctgggcatcagaaagtttttaaagctcctcgggtgattccaccatgaggccagagcatgaagagaaggcaggcctgtgcccagtcttgcagagaagagctgcaaaggagacagatgaagcagcaccccacaatgagtgtaggccatttcatttaacatcaaatgcttatgttgatgccctgttcttttgtagttctacatgtcctatcacctgttcattgtggcctgtgcaggagctggtgccaccgtcattgccctggtgagtaatggccccaagaccaccctagtctagcctcctccctccagcttctaaatgacagatttccctt

SEQ ID NO: 3060 - DNA, 43392 bp, human
ggctagaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggtacccagcgctctgacaatagcctgtttaaagcttttcactggggggtgcttaaaaagggttagctgggttttgtctctcttttaaaatggctctgagacaatccctatggcatggtcttgctttcagggttgatttttttcctgtgggctgatgttaagttaatagagcagcctttcttcaatccattcctgttccaaatctttctaccgacgtgatatttcatagagggatgtctatagtttgtcaccttgggctgatgcattggggaaactgtctttttttattaatataattaatcgtaacttaggtcttgtgtcctgcatgttatattccaggaacgtggaatgtgtagttttctgctaatgctgaggaggaactggaggggcatgcatgttaattctgctttggttccgctaatgctgtagtgatttgggcattctctaattttcttattctaatatgattgctctttcttgtatcaggccctgactacgacatgtaataatcatttacagttggagcttcagagaggggacatcagctctgtcacccagtgctgatggaaaggcagggcgggggatcttctgctaattatgacttggagactggggggaagaaaattgataaaggtcctatttcttaaagagaatcttagaacgtaccacaattttcatatacagaatggttttttggagaataaagtgtttttgcagtaagaaaatggcagaaaggaactaaaattaatctcttttttctaaataatgactgatttcaagtttgatgtcccatagaatcggctcagccactgttaggttaatggatctcactgcattgtaattttccctcactcaaagtcatagactgtcataaatgcccaaaaacatattctgtaaccgcagtggctctaatataaaaagccatcatgctaaggttatttctcacagcccttgcgtccactgatagtcactaaagagtaattcgccagtacggggacaaaacttcgttttatttataaagatacaggctgaaccatatgaaattgctgatagtcaaccattttaaacctacaaaaacggcaattacatgtacttcagcttcacagtatgctggggtaaagactgcttgtttttatataaaatttctttggtacacaataatattttatcctaaacagagcaattttactttttaaattaatttttttaggtatcacacaatacacataacataaaatttaccattttaagtatacgattcagtggcattaagtacatagcaccttaattttaaaatcgtttgtttagttcaatcctcttaccaaatctacacctccccaccaaaaacccagcctgtattttcttgtgtgtctttaaaaaaaaaaaatcttcatcaatgaccaaatagctataagagaagctcttgggaatatttatcaagatgaagaagtgagatcaaagttttttccatgatgactagagactaagttgattgcatgttgtcggggtatgataatgtaatagcattgtcccaaggaagcctatcacgattttatcctaaaatgatgattttacttagtacatacttttaatttttattaatgtggtattcaaccatggcagataaaaccgttttggtctttgcaaaaaaatcccttttttaaatttctctctgaaaggaagcaaaggtcatataaccaatataaaatcattactacacaactgtgtatcttatcacttagtcttatggactgctattattttatgtcaattaaatcttatttaataacagatctacaggttgctagtacatccctgacaacccgtatatgaaaagtcattagttgtgattttagagacaaaattagaagcaaaagataatttgtgaaggaactttaaaaattacctaaatgtataaacactagctgcttgttaaataattcaaaaatatcacactaccagaagctagtgtgacatgtatggtacatgcttgaataagaatacaagccaggggatttgtttttcctgatctacagcaagaggggttgtgattgttgtgtgacccaccataattgttgatctggagggtggcttatctaatctgcatttagatgaacaagttcatatgctggctacacaaaatcaaagcccacacaagacactttgtagtttcccaatttgctcacccatcatcattaaggtacacataggataaaatgatagccacaaatgtttctgcgtgattgtcacatcagtattccttcagatttaactttaagtttattaaaaaattatttttccattgaaattaacatttgaaaacttgacataattatttatagaatgtgttatataattcttgagctggtggatccgttttttatgtttttcttttaagcctttcagcaaaggattttattcattaaatttaatcctgtaaattttgtcactttacgcagagttttttatgcacatatatattttttttcctgtgtttctcctttcccatctgttttcagtggttggtgatggagtgatgcctgtctcttaatttggggcattattgcccaatggctaatacccaatagcatgtgaattaatatctttggataattattgcagtgtctattaagaactaagaatgtaaattaaacttagctttataaattgaccttgcttttctagttgggatctttcctgggagtttcagcgggacaacacaacccagctattgtgattcactaactcctacaaagagagctctttctttaaacttaatcacaatgactttgtttctactttagacaaaattaatccatgtccttaaaaaaggaaagcatttgtgttttttcagtctgatagttttcatcacagcatgctaccagataccaaaattcacaagagtatttagtagatatttagggatttttaaggaaaacaagcagattttcttagatggatgtaagaaatgccaaattattacaaatgatagtttttaaattaaaagcattaaagtgtgaagattgagtaagcagattcactgacatggaataagcagaggaaatgaataagacagaatcaaaagaaatagatcatggaacccaataataaaaagatggagagtcggtttccattgatttcagtggagtattacttgttgtcatttcatttgtgaaaataaatgcatctgaaattgctgagagtggataatcactgagtagaaaaacaattgaatcataacaactttgtatgctctattatgggggaaaaatctatctgttatgaaaattattttcattatatgtaggtaattgaattctactgaaacaattatagtcaggttagttaacttcctatgaatcgttgctgaaataaattacaggcatcaaattaaattcctaaccacacaggaagaaaaatatagtgaatgggaaacaatgtgtaatttaaaataaattacaggatatagtcaaagtaagaaatgaatttaaattattgacttccttaaaaaattaatacatctattttaatctttttgatcaaatagatataatttcttatttttttttttaatttagcaaaatgtatgcacttttggctctcatttttcgtttaggaagaaaagcactcctctagaatatacgacttgtgtgattaaaaacccaaagggacacataacacacgtcacactattcctgatgatctgcgaattattgcattttgaaatttgtgttgacattttctaacttggctatataaatatggtacagaggaagttttagatgcagttattatctgtaagaatttgccaaggtggacatctgaagagttggtgtctggggaataggctgtagagaaaagtggctggccagatggtgcggaacatatgtggtaggtatgatacagcttcctttgattttttttttttttttttagaacatttaaatgtggaaaagatctcaacgagccatttggtacatcttctacttttacattattaattccattaggatttttttaaagacttggccttgctatttcgttagaaaaagaattctgggccatttctggaaatttagatttgccttccctgaaattgagtgtaaaccctgaattaagattattatgattttcaagatcacatttctctgttatttggaagtacagggtcaatttagactaaatgatcttaataaagtgactttgtcttgatgtatctgagaacatgcaaaataaccagtgtccccatgacttaaacttcccctctctgtgactgtgatggattggattggattgttacaaagacactctcgcttttttctcctttggaccaaatgtacatacatgggagatagttggccaggagtagggatggccatggaacggaggaagaaagtgaccacaccgactgtttttaagagaggaaggttacaatcccagtttcacaaatgtgctttgttgttcattcatttattcgtttaatggtgttctctgccgggtgtggtggctcacgcctgtaatcccaccactttgggaggccgaggcgggcggatcaagaggtcaagagatcgagaccatcctggctaacatggtgaaacccagtctctactaaaaatacaaaaacaaaattagccgggcgtggtggtgtgtgcctgtaatcccagctactcaggaggctgaggcaggagaatggcgtgaacccgagaggcggaggttgcagtgagccgagatagtgccgctgcactccagcctgggtgacagagcgagactctgtctcaaaaaaaaaaaaaaaaaaagaaagaaaagaaaagtgttctcctttgaaatgtcattcttcctctgtcccttcagctcacgttacaggagtacaggggtgctaagtcatcgtagggaccattaggggtagtataatcttggttttaataataattttgctgattggtggcagattaaatagcagacaaaatgccatagacgagaattttgatccttagccagctgagtgatatttctcgtcaaagagtgtataagagaaaatgtaataatttcctatttgataagctgattttatcaattgcattaactgctttatgtagccaagccttattatgctgtatttaaaatcaagggtcaacacactttttccgtaaaggtcagatagtaagtattttaggtgctgcagaccactcagtgtctgttgtaactattcaaatctgccactatagcatgaaagcagccctagatagtatgtaaacaaatgggtgcaactgtgttccaataaaaccttataaataaaaacagatggctataatttaccaacctttactatatttatagcattgttatggcattccttaatattttaaataatagctaaaaatgaaagataacaaatatagctttgaaagaccttgctcagtgaatatggtctttcttggaagctcagtgtttgtcacttagttgcttccggtgataatttcctaggtgctaagaagcatgacagtctgaagttcatttgttcagccttctcgctaaattacattaaataagtaaatggggaaaaataaacaaggcattgttttgctttcctttttgcaatttccccttgtttcatgcccacctttggcaatgaccactcacagctgtgtctgtcttcataagccaccactggtcacctcatctctatcttcactctcttagggggaacattttgcagttttccctctgcagggcataaaccattttcccatttcttgccaggtgcccagaatcaagacattttaaaagaccttttgagccaaggcatcctcttggaatcctgtgactgccttttaggtgttgggatcctgtccttgggattaaaatgtatactgtgttttttgaaattttataaataactttatatttaatgcctttatttaaatttggctcaaaaatataaaatagaagtgatttttcttttctttcatatctaaagatttactgttgtaaaaaggcccctccagaagtgtaagtccaggggatttggaacacatccatccagttgccgatcccatcggtgtgtcttctggatctattctttttttttttttttttttttaaatcctgaattaagggtcttaggcatggctgccatgtttttctcagaaaacacgttaacattgagcagtccatggtttttcattgtcattgcctagcagcctatgcttgcttgcctgaacatctggagacttaccccatccatatgaggagatgagcacagagcatggatgaatcttctgcagagataccctgaattgcatggcctggcttgggtaaaagtcagcatggtgggggatctagaggtccatttctggtccacagggtcccagggtgctcccttcctttcaaccaaatatttattcagccagcgtttattgggcacctgtgtgctgagtatgtagagacaaattttttaaaaggataaaaatttccagatcaaaagtgatagaactacttagaatcctcttgcttaggggtctatgtggagggctcatagccccctttaccaagaggaaatcagatcataccatgaagtgccttgaccttctgttttttttctgtcagccccactgggttttcttgcctttggagaatgtagcaacatctatttctgagagagaatctcctgaacagtaaagcaaaaatctaaatctgttttttgggggttttttttctttctttttttgagacagagtctcaccctgtcacccaggctggagtgcagtggcatgatctcagctcactgcaacctccacctcccaggttaaagtgattctcctgcctcagcctccagagtagctgggactataggcgtatgccaccatgcccggctaattttttttttttttttcctgagatggagttttactctttttttttttttttttgcccaggctggaatgcagtggcgcgatctcaactcactgcaacctccatctcctgggttcaagcaattcttctgcctcagcctcctgggtagctgggactacaagtgtgcgccactatgcccagctaatttttgtatttttagtagagacagggtttcaccatgttggccaggctggtatcaaactcctcacctcaggtgatctggctgcctcggcctcccagagtgttggaattacaggcatgagccaccacacctggccaattttttaatttttattttttatatattttttttatttttagtacagacagagtttcaccatgttggccaggctggttttgaactcctgacctcaagtgatccgcccgccttggcctcccaaagtgctgggattacaggtgtgagccaccgcacccagcccacaaaaatctcaatctaaggaagactgaaagttaagaaattttaagaagcctgagataacatcagtagcttaggacctggaccgtttctttaggagacacagaagcacaactcaactgcaaatgcacctcagaaaaactctcattgggttaactgttgcctcagcagaagagtagaaaattgcaatacatgcagaggtcacagtaggatgtatggtggtttccaaagtgtgccctcttgagtgaaattgctaaggttcacattcaggcttctctacctcctggctgaaagatcttgggcaagtgatcattaccttctccttgcccttgggttgttcccttgtaaaaatggaataataatagtacctatttcagagggtggttgtgacaaatgtaataagtaccacatgctgagtgcagtgcatagtacatcataagcactccataaatttttgctgtcatcatcattgaccacaaaaatagtttcattgtgcagttctgatcttatcccagcatcttttctgtacctccctaccctggttttaaatgagttatgtataccttaccttgaagtcaaaaagattttttctaaaacattctagaaaagcaggtttctgcttccaaacttgaaataccttacaagttttcagagattgtggagagtggagttgggattttataaaggctttgtgaggttttacttgcctcacactgtggctttagtaggttcttctcctcagagacctgagctgccagatggtgcattatgacctgatcttctgatggaatcattacccacatcaatggcacaatttttttttaatccttaaatatttgtggtgccccagaggatataaccccttattaggttttatgggattctcggagataaactggccatagcgaccttatgatctctttgagatttcaagattgtaattcaactaacttttatgagaagcctactctgtgccaggcaaattggtaggtatttttctttgcaatcccctaagaagtgggaaatattgtatcatattaccagatagagacctgagtcctcagggagtgccagctgtcaccatgtgtgtaattaagcagtggttcgagcccaagaccagtagccctttctgtatagcacatgggagaaaattggaacaggatttaatccagaacattctagactctgacgttctgagtttaagataaggtgacagacaatactgcagacgtcaatgggaggacaagcatttcatccaagaaacagcagaccattaggttgtttgccaggttttctggactagagctgggtacccttacagagagggagcctgcgttcacctttgctagtgcagctggcaataattatagtgctctgttagtgctctgttggtctgaaaaggaaacagaaagaaaaatattattgtgaggagccaaattttcactataaatagtatcttccccaaatgagcattttaagaagcaggatatggtgtgtgttgggggaaagatgtagaaaataaagatcattttggtgatttacataaacttcaatttagaaacggaggacattctcaatggatcatgctggtactgaagggttgcatttcaatagcatattttttaaactccccatttcctttctatggtaaagaataaataaaaatgctgatatagaatctttgctggagatagagacactgactctttgccacctgaaattggcagtgaacagcagagctgaaatggaaattggcaggtaccactggatgtacccaggctcaaagaaccaccagtaccatcccgtgccaaccctgggggacagggctagccccttgagcagtccaggtaaatacagccttggggtgaattctaatagcaagtcaactgttatctttaatattatttgtaatggctcttgcagcttggtgatattttatgttttgcttggtgcattaatttgttcacacgggcatgggtggaattcgccctataaacattttttaatcatctttctttttctctctccctctccattccaccccatctttctccactttcttctccttcttccctcttccctctttcaccttcaatcacttcgtcttctcaaagggaacaatgtacagtgagatatgcctttggttaaccatgaaatttccaatgcctgaaccaataatgggggaggggggccacccacatcccccatgtggccaagaactgggccagggccttcaaggagccttggccctgagagtactgtgagtgtccccaaatgtcttcccagccctgctgctctgcaccaccctctcacctcagtcattgcctttgagaaagagaaatcaaagctgtgaaagtaggattggataaccatgtacccgattcccatcaggtaggttcagtgggtccggtttccattttccttgctcgtgaggaacattggccattcagaaccgctaggtgctggatctgggtgaggtgtgcgacagctgatttggggacctagaaggggcaaaaggtgaagcagtatgaacatccaacctcccacgttcccaaaaccaacacaagttgtaatgcccagctcagttagctaaaactcagtgattttgccagtgtacaaccatagttcaaactacataaaatgcagacataaagggctggtggtaggtcggataaacacagtaagaggcttaaagtatttctgtgattttgcatcaatccataacatttctcccaaatgcttgctaactttttcaggagtaaatgtagcatggtacagctccagaaagggcaatcccaaggtacaatgtaagttacccattgaattacaaagtcataaaatccatgattaataaaaccttttcctttaaaatctaaattgtgttgtcaggttaattaaaatgaaatctgacgttggatttagttctgtcttgggttatgcattccttcatctgtcctatggctatcaggtgttggttctgtgtgtgcctgtgcagcgctggctaaatagggtgagcatgaggtgacatcagccatccattctcatggatcctataaagaatatggagggttctggaatcttgatttaaaaaaagtcattagacgtgatatatccatacaatagctactattcagcaataaaaaggaatgaaatatttgtgcatgctacaacatggatgaacctcaaaaacatcatgctaagtgaaagaagccagacacaagagaccaaatgttctaccactctgtttatgttaaatttacagaattggtgagataagaagtaggttaatggttgccagaggctgagagaagggaggattggggagcaactacagatgggtacaagggatcatttttgctgtgatgaaaatgttctaaaattagattgtggcgatggtcacacaacgctgtacatttactcaaagtcattgaattgtatacttgaaacaggtgaattttatagaatataaattatatctcagtaaagctgcttttgaaaaaaaaagcagcaaaaaaaaccatgagatgtgcataattcaagggtggggagcggggaaaggggtattttttaacataacaagaagcccccaagttatcagaaacaactgcttgagggaggagtccctcttcatcttaagagtctttaagagtcttcattttaagagtgttgaatgacatcaggccagctggaaacccagaaaaatacttattcttttctgtattttagttcactaaactggtaaagaataaacacaatatcttattgggggggaataaaagaaacctctatcaattgctcttgaagagttttctccacttgttgagcagttccctgtaaaagcattgcaataatatttgtgtgcttttgatcctacggtgaaacaccagaatctgggcattcatagcagcagtggcagctgagaagaaaaatacgaggctccattttctgtttttctgaaactgatttctttcagaattccaaagaatttgggtttccaaaagataacatagtgcatacatcatgtactgcatgataccaccactgagtgtctctgcagatctaactcattaatctttctggagagcccaagactataaacaactccttgtccattcaggtgagattttggcaccaaggaagaggagatcagaacaggttttgctgccagatgagttaggggagaaaaaaaaattacttttcaagttttttggaattccataatgatatgatgaaagattgtggaagtctaatagtatcaggttgctggtgatactactgcaagcgagaattccatgaactaacaggttcttgcctgagggggagaaacaaaatcactgaatttgatttaaagaattatcttcccagatcctgaaacaatctccacctacacatagttttaactttttgtgtgcattgatggaaataattggaaaaaagatgcctccacggggactgttaatgtctggagctgtctgcagagaccttatgtgtgatagtgtaaagcctacagcgcaggccacagagtgaagggacccactctagccatgccatcgcctttccagacacttacagattttgttgggtcctaaatcaatgccgttgccattctatacttagatctccaaccccaaccagatggtatgaggcaaaaaatagggaattctgtatggctcttttttttttctttttttttttattaatttttttgcagagttgtcagcctttttccatgggggaaaaagaggttttgatacaggctgaccaggaaatttttgccaaaggaaaatgcctctcccactcatgcagttactgtagcagagactgcccttctccaggaacttccttattccccattggaaaggtcatggcggttccagggtccttttcatggttttctttttcttgctactacttcccagtagaattccatctttaggggttagatagttattctttccttatctctttttccttttcaatttttagctgcgttggacatgtagtgtccacatcttttctgccttcaggagatgaaatgatgtatgaccacatgggctacccccgccccccgccccccccgccgtccatgatgctgccctaggggcctggcctgaggtggtggtctgagatgcaggcaagcgatgaagcagggagtagttcatgctaagtctccagtcagtggcatattgtgcttaacattggagggagcacttccagactgttgtagattgtgttacacaggctccagaggatagcctaagacaatctagattctctattccaagtgcgggctgtggaccagcagaatcaacacctccaggagctcgttagaaatgcagagtcccaggtcccacccagccccactgaatcagaatctgcattttcataagacttccaggtagttcctatgcacattaaagcttgagaagcagtaattaagagcaaggtccaagagcaagaagggagaagacaggaaggaattgattatgtgaatttaccctcaagagatctagaaatctttatctttggaaaagataaagaattgctcaaggtattcatcctttcttctttccgtttctatttaggaagaggcatgtctaagcaatgccaaggcagtcattaatctgttgagtcctggctggtttgaaaaacagtgaccttgcttctcttacctgcttgtctcatgagggggtttggggaaggggcagtgaaggtgagaaaggtttgtttctttgtggcaaagtgagggccagaggagaaagtagttgatggaagcttgggagaaattctcaaatgtctctcatctccctctttaatataatccaatgacatgcaagatgccgtgactaaatataggctgccatttttagtggactaagaatggttctttatatacagttaaatctgtaattcagaattcagtctcacaaggaaggagtagaataaccacccacttcacatatcaccaatttccgcctctcaaatccaaaatgctctgatgtttcagttaaaatggccacagataattccagaagtcgggacaaagagcacaccctctacatagggactgtcacagaggatgtcgggagaggagggccctctggagtgttggtatttagcaagaagcccaagtgttgtgatttgcaccacagagaatggattcctgagtcgccacggggttgtggggtgggggcgggtagcagactgacggagggcccagcactgctgttaactcatgttgcaccttgtctgcccagatgtaaccacaggctggctcctgggaactgcagactttatcccttggcccccttctaggctgagcctgggacttctctctcactgatctgctttgtagagggacacctgtagctataagtcctgggaaatgctactggatttttgtcattgttctttagtgtcactctttcctaacctaaggttgtaaggccactaagttcgaggtcttctcccaaaccacttgaaatgtattttaagggggaagaaaaacccttaatccttctgcgtgtaccattccacctctggccatagttgggtgtcgaccataactgacagtctggtcgtgccgtgtgggttctgctggtggtatcattctgtccccagaggctggttgcagaagcttttgtagcttatccagcctaagccagtggatgctctcagtctgtctgatgccttccagttactcaagatatttctgattacatagaggtaaatggtgaacacagtggaagcacgttgtagctcaggctcatgccgtaaagtccctgagatttttagagtactttgccttttgttttctgaaatgtatcaattctttcattttcaaagcacctgcagttttcaccaaaaaagtgccatatacagcagttaacgattttatagtttatttactgactgctatggcagtctttatatatatatatataaaataatttatatatagctgtaaacaaatacttatcgatataagtaatttcttgattgtttttgaacgttccattgtttatgcgctatattgttagtctgtgattagcacctaattatgtaacaatggcttactgtgtgtgtgacatatcagctccctttgtcttttggtcttacctttgcttctcaccttagagtaggcagacagagaaagcagagataaaaagcagatcgatgagtattgagtgttgatctcgggctttctgtcagacatgtctgattgtagggacactgacttggattattcaagactgagtacttctcggtctttgagaagtagtgtcatctggtctttgctgcctttgaaatgtcccttatgttatatgttttcatataaatctaactagagtccattaaaattaattttgctttgaaatcttttgccacccttagaggtaactggaattactctgaagtagctggggagtagctgaaatcagccacttaggtcttcccacctcctcaggctgtgtccttttgggtgccgaagttcactcccaaataagccacatataccctcaccccctgagtgcgtccacgtctatgaaaagcttatatgaattggcttttgtactaaacggaatgctctgggtgtcagagtcatttaggtgggacaaatcttcctctgaagatcatcatgcttgtattttctggagacttccatgaacaatgctttcacccccaaggaccagctctaggggtgaaatgtcaggctggtaggagaggtaatgggatcgaaacaagacttcctgtgtcttgagaaaaccttgtttatattcatgtgctgtttcccagtggcaataaatcgagattcctgtgaggatttgacagacgaggctggtgatgccacccactgtttttgtaaagaaaatgttatcggaaccagccaggcccatttgattgtctgtggctgctttcgtactccactagcagagttgagaagctgcaactatacaccctgcaaagccaaaaatatttgccatctggtcctttacagaaaacaattgccaatccttgaattagaatttgcaaagtgtgtcaaaatgcaatactctatctactgatgttaggcaacacctaaaaactttgctcggcactcagtttcctaaaatcttctccatcaaacatccctcatcctctgccctccaggccccagaatccttgttctctgtggggaatagggactccctgctcacaggctgtcaactaaggctcagcccttcttcagagaatttcttggtactttctagaagctcagcccctctggcctctttcaggtccttctctgagttttcccataataaaccaagtcccgttaagtggatactgtgagctactttcatctagtgttctattcagtgcactttagcaagttttatttcctgtgtatagaaaagatatttgtggtttactaaatgtagtgctggggatcatttctttctttttttttttttttaagtatgaggttccaatgccctgaatcggaatcgctaagaatgctggttaaaaattcagatttcatatgggcatggtggcacacatctgtagtcccagctacttgggaggctaaggcaggaggatcacttgagcccagaagttcaagttcagcctgggcaacatagcaagacccgatctcttaaaaagaaaaatcagattcccagtccccacctaccctctctgcgatgggtcccagaaatttggcccattttaagaagctcccccaggcaattctaatgcacagtaaagtttgaccaccactgctatatacatagaaggccataacccctcattataacatctttggtaaagtatcgtttcagttcagcctgtgtatgtatatgttcaacctgtatatgtatttacagttaagatgctcaaagtcaaacctccacatccttagcagacagtactattgaatttgaagtaaattcctcttgaagtaatgtttcgctattgccactatatctttgtgtataagagccaatgcaaaaacattagattgtaaagctgtaggcaaacatcagagctcaggctgtgtgttagttatcaattgttgcataacaaattcctccaaaacatagtggctagaaacaaaaatgtatattatctcggcttccttaggtcaggagtctggactcagcttagctgtctcagaaactctaatgagatttcagtctcatctgaaggcctaactggggaaggatccacttccaagctcattcatgtggctactggcaggacttggttactttgggactgagggcctcagttcctcacaagctgctggcctaaaacctcccttgatttttttccatgtgtgggctctccatagctacttcatggcatagcagatgacttcatcagatagagagagcaagtgagcaggtaagagaatgtgccagccagagagacaatgctaacaggacagaagtcaattttttgaaacctaatcagggaagtgacatctcatcacttttgccatattctagtcctaagaagtaagctactaggtccagcccacattcaggggaaggaattacacaaggccatgaatgtaggtttgtggggatcattgggggtggtgtcttagctgcctgccacagtctgtataaacatttcacagtgcaaatgcatcctccatctccttaatgatcataacctcttcactttctcaaagcctcacctctcagagaatgtatcactgggttaaatgagtacctggcaggtgtttgacggccttcctgaggtactagactctaagctctctgtgagcagaggtcttcatgccttgctccctgctttggcctggctcgggacctaggaccaagaaagcagtcgttcatagtgttgaatgatgatcactttatttttagcactcatgatgtgtgactctatatgaaattgtctaattttagtgtccattgtgtacatggctcatttcctgggccaggctggtcaagaccttgcactctgagagttgcataggagctcagcaggtgtttgttaagtaagttcagattggctactcgttgtcaggagtttgagaccagtctggccaacatggtgaaaccccatctctactaaaaaaaaaataataataataataatacaaaaatcagccgggagtattggtgggtgcctgtagtcccagctacttgggaggctgagacaggagaatcacttgaacccaggaggcagaggttgcagtgagcagagattgtgccactgcactccagcctggacaacagagcaaggctctgtgtcaaaaaaaaaaaaaaaaaaaaaaaaaaaaaaaaaaaaaaaattaggttggctaatcgaggtttctagaatcatctgcatgtaaatagggttaactttgtgggatgattttcttgaataagaagttctcagcctgagcttcacagtagaaccctggaaggaaggggaggtcttttaaaattccgaagccacatccagaccaagtcattcagaatcttgagggtgggacccaggcatcagcgttcttgaaagctcccccaccaggtgatcctctgtgcagccaaggttgagaaccactgtggtagaccagtgtttcccaatccgggggagtttctgcctttcaggagatgccttttaggcatctagtggtgtagaggtcagggatgctgctaaacatcctacagtgcacaggacggcccctccccaacaaaggatggcccatgccaatagtaccaagagttgagaacccctgggctaggtcctacgctttgagtcaggaaattggttctaagtgaagcagtagaagtccatggggtagctttgtcccagatgttaagcttattgcaggcatggatagcttgataagtctggaatattatatacaatctatgtatcggtgtttcctgaagagaaactcactcttttaaaaggcacgcagtgcataaaccaatacatttaaacctacatatatttatttatgcaacataataccatacacgtgtgtttgcatatagcacgtgctataaacaccctatgcatacagagatgtatgcagggcatatgagtgtgttattgtggttagaggaacaggtatgtcttcctcagcgccctttattttccttccccctcactgtagcctcctgccctctgcttgtctagtaaaagccctaaggcctccctgacccttgctgtccttaccctcagtccagaggatgcctctgctgtgccttgctgcctggagggttcccatcacccaggttaatgtggctcttggctttcaccaccaatccttagtttctcaaaggggttcacaacctttttaaattactagtgtgtcttgtagaaattgaacttcacaaacaggtcttctgaaaacgctttcttgtggtgtaattgatatgcatatggtgcatctctttaaagtgtctgacaagccttgacatacgtgtgtgctcatgaaagcagcaccatgagcagcatggcaatgtggctgccactcccaactctttccatccttcctatgctcccactctccccaagcaaccactgatctgctctccttctctgtggattagtttgcattttctagaatggcccttgtgaagatgtgttcacataaattctctcaccctttctcacccgaatagaaaatgttgcatgatgttgattgcttaatagctccacagctttgtccaatttttatccttcctgcttttactgaagatgtcctgcccccatgaataaacctcagaagacccattctgccaccgcctaccactgaagagttgagcttgcacccactccagtccagcccacacaccagtgccagattcatctcttaaaagcacatcctgagtcacgcctcgcctgctcacaaaccttccctctcttccccttgctgcaaagtgaagcacagaggcttgaggctggcttggacatcttccatggaccaggcaatggggggacctaccttcctgacttctccccaccattaccctggtgtccttgatgaactcggctacaccctgaacgctccccacgtctcccacatcacatgggtcctgctgtccttcctttgtgcttttcatggaatccttctgttcttcaaggcctcttcacctcctgccatccataaacctttgccttagcaacccacaccaaccaaagagatctgtccctacctcactcccccatatccctgtgtcagcactctctttattctactttagtgataccttatgtgtctgtgtgtcttaccgcccccctcaccccacccacaaggatcaaagccaggagggcacacttgcagaccccaccacagtggcttgcacatggcaggtattggacagacactcattgaatggaatggaatccaggaaagtagagacactgtcgcccagatggtcaaggaaactgattgctgctaaagctcaaaattgcagatattaaatacttctcaaatgtctggagtagcctccagattgctgtgctcttaaaatctgtgtcatctggacttagagctggcttcccctactctccattgatctccatgattccttgctgtcccactttaccaggctaaaagcctttgggaaaaccaaagccagttcccacaaaaggcaaaggaagagactaacaagtatctggttgttggatttgtttattcccagtcatggaagcgtatcattgcttttattgacttgcttatcttctgctagtaccatattgcaaatgttagaggctcatctattttaagacttccatagtgttttcacaaaaatgaaaatcccttattaaacagattttaggacaagcttctaaaaggacctgccaaaaagtgatttcctttctatcattagaaatagtttccacattcttatcgttatgtagttgaacttttatgtccaggactgcatgaaagacgtgagaactgagaagcaacctatatttgatttcgcactttgttcttggacaggaagcccctgtcaactgacttcacatctttttaatgcactatattagtggttcacagaactttctgggtgttaggtccctttatgtgcttagaaacagttgaccccaaaacgcctttgctcttctgagttgtgcctataaatattttctatattagaagctagaactgagggctgggcatggtggctcatgcctgtaatcccagcactttgggaggccaacgtgggcagatcacctgaggtcgggagttcaaaaccagcctggtcaacatggcgaaaccccatctctactgaaaatacaaaaattagccaggccagccaggcacagtggctcacacctgtaatctcagcactttgggaggccgaggtgggcggatcacctgaggtcaggagttcgagaccagcctgaccaacatggagaaaccccgtctctactaaaaatacaaaattagccagcatggtggtgcgtgcctgtaatgccagctacttgggaggctgaggcaggagaatcgcttgaacctgggaggctgaggttgcagtgagccgagctggcaccattgcactccagcctgggcaacaagagtgaaactccatctcaaaataaaataaaataataaataaataagccaggcatggcagcatgtgccttaattccagctatttgggaggctgaggcaggagaatcacttgaacccgggaggcagaggttgcactgaactgagatcgtgccactgcactccagcctttgagttttttaagatggagcgagactccatcttaaaaaaaaaaaaaaaaaaagaaaagaaattagaactgagaagtttattacttaataataaacttagtcatttaaaataatagcaaatccattatatgtcaacctaagtaatgtttaggaaagataacgattttcaaaaagaaaataatattttagtgtgaggaataggactgttttacatttttgcaaatctctttaatatctggcttaacagtagacagctggactcttacatctgcctctgcattcattcagaggcatcttggggtatcttgctttggttgaagtatatgaagaaaactcaaatttctcacaggtatgtgcttggagaatggaggagtgttttaatggcctttgcagataattatgaaattcttccttgatactacaccaaaattcagcagctagtggtttcttaaagactacttgtaatgtggaatctgaaaccatattgatgatatttttgtactcttttccactaaaattcattgcttgatcttgcactttgattgactcttatattcaagaattattttcccttggctatttggaaaatattggttctctgagttgtgcagatcttccagacgttgacacatttaattaaaccatgtcaaaaaaatttcattggttaatgtcaccaccaatttcatcaagaagtctggtaagtatttggaagctgtcagtctcactatggcaggtacaagttttccaaaattgattggcaacagatactatcagttgttttctttgaagtgacaagctgttcatttttgggaaagtttctgccaaatacttaagtctaaaaaactatatcttgtcaggcattctttcaagaaagggggtgtttgcccccagaaaggtacaagtttggctcataactcagttacataagaatgtttcctgcagcccactgtcacacgctggtttgtggtagaagggctctctgcatcctctcactcatttcattacacaaactgttcgaaaggcacatactcgggggttgagatttaatcaaattaataattttttattgcatcgaggacatttggaagtgaaactggctttttaatttattttcttgcgagcgcgtggtagtgaggaatgtgttcctgctaagtacactatggagccactgcccgattcacgctcaggcatcagcagttttactgtgcaaatgtcaagcagtgaaaaaagtaaataacatcttggtgctattataaaaagttttggcttcacagtcctcctgcaaggatcttgaggtctgccggggctgcacagaccgtctttgagggcccactcctggctcagagtgagactggtgggcaggcaggatagaatctcttgggagctcaatgtcctttccagacctgcctgaacagaatctgcgttttaatgaagtcccgaggagatttatacgcaggttaaagttttcctgtagtcccagctatttgggaggctgaggcaggaggatggcttgagcccaggaggcagaagttgcagagagctgagattgcactgctgcacttgaacctgggtaacagagtgagattgtatctgggaaaaaaaaaaaaaagagagagagagagagaaccactgctctttaacagaggtctgcaaaactttcctttaaagggccacatagtaaatacctgtggcaacaactcaaccctgcctttgtagcttgaaagtagccatagaccatatgtaaatgaatgagcgtggctgtgtgccaatacaactttatttatagacacagaaatttgaattttgtgtacctttcatgtgtcacaaaataggttttttaatatattctaagcggttaaaaaagtaaccacttggaatcatgtcaaaatcattctgagtttgcaggccatgaggagagccagatttagctggtgggccacagtttgctgacctgtgctatataacactgagtgctcattgaagttaccgggggagcttcaaaaaaacaaaccccaaccctctaattcctgagtcccgtccccaataaattctgataaaattggtctggggtgaagccagggcatcaggattttcagatgctccccagattattccaatgtgtaggaaaaatggagaacctctgctctataatgttttccaagaaagttagttttcttttaagcatttctttttaagattttagaatttggcagtgtcaccaaatgtctgagaccagaattatgtattgtaaccttagagcagggtttctcactcttggcactgtgaacccaaagctatctgagataggtctcaatcaatttagaaagttaattttagcaagcttaagaacctgtgacacagcctcgggagatcctaataacatgtgcctaaggtggacggggcacagcttacttttataccttttagggagacatgagacatcaatcaatacctgtgagatgtacattggttcaatctggaaaggcaggacaactcaaagggggtcagagggtggcttgcaggttataggaagatttaaaaattatgtaaagacctggaatccatagaaaggaatgtctgggttatgatgataaggggttgtggagagcaaagttttatcctgtaggtgaagcctccaggtagcaggcttcagagagaatagattgtaaatgtctcttagcagatttaaggtctgttgatgttaatgctggttggcttttcctgaattccagaagggaggagggtataatgaggtatgtttgactctcccttccaatcatggcctgaactagttttttcaggctaactttggaatccccctggcagagaccaggaatctattcagatggttgggggtggggtggggggtgcttagaatttttttttttttttttttttaaacggagtctcgctctgtcgccaggctggagtgcagtggcacaatctcagctcactgccacctccaactccctggttcaagcgattctcctgcctcagcctcccaagtagctgggattacaggcatgcgccaccacacccagctaatttttgtgtttttagtagagacggggtttcaccatgttggctgggatggtgtcgatctcctgacctcgtgatctgcctgccctggtctcccaaagtgctgggattacaggcgtgagccaccccgcccggcccagagttttatttttggtttatagcactattggcattttgggtgtgaccattctttatttggggatgggggctgtcctgtgtattctaggaggtttaggagcatccctggcctctacccactagatgccagtagtgtcccccaccctcagttgtaacaaccaaaactgtctccagacaccgctaaatgtccctgggtggcaaaattgcctggattaggaaccagtggtctaaacgatgtagatgttttttgtgctacttcagagaatctccacattggagctattgacatctggggctgggtaattctttgttataagagcatattctgtacactgtgggtgttgagcagcatccctggtctctactcactagatgccagaagcaccctctcccccagctttggcaacgaaaaatatctccagatattgccaaatgtcccctgaggggcacagtcaccccctgttgagaattgcttggccagctcagaatcagggaagcttctgtccactgacattcactgctgcttctcttaggattttcgccctctccattttcccattgcttgttgcttgaaagttgtaaagcttggttcctgcatcttttctttttaattttgtggctcattaggaatcagtaatatagcaaggaaggccccatgtagagaggtaagggggtggtttttttgtgtggtgtttgttggggggtgtttgggagggtgtgtgtgtgtgtgtatgtatgtgtgacattcattccctggggaagaatctgagcccttgttcctgccagccctacgtctgagccagcattaaatctgcagccaagatcacagacaacttgggcaaatcacttggccattatgaactcacagccatggcaacggccatccacaagcctgaggacaaaaggtgttttattctgttgttctgcacaaaaggttctagggatactggagacaaaatagcctttgagacttaaaggcattgatgtgtattttttttttccctactacatggcttatatttaaactgtcttaggctaatgtacactgtaatttttgtgtgaatcaaaacctaaaattctttttatccagaggccagctaaatgaaggcataagacagcccaacagaggcttttagggtttggtgagaggtattgagaattactagtaaaatgtgctagaaagcctggcattctagcctggccaacatggcaagaccccgtctgtactaaaaatacaaaaaattagctggatgtggtggcatgtgcctgtaatgccagctactagggaggctgaggcataagactcacttgaacccaggaggttgaggctgcagtgagcggagatcacaccactcactccagcctgggcaatagagtgagactctttctcaggaaagaaagaaaaaaaaaaaacctggcattgattattatttttttacatgaatacatcacagtcatcaaaaaaatgctttccttattttttctcgttcacgttacccaatgttgtcattgctggtttgaagcttgggaaaattcagtctgtggatttataggagcatccaagaaaagcactgatcttccttagctatcgtaaacttttaacagcatggtgttctgctggtacttggcaccacccctatatttaaaaacatcagcttgcctatgactactaaggacagcctgaatcccagatctacttcctttttgtgcacaggcactcccagcactttagggggtggttggagtgtgtgtgtttagaaatctgctttctcaggtgactcaattcccgtcttctcagaccctgtctatggcatgacactaaagcatgaaaaattccaaggttaacagtacttgtttggctcacaaaaatgcactctagctgcactcttttcaagatggctggacaacttggaacattttgtttttcttaactgtagtccttggaacttgccatttgattcacaagtgactggagggttatggccaaacccagtgggccacgtcttagagaaaaaacatcacacaccatcgaatatgaaagcaggcacttcaaacagactcaggatgccacacctgagaccgggaagatgccactgttgactagaaatgggcttctcaaattttcatgtgcacacaaatcaccccagaggccttgttaaaatgcagattctgactcagtctggggtcacttccaacattctttatttctcacaagttcctccctgctgaagctgacactgctggtccaatgaacacactttgcaaagcacatggaattgacaaatgacaaatggtccactcatatcttttcttgacctctgatagttttccttgttgcccagtagaagctgccagcatccaagttcagctcttctcagctacagatccatatatcccttcacatcatccagagtgatctttcacaaccccaatctgtttcccatgcttaaaaatgctccctggcagaccaggcatggtggctcacacctgtaattgcagcactttgggaggccgaggcgggaggatcacttgagcccaagagtttgagaacagcctgggtaacataaggagaccctgtcactacaaaaaaattaaaaaataaaaaatgagctgggtgcagtggcatgggcctgtggtcccagctacttgggaggctgaggtgggaggatcgcttgagccagagagttcaacaccgcagtgagcagtgattgtgccactgcactccaacctaggcaacagagcaagaccctgtttcaaaaaacaaaacaaaacaaaaaaaaaacgcagtggcttcccatgattttgttttttttgtctttttgtttttgtttttgtttttgttttgagatggagtcttgctctgtcacccaggctggagtgcagtggtgcaatctcggctcactgcaccctccgccttccgggttcacgccattctcctgcctcagcctcccgagtagctgggactacaggcgcccaccaccacgcccagctaattttttgtatttttagtagagacggggtttcaccgtgttagccaggatggtctcgatctcctgacctcgtgatccgcccgtcttggcctcccaaagtgctgggattacaggcgtgagccacggcgcctggtcaaggcttcccatgattttgaagataaagtccagaattcttaaggtggcctggaaagccctaggtggtctagctcctatattacctatatcctctagctcctaaataaacacatttagctttttcttactaactttttgcagcagttttggttcctctaggatgagtgtgtgatatgtgactaaattgcccagtgttcaaagatatcatgcacactgtgaccagaggtggcttctatactgacatagaagatacagtggagagtgatccatttatagattgttggatatctaccacacatgcaatcttaaccctgaagataactggtcaaccaagctagaataagctctacatccagctgtattatgtcctataaatttttcccatattttatgtcactagcttctagtcatgttggctggcacagtccgtaagagttttatctgtgccagtggagcaaagatggtgatttctgttctataggagccagggttcctacagccacaaataaaatcatctgctgaaaacctaagagcattggcatctgctgagagagcatgattcattgaagtgatcccccaaattcttgagttcctggttttccctgctgttataaaactagatccacagcatgaggtatatacagagtccttgagagatataaattggagggaaactttagctttgatctagtattgaatttgggattgaacagcatcattcttctaaccccacttggctttttgagcctgggagagctgtgatatttctttggaatgctctaaccatttggatgaaagaccgtttgaagtggcaactgtggatttggaaggatgagttctatcgttaaagggcgagtgtgctgcaccataacacctaaccctaactccaaatgatgaaaaagggtgtgggtttagtttaaaaatatatatagatgtatacatctatatatacacacagagaattaatgaacaattttatctggttatatatcagtgtcaccacatcagctgtttaagtattctggatactagatctttctgtagaaggacccatccagtatgaattatttgcccttctgatcttccctgtcccccttctctccactctctttccactggctctgcaggggtctgtatctttgcccccatcatgctggactataataattgtgttacttgtctgcctgcagtattggatttatcttgaagccagaaaggtatcttatttcagttttgtgtacttggcacccagtaggtcttcacaaaatactgaattaatgaaatccaacagaaaacccagttagaacccagctcctgggttatagaaaatcaaatatgtgacaattcaaaatgtatcttccaaagcagtgtgttctgtgatgatgaaatgtcctatatctgtgttgtccaatacggtagccactagtccatgtggcttttgagcatatgaaatgtggtttgtgcaacagaggacctgaaattttcattttatttaattttaaataaacgtaaatagctacatgtcttagtggctaccattttggaccacacagccccaaggcctcacatctttatcctttaagaaccagatacaactttgttagccaggaaagcaggcattcatctttttcttaacatgatcatagaggctgagaatgtggggaggttgtggatgatacaatacccatgtctgttttctctttataatgagatacgtcaaggccaaggattctagtttctcttagtttgggaacctggagagaatttggactttgagttgcattcctctcacctcagtccccagaaagtcatgtgacaaaataagattgagctctaacatctctgctcacaaatcccaagtgtctgaagctctttaagatactgacttgctagtgaacttgaaccatattgtgcactggttccctttttctttttttgagacggagtcttgctctgtcgcccaggctggaagttcagtggcgcaatctcggctcaccgcaacctcttcctcctgggttcaagcgattcccttgcctcagcctcccaagtagctgggactacaggtgcccaccaccacacccggctaattttttgtatttttagtagagacggggttttactgtgttagccaggatggttcccattttatatagtttccccaatccacttcagggaagttggtcttcctaaaaacagctgctcatcttttgaaattaaaggaagcacagctttcttatgaagccctgatattttttattttctaatgaactaaagagaaatctagtaatgagttttcatagtcactttccataggtttaagcgaatgctagtttaaaaggaatgctcactaaaatgaaaacattcatctatggtgttttatgctgggttgtcattccatgacaactatgaagaccatttgggggattttttttttttttttttttttttttttgctggcttaatgtgcttgccctaaagtaatgaagtgcccttgattgctgctaaacaccataatgcgtttaaagttcaatttccccgacaagccatttacttaagggtctggataatataaacagagacaggaggttaggagaggtactgacattatcctgaggccagtgctgcctttactgaaacgtaaatgtctccaaactgaaaacgtcacctggctctgcccctgaggcaggtctttatggacatctcaagtaaaagtttattttaaaaatgaatacaagtctcgtcttttcaagattaagagtgacttacggctgtctctccttcattccacttcatggatgttcattttggttttgtttttttcttctgttcttttttctccttcaagtacttaaatatcacccaccagttctgggttctgactctgaacgtgtgtgtcggggaagggggcaggtggaagccggggaggaggaggactgtgaatgaattgcttgggctgactgggctggggggaagcatttttattaaaaatttgagataatttctgatgtcaacttgaatgaaacttgagtagacccacttgagtggctcttggtgactttgttcttcactgaattatggaccaaaatacctgtgacctttccaaaacaatcaccttgctatttgtttgaacctggcgacggcataattgctgtatcagattctcccagttgccccggaggtccagggcttggggaaagccgttggttgccacagcagcagacgtattgaaaccccagaactgtgaggctggagacgacctgactgttgcttttcttcacagagctgcagcttcactgctgtcctctcttttgactgtgttagtggaatgagtgcttcttgttggcacttgagcggggctccccccaccactcagtcgatcaggaagctctagaactgtaactaccttataactctttgtcaattgactgctctgccattcactacccttccagattctgagcaaattaagttacattcccttttggagcctcagggtcctcaccgcagaatgtgagatcacggtaactaccacactggcccttgggatgtcgaagtattaatattaaccatagagcctgagaggggagatggaaaattgtaagccttctctgtgaatatggggtattcttgaagaccagaggtgttcttgcccgtaacggctatattttctctcctttgggttcaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgtaagtatccggttccctttaaaaatgcatctaaggcctggcgtggtggctcatgcctgtcatcccagcaatttgggaggctgaggcaggcagatcacctgaagtcaggagttcaagaccagcctggccaacatggtgaaacgccacctctactaaaaatacaaaaaaaaatttagctgggcgtggtggtgcgtgcctgtaatcctagctacttgggaggctgaggcaggagaaccagttgaacccaggaggtggatgttgcggtgagctggtgagccgagatggcaacactgcactccagcctgggtgacagagtgatactttgtttaaaaaaaaagtatctgagatgcaaccacctcatgatgtttttcagaaagactacagtgtgctttcctagcagaagatgaatgcttttacttaaagctcactttatgtagttagaaaaaggttcatgagagaaggaaaaagaaagggcctagaatatggtagctgtttaggccccagggtggaatgttacttgggaatggtaaggtgcacacataggacactccacacatggtagctgtggacatggggagctgtgacatggtgataggtgatgctgccgattgtctcaacagaattgtgttgttcccaagtaacagatgcctccagctttctcccaggaagtgaccatccctggaatggtaggagccctgttgaggactgaccccaactctaagcctacaggagcagtattttaacattaactcttccagcagaagagcagatcccagggcatcctccattgcagaagagcagatcccagggcatcctccattgcagaagagaggaaggtccaggggtttagcagcagatctctgcctttctttctggaaacattctcaatggagtcgcagtgactcccacacatagattcttgtagctgtgcaagctcagcagcaatctacttatttccttcacatgtcttcccctttctccatttccttctaccgtttctttttcttcccttgaatcccaaagttccagtgttagtgtgtcttatgattataagaaacttcttcaccagactgaaaaagacatgaatgaatttttatggaatggtcatggagtcatgttggagactcttcagtccttagggaattttattctttcttatctgttcacaaatgacctccaaagaaatgaacacaggttggggagattataaggagggctcaagcaggacaggggactcactgagttccaactatgtgcaaagaagaaatgtttaccaagactgaacctgggaaaggtgtgttgatttaattaggtagtgatctcagtctgtggctctcaaacttctgagaagctttaagaaaatccccatgccttaccccagaccaattaggacataatctctgggggcgggatccaggtaccagtattttccaagctccccaggtgattccagtgggcagccgaaggctgaggacatgtcatttgtctttgttagcttttgtgggacaaactgcattgtgaattaactttctgtatcttaaacctactcgacctactactatttgtgtggtgggagtcacagtgcaaaagacatctccccagattaccccctaaagaagccctgagtgcctacttaggggttttatcagagtgacattaaccactaggcctggttgggaggcattttgaaagggcagaaagaacatgttgtccattgggccagggttcagatgctggctttgccactaactgtgtatcctccgatgaggagcttaactcctcaatgcctgtgttttacttatgtgcaaaatgaggattctaacccttgccgcccaggactcaggtaaggattaaaagattacaactggatgctgccctgagcaaaggaaacatcattcccaccttggaaggaaggcccaggttgctgggacatgggcagggatgccgcccaggatgccccacaagtccatcaaagccatcagtggggcgagtgacgcactcacaggaacatccccctcatgtcctctctccagcgtccagaaacgtagtcactaccaggcagtgaatttaatggttcaggatctcttcttctctttgtaggatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatggtgagttgaacctctgataactgattgtttgatatacaaccagagccatgccttgatgtatttccttgtatttggcaaaagctaccaggtatcgagcgtgaatggagggtccatgacacaaatattggctttaccaatttagagttaggactataaaaaccttcaacatgctattgatagtaaactaaagtctatggctggcagaaataaatcaaatgttttcatcagtgtaaaggtgaaaagggtgctgaagatttttcaaatgccaagttcccactatagaaggaggtaactttcatgtggtctcagtgctcccctttggttgtctttaaatatggatcatagccataaagacatacatgaaccatggaaaatcgtcctgatccttctgtaaatacttaccagtacctgctgtacagagcgcctagctgggctttgctagccactagaggtgcaaagattaaaacacaggctgctttctcaagcagcttatagtctaagacaggggttagcaaactaggggctgtgggccaaatttgacctactacctgtttttgtacagctcaagagccaagaatttttttttttttcttttttttttttttttgagacggagcatcactctgtctccaaggctggggagggcagtgtcgcgatctccactaactgcaacctctgcctcccgggttcaagcgattctcctgcctcagcctcctgtacaagtcaggggaatggttacttttgtaggggaaggaggcagctgttaaataaaatgcctgtggaaagcagagggaaaatagccacaaatagtgggaatcctcctccaaaggaaaaaaaaaccaaaaacatctcctcacagctttaaaatgacagctttccccctcacttctacccatcaagtttcaaaaatagaggtctagtttccaccagggcacagcattaagtcatccactgcctgatgtttaacatatttggatcctttgagcattggtcaggacacagtacatggtggagaggagaggagcttgtttgtacttgagctagtggcacttcacctagagatggggacactgtgagggatccacagcccacctagcatggcccgcttttagctcttatgtcagattttgttggagaaagtcgaaagcccccttagactggagaggagcttgaccatcttgcttgatttcattgccagtcattcatgcgctgtctgcatctctggccactggcacctcatgtgcttccgtttcatccatacgcttaacagatcacaatgctgacctgccttggagggtgtgaggaagatgcaggtgacggggcagggctgaggatgctggggacagaaacaggacagaaagtcatgtgaggtggagaaggtggatgagatctgcccgctagggaagcaaagctgccactccatcaccaaaggcctttgtctcctcagtcctgtgaacccaaaagtatctgaaacaggtatcagccaatttagaaagtttattttgccaaagttaaggatgcacccatgacacagcctcaggaggtccggacaacatgggcccaaggtggtcagggcacagcttggttttatacattttagggagacgtgagacatttatcaatgaatgtaagatgtacattggttccgtccagaaaggtggggacaactcgaagcagggagggggcttccaggtcacaagtaggtgagagacaactggttgcattcttttgggtctctgattagcctttcattgaatatacaattcacatgggagaggagggtagaggaatagtcacttatgcctggtctggcttggtgaaaagacagggcagaggaagcaatcagatatgcatttgtctcacatgagcctcagagggatgactttgagctctgtcctttgtccacgaggaatttccttgtgggcaaattgtgagggaggtatgtagctttatctttgtgctatcttgtttaggaatagaatgggggatttgcctgtcgcagttcccagcttgacttttccctttggcttagtgatttgggggtctggagatttttctttcgtagtcctgtgtgggaggtttgtgcccaggaactcactgaggaagcagctctggacgctagaggcctccatgacagggccagctcgcagcggggacctctgggagggggacagtggccttccctctggagtcctggcctctgacagaagggaaggctcactgaagccaagaaccaccagctccctcctgctcaggtcctgttttcttttgaagggaaagaaacctagtctggagcagcagtgggaggaagtgggaggtggaactgctgaaatctgcttctctgaatatttttggagatgcaaatgcttccttgcagtgcaagggaaagtgtctcgtttctgcagtttcctggcattgtgaccatcaggaggtggcctccaaccgcccaggtatctcctgcagcacagaaagttaggggtgaccatcaggtctccaccatcagcttcaaaatagaaaagccaaactagcactccacaccctctgtgggcgcgccttctgagaacacaaataccacgtttttgaggccgcctcacaaagctctctgaaaagtggtcaaggcagaggaaagccaagcaacgggattctattcttcctggattgcccatgacagtgtgtgggtgaacacctgaagctttttccctaagccgttgctttgcttgcaaagctgctgtgaatcttagagacaaaagaaaagtagaggaaaatgagaattttatagatcgagcattaagcttgtattcgtgattatttgaaacttttggtaattttgcagaatcaggaaactagcaaagttctttttgagagggcttcttgtggcaattgctattctctgtgagccaacctgttacgaaaaataaaggtaacttttgagaaattaatatgaagttataattcagtggtatatggaatacatccagaatctatcccatgttaagtagcatgttctgcattttcagaacggctatttagaaagagcacctcttgagaggctgccactgattagctctgtgaccttggatgagtgagatcacctcttggggtctcctgtccttgttagttaagagtgacccgaaaggccctgacattgcttcgggcactccaattctagatcctctagctctggggaatgtggctggctcttacttcccctgctcccgtgctggcttttccttcttgctaccaatgccggggcgagggtccccacaatgtgttccacaggtcagtattgggcctgaaaatgcacaatccttccacttaggggacacacatctacctgtttcagtgatgattgtccttcctcttgttttggcctagttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtacttccttctaattcacccctcccccagttatttcattatcctctcgtgcatatgtctggacctaattattacatgcgcatccttttaattgtcatgatctgtttcatcccttctattagagtaattttatacttttcccttcaatatgctattttctgggtggaaacttcagggaggcttttagcttgctaggtatcaaaatttcgttatattttcatgttaagtgtgtagtgaaagaagcttttcttaatatgaaactactttataatgcagttcaatcaaaaaagacttctggatctccgctacaaaaagattgtattttttctttattttcagttttataacatccaactttccattcaaaataatattgcacacattgtataattcaattaatttgcacatccaactcctcaaatctggtctttttaaaatgaccaactgcttaaacttcatctgtattgaaaaatacaacattagatccagccatattttaaagtcatcagaacatactctataaatcattatcagctgttagaaaccagttcaaacattttctaatgagtgagatccttacaatggggatctaaggttggttcattgtgacaaaccccagaagagaccactggctcctcctgtcagttaatttgggacttgacttcgctgctgagtaagagagggcagctgagtaagagggcagcatcctgagggaggagtctaattactgcttccagccaccatggtaggaaatcttttcttggcagaaacaaccgggggtgggggggaatagctttcatcagaattgaagaggaaataactgtccttccagagcttttctgaagagagatgactatttcatttttgctgtttttctcatgtggcttagtctcaacatcttaccttacaacataatactaaatttgcttgaaactacctatcagactaacctcttctcacaaagaccaaggctgaacaacactgttctttatgatagagctaaaaacggagcctaaagttggctgttaaagttatttgtaaatgaatatctaaatgtatatcattctcctattccttaaaagtaagtgttttgccacaaatttttggtaatcagcaatcatctttttaaatcctctatatttgcctatttattgttatagttactggtttcactgataatttggggtaatttcccatgcttctgaagtataaagatgtactcttggcccgtgtcaaggatgaaaggaataaggattttttttcttctaatactcctttccttaacctcctaggagtgtttaatatttaagcacaaacttatgcattaaaggggaaaaaaagcagcagcccactggacaactgtcattgcagaggagcctcagggtttaagtgagagagaaatcatagactctgcttgtcccaccctctggggtaaaggacagtagtgttttttctttttaaaaaatttccggccacgcacgatggctcatgcctgtaatcccagcactttgggaggctgaggcgggtggatcacgaggtcgggagttcaaagaccagcctggctaagatggtgaaaccccgtctctactaaaaatacaaaacttagctgggcatggcggcaggcacctgtaatcccagctagttgggaggctgaggcagagaactgcttgaacccgggaggtggaggctgcagtgagccaatattgcagcactccactccagcctgggcgacagagcaagactgtctcaaaaaaaaaaaaaaacaaaccaatttgattttcagtccaaaaatattttctaatacgtttataagacataataaaaatgaatataaaaacaaagacaaagtacaaatccagagttttttattggattcccacaaacataaattactccgtcaaattgccatgaaagtttgagtgtatacttgcaattttggaacttaactcctggcagaccagtaacagagcttggacagcaaggccacagaccacagcattcatgaggaaatgtattttgacctcaatgtgataaaatgctttatgagggggttgtcctgcagtaactatagggaaagcctggctttgaaaattaatgtttacaaatatgaacttccaaatgtgaaccctcactgaataaagcacaatttgtaggggaaaaaaatatcaggctgtttaaatctcttatggactagttggctttgcttttggcctattgttcaaatggggctatttattccaaaatgcttgttctgcagacagcagatccatcaattcttaatgaagaacatagcctacaattacactgtaactggcatccgaagtggtggggtctgttaagaacatgaggcgctatagtttgtactaacatcctattggggttcattttacaggtatcattccttggaatgctttccccggaaaaatatgtggctctgccctggagaacatctgcaacacaaacgaggtaaactcatcacagttcagaataacccttgagtattaggctgagaaaaaagggttctcccagctgtagaaagagcgagagagatggttaaaatgccattaaggaaagctccttgtttagaatctttaagatagagctatatgtaaccatcactattcagccatttttgacctacaaaaatggtcacttcatatggtccaacacatttggtgagaatccttaagaagtggagggcttttcctttgggcaataatttagaggtgatcccaaacctagaaatctaataatatatctagattcttctctcacctcttctacttctactctttctactttgaaagattttcaaagtagaacacctgtcacagaacggatgtaagttaattttcatagaggagtccctctatttcatagaggaatttgtgtatatacccaacttttaataaatgaggccacagttaatcatttatatttctggaatgacttgctacttctctaattctcattcgtccttactagggagtgtgtcctaacaatttggtttaaattgtctcagccctagaacattcttcagtcattggcttgtaactgtttataaaggaaaattcttaaatgcattcgtaggtgcttgtatatttaagaaaatcctggcaagcttttaagaagcagtgagttacagaaataatcagctcctaccctatctgacttgtcaatttgtatatccataatatgcagtggcttgaagcagggctccccaccgtggctgcatgttacagccatcaaggcagcactatgttatactgatggctgaggcccagcccttaggtattcagatttaatcgatttggggggcagtctgggcatcagaaagtttttaaagctcctcgggtgattccaccatgaggccagagcatgaagagaaggcaggcctgtgcccagtcttgcagagaagagctgcaaaggagacagatgaagcagcaccccacaatgagtgtaggccatttcatttaacatcaaatgcttatgttgatgccctgttcttttgtagttctacatgtcctatcacctgttcattgtggcctgtgcaggagctggtgccaccgtcattgccctggtgagtaatggccccaagaccaccctagtctagcctcctccctccagcttctaaatgacagatttcccttccagcttttaccagcctattgaagccaatgattctggcactcaaccttggttaactggcgcctgtgttaacttaccacatgtagtttacagaaagtattagttggttgccttggcactgattgtaggtgatgtaatttggactctggaaagaaaagagggtatcaacacctatcaactaggcctagcatattaccttgttgcactgagcacttagcttcatgacttcagtcgcagacagatgcaatgctcacgtgaggcattacccatttctttgccaagggatattaatttacaagtggagatatgcacatatacatacatttatatagtcactcatacagggtagctgtgttccataaagtcacctcaagcaatgaattagcgaatgctggaccactgctcctaggggaaatacatggctaggtttctgtgagcctctggtcacatcattttcagcaacctatcaacacataagcttgtttcgtgtgtttctgtgtaaatacaccgtatttaatatatattgttgattccttaatattgaattcatggccaatagctctatccctatgcctgaatgaagcttctctaatgaacattttctctggtcaggcagtttgcaaccttcttgcacttagggactctagacagcactgcagcactatgcttgggagccattttaagcagcaaaatcacccacaaaatgcacaaaaatgtgaaaaacgtggcactaaatatacttcgagtatacttatttacagtctgagagctgaaacaagaaggcagagtattgccttgttcagcctcagctgggaatgtgcataccgggcaactcaactttcaccgctctgcacatgtctgctaataactgcgaaagaagtgcctcaagtattaaggattacaaatgaatcttagcaagtaggcagtcacaaatgtggaatctacaagtaatgaaaatcaactgtataaatacacgctcttatgtatgtatgtttgtatacatgtaattttggagggcttggtttgtgatttcaggaaaaccaactaagattggtagagcaagggaaaaatctcagctgcttgtaaattattcattcccagtttttctgaccattaaatccccttagaatctatgaaaaaaaccacctttaaaatcatggggtgacctgttcttttggttgagcaacagggaggaaagataactgcctgctgctgagcaggtggttttggaaagatgagaggattaaggcatttagcttcatccttctcatgctgttgacccagctctctgtcttgttattcttgaaacgcatccaagtccttttagtaaactcactgagggcagaaccaatgacttacattgtacatgtgtgatgagaaaaagtttgtgtgtgctagataggaaaattgtctgttgtgattttaagtgggaaaaaaacaccttagactatgagcaggcacccgtccccacccaagtttagaagtgtcatggcatcggccctcactgcctgtatcttactgtcctgttttgttctcttccaccagctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaa

SEQ ID NO: 3061 - DNA, 33874 bp, human
gaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggtacccagcgctctgacaatagcctgtttaaagcttttcactggggggtgcttaaaaagggttagctgggttttgtctctcttttaaaatggctctgagacaatccctatggcatggtcttgctttcagggttgatttttttcctgtgggctgatgttaagttaatagagcagcctttcttcaatccattcctgttccaaatctttctaccgacgtgatatttcatagagggatgtctatagtttgtcaccttgggctgatgcattggggaaactgtctttttttattaatataattaatcgtaacttaggtcttgtgtcctgcatgttatattccaggaacgtggaatgtgtagttttctgctaatgctgaggaggaactggaggggcatgcatgttaattctgctttggttccgctaatgctgtagtgatttgggcattctctaattttcttattctaatatgattgctctttcttgtatcaggccctgactacgacatgtaataatcatttacagttggagcttcagagaggggacatcagctctgtcacccagtgctgatggaaaggcagggcgggggatcttctgctaattatgacttggagactggggggaagaaaattgataaaggtcctatttcttaaagagaatcttagaacgtaccacaattttcatatacagaatggttttttggagaataaagtgtttttgcagtaagaaaatggcagaaaggaactaaaattaatctcttttttctaaataatgactgatttcaagtttgatgtcccatagaatcggctcagccactgttaggttaatggatctcactgcattgtaattttccctcactcaaagtcatagactgtcataaatgcccaaaaacatattctgtaaccgcagtggctctaatataaaaagccatcatgctaaggttatttctcacagcccttgcgtccactgatagtcactaaagagtaattcgccagtacggggacaaaacttcgttttatttataaagatacaggctgaaccatatgaaattgctgatagtcaaccattttaaacctacaaaaacggcaattacatgtacttcagcttcacagtatgctggggtaaagactgcttgtttttatataaaatttctttggtacacaataatattttatcctaaacagagcaattttactttttaaattaatttttttaggtatcacacaatacacataacataaaatttaccattttaagtatacgattcagtggcattaagtacatagcaccttaattttaaaatcgtttgtttagttcaatcctcttaccaaatctacacctccccaccaaaaacccagcctgtattttcttgtgtgtctttaaaaaaaaaaaatcttcatcaatgaccaaatagctataagagaagctcttgggaatatttatcaagatgaagaagtgagatcaaagttttttccatgatgactagagactaagttgattgcatgttgtcggggtatgataatgtaatagcattgtcccaaggaagcctatcacgattttatcctaaaatgatgattttacttagtacatacttttaatttttattaatgtggtattcaaccatggcagataaaaccgttttggtctttgcaaaaaaatcccttttttaaatttctctctgaaaggaagcaaaggtcatataaccaatataaaatcattactacacaactgtgtatcttatcacttagtcttatggactgctattattttatgtcaattaaatcttatttaataacagatctacaggttgctagtacatccctgacaacccgtatatgaaaagtcattagttgtgattttagagacaaaattagaagcaaaagataatttgtgaaggaactttaaaaattacctaaatgtataaacactagctgcttgttaaataattcaaaaatatcacactaccagaagctagtgtgacatgtatggtacatgcttgaataagaatacaagccaggggatttgtttttcctgatctacagcaagaggggttgtgattgttgtgtgacccaccataattgttgatctggagggtggcttatctaatctgcatttagatgaacaagttcatatgctggctacacaaaatcaaagcccacacaagacactttgtagtttcccaatttgctcacccatcatcattaaggtacacataggataaaatgatagccacaaatgtttctgcgtgattgtcacatcagtattccttcagatttaactttaagtttattaaaaaattatttttccattgaaattaacatttgaaaacttgacataattatttatagaatgtgttatataattcttgagctggtggatccgttttttatgtttttcttttaagcctttcagcaaaggattttattcattaaatttaatcctgtaaattttgtcactttacgcagagttttttatgcacatatatattttttttcctgtgtttctcctttcccatctgttttcagtggttggtgatggagtgatgcctgtctcttaatttggggcattattgcccaatggctaatacccaatagcatgtgaattaatatctttggataattattgcagtgtctattaagaactaagaatgtaaattaaacttagctttataaattgaccttgcttttctagttgggatctttcctgggagtttcagcgggacaacacaacccagctattgtgattcactaactcctacaaagagagctctttctttaaacttaatcacaatgactttgtttctactttagacaaaattaatccatgtccttaaaaaaggaaagcatttgtgttttttcagtctgatagttttcatcacagcatgctaccagataccaaaattcacaagagtatttagtagatatttagggatttttaaggaaaacaagcagattttcttagatggatgtaagaaatgccaaattattacaaatgatagtttttaaattaaaagcattaaagtgtgaagattgagtaagcagattcactgacatggaataagcagaggaaatgaataagacagaatcaaaagaaatagatcatggaacccaataataaaaagatggagagtcggtttccattgatttcagtggagtattacttgttgtcatttcatttgtgaaaataaatgcatctgaaattgctgagagtggataatcactgagtagaaaaacaattgaatcataacaactttgtatgctctattatgggggaaaaatctatctgttatgaaaattattttcattatatgtaggtaattgaattctactgaaacaattatagtcaggttagttaacttcctatgaatcgttgctgaaataaattacaggcatcaaattaaattcctaaccacacaggaagaaaaatatagtgaatgggaaacaatgtgtaatttaaaataaattacaggatatagtcaaagtaagaaatgaatttaaattattgacttccttaaaaaattaatacatctattttaatctttttgatcaaatagatataatttcttatttttttttttaatttagcaaaatgtatgcacttttggctctcatttttcgtttaggaagaaaagcactcctctagaatatacgacttgtgtgattaaaaacccaaagggacacataacacacgtcacactattcctgatgatctgcgaattattgcattttgaaatttgtgttgacattttctaacttggctatataaatatggtacagaggaagttttagatgcagttattatctgtaagaatttgccaaggtggacatctgaagagttggtgtctggggaataggctgtagagaaaagtggctggccagatggtgcggaacatatgtggtaggtatgatacagcttcctttgattttttttttttttttttagaacatttaaatgtggaaaagatctcaacgagccatttggtacatcttctacttttacattattaattccattaggatttttttaaagacttggccttgctatttcgttagaaaaagaattctgggccatttctggaaatttagatttgccttccctgaaattgagtgtaaaccctgaattaagattattatgattttcaagatcacatttctctgttatttggaagtacagggtcaatttagactaaatgatcttaataaagtgactttgtcttgatgtatctgagaacatgcaaaataaccagtgtccccatgacttaaacttcccctctctgtgactgtgatggattggattggattgttacaaagacactctcgcttttttctcctttggaccaaatgtacatacatgggagatagttggccaggagtagggatggccatggaacggaggaagaaagtgaccacaccgactgtttttaagagaggaaggttacaatcccagtttcacaaatgtgctttgttgttcattcatttattcgtttaatggtgttctctgccgggtgtggtggctcacgcctgtaatcccaccactttgggaggccgaggcgggcggatcaagaggtcaagagatcgagaccatcctggctaacatggtgaaacccagtctctactaaaaatacaaaaacaaaattagccgggcgtggtggtgtgtgcctgtaatcccagctactcaggaggctgaggcaggagaatggcgtgaacccgagaggcggaggttgcagtgagccgagatagtgccgctgcactccagcctgggtgacagagcgagactctgtctcaaaaaaaaaaaaaaaaaaagaaagaaaagaaaagtgttctcctttgaaatgtcattcttcctctgtcccttcagctcacgttacaggagtacaggggtgctaagtcatcgtagggaccattaggggtagtataatcttggttttaataataattttgctgattggtggcagattaaatagcagacaaaatgccatagacgagaattttgatccttagccagctgagtgatatttctcgtcaaagagtgtataagagaaaatgtaataatttcctatttgataagctgattttatcaattgcattaactgctttatgtagccaagccttattatgctgtatttaaaatcaagggtcaacacactttttccgtaaaggtcagatagtaagtattttaggtgctgcagaccactcagtgtctgttgtaactattcaaatctgccactatagcatgaaagcagccctagatagtatgtaaacaaatgggtgcaactgtgttccaataaaaccttataaataaaaacagatggctataatttaccaacctttactatatttatagcattgttatggcattccttaatattttaaataatagctaaaaatgaaagataacaaatatagctttgaaagaccttgctcagtgaatatggtctttcttggaagctcagtgtttgtcacttagttgcttccggtgataatttcctaggtgctaagaagcatgacagtctgaagttcatttgttcagccttctcgctaaattacattaaataagtaaatggggaaaaataaacaaggcattgttttgctttcctttttgcaatttccccttgtttcatgcccacctttggcaatgaccactcacagctgtgtctgtcttcataagccaccactggtcacctcatctctatcttcactctcttagggggaacattttgcagttttccctctgcagggcataaaccattttcccatttcttgccaggtgcccagaatcaagacattttaaaagaccttttgagccaaggcatcctcttggaatcctgtgactgccttttaggtgttgggatcctgtccttgggattaaaatgtatactgtgttttttgaaattttataaataactttatatttaatgcctttatttaaatttggctcaaaaatataaaatagaagtgatttttcttttctttcatatctaaagatttactgttgtaaaaaggcccctccagaagtgtaagtccaggggatttggaacacatccatccagttgccgatcccatcggtgtgtcttctggatctattctttttttttttttttttttttaaatcctgaattaagggtcttaggcatggctgccatgtttttctcagaaaacacgttaacattgagcagtccatggtttttcattgtcattgcctagcagcctatgcttgcttgcctgaacatctggagacttaccccatccatatgaggagatgagcacagagcatggatgaatcttctgcagagataccctgaattgcatggcctggcttgggtaaaagtcagcatggtgggggatctagaggtccatttctggtccacagggtcccagggtgctcccttcctttcaaccaaatatttattcagccagcgtttattgggcacctgtgtgctgagtatgtagagacaaattttttaaaaggataaaaatttccagatcaaaagtgatagaactacttagaatcctcttgcttaggggtctatgtggagggctcatagccccctttaccaagaggaaatcagatcataccatgaagtgccttgaccttctgttttttttctgtcagccccactgggttttcttgcctttggagaatgtagcaacatctatttctgagagagaatctcctgaacagtaaagcaaaaatctaaatctgttttttgggggttttttttctttctttttttgagacagagtctcaccctgtcacccaggctggagtgcagtggcatgatctcagctcactgcaacctccacctcccaggttaaagtgattctcctgcctcagcctccagagtagctgggactataggcgtatgccaccatgcccggctaattttttttttttttttcctgagatggagttttactctttttttttttttttttgcccaggctggaatgcagtggcgcgatctcaactcactgcaacctccatctcctgggttcaagcaattcttctgcctcagcctcctgggtagctgggactacaagtgtgcgccactatgcccagctaatttttgtatttttagtagagacagggtttcaccatgttggccaggctggtatcaaactcctcacctcaggtgatctggctgcctcggcctcccagagtgttggaattacaggcatgagccaccacacctggccaattttttaatttttattttttatatattttttttatttttagtacagacagagtttcaccatgttggccaggctggttttgaactcctgacctcaagtgatccgcccgccttggcctcccaaagtgctgggattacaggtgtgagccaccgcacccagcccacaaaaatctcaatctaaggaagactgaaagttaagaaattttaagaagcctgagataacatcagtagcttaggacctggaccgtttctttaggagacacagaagcacaactcaactgcaaatgcacctcagaaaaactctcattgggttaactgttgcctcagcagaagagtagaaaattgcaatacatgcagaggtcacagtaggatgtatggtggtttccaaagtgtgccctcttgagtgaaattgctaaggttcacattcaggcttctctacctcctggctgaaagatcttgggcaagtgatcattaccttctccttgcccttgggttgttcccttgtaaaaatggaataataatagtacctatttcagagggtggttgtgacaaatgtaataagtaccacatgctgagtgcagtgcatagtacatcataagcactccataaatttttgctgtcatcatcattgaccacaaaaatagtttcattgtgcagttctgatcttatcccagcatcttttctgtacctccctaccctggttttaaatgagttatgtataccttaccttgaagtcaaaaagattttttctaaaacattctagaaaagcaggtttctgcttccaaacttgaaataccttacaagttttcagagattgtggagagtggagttgggattttataaaggctttgtgaggttttacttgcctcacactgtggctttagtaggttcttctcctcagagacctgagctgccagatggtgcattatgacctgatcttctgatggaatcattacccacatcaatggcacaatttttttttaatccttaaatatttgtggtgccccagaggatataaccccttattaggttttatgggattctcggagataaactggccatagcgaccttatgatctctttgagatttcaagattgtaattcaactaacttttatgagaagcctactctgtgccaggcaaattggtaggtatttttctttgcaatcccctaagaagtgggaaatattgtatcatattaccagatagagacctgagtcctcagggagtgccagctgtcaccatgtgtgtaattaagcagtggttcgagcccaagaccagtagccctttctgtatagcacatgggagaaaattggaacaggatttaatccagaacattctagactctgacgttctgagtttaagataaggtgacagacaatactgcagacgtcaatgggaggacaagcatttcatccaagaaacagcagaccattaggttgtttgccaggttttctggactagagctgggtacccttacagagagggagcctgcgttcacctttgctagtgcagctggcaataattatagtgctctgttagtgctctgttggtctgaaaaggaaacagaaagaaaaatattattgtgaggagccaaattttcactataaatagtatcttccccaaatgagcattttaagaagcaggatatggtgtgtgttgggggaaagatgtagaaaataaagatcattttggtgatttacataaacttcaatttagaaacggaggacattctcaatggatcatgctggtactgaagggttgcatttcaatagcatattttttaaactccccatttcctttctatggtaaagaataaataaaaatgctgatatagaatctttgctggagatagagacactgactctttgccacctgaaattggcagtgaacagcagagctgaaatggaaattggcaggtaccactggatgtacccaggctcaaagaaccaccagtaccatcccgtgccaaccctgggggacagggctagccccttgagcagtccaggtaaatacagccttggggtgaattctaatagcaagtcaactgttatctttaatattatttgtaatggctcttgcagcttggtgatattttatgttttgcttggtgcattaatttgttcacacgggcatgggtggaattcgccctataaacattttttaatcatctttctttttctctctccctctccattccaccccatctttctccactttcttctccttcttccctcttccctctttcaccttcaatcacttcgtcttctcaaagggaacaatgtacagtgagatatgcctttggttaaccatgaaatttccaatgcctgaaccaataatgggggaggggggccacccacatcccccatgtggccaagaactgggccagggccttcaaggagccttggccctgagagtactgtgagtgtccccaaatgtcttcccagccctgctgctctgcaccaccctctcacctcagtcattgcctttgagaaagagaaatcaaagctgtgaaagtaggattggataaccatgtacccgattcccatcaggtaggttcagtgggtccggtttccattttccttgctcgtgaggaacattggccattcagaaccgctaggtgctggatctgggtgaggtgtgcgacagctgatttggggacctagaaggggcaaaaggtgaagcagtatgaacatccaacctcccacgttcccaaaaccaacacaagttgtaatgcccagctcagttagctaaaactcagtgattttgccagtgtacaaccatagttcaaactacataaaatgcagacataaagggctggtggtaggtcggataaacacagtaagaggcttaaagtatttctgtgattttgcatcaatccataacatttctcccaaatgcttgctaactttttcaggagtaaatgtagcatggtacagctccagaaagggcaatcccaaggtacaatgtaagttacccattgaattacaaagtcataaaatccatgattaataaaaccttttcctttaaaatctaaattgtgttgtcaggttaattaaaatgaaatctgacgttggatttagttctgtcttgggttatgcattccttcatctgtcctatggctatcaggtgttggttctgtgtgtgcctgtgcagcgctggctaaatagggtgagcatgaggtgacatcagccatccattctcatggatcctataaagaatatggagggttctggaatcttgatttaaaaaaagtcattagacgtgatatatccatacaatagctactattcagcaataaaaaggaatgaaatatttgtgcatgctacaacatggatgaacctcaaaaacatcatgctaagtgaaagaagccagacacaagagaccaaatgttctaccactctgtttatgttaaatttacagaattggtgagataagaagtaggttaatggttgccagaggctgagagaagggaggattggggagcaactacagatgggtacaagggatcatttttgctgtgatgaaaatgttctaaaattagattgtggcgatggtcacacaacgctgtacatttactcaaagtcattgaattgtatacttgaaacaggtgaattttatagaatataaattatatctcagtaaagctgcttttgaaaaaaaaagcagcaaaaaaaaccatgagatgtgcataattcaagggtggggagcggggaaaggggtattttttaacataacaagaagcccccaagttatcagaaacaactgcttgagggaggagtccctcttcatcttaagagtctttaagagtcttcattttaagagtgttgaatgacatcaggccagctggaaacccagaaaaatacttattcttttctgtattttagttcactaaactggtaaagaataaacacaatatcttattgggggggaataaaagaaacctctatcaattgctcttgaagagttttctccacttgttgagcagttccctgtaaaagcattgcaataatatttgtgtgcttttgatcctacggtgaaacaccagaatctgggcattcatagcagcagtggcagctgagaagaaaaatacgaggctccattttctgtttttctgaaactgatttctttcagaattccaaagaatttgggtttccaaaagataacatagtgcatacatcatgtactgcatgataccaccactgagtgtctctgcagatctaactcattaatctttctggagagcccaagactataaacaactccttgtccattcaggtgagattttggcaccaaggaagaggagatcagaacaggttttgctgccagatgagttaggggagaaaaaaaaattacttttcaagttttttggaattccataatgatatgatgaaagattgtggaagtctaatagtatcaggttgctggtgatactactgcaagcgagaattccatgaactaacaggttcttgcctgagggggagaaacaaaatcactgaatttgatttaaagaattatcttcccagatcctgaaacaatctccacctacacatagttttaactttttgtgtgcattgatggaaataattggaaaaaagatgcctccacggggactgttaatgtctggagctgtctgcagagaccttatgtgtgatagtgtaaagcctacagcgcaggccacagagtgaagggacccactctagccatgccatcgcctttccagacacttacagattttgttgggtcctaaatcaatgccgttgccattctatacttagatctccaaccccaaccagatggtatgaggcaaaaaatagggaattctgtatggctcttttttttttctttttttttttattaatttttttgcagagttgtcagcctttttccatgggggaaaaagaggttttgatacaggctgaccaggaaatttttgccaaaggaaaatgcctctcccactcatgcagttactgtagcagagactgcccttctccaggaacttccttattccccattggaaaggtcatggcggttccagggtccttttcatggttttctttttcttgctactacttcccagtagaattccatctttaggggttagatagttattctttccttatctctttttccttttcaatttttagctgcgttggacatgtagtgtccacatcttttctgccttcaggagatgaaatgatgtatgaccacatgggctacccccgccccccgccccccccgccgtccatgatgctgccctaggggcctggcctgaggtggtggtctgagatgcaggcaagcgatgaagcagggagtagttcatgctaagtctccagtcagtggcatattgtgcttaacattggagggagcacttccagactgttgtagattgtgttacacaggctccagaggatagcctaagacaatctagattctctattccaagtgcgggctgtggaccagcagaatcaacacctccaggagctcgttagaaatgcagagtcccaggtcccacccagccccactgaatcagaatctgcattttcataagacttccaggtagttcctatgcacattaaagcttgagaagcagtaattaagagcaaggtccaagagcaagaagggagaagacaggaaggaattgattatgtgaatttaccctcaagagatctagaaatctttatctttggaaaagataaagaattgctcaaggtattcatcctttcttctttccgtttctatttaggaagaggcatgtctaagcaatgccaaggcagtcattaatctgttgagtcctggctggtttgaaaaacagtgaccttgcttctcttacctgcttgtctcatgagggggtttggggaaggggcagtgaaggtgagaaaggtttgtttctttgtggcaaagtgagggccagaggagaaagtagttgatggaagcttgggagaaattctcaaatgtctctcatctccctctttaatataatccaatgacatgcaagatgccgtgactaaatataggctgccatttttagtggactaagaatggttctttatatacagttaaatctgtaattcagaattcagtctcacaaggaaggagtagaataaccacccacttcacatatcaccaatttccgcctctcaaatccaaaatgctctgatgtttcagttaaaatggccacagataattccagaagtcgggacaaagagcacaccctctacatagggactgtcacagaggatgtcgggagaggagggccctctggagtgttggtatttagcaagaagcccaagtgttgtgatttgcaccacagagaatggattcctgagtcgccacggggttgtggggtgggggcgggtagcagactgacggagggcccagcactgctgttaactcatgttgcaccttgtctgcccagatgtaaccacaggctggctcctgggaactgcagactttatcccttggcccccttctaggctgagcctgggacttctctctcactgatctgctttgtagagggacacctgtagctataagtcctgggaaatgctactggatttttgtcattgttctttagtgtcactctttcctaacctaaggttgtaaggccactaagttcgaggtcttctcccaaaccacttgaaatgtattttaagggggaagaaaaacccttaatccttctgcgtgtaccattccacctctggccatagttgggtgtcgaccataactgacagtctggtcgtgccgtgtgggttctgctggtggtatcattctgtccccagaggctggttgcagaagcttttgtagcttatccagcctaagccagtggatgctctcagtctgtctgatgccttccagttactcaagatatttctgattacatagaggtaaatggtgaacacagtggaagcacgttgtagctcaggctcatgccgtaaagtccctgagatttttagagtactttgccttttgttttctgaaatgtatcaattctttcattttcaaagcacctgcagttttcaccaaaaaagtgccatatacagcagttaacgattttatagtttatttactgactgctatggcagtctttatatatatatatataaaataatttatatatagctgtaaacaaatacttatcgatataagtaatttcttgattgtttttgaacgttccattgtttatgcgctatattgttagtctgtgattagcacctaattatgtaacaatggcttactgtgtgtgtgacatatcagctccctttgtcttttggtcttacctttgcttctcaccttagagtaggcagacagagaaagcagagataaaaagcagatcgatgagtattgagtgttgatctcgggctttctgtcagacatgtctgattgtagggacactgacttggattattcaagactgagtacttctcggtctttgagaagtagtgtcatctggtctttgctgcctttgaaatgtcccttatgttatatgttttcatataaatctaactagagtccattaaaattaattttgctttgaaatcttttgccacccttagaggtaactggaattactctgaagtagctggggagtagctgaaatcagccacttaggtcttcccacctcctcaggctgtgtccttttgggtgccgaagttcactcccaaataagccacatataccctcaccccctgagtgcgtccacgtctatgaaaagcttatatgaattggcttttgtactaaacggaatgctctgggtgtcagagtcatttaggtgggacaaatcttcctctgaagatcatcatgcttgtattttctggagacttccatgaacaatgctttcacccccaaggaccagctctaggggtgaaatgtcaggctggtaggagaggtaatgggatcgaaacaagacttcctgtgtcttgagaaaaccttgtttatattcatgtgctgtttcccagtggcaataaatcgagattcctgtgaggatttgacagacgaggctggtgatgccacccactgtttttgtaaagaaaatgttatcggaaccagccaggcccatttgattgtctgtggctgctttcgtactccactagcagagttgagaagctgcaactatacaccctgcaaagccaaaaatatttgccatctggtcctttacagaaaacaattgccaatccttgaattagaatttgcaaagtgtgtcaaaatgcaatactctatctactgatgttaggcaacacctaaaaactttgctcggcactcagtttcctaaaatcttctccatcaaacatccctcatcctctgccctccaggccccagaatccttgttctctgtggggaatagggactccctgctcacaggctgtcaactaaggctcagcccttcttcagagaatttcttggtactttctagaagctcagcccctctggcctctttcaggtccttctctgagttttcccataataaaccaagtcccgttaagtggatactgtgagctactttcatctagtgttctattcagtgcactttagcaagttttatttcctgtgtatagaaaagatatttgtggtttactaaatgtagtgctggggatcatttctttctttttttttttttttaagtatgaggttccaatgccctgaatcggaatcgctaagaatgctggttaaaaattcagatttcatatgggcatggtggcacacatctgtagtcccagctacttgggaggctaaggcaggaggatcacttgagcccagaagttcaagttcagcctgggcaacatagcaagacccgatctcttaaaaagaaaaatcagattcccagtccccacctaccctctctgcgatgggtcccagaaatttggcccattttaagaagctcccccaggcaattctaatgcacagtaaagtttgaccaccactgctatatacatagaaggccataacccctcattataacatctttggtaaagtatcgtttcagttcagcctgtgtatgtatatgttcaacctgtatatgtatttacagttaagatgctcaaagtcaaacctccacatccttagcagacagtactattgaatttgaagtaaattcctcttgaagtaatgtttcgctattgccactatatctttgtgtataagagccaatgcaaaaacattagattgtaaagctgtaggcaaacatcagagctcaggctgtgtgttagttatcaattgttgcataacaaattcctccaaaacatagtggctagaaacaaaaatgtatattatctcggcttccttaggtcaggagtctggactcagcttagctgtctcagaaactctaatgagatttcagtctcatctgaaggcctaactggggaaggatccacttccaagctcattcatgtggctactggcaggacttggttactttgggactgagggcctcagttcctcacaagctgctggcctaaaacctcccttgatttttttccatgtgtgggctctccatagctacttcatggcatagcagatgacttcatcagatagagagagcaagtgagcaggtaagagaatgtgccagccagagagacaatgctaacaggacagaagtcaattttttgaaacctaatcagggaagtgacatctcatcacttttgccatattctagtcctaagaagtaagctactaggtccagcccacattcaggggaaggaattacacaaggccatgaatgtaggtttgtggggatcattgggggtggtgtcttagctgcctgccacagtctgtataaacatttcacagtgcaaatgcatcctccatctccttaatgatcataacctcttcactttctcaaagcctcacctctcagagaatgtatcactgggttaaatgagtacctggcaggtgtttgacggccttcctgaggtactagactctaagctctctgtgagcagaggtcttcatgccttgctccctgctttggcctggctcgggacctaggaccaagaaagcagtcgttcatagtgttgaatgatgatcactttatttttagcactcatgatgtgtgactctatatgaaattgtctaattttagtgtccattgtgtacatggctcatttcctgggccaggctggtcaagaccttgcactctgagagttgcataggagctcagcaggtgtttgttaagtaagttcagattggctactcgttgtcaggagtttgagaccagtctggccaacatggtgaaaccccatctctactaaaaaaaaaataataataataataatacaaaaatcagccgggagtattggtgggtgcctgtagtcccagctacttgggaggctgagacaggagaatcacttgaacccaggaggcagaggttgcagtgagcagagattgtgccactgcactccagcctggacaacagagcaaggctctgtgtcaaaaaaaaaaaaaaaaaaaaaaaaaaaaaaaaaaaaaaaattaggttggctaatcgaggtttctagaatcatctgcatgtaaatagggttaactttgtgggatgattttcttgaataagaagttctcagcctgagcttcacagtagaaccctggaaggaaggggaggtcttttaaaattccgaagccacatccagaccaagtcattcagaatcttgagggtgggacccaggcatcagcgttcttgaaagctcccccaccaggtgatcctctgtgcagccaaggttgagaaccactgtggtagaccagtgtttcccaatccgggggagtttctgcctttcaggagatgccttttaggcatctagtggtgtagaggtcagggatgctgctaaacatcctacagtgcacaggacggcccctccccaacaaaggatggcccatgccaatagtaccaagagttgagaacccctgggctaggtcctacgctttgagtcaggaaattggttctaagtgaagcagtagaagtccatggggtagctttgtcccagatgttaagcttattgcaggcatggatagcttgataagtctggaatattatatacaatctatgtatcggtgtttcctgaagagaaactcactcttttaaaaggcacgcagtgcataaaccaatacatttaaacctacatatatttatttatgcaacataataccatacacgtgtgtttgcatatagcacgtgctataaacaccctatgcatacagagatgtatgcagggcatatgagtgtgttattgtggttagaggaacaggtatgtcttcctcagcgccctttattttccttccccctcactgtagcctcctgccctctgcttgtctagtaaaagccctaaggcctccctgacccttgctgtccttaccctcagtccagaggatgcctctgctgtgccttgctgcctggagggttcccatcacccaggttaatgtggctcttggctttcaccaccaatccttagtttctcaaaggggttcacaacctttttaaattactagtgtgtcttgtagaaattgaacttcacaaacaggtcttctgaaaacgctttcttgtggtgtaattgatatgcatatggtgcatctctttaaagtgtctgacaagccttgacatacgtgtgtgctcatgaaagcagcaccatgagcagcatggcaatgtggctgccactcccaactctttccatccttcctatgctcccactctccccaagcaaccactgatctgctctccttctctgtggattagtttgcattttctagaatggcccttgtgaagatgtgttcacataaattctctcaccctttctcacccgaatagaaaatgttgcatgatgttgattgcttaatagctccacagctttgtccaatttttatccttcctgcttttactgaagatgtcctgcccccatgaataaacctcagaagacccattctgccaccgcctaccactgaagagttgagcttgcacccactccagtccagcccacacaccagtgccagattcatctcttaaaagcacatcctgagtcacgcctcgcctgctcacaaaccttccctctcttccccttgctgcaaagtgaagcacagaggcttgaggctggcttggacatcttccatggaccaggcaatggggggacctaccttcctgacttctccccaccattaccctggtgtccttgatgaactcggctacaccctgaacgctccccacgtctcccacatcacatgggtcctgctgtccttcctttgtgcttttcatggaatccttctgttcttcaaggcctcttcacctcctgccatccataaacctttgccttagcaacccacaccaaccaaagagatctgtccctacctcactcccccatatccctgtgtcagcactctctttattctactttagtgataccttatgtgtctgtgtgtcttaccgcccccctcaccccacccacaaggatcaaagccaggagggcacacttgcagaccccaccacagtggcttgcacatggcaggtattggacagacactcattgaatggaatggaatccaggaaagtagagacactgtcgcccagatggtcaaggaaactgattgctgctaaagctcaaaattgcagatattaaatacttctcaaatgtctggagtagcctccagattgctgtgctcttaaaatctgtgtcatctggacttagagctggcttcccctactctccattgatctccatgattccttgctgtcccactttaccaggctaaaagcctttgggaaaaccaaagccagttcccacaaaaggcaaaggaagagactaacaagtatctggttgttggatttgtttattcccagtcatggaagcgtatcattgcttttattgacttgcttatcttctgctagtaccatattgcaaatgttagaggctcatctattttaagacttccatagtgttttcacaaaaatgaaaatcccttattaaacagattttaggacaagcttctaaaaggacctgccaaaaagtgatttcctttctatcattagaaatagtttccacattcttatcgttatgtagttgaacttttatgtccaggactgcatgaaagacgtgagaactgagaagcaacctatatttgatttcgcactttgttcttggacaggaagcccctgtcaactgacttcacatctttttaatgcactatattagtggttcacagaactttctgggtgttaggtccctttatgtgcttagaaacagttgaccccaaaacgcctttgctcttctgagttgtgcctataaatattttctatattagaagctagaactgagggctgggcatggtggctcatgcctgtaatcccagcactttgggaggccaacgtgggcagatcacctgaggtcgggagttcaaaaccagcctggtcaacatggcgaaaccccatctctactgaaaatacaaaaattagccaggccagccaggcacagtggctcacacctgtaatctcagcactttgggaggccgaggtgggcggatcacctgaggtcaggagttcgagaccagcctgaccaacatggagaaaccccgtctctactaaaaatacaaaattagccagcatggtggtgcgtgcctgtaatgccagctacttgggaggctgaggcaggagaatcgcttgaacctgggaggctgaggttgcagtgagccgagctggcaccattgcactccagcctgggcaacaagagtgaaactccatctcaaaataaaataaaataataaataaataagccaggcatggcagcatgtgccttaattccagctatttgggaggctgaggcaggagaatcacttgaacccgggaggcagaggttgcactgaactgagatcgtgccactgcactccagcctttgagttttttaagatggagcgagactccatcttaaaaaaaaaaaaaaaaaaagaaaagaaattagaactgagaagtttattacttaataataaacttagtcatttaaaataatagcaaatccattatatgtcaacctaagtaatgtttaggaaagataacgattttcaaaaagaaaataatattttagtgtgaggaataggactgttttacatttttgcaaatctctttaatatctggcttaacagtagacagctggactcttacatctgcctctgcattcattcagaggcatcttggggtatcttgctttggttgaagtatatgaagaaaactcaaatttctcacaggtatgtgcttggagaatggaggagtgttttaatggcctttgcagataattatgaaattcttccttgatactacaccaaaattcagcagctagtggtttcttaaagactacttgtaatgtggaatctgaaaccatattgatgatatttttgtactcttttccactaaaattcattgcttgatcttgcactttgattgactcttatattcaagaattattttcccttggctatttggaaaatattggttctctgagttgtgcagatcttccagacgttgacacatttaattaaaccatgtcaaaaaaatttcattggttaatgtcaccaccaatttcatcaagaagtctggtaagtatttggaagctgtcagtctcactatggcaggtacaagttttccaaaattgattggcaacagatactatcagttgttttctttgaagtgacaagctgttcatttttgggaaagtttctgccaaatacttaagtctaaaaaactatatcttgtcaggcattctttcaagaaagggggtgtttgcccccagaaaggtacaagtttggctcataactcagttacataagaatgtttcctgcagcccactgtcacacgctggtttgtggtagaagggctctctgcatcctctcactcatttcattacacaaactgttcgaaaggcacatactcgggggttgagatttaatcaaattaataattttttattgcatcgaggacatttggaagtgaaactggctttttaatttattttcttgcgagcgcgtggtagtgaggaatgtgttcctgctaagtacactatggagccactgcccgattcacgctcaggcatcagcagttttactgtgcaaatgtcaagcagtgaaaaaagtaaataacatcttggtgctattataaaaagttttggcttcacagtcctcctgcaaggatcttgaggtctgccggggctgcacagaccgtctttgagggcccactcctggctcagagtgagactggtgggcaggcaggatagaatctcttgggagctcaatgtcctttccagacctgcctgaacagaatctgcgttttaatgaagtcccgaggagatttatacgcaggttaaagttttcctgtagtcccagctatttgggaggctgaggcaggaggatggcttgagcccaggaggcagaagttgcagagagctgagattgcactgctgcacttgaacctgggtaacagagtgagattgtatctgggaaaaaaaaaaaaaagagagagagagagagaaccactgctctttaacagaggtctgcaaaactttcctttaaagggccacatagtaaatacctgtggcaacaactcaaccctgcctttgtagcttgaaagtagccatagaccatatgtaaatgaatgagcgtggctgtgtgccaatacaactttatttatagacacagaaatttgaattttgtgtacctttcatgtgtcacaaaataggttttttaatatattctaagcggttaaaaaagtaaccacttggaatcatgtcaaaatcattctgagtttgcaggccatgaggagagccagatttagctggtgggccacagtttgctgacctgtgctatataacactgagtgctcattgaagttaccgggggagcttcaaaaaaacaaaccccaaccctctaattcctgagtcccgtccccaataaattctgataaaattggtctggggtgaagccagggcatcaggattttcagatgctccccagattattccaatgtgtaggaaaaatggagaacctctgctctataatgttttccaagaaagttagttttcttttaagcatttctttttaagattttagaatttggcagtgtcaccaaatgtctgagaccagaattatgtattgtaaccttagagcagggtttctcactcttggcactgtgaacccaaagctatctgagataggtctcaatcaatttagaaagttaattttagcaagcttaagaacctgtgacacagcctcgggagatcctaataacatgtgcctaaggtggacggggcacagcttacttttataccttttagggagacatgagacatcaatcaatacctgtgagatgtacattggttcaatctggaaaggcaggacaactcaaagggggtcagagggtggcttgcaggttataggaagatttaaaaattatgtaaagacctggaatccatagaaaggaatgtctgggttatgatgataaggggttgtggagagcaaagttttatcctgtaggtgaagcctccaggtagcaggcttcagagagaatagattgtaaatgtctcttagcagatttaaggtctgttgatgttaatgctggttggcttttcctgaattccagaagggaggagggtataatgaggtatgtttgactctcccttccaatcatggcctgaactagttttttcaggctaactttggaatccccctggcagagaccaggaatctattcagatggttgggggtggggtggggggtgcttagaatttttttttttttttttttttaaacggagtctcgctctgtcgccaggctggagtgcagtggcacaatctcagctcactgccacctccaactccctggttcaagcgattctcctgcctcagcctcccaagtagctgggattacaggcatgcgccaccacacccagctaatttttgtgtttttagtagagacggggtttcaccatgttggctgggatggtgtcgatctcctgacctcgtgatctgcctgccctggtctcccaaagtgctgggattacaggcgtgagccaccccgcccggcccagagttttatttttggtttatagcactattggcattttgggtgtgaccattctttatttggggatgggggctgtcctgtgtattctaggaggtttaggagcatccctggcctctacccactagatgccagtagtgtcccccaccctcagttgtaacaaccaaaactgtctccagacaccgctaaatgtccctgggtggcaaaattgcctggattaggaaccagtggtctaaacgatgtagatgttttttgtgctacttcagagaatctccacattggagctattgacatctggggctgggtaattctttgttataagagcatattctgtacactgtgggtgttgagcagcatccctggtctctactcactagatgccagaagcaccctctcccccagctttggcaacgaaaaatatctccagatattgccaaatgtcccctgaggggcacagtcaccccctgttgagaattgcttggccagctcagaatcagggaagcttctgtccactgacattcactgctgcttctcttaggattttcgccctctccattttcccattgcttgttgcttgaaagttgtaaagcttggttcctgcatcttttctttttaattttgtggctcattaggaatcagtaatatagcaaggaaggccccatgtagagaggtaagggggtggtttttttgtgtggtgtttgttggggggtgtttgggagggtgtgtgtgtgtgtgtatgtatgtgtgacattcattccctggggaagaatctgagcccttgttcctgccagccctacgtctgagccagcattaaatctgcagccaagatcacagacaacttgggcaaatcacttggccattatgaactcacagccatggcaacggccatccacaagcctgaggacaaaaggtgttttattctgttgttctgcacaaaaggttctagggatactggagacaaaatagcctttgagacttaaaggcattgatgtgtattttttttttccctactacatggcttatatttaaactgtcttaggctaatgtacactgtaatttttgtgtgaatcaaaacctaaaattctttttatccagaggccagctaaatgaaggcataagacagcccaacagaggcttttagggtttggtgagaggtattgagaattactagtaaaatgtgctagaaagcctggcattctagcctggccaacatggcaagaccccgtctgtactaaaaatacaaaaaattagctggatgtggtggcatgtgcctgtaatgccagctactagggaggctgaggcataagactcacttgaacccaggaggttgaggctgcagtgagcggagatcacaccactcactccagcctgggcaatagagtgagactctttctcaggaaagaaagaaaaaaaaaaaacctggcattgattattatttttttacatgaatacatcacagtcatcaaaaaaatgctttccttattttttctcgttcacgttacccaatgttgtcattgctggtttgaagcttgggaaaattcagtctgtggatttataggagcatccaagaaaagcactgatcttccttagctatcgtaaacttttaacagcatggtgttctgctggtacttggcaccacccctatatttaaaaacatcagcttgcctatgactactaaggacagcctgaatcccagatctacttcctttttgtgcacaggcactcccagcactttagggggtggttggagtgtgtgtgtttagaaatctgctttctcaggtgactcaattcccgtcttctcagaccctgtctatggcatgacactaaagcatgaaaaattccaaggttaacagtacttgtttggctcacaaaaatgcactctagctgcactcttttcaagatggctggacaacttggaacattttgtttttcttaactgtagtccttggaacttgccatttgattcacaagtgactggagggttatggccaaacccagtgggccacgtcttagagaaaaaacatcacacaccatcgaatatgaaagcaggcacttcaaacagactcaggatgccacacctgagaccgggaagatgccactgttgactagaaatgggcttctcaaattttcatgtgcacacaaatcaccccagaggccttgttaaaatgcagattctgactcagtctggggtcacttccaacattctttatttctcacaagttcctccctgctgaagctgacactgctggtccaatgaacacactttgcaaagcacatggaattgacaaatgacaaatggtccactcatatcttttcttgacctctgatagttttccttgttgcccagtagaagctgccagcatccaagttcagctcttctcagctacagatccatatatcccttcacatcatccagagtgatctttcacaaccccaatctgtttcccatgcttaaaaatgctccctggcagaccaggcatggtggctcacacctgtaattgcagcactttgggaggccgaggcgggaggatcacttgagcccaagagtttgagaacagcctgggtaacataaggagaccctgtcactacaaaaaaattaaaaaataaaaaatgagctgggtgcagtggcatgggcctgtggtcccagctacttgggaggctgaggtgggaggatcgcttgagccagagagttcaacaccgcagtgagcagtgattgtgccactgcactccaacctaggcaacagagcaagaccctgtttcaaaaaacaaaacaaaacaaaaaaaaaacgcagtggcttcccatgattttgttttttttgtctttttgtttttgtttttgtttttgttttgagatggagtcttgctctgtcacccaggctggagtgcagtggtgcaatctcggctcactgcaccctccgccttccgggttcacgccattctcctgcctcagcctcccgagtagctgggactacaggcgcccaccaccacgcccagctaattttttgtatttttagtagagacggggtttcaccgtgttagccaggatggtctcgatctcctgacctcgtgatccgcccgtcttggcctcccaaagtgctgggattacaggcgtgagccacggcgcctggtcaaggcttcccatgattttgaagataaagtccagaattcttaaggtggcctggaaagccctaggtggtctagctcctatattacctatatcctctagctcctaaataaacacatttagctttttcttactaactttttgcagcagttttggttcctctaggatgagtgtgtgatatgtgactaaattgcccagtgttcaaagatatcatgcacactgtgaccagaggtggcttctatactgacatagaagatacagtggagagtgatccatttatagattgttggatatctaccacacatgcaatcttaaccctgaagataactggtcaaccaagctagaataagctctacatccagctgtattatgtcctataaatttttcccatattttatgtcactagcttctagtcatgttggctggcacagtccgtaagagttttatctgtgccagtggagcaaagatggtgatttctgttctataggagccagggttcctacagccacaaataaaatcatctgctgaaaacctaagagcattggcatctgctgagagagcatgattcattgaagtgatcccccaaattcttgagttcctggttttccctgctgttataaaactagatccacagcatgaggtatatacagagtccttgagagatataaattggagggaaactttagctttgatctagtattgaatttgggattgaacagcatcattcttctaaccccacttggctttttgagcctgggagagctgtgatatttctttggaatgctctaaccatttggatgaaagaccgtttgaagtggcaactgtggatttggaaggatgagttctatcgttaaagggcgagtgtgctgcaccataacacctaaccctaactccaaatgatgaaaaagggtgtgggtttagtttaaaaatatatatagatgtatacatctatatatacacacagagaattaatgaacaattttatctggttatatatcagtgtcaccacatcagctgtttaagtattctggatactagatctttctgtagaaggacccatccagtatgaattatttgcccttctgatcttccctgtcccccttctctccactctctttccactggctctgcaggggtctgtatctttgcccccatcatgctggactataataattgtgttacttgtctgcctgcagtattggatttatcttgaagccagaaaggtatcttatttcagttttgtgtacttggcacccagtaggtcttcacaaaatactgaattaatgaaatccaacagaaaacccagttagaacccagctcctgggttatagaaaatcaaatatgtgacaattcaaaatgtatcttccaaagcagtgtgttctgtgatgatgaaatgtcctatatctgtgttgtccaatacggtagccactagtccatgtggcttttgagcatatgaaatgtggtttgtgcaacagaggacctgaaattttcattttatttaattttaaataaacgtaaatagctacatgtcttagtggctaccattttggaccacacagccccaaggcctcacatctttatcctttaagaaccagatacaactttgttagccaggaaagcaggcattcatctttttcttaacatgatcatagaggctgagaatgtggggaggttgtggatgatacaatacccatgtctgttttctctttataatgagatacgtcaaggccaaggattctagtttctcttagtttgggaacctggagagaatttggactttgagttgcattcctctcacctcagtccccagaaagtcatgtgacaaaataagattgagctctaacatctctgctcacaaatcccaagtgtctgaagctctttaagatactgacttgctagtgaacttgaaccatattgtgcactggttccctttttctttttttgagacggagtcttgctctgtcgcccaggctggaagttcagtggcgcaatctcggctcaccgcaacctcttcctcctgggttcaagcgattcccttgcctcagcctcccaagtagctgggactacaggtgcccaccaccacacccggctaattttttgtatttttagtagagacggggttttactgtgttagccaggatggttcccattttatatagtttccccaatccacttcagggaagttggtcttcctaaaaacagctgctcatcttttgaaattaaaggaagcacagctttcttatgaagccctgatattttttattttctaatgaactaaagagaaatctagtaatgagttttcatagtcactttccataggtttaagcgaatgctagtttaaaaggaatgctcactaaaatgaaaacattcatctatggtgttttatgctgggttgtcattccatgacaactatgaagaccatttgggggattttttttttttttttttttttttttttgctggcttaatgtgcttgccctaaagtaatgaagtgcccttgattgctgctaaacaccataatgcgtttaaagttcaatttccccgacaagccatttacttaagggtctggataatataaacagagacaggaggttaggagaggtactgacattatcctgaggccagtgctgcctttactgaaacgtaaatgtctccaaactgaaaacgtcacctggctctgcccctgaggcaggtctttatggacatctcaagtaaaagtttattttaaaaatgaatacaagtctcgtcttttcaagattaagagtgacttacggctgtctctccttcattccacttcatggatgttcattttggttttgtttttttcttctgttcttttttctccttcaagtacttaaatatcacccaccagttctgggttctgactctgaacgtgtgtgtcggggaagggggcaggtggaagccggggaggaggaggactgtgaatgaattgcttgggctgactgggctggggggaagcatttttattaaaaatttgagataatttctgatgtcaacttgaatgaaacttgagtagacccacttgagtggctcttggtgactttgttcttcactgaattatggaccaaaatacctgtgacctttccaaaacaatcaccttgctatttgtttgaacctggcgacggcataattgctgtatcagattctcccagttgccccggaggtccagggcttggggaaagccgttggttgccacagcagcagacgtattgaaaccccagaactgtgaggctggagacgacctgactgttgcttttcttcacagagctgcagcttcactgctgtcctctcttttgactgtgttagtggaatgagtgcttcttgttggcacttgagcggggctccccccaccactcagtcgatcaggaagctctagaactgtaactaccttataactctttgtcaattgactgctctgccattcactacccttccagattctgagcaaattaagttacattcccttttggagcctcagggtcctcaccgcagaatgtgagatcacggtaactaccacactggcccttgggatgtcgaagtattaatattaaccatagagcctgagaggggagatggaaaattgtaagccttctctgtgaatatggggtattcttgaagaccagaggtgttcttgcccgtaacggctatattttctctcctttgggttcaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgtaagtatccggttccctttaaaaatgcatctaaggcctggcgtggtggctcatgcctgtcatcccagcaatttgggaggctgaggcaggcagatcacctgaagtcaggagttcaagaccagcctggccaacatggtgaaacgccacctctactaaaaatacaaaaaaaaatttagctgggcgtggtggtgcgtgcctgtaatcctagctacttgggaggctgaggcaggagaaccagttgaacccaggaggtggatgttgcggtgagctggtgagccgagatggcaacactgcactccagcctgggtgacagagtgatactttgtttaaaaaaaaagtatctgagatgcaaccacctcatgatgtttttcagaaagactacagtgtgctttcctagcagaagatgaatgcttttacttaaagctcactttatgtagttagaaaaaggttcatgagagaaggaaaaagaaagggcctagaatatggtagctgtttaggccccagggtggaatgttacttgggaatggtaaggtgcacacataggacactccacacatggtagctgtggacatggggagctgtgacatggtgataggtgatgctgccgattgtctcaacagaattgtgttgttcccaagtaacagatgcctccagctttctcccaggaagtgaccatccctggaatggtaggagccctgttgaggactgaccccaactctaagcctacaggagcagtattttaacattaactcttccagcagaagagcagatcccagggcatcctccattgcagaagagcagatcccagggcatcctccattgcagaagagaggaaggtccaggggtttagcagcagatctctgcctttctttctggaaacattctcaatggagtcgcagtgactcccacacatagattcttgtagctgtgcaagctcagcagcaatctacttatttccttcacatgtcttcccctttctccatttccttctaccgtttctttttcttcccttgaatcccaaagttccagtgttagtgtgtcttatgattataagaaacttcttcaccagactgaaaaagacatgaatgaatttttatggaatggtcatggagtcatgttggagactcttcagtccttagggaattttattctttcttatctgttcacaaatgacctccaaagaaatgaacacaggttggggagattataaggagggctcaagcaggacaggggactcactgagttccaactatgtgcaaagaagaaatgtttaccaagactgaacctgggaaaggtgtgttgatttaattaggtagtgatctcagtctgtggctctcaaacttctgagaagctttaagaaaatccccatgccttaccccagaccaattaggacataatctctgggggcgggatccaggtaccagtattttccaagctccccaggtgattccagtgggcagccgaaggctgaggacatgtcatttgtctttgttagcttttgtgggacaaactgcattgtgaattaactttctgtatcttaaacctactcgacctactactatttgtgtggtgggagtcacagtgcaaaagacatctccccagattaccccctaaagaagccctgagtgcctacttaggggttttatcagagtgacattaaccactaggcctggttgggaggcattttgaaagggcagaaagaacatgttgtccattgggccagggttcagatgctggctttgccactaactgtgtatcctccgatgaggagcttaactcctcaatgcctgtgttttacttatgtgcaaaatgaggattctaacccttgccgcccaggactcaggtaaggattaaaagattacaactggatgctgccctgagcaaaggaaacatcattcccaccttggaaggaaggcccaggttgctgggacatgggcagggatgccgcccaggatgccccacaagtccatcaaagccatcagtggggcgagtgacgcactcacaggaacatccccctcatgtcctctctccagcgtccagaaacgtagtcactaccaggcagtgaatttaatggttcaggatctcttcttctctttgtaggatacaactgatgcagtatgtcatctatggaattgcgtcctttttcttcttgtatgggatcattctgttggc

SEQ ID NO: 3062 - DNA, 109204 bp, human
aattccaacgtgcatcaagacggaaaaccaccgtgtaactccttgcttctcaaaatgtcccaggacaaaggccccaggtaaattgtttgtatattcaagcctgagaaacctacaggttcctttctagttaaaagcccattgttctagttggcctagagagctgttgactccgcaatgaaggaaagtgttgtatatttctggaggcagagagaggtctgcaatgcaaaaatagtttacagagaaagcggtattgttaccatcagaatcagttgtgattctattttagatcattggcttcagaggaaaaaggcaaaaaaacattttttttctacttcatttctagtcttggtttttcaccaccaaacaaaacaggaaaaaaaagggggtgggggttggtggtggcgagggactgcaggaaccaaatggatagaataaaatagtcttgtctcatgcagaagaaaaataaaagacaagttacatctttttctgctagagaaaagaatgtatttcctgtttgccctcgccgagagcctgggcataatgcggcagtgtgcacagagccgctgaacaaagaatacagaaatggctgagaggacagagtttgaaccgccaaatactggctcagttagaaaccatgtgacagatgcagcttctgatttcatttactagggcgaaacagaaatgtgtaagtgtttctctatatcctcggaggctttgagtgaaagaaaatggaaggtaattaattttcccttccagagttttgcatgtacattggaagatctgttatgattgaaagccttttaaataccaagcttgttaaccaaatggcttctgcaagaaagtgggctttataataagccctggctgcataaagaaatgttcccaaaccatgacgttttccgttggtgtttataacattccatagattatgtgagatgctattcgaatcactgaaaaatagttgggtactgaaagtgtctttagggatcatctaattcagtggttctcaatctgtttttctgtcctcaacacacccatagaatataaaattctgcaattagcgccagctgtatgtctttttaagctgggtgggtcatagcagaatcaggaggggtggagaagagcccattttataacaaaaaatcctcagtagttctgagatgcccatatcccactggttctcaaacttcactgtacattggaatcagctgaggagctttgcaagcgactgctctctgggttccatttgcagaaattctgatttaatttttctagggtgcagcctagtgagagactatgaaactctacccaggtgattctaagtgcagccaactttaagtctaatttccttaaaaaccaccactcttttctccctccattgcaaatggctgtattttgaatacttacagaggggagaggttgtatgtttcctcctgtcccatttatttgcatctttgtctctttgatctggagtccttggtcaggaatccaggctcagttatctaatgtctgtgggaaaacgcagcccacttaattataacttcaaggaggaaagtaagcccaggaggctcaaatctgtgactggtctgtggtaaaaacagactggtgggcttctgagactttcctgtggacgctgttgcctctgcagccactggaagagatgtggtgtcctcttgttaccagtgtgtcttgtgtaatcaagatggtatgccatgctattcactccaacatgcttttctgtatcttcccccaagatgtccctacaggccctcctgaaggagaaacccaaagtgattaacttaactcttccctctttagtcctcatcatttgaggttatcttttgtcattgttaccagcagggaaaacacaaagcatttatcagtggacagattggcatggataggatggcagttaatgtcgttcaaagatgaaggctcgggccaggcacagtgactcacgcctgtaatcccagcactttgggaggccgaggtgggcagatcacttgaggtcaggaattcgagactagcctggccaacatggcaaaaccctacctctactaaaaatacaaaaaaattagctggctatggtggcatgcacttgtagtcccagctactcgggaggctgagggaggagaatcactggaaccctggagacagaggttgcagtgagccatgatcatgctactgcactccagcctgggtgatagagtgagactccatctccaaaacaaaaagatgaaggctgtgttagagggggcatttgtagactggtacccaacatcatacatcaaacactgagaacaagagtttctagatttttttttttttttttttttttagtagtgacttaaggtagagagaggtggcacttaggagatgtcattctctttggtttgatgttgatggtcagtcctgttcagggctggggaagtgaccatgtcagcagaagaacgactgcttagggttttgtggcctcttttcatgtaggctaagagaggaaatgtcttgaaattcgggtatagaggtgtggaatgactgggattatatagggactctatcccttccatgccctgtaatgtccatagtgctgggaacttataaatactgcctttgtgtggaagcgtttttcaggtactcaagtaaagtaactctatcctgatactcacagtactataaacataaagatgaaaaaatgcaggatttaggggaaatgttttcagatttcactggagaaaaatgtagtagcctacaaagatagcaattgagttcctaaaggcatttgggttaaattaatcattgattaaacgtgaaacttcagagagattttgctttctgattcattagcttagatttgaatacatttgcatccctgcatatgtagaaagctaattcagtgaggtctttttgcagcacataatgaaaaaaatgaatgtgttttatgcttaggtgttgtagaatcaggagaaagtggtagataggtcaaaattttatttctgttgctaacttaacatattacaagtatatcgcaaaagcatacgtatacattttgtgcttcttaggcattcgttctttgtgttttagcttaacaaaaagatatgtcagtttttcatttggagccattataacattggaaagcagtaggagtgaaaaactaaaaccactcgaaactcaaacataaaatactatcagacttcctctctaaggcagccttgtttccctggcacgcaccctttgcttctccgctcattcttgcggtcactgactgccttgactgtacttcataggcaccatccatcacgcttgtctgcagcagtgacttaagatggaggggggtgggaccacaagatgcctggcccttggtggggcggggacggggggttgttgttcatacaaaagacctttgcatccttccgaagcgggtggcacctccctgccatcacttgggcatcctccaccagcctctgaagatttcactgaggaggaggggccagaagtagcagggtataggatggaggccagggccacctctaggagtcctggcccgctcaccccaatcagactttacatgccttctttcactattgagaaactgtaagggttaattttggggatgtcatttttgaatgcttctatttgccaggggcaaactgattaaaaggaaaaaaagagagagattgagcttaaacttcctgaacatctatttgaacagctaagaattcctttttctaaggtggcaagtaagataattaatggaatatttggtgcttatgttatctaatatgttagtttgggatgaaataaagtcacaatgaaattttattttttatatgatacctatatactttatagtaaaccaatcctccgtgtatacttgataattttacttatgcacagtttaggactttgtaagaaaagtggtacagatagttgttttcaaatgtcctgttctgggaatgcagagttggggaacaagatgccttcctgtactaagaaattactggatgtctccctcgatgaggtgacatatgaagaatatatagagatgcccaacaaatgttattttctacccctttttctgggtttttcgttttctctcctataaattttgggcaggccgtgtgctctgttgggtcgtgtcatttgagtccatcactacataggaccttctctcaatatttcaaatacttacacaagctagaggttgtatgtttccttctgtcacatttatttgcatctttgtctcttttatctggagtccttggtcaggaacccaggtttaattatctgatgtctatgggaaaactcaacccacttaatgacatgctgcattattttgtagctctcaggggaaaatgtggcaagaaaatggagactgcttattatttcttcttacgccatggttccagaatcttttcatgagagtaaataaaagtgaggtaaaatctgcagaatccttaggttagagagtttgcattatcgattgataggtccttaaaaacattttctctttatttcagaacaatggtttatgacaaccccattcactactcttgaaactgatgaggaacatcagattatgtaatcttgtgcatttggctaagtcagaggaggcctggtgaattcatttgtcattcagagtctagaggaatctaatatttgtttccagataaaaacctgactgagaaagtatatatttctgacatggagaactatgctagatattttatataatatgaactattctagagtattctagaccagcactgtctgatagaaatgtgagccacatatgtaacttttttaaggttagcagcctattgaaaattatttgaatggataaaatcaggtgaaattaactttttaaaatttatttattttttgaaatggagtctcactctgtcgcccaggctggagcgcagtggtgggatctcggctcaccgcaacctctgcctcccgggttcaagccattctcctgtctcagtccccctgagtagctgggattacaggcgtgtgccaccacgcctggctaatttttgtactttttagtagagacagagttttaccatgttggccatgctggtcttgaactcctgaccttgtgatctgcccgccttggcctcccaaagtgctgggattacaggcatgagctaccacgcctggccgtgaaattaatttaacaatatgtttaaaatttttttttttttggtttagagacagggtctcacgctatcgcccaggctggaatgcagtggtgcaatcatagctcactgcagcctcagactcctgagttcaagcgatcctccttagtagctaggactacaggtgtgtaccaccacgcctgactaattttttttttttttttttaagagacgaagtctcgttatgttccccaggctggtgtcaaactcctgggctcaagtgattctcccaccttgacctctccaaagtgctgagattataggcttgtatgccactgtgcctggccctaacaatacatgtcatttaacccagtatttccaaaatgttatttcaacatgtgaccaatataaaaaattactgagttgttttacattatttttgaagtccaatgtaaattttacacttagagcacttctcatttgggattagccccaatcatatgcccactggtgacatgtggccagcggctaccatgttggacaacacagctttggaccttcattcctaaacccaggcactgagagattgataaccaatcaagactcctgctccaatttagaaaggggacttaaacattgagaaaaggagctctctgaaaaaaaaaatatgaaagactccttcaaatagttgatattagaaactaaaccactttccacataaaatctgtgtttttgtctgaagagcgcagtggggaactagcaatttgtaaaatgtttctatgtgaattggaagaacattctgccttcagattgtgcttctggaaaaccagatcaggatgacattgagaggcagatgattgtattgtagcttttaagagaataagctctgtagcttcaatgcctggattcacagccaagctctgctatttaggttggtgcaaaagcatttgcagttttggccattgcttttgatggctaaagccgcaattgcttttgcgccaacctaatacttgctcgctttgtgatctttggcagattcctcttcatgtgtacttttcctcacctgaagactcaggacagtaatagtaactatctcctagggtcatgaggattaaataaactaaaacaaaggcctcagattggtacttagcagtgagctattctattacagcattagctattaaatcatcatcatcgtcactgaaaattgtgctcttatatctcattctttttttttttggtgacagggtcttgctctgtcacccaggccggggtgcagtgatgcaatcatggctcactgcagcctcagtttcctgagttcaagcgatcctccttagtagctaggactacaggtgtgtaccaccacgcctgactaattttttttttttttttttaagagacgaagtctcgttatgttccccaggctggtgtcaaactcctgggctcaagtgattctcccaccttgacctctccaaagtgctgagattataggcttgtatgccactgtgcctggccctaacaatacatgtcatttaacccagtatttccaaaatgttatttcaacatgtgaccaatataaaaaattactgagttgttttacattatttttgaagtccaatgtaaattttacacttagagcacttctcatttgggattagccccaatcatatgcccactggtgacatgtggccagcggctaccatgttggacaacacagctttggaccttcattcctaaacccaggcactgagagattgataaccaatcaagactcctgctccaatttagaaaggggacttaaacattgagaaaaggagctctctgaaaaaaaaaatatgaaagactccttcaaatagttgatattagaaactaaaccactttccacataaaatctgtgtttttgtctgaagagcgcagtggggaactagcaatttgtaaaatgtttctatgtgaattggaagaacattctgccttcagattgtgcttctggaaaaccagatcaggatgacattgagaggcagatgattgtattgtagcttttaagagaataagctctgtagcttcaatgcctggattcacagccaagctctgctatttaggttggtgcaaaagcatttgcagttttggccattgcttttgatggctaaagccgcaattgcttttgcgccaacctaatacttgctcgctttgtgatctttggcagattcctcttcatgtgtacttttcctcacctgaagactcaggacagtaatagtaactatctcctagggtcatgaggattaaataaactaaaacaaaggcctcagattggtacttagcagtgagctattctattacagcattagctattaaatcatcatcatcgtcactgaaaattgtgctcttatatctcattctttttttttttggtgacagggtcttgctctgtcacccaggccggggtgcagtgatgcaatcatggctcactgcagcctcagtttcctgggcccaagcgattctcccacctcagcctcccaagtagctgggactagagacatgcgccaccatgccacgctattttttaaaaatattttgtagagatggggtctcgctgtgttgcccaggctggtctcgagctcctgggctaaagcagtcctcccaccttggccttccaaaatgttgggattacaggcgtgagccacgtgcccagttctgtatttcactttcacactctctatgctccacttagtgtttcagttgcctgtttcagttgctgggcctatagtggtgggcaaggtagacaagattcctgttctcacatcttacattttagggatgggaaataggcaataaacaagacaggagaacaggcaaatgaacaaggtatttccagagtgtgagcagagtgttcagagagtctctagaacaggttaacatgaccatgagaagctggaggtgatgtttgagccaagacatgcatgacttggtgcaaatttggggcagagcatcaagcccagggaacggcaggttgcaaaggccccatggagaaaccggtgtaacgtatttgaacacctgaaagctggctcctgtgtttggagtgtaagaagggggtaaagattggagatgaggtcaataagcaggcaggggctggaacctcaaaggccttgcagagcttgataaagagtttgaaattttattctaagagcctcgaaaggtttaaggcagggaagtaatagaacctgatttgccttttttttttttttttgagatggagccttgctctgtctcccaggctggagtgcagtggcacaatcttggctcactgcaagctctgcctcccgggttcacaccattctcccgcctcagcctcccgagtagctggaactacaggtgcccaccaccacgcccggctaattttttgtatttttagtagagacggggtttcaccatgttagccagggatggtctcaatctcctgacctggtgacccgcccgcctcggcctcccaaagtgctgggattacaggcgtgagccaccgcgcccggcctgatttgcctttttaaatggtcactctggcttcaggagatttaatgggagcaggagagagacgaccactactatctgctttcaagaatgtaagattggacatagctctctgtcccctgctttgagcatagctgattcctctacaacaaccccatcactggccttgtgttgtgaaagagatcattttctgcttgtataggagagtagagagacctttacgctaacgtggcctgccatttcagactatgacataaccatgcacatgctcgcacattcctagaagaatccgtgtgttagcaaaaggattgttgtgttctttgcgaagcaagagcaaagaatccctcacagaagctgaaaattgccactgatgagtcaaatggccatgctctggtcttcataaacaaaaggcaggctctgattcctccaagtgcagctaattttcaggtagtactaatgggtttatactagcggttctcaaagtgtgcttcctggacgagcaacatcagcatcacctgggaacttgctagaaatgcaaatcctcaggtcccaccccaggagacatactgaactctgaagtgggcccagcaatgtgttttaacaagccctccagctgatgcacctcagaatttggggaatccctgttttttgctgctagagatgattgctcagagtaaaaagcactactaaacatggctgaggagcagagtgatactcctttcattgtaatctttttaatgtaaatgctgagtatttgggtagcttttggaatcaagtgtttgaaccacgccttttgtgtttgaagctattcatgttttatttaggttcttttgttggatgctgctgtatggtataatatttacaaggtttctgggctggcttctccttactggaattttcagaattgatgtaattacatcctccctgagtcgaatttaacagtctaaattggaagaagcctctggctgtcctgatagaaagttcccactgaaaacaaccagcagcattgtatttgaatctttgttgtccacaggtagactgtctatactacagcttcccttcagtgagtttttaacccctgggtggctcatgctgccagccaatctgttcttatgtggatcttcaccgtaagttatgacctgcttacggaaagcagacagatttttagtttagatacatcataaaaggtatatctacttgttgggggagggagggaaataaacattccaaatacagtactgttgtcaaagccaaggatgttctactgtggggctgttcttatatccctgctgtatctgtttcctgtggccgctctaagacactaccacaaatttagtggcttaaaacaatgcaaatttgttatagtcctggaggtcagaagtctgacgcaggtctcactgggctaaaatccaggtgtagatgaactgtgtttctttctagaagccctaggggagaatccatttccttgccctttccaccttctagaggctacatgcattttttggcttgtggccattttcctacatcttcaaagccaggaactgtgggttaagtttttctcacatcgcatcacttggacctcttctgcctctctcttgtacacttaagtaccctgtgataacgttgggtctacctggatgattcaggataatctttggtcatctgattagcaaccttaattctatctgcaaccttaatcccccgtttgccatgtcatgtaattcacaggttccaaggattaggatgtggacatcttggggtggggggtatgatgctgcctaccacagcaggccactaaacttccttacagcctcagtttccttatctgcataatgacattagtaaaaaattattgaaggctctccttgagcattacaggagatacatgtgaaattatttggcacagagctgcccttcagtagatgctggtggcctaacactattttatgttcacaaagtgtctacatagattcttttaaaaattatttgaatgcttgcttctcactcccagacccctctgctctgttctttggtaccccttcccccaccttcccattgggtggtctccctgacccatgctgataggaataattagagcatatgcaagtggaaagggtaggggagaggaaaaaaaaaaaaaaccttcttgtctctaatcagttactattttcccccatactttaaactctgaatagaatattcgtaagagtttgggagattcctttgatttttttttttaacagctttattaaggtataattttccatttgttgttctctaccttgctagagttacttctgacctcgtcaaatcctgattcaatcaaaccaactgtcattaactatttggggggataattgttgaaatttgaatataggcagatcttggatgatattaagaaacattaactcttgtatgagtgataatagtgttgtgcttatgtaagaaaatgcttattttttcaagatacttactgagatatttagttgtgaaatgtcagaaggacttaaactaggggaaaaaaaaggcgaagcaaatatggtgaatttttttttttttttttttttttttttggcagagtctggctctaatgcccaggctggggtgtagtggcatgatcacagctcactgcagcctcaacctccctaggctcaggtgatcctcccacctcagcctcccaagtagctttgactacagaaatgtaccaccatgcctggctaattttcaggggttttttttgtaaagatgggattttgccatgttgctcaggctggtcttgaactcctgggctcaagcgatctgcctgccttggcctccaaagtgctgggattacagatgtatgccactgtgcctggttcatttttttaaaatattagatacaatcaagtgatgcaaaggacccaggtggccagatgtatagtttctggaacaacttctttttcttaatacttcacttaaatgacttggttctctgtgaactttaccaattctagtccactcactcccaaactctgctctgttgacatagctcatgctttatcagatgtcctaaggaaactctacttcactatccttgtcaagtttacatgctcccacaccttttggtggaacataatttacattttagagaacactgggatcttgttaggtttgtttcgtcccatatcacaatccactcttcaactgctagatgatgcatcccacttctagaaagagagccttacttagtgggactgagagctgctctaatcatctgcagttctagctgttacgcgtttcccagtggatcttgagctgccttggggtggtgaggggctgttttgtgggagtgtaaggtcagggaagtgtcctctcctgccctgtgacccaggccttgcaatgatactgaaatacacagctggaaattgtgtgatccaaaaaatggtcttgtctgtgcacttgcatgaactacagccctgcccccaaattcgggagttgagatggtgttcccaaattactccagtgagttgtctgttattccaggaggtgacacagcatcatggtatgtgcatgatgtcacctcagacgttgccagacaacaagcccactcaagtcggacatacagcactttataatggaggctgggttccaccgagaacagccattctcttgtctgctgtccccagtgattataggcagatgtgctgtgacttgagcttgcacaggcttaaagttccttctgccttcagagtcagcagtcagccatcttcacaaatggaagattgttccagaccaccattgaccatctggctggatccatcccaccatctgccctgcacagtggcctctcatttcctaatgtttctcataaacagcttaaagttccctgtgacattatctactgcagcagggcttttggtaccactcctgggcatgccaggaacatagggcctatgggtattcatcagagaacatttgtatgtcaaaaattttaacaaatgagacttccattttgaagataatgatgcagacatgttgtacgttcacttatgtgtcttccttgataaccagtcaacaatttatcagtgatcctttatggacatattaatacacttattggtgatctggaagtagtgtaggacctaatctgtaatcttaaactgtgcagagccttgaggatggccattgtttgttggttatggtgtcctccttgatctttgatgaaagaaagattgccttaggtgcttatatcaagttaatctcatctctgtgacaattgaaattaccattggttctcttctttccacataacacatcgttgtaactcagcatgtctttttcatcgttgttcttgtggaattcttttaatttaatttattgtggtaaaatatgtccaacataaaactgatcattgtaaccattttaaagtgtacaattcagtagcatttagtacattcacaatgttgtacaaacatcactatctagttctaggacatttttgtcatccaaagaaaaccctataccattaagcagtcactccccatctccttcccccacctctggcaaccactaatctgctttctgtctctatggatttgcttatcctggacatttcatataaatagaatcacacaacatgtggcctaccgtgtctggcttctttcactgagcataatgttgtcaacattcatccatgtcgtagcatgtgccaggagttcattcctttgtatcgttgactgctattccattgtacagatagatcacatttcatgtatccattcctcagttgatgggcatttgggctgtttttaccttgtggctattgtgaagagtgctcctgtgaccatgtgtgtacaagtgtttgagcacctgttttcaattcgtttgggtatgtagctagaagtggaattgttgggtcagacagtaattggatgtttaacttcttgaggagctacccgtgcggccttttgctcatgccagtcctcctctgccatatgatgtctgttctctttcaaacctatgttaggactcgcctccaccttgattccttttcctgatagtcccctgcagcttcccataattcatgcatccttactagtccctatgagcacccctcattcagctctgcctggagaaacttcacttttgcctcctcatatattcatctggggttaccctacttcttttggctttgaggatgtttttcccactaactgcatgcaactgtcaccatctcaaggatggagatggatactcgttctctgtgctcaaaggcacttgtcactatttttgcctttctattgttgggctattctagtaacagctggaaattacagaaataggttttgattttattgctcatcaaggtcaggtttccactgaaatacaggcatcatagggcctatcctgtttgaaatattaaaatgtcagaagattcaaacaggccaaagagggagagtttgaagcgggggtgggggggggattggtatgtgtatggagtataaataaagaggttcaaaataacaataatagcattaatgcaaccttcttgagtttgacctcgtttagtcttcacaacgaccatgtgagatggagatttagtgtgcatggctcaaagccacacatcccttatgtggcaaaatcagtatgtttgactccagagtctgtgtttttttgtttttgtttttgtcttttgtttgtttgtttttggagatggagtcttactctgtcacccaggctggagtgcagtggcacgatctcagctcactgcaacctctgcctcccaggttcaagcaattctcctgccctggcttcccaagtacctgggattacagggatgtgccaccatgcccagctaatttttttttttttttttgtatttttagtagagatggggtttcaccatgttggccaggctggtcttgaactcttgacctcaagtgatccacccatctcagcctcccaaagtgctgagattataggcgtgggccactgcgcctaccctgggcctcccactttaaaagttgctcaccagttcttgtatccctagcaccttccagaatgtgttgagtatagtcagtgctcagtgaatatttattgaatctaattgtcaaggaatatgccatttgctgtgttaattttccccaatatagtttttgttgttacatttttctccttaagccctagaaaagtgtaggctttttaaaaaatgaaaatgtttcattttatttcaagaaaggagccttaatctttatttgtatctatttacaaactgttaaagattttgactgcctcctaatgtctttcttaatctcacactttttgaataaaaagtgttaatatatccgttgtaaattgctggcagctcaatttgaaatatctttttgcacaatatgtactattaagtattctcgtgttattgctcagggtaagaaaagatgactgtttttttgccatttaaagcagtcgtctttttttaatgctgtatttaatttttaaaagacaaagtacagcttaatgaaacaggaacttgctgtttcaatgtgaaggacatgatactccagacacattctaaaaggaaatacatttttaaatataaatgtttggtgtttaatcattcattaggcaaaaatggagacatttgagttgtctggatcccttgagcacattttcatggcacttacatgtaatgaagcagctggcccaggatatattcataatcagtgtcactggagggcttaccatatgccaggcttggttctaattgcttaatgtggattgacccatttaatcccaaaataaccctacaaagttgatgtagtcatccctcttttaaaattgagattaaatttgcatagcataaaatgaaccattttaaggtcaacaatttagtgacatttagtctattcaccacattgggcaaccaccagctctatttccaaaacattttgatcaccctcaaaggaaccccataatccctcgtttaagaatcgggaaacagagacatggagataagcccctttccttaagttacccaactgggaagtgatggagccatgtttgagcccggacactgggactcaaggccactctctgtcgctctctgaagatctatactttagtcccactgccaccttacccacctcctaccaacctccagtgtagtgggggcaaagcacttcacttctaacctcaggttcttgaagtgaaaagcagtaagataatgtgctggttgccaagatctcagggctgcaaaaaaaaaaaaattccttacgctattctccatgggaatcaggccaaagcttttcttcatcaaatttcccgaccccatttctgcagaacaaacagcacaccaggcagggactcccctctgtttcttgatatcccacttccacatttatctattatcatcactctctcattcatgtttcagaagattcccacctcttcactagggtcgagactagcataaaacaaaagagatgaccagggtgcgaaatggaagggggcactccctctcagggtcctgtaagccgagtaagtactctctggcctcacgtagtcctggtcctgccccacacctcctccaagatcatgttcagttgctactccctctcattccttgcctccctctaaagaattctaggatccttttcacttctgactccttgtcctgtctctgaccatttatgtccctcctctctggagatgctcctgctctgttcgccctctaaattgtcttttttttttttcttactctatatccagctgggtcatctcgtccgctctgtgtgctactgtctttgtgttaactctcatacctgcagttctctttcaccctcagcctaggtgaccatatgtcctggttggcctggaaagtcccagtgtatgcttgttgtcttggaatcattattggcagtgcctcttgtcactctcaaaagtgatatgtaggcttggcatggtggctcacgcctgtaatcccagcactttgggaggccaaggcaggaggattgcttgagcccaggagtttgagaccagcctgggcaacatagtgaaaccccgtatctacaaaaaataaaaaaatagcccggtgtggtggcacatgcctgtagtcctagctacgtggaaggctgaaggtgggaggatcatgagcctggtaggttgaagctgcagtgagctaaaatcacgccactgcattccagcctgagtgacagagtgagaccctgtctaaaaaaaaaaaaaaaaaaaaaaaaaaagtgatgtcacatattgcagccttctccccagcactcctattctgctagcacgtttctcaggcatacaaaatgcaacagatcagaaataaaacttctcagggtcttgcctaaaggctgcaccacctcaattttctctatcttgactaattatatccacaaggaaagctgttggctcttcataaactcaatctcagttctccaaggctgaaggaagaccaccacacctggaagaacagctggacccagcagtctgcacctctgttccctgtcacccttccttggaatcaagggctactgctcatttaattctctagcccagcacttcccagcagctctttccgccatgacagaaatgctctatatttgtgttgtccgatttggcagccactagcacatgtggctattgagcacatgaaatagggcttgtgcagctgaggaactgacttaacaaagtacaagtagctagtggctactatatgttatagagcagctctacctcagtacttctcaaactttaacatgcatacaaaacacctggatctcactgaaaggtgcaatctgcttcagtacatctgcaacaagacctgagcgtccccattgtagtaggcttccaggtgaaactgacactgctggtctaagggccacactttgaggagaaaggcgctaatctaactcgattctcatccctggctcacatgagccacacgggggaaggtttaaaaatgtgtcagatgcccagggcctttcccaagccaattaaatcaggacctcagagagtaacctgggcattgacatgttttgaaagctcctcaggtgattctaatgtaagatgagcccagactgagctgctcaaataagactttactaaagatttagggttaagaagatggaattaaccagtgaatacaagtcagttagccactgggatttctgtgtggcacctactcatcttcagcctgaagtccctaatagagtctctgtatctgccttctcccccagatctcctgaaactggcagagaatgaaacagctctaacttcttttttttttgttttgttttgttttgttttgttttgttttgtttttgtttttgttttagagatagggtctcgctctgtcaccgaggctggagtgcagtggtgtgatcatggctcactgcagcttcaacctcctgggcccaagtgatctacttcaacctcccaagtagctgagactgcaggtgtgcaccactgcacctacctagtttttatttttttttgtagagacagggtcttgctatgttacccagcctggtctaacttctttaaatagatctggaaggtgccagacttagcctcacagttgtaaaagatttctgtctttgcaaagggctgttctagataatgtggcttttctgacatattgcatacatactctttgaattactttatacttttcttcacacacatgttcattgtatactttttaaaaagcaaatacagagaccagagctgtttaatagctgaggacctccctggactcagattctccctgaagcagtgttaggggctctgttttctgtgttcatataaccctcagtccataccttgttggaatggttgttattgctttatgatttctctatttgtacttctttctagactgagagctccttcaaagtagggccactgccctatttctctctgcctgtctatcccggccactatcagaacctcctggggaattcctccctcagacctactggttcagaatcttaagtggatgagccctggaatgtgtatgtttaaaaggcttcacagatgatctttattttcagacaggaatgaacatcattgccttagagactgacattatatctggaacatggtaaacattaaataactatttgttgagtgcatgaaaatcagtcttaaattcgacttgtggcatctcgaggcagatgccaccttagccaagtgatcaaggttaatgtcatgagtaacctgcatcaataccatttgccccccatgcaatgcattgcaaaggatacagtattactactctggtttccttccaagtgatgcataaccccagctgaatcatgaggaaacagcagacaaacccaaattgagggatattctacaaaatttgtgaccaatactcttcaaaagagtcaaggtcatgaaaaacaagtaaagactggggaatttgcacagattgaaggagaccaaggagacaggacaactaaatgccgcacaagattctgaattgtatcctggaatggaaaagggacattagtgggaaaactggtgaaatccaaataagttctgtgctttagttaacagcattgtgccaaggctaatttcttagttttgataaatgttctgtagttatgtaagatgttaacataaggagaagctcagtgaaggatgtattggaactctttgtaatatttttgcaacactgctgaaagtctgaatttatctcaaaaccaacaaaaggttaaatttaaaaaatgaatggaagataattgaaatgtcactgaacaagggcattctggaaggagagtaaagaagtccaaggggagaccattggttcgacaatcggaaccaaactggaccatcatagattacaagttgatgcccctatggttttgtcaaaactccctcatgtttttatagctattttgaggtataatttacataccatacggttcacccatttaaagtgtataattcactgtgttttagaatatttacagggttgcaccaccatcatcacaatctaattttggaacgtttttgtcccctttaaaaaaaaaaaaaacaacctatatccatttgctgtcactcaatatcccaccccaccagctgctgccaagcaaccattttttcctttctgtctctataggttttcctattctggacatttattttaaattgaatcatatgtgatattttgtgtctggcttctttcacttagcatgatgtttctgaggtttatccatgtggtagcatgtgtcagtacttcattcctatttgtggcccaataacattctgttgtatgaatacggaccacatttatttattcattcatcagtcgatgaacacctaataccttttggactattattctgatgggtttggttgaatactagggtagactgcccttccagcctcccatgctctatgcatccattgctccagaagatagactcttaggataaagagttgacaccatctccaagcatcccaaacagcattgtgtacttatatacatgattagccactttggaatgtctttagtgttaaggcaagaaatgtccttagagtcccagagagggaaaaaatgtgggttatgttatgtccaaatccataaccaccacttcagggagttgtgcagtgaattgctttattgaataagtgtgagaaaggaaagatattagttgtccaagaatgctattgccaaactttgtggaaacagagtattttctgtggaaacagcatacattttattctgtgccatggaatttcccctcatttgacccaaggggtaaagaaaaactcttatgcaaccatcccattttaaaagttattcttttatatgtaggctggttaataaccaacaacagacaattttatctaagatgactaagatcttgcatttcgcttttagtgagagctgatttacatatctaattcatgttctattagcagagttatgggaatataaggaaatgcaagaaaaacccaggacttggatcagattttaaagtcctacagttatatacagttgtgaagatgtccttcaaaatccagaaaccaaacagactctgtcatcttactttttgctgaggtgttggccttttatttttgaaatctagcaattttcacttcttgttatctaaaagttattaatacaaagcatttcctcccgtcatttacataactcttttccagcagtatgcacacgtacacacacacacacacacacacaatttaaatgtctatgagcaacttttgactttctggaaaattctttccccagcttgaaactttctccatattctggtgtttcacctgaatgtgaaatgaagacatttcacagaatctaagagttcagaaagaggcaccgtgctagatactcatgtgcatagtttctggtcttctcactggcccttccagtaacttgtggttattctagaagtccatgtccagaacagaacactgagcaacagatatcatctgggatccatgtttttggtctaattggccttttgggtgaacacatcatttgggctcaagttgatgattgtatcaagtaagccttttcagtctcttctgtgctgccactgagcctgttccaccaccaccttccctcacccccatcttgaaatcatgcatttggttgctgagacccaagtgtaggatacaaccgtttgttcccatgaccttttcaggtcctcctcatctttctggtttgtcttcctttcagcatctggtaattttgttgttgaatgggttggcctcacttcctagcttcatgttacctgcagacttggtcacgaagatgtgtataacttcatgtgagccattgataagcagggcaaaatagggaaagtgccacccccacaccatgcctgtcactggagactgctcggcagtttcatactttattacccctgagatctgttgtgaatcagcctcactaaaggtcttcccctctacattcccttgtgaacaagaatagctggaaagcccttacaaatgccttgcctgccaggcacagcggctcacgcttgtagtcccagcactttgggaggctgaggtgggtggatcgcttgagcccaggagtttgagaccagctggggcaacgtggcaaaaccccatctctacagaagatacaaaaattagccaggcgtagtggcacacacttgtagccccagctgcttgggaggctgaggtgggaggatttcttgagcccaggagattgaggctacagtgagctgtgattgctccactgcactccagcctgggtgacagagtgagaccctgtctcaaaacaaaaataaatgcctcttcatgattcccatggtttgtgtctagagatttccctcagcctaagaatctaaccgtaccaagtgaaagcaagagaggctgatcttgcatgtaatagtcactgaatgttctaagtgcttgcagaatattcttcaattgtctcttctagactcttgactaggatgtatatcagattcaccaatctgtggtttttgaagcatgttttttccttttcccttttgaaaactgcaaatgcatctctctgactccattcgtattacaggggaagatttagttattttatcttcaagttctccaagtatctgggtataatttgtcttcactataatgctaaaattcatttagaatatcttctaatcaatttgggacctcagttctctcttcattagatttttttcgtctactcttccctggctgaagctcattgtttttttaaaaatagatatatattttaaatttttaaatatttaattgacatgtaataattgtacatatttatggggtacaatgtgatatttctgtacattaatgcattgtgtaatgatcaaatcagggtaattggtatatccatcacttcaaacatttatcacttctttgtggtgaaaatattcaaattcctgtcttctagcttttttgaaatatgtgttgttaactatagtcattccagtgtgcattagagcaccagaacttattcctcctaactggtgatgttgtacccattgagtgacctcttcctacttttttgagacggagtttcactcttgttgcccagactggagtgcaatggcgcgatctcagctcaccgcaacctccgcctcccaggttcaagtgattctcctgcctcagcctccctagtagctgggattacaggcatgtgccaccacgcccggctaattttgtatttttagtagagacggggtttctccatgttggtcaggctggtctcaaactcccgacctcaggtgatccgccagcctcagcctctcaaagtgctgggattacaggcgtgagccactgcgcccggcttgacctcttcctacttctaactcccctcaccataaccctccatagcccctagtaacttctatccaattctctacttttatgagctcaacttttaaaaattccacatacaagcaggatcatgaggtatttgtctttctgggcctggcttatttatttcacttaatatgatgtcctccaggtgtatccgtgttgtcaaaaatgacaggatttattgttttttttatggctgaatagtagtctgtgtttttatccaagcagtcagaagcaaagtgcagaagagaatggggtttttttctttcattttttatttttactttttctttttgagacagggtcttgctctgtcacccaggctggagagcagtggtacaatctcagctcactgcagccttgacctcttggactcaagtgatcctcctgcctcagcctcctgagtagctgggactataggtgtgcaccaccatgcccagctaatatttttctttgttttttttttcttttcttttctttctttctttcttttttttttttttttttttgaagagatggatttttaccgtgtggtccagtgatctgccggcctcaggctcccaaagtgctgagactacaggcatgaaccaccgtgcctggctgagaatggggttttctttgcctattgtaatggaaacataaatccgtgaatttggcccgtgacctctttgctgttttttatcacaatgtcatgaactgctttgcagtttacaaagtgcccgcatgtgcatgtgatctttacaaccaccttgtgagctagtgagtttactacctgtattttagaaacaaagaagcagagttgaacttgcatttagtgacatggagggttgggtgacttttccaagttgtggagcctgttcatgaccaagttggatgcctcccagctttttcactatgcaatctttgccacatttatcacatacagtagtccccctttattcacggtttcactctccatggtgtcagttacctgtggtcaacagtggtccaaaataggtaagtacagaacaataagataagaaagagagactacattcacataactttgattacagtatattgttatagttgatctattattagttattgttgctaatttctcactgtgcctaatttataaatgaaactttattgtatgtatatacagggaaaaacactgtatatagggtttgttactatctgcagttttaggcatccactgggggtcttggaatgtatacctcatggataagtggggacctgtactttactatacgttggaagcacacctttctgactttctcccctgaaatccttgtttactctttaattcatgccattctctgtctttcatacacagtatgtgggaagggtgatgcccataagccactctaacttcctgcactccctttcatttctctgtggggctcaccgatgagtgagtatatttccagaacatcatttctgacatcatccaaatcctctaaagcagccttcctttaaaaactccaaccctggaatctaatctgcatttttggaacgtttgcaatatgctgaagtcagagctactccctttgctgtgccccacgtgcctgggcaccagcccctcggctccaccacctgatgtgcaagtcatgtcagtgtcctcccaagattcctttcacttccccaacttggtgcccaagggggatctgcactgggtctagtgcagcatcccccctaacgtgctttctacaagagggaattggcagcaatgctaggcaaggcgattcagaatcagcgactctacttttttgctgaataagacactgcagatctatttcgctgatttatttacattattctgcatgtccttggagagatggcagaaggttaagggacagcatcgattctttcagattcctcaaggctcttgcagatttcccatggtcctttgtactacaaagtgggagaatcaagcatcagatgaccttttcaatgttactctgttggttcaatctgtaacaactttttctcttgtcttcaccaacctctcactgctttccacaaaaaatgaaccatggcctgctattatttgttttcaattctgaatataataagatatcataaattgctttcacgaaagtactgatttgattatcacttatgatacaaattatgaaactgcaacatgagtgttttctctctgattcctttcaccatttcactgcagacttgaaaagggaccagaatggaccaaaaagaaattatttctttgttgttttgccaaagacctttcctttcaaaatgcacacatcctggagttttgaaaactgctataattatcacaaggcagtctttctgtgggaagaaagtgagtgaatttcccattaggagatcatggttaaaataatctctcggctctgggaccaaatggaactagaaagtgtgttcaaaagctgcattcatttcagaagggagaaagaacaacctttctcataatgagccttgggaagcagccagcgtggaaaaaggtcacacaattgccactttggtatctgaataactactcttagcttacttttgcttgtggtgtgatagcttttgtggttttctctggggctgaatccctgctgtcttcaagcatagttttcactgagtctgtcttggaaaccactgtgcgtgtggcattgtcatctaccatttttataggagacagaaacagttactctgacccaagtgactgaaatgcagctcagtaaattttttttcccaatagtcttagcatgtggataggacatttgttcttatccagaaatgaaatgtgttaagattgtgtgaaattatctgtatcttttgctgctcatttttcaaagattgccccggagggtgttttggtgaaattatttatggaatatgtaaaaatgttcaagaccctttatcagaacagaactgaggaggatgctgttcctgaagattctgcctactgcctatccaagatgcaaaatattagtggtattgaagagagatgagaggggagattattttaaggttatgtgtctttctacaattataccaatttttaaagtgtatttccagctgggcatggtggctcatacctgtaatcccagcactttgggagaccaaggtgggaggattgcctaaaccttggaatttgagaccagcctgggcaatgtagcaaaaccccatctctacagaaaaaaaaaaaaatcacaaaagttagccgggcatggtggcatgtacctgtagtcccagctactggggaggctggggtgggagggtcacttgagcccaggaagtcaaggctgtagtgagccgtgattgtgccactgcactccagcctgggtggtagagaccctgtatcaaaaaataaaaataaaaaatagtaaagaatatttccacaaatcagaagtgaaagagacagctcttggagaagggttcatattcataatacttttctcattgcttattttccaaaagctctaaaatggacttctatgtattaccactgcttcatattgcccacctacccaccttgttgctcctgtcatctaatgttatgaaaatagtgtttgggatttaaagcggaagccatgggttgatttttaagaagtcacagaagccaagactgctgagcactctggtgtcatcagaatgaacattccctgactccagtgagtatcctgacgtgtgtagttaactctcacaaactcaggcacgtgaatgatctcagcagaagagagagaagggccagtggtttaccccattgtctctcccctctttcaacatgggtcttgactaccttgcttccaggaagcaagggtgacagctgaaaaccaaccggaagcgttatttttgttgttgttgttttttgttgtagttgttgttgctgttgcttttgagcctccaaagaccaagatccacttaatagaccgtggcatttttgcctcatctactgacttaagaacttaatccatgaccctgtcactacaccccctgcacccccacccacgcacatttacatgctcactcgtacactcattcacactcacctctacctttagatttaacccactgagctgtactgagccagatgaactggactgttgattcttaccatttctggatcgtgggttcctgaagaatctggtgagaagttgtaaaccctcttccctgaaaagtgtctatacaaatgtgtgcagatttggcttatgattctggagggattcatggccaggaaatccatgttaggggatttacttttcactatataccctttgtttctgttgtgaggttgttactgtctgtgtatattacttctgttaattgaatctgtctaggttactttttcaattaacaaattaattagaagactaagagcctaaaagagatttttcttatctgattaagttcagtattgaatcctgagagtccatttgaaagcatagtattcgtcggctttttcaattgcaaaatatttatcgtgattgccaagaaatattgctgagagccaaaataataatagaggaaatgatctacagttgaatttttatctgaattattttgaacatagaaaatgaatttttgtaaataaaaaaataatagatgttggtgtggatgcagtgaaagggaacacttctacactgctggtgggaatgtaaactagtacaaccactatagaaatagtggggagattgcttaaagaactaaaagtagatctaccatttgatccagcaattccactactagctgtctacccagggggaaaaaaaatcatatgaaaaagatacttgcacgtgcatgtttatagcagcacagtttgcaattgcaaaagtatggaaccagcccaagtgcccatcaatcaacgagtggataaagaaaatgaggtgtgtgtgtatatatatatgtatgtgtgtatatgtatatatgtatattatatatatatgtatgtgtatatatatgtgtgtatatgtatgtgtatatatgtgtgtatatgtatatatatgtatgtgtatatatatgtatatatgtgtgtgtgtgtgtgtgtgtgtgtgtgtgtgtgtgtgtatgcacattcattctgtggaatactcagccatataaaggaactaaacaatggcattcgtggcaacctggatggaattggaggcaattattctaaatgaagtaactcaggaatggaaaaccaaacattgcatgttctcagttgtatgtgggagctaagttatgaggatgcaaaggcataagaatgatacactgggatttggggactcggggggaaaggctgggggtggcaagggataaaagactacacattgggtacagtgtacactgcttgggctatgggtgcaccaaaatctcagaaatcaccactaaagaagttattcatgtaaccaaacactacctgttccccaaaaacctattgaaataaaaaataaaatattaaaatgaatttttgtgttaatggtctcatattcaggtgggaaaaatcttcttacagttgccaaaaatggttacctggtagtatgaaaagggtaagagttgataatcctcgagaataaggataccttcctacagtgttttcagcatagcttattttgtgtgattctttgagagcaaaaaaaaaaaaaaaaaccccacgttttgggattgtagtgactgctttgccttgattgggctcctcatgggagccatttcttatactgaatctttcaccataccaaagagtgttataaccttcatgtacattttaaatgacagtcatattttacccttcccaacagggtttatgtaacatctttgtgcagtatgcttaaaatccacaaaactaaaatatctcaaaggagaaaagagaggttagtgatgaataaaaattgtagtgaagattgtcttgttttttccttctaaaattccttcctgtgtaaaagccgcctggccaactgatagtttttctttcaactcactgtgaaatatttttcttagcttgcatgttagcaccaagtgatgtatccattgtcactactgtgtgatatcagttgctgaggtgataaaacatggatttcttttttaacctggtactggaatggaggatggggaagaaaagagagtcaagaaaaggaatgatgcaactgacaggcatacattagtgaggtgccctattcatttatttcagtagctgtacatccttactttccagcactattgaatactctgtgggtggtaggatcgtgtgggggaaagagcatagttataatagctgacatttattgaacatttgctattctaagcacattatttatattaactcatctaatccctatgacaactatatggattagctgggttcaaatccggactcctccacttcctagctgtataaacttgtgcaacttcacttttttttttagatgaacaaaaactatccatctcttagggtagatgttagcattaattgagatggtagttctattgcatatataatcatgtctggtatataaaagaactcaaatgatgtaaaaaaaaatctctgtacacaaagacttcatggcagcatgattcataatagctccaaactgaagacagcccaaatgtccttcaactggtaaatagatttaaaaaagaattgtggtatattcatagtatggaatactactcagcaatgaaaaaaaggacatggatacacacaaaaacatggaaaaatctcaaacattatgttaagtgaagaaatagaaacacaaacatactgtgtgatttcatttatgtaacattctagaaaagcctaactgtggcaacaaaaagtagatcagtggttgccagaggttggggaaggagatcagctgcagaaaggtactaggaaactttgtaaagtgggggaactgttctgtatgttgattgtggtgattacaaaactgcatatgattactaaatttcgtaaaattgtacacttaaaaatgggtgaagcttaatgtatgtaaattatacctcaaagctagaaaaacacttgctgcaaattgtaaggttgtataacattagactttctcatattttagaacagttgaatgggttttatgcagctcgggttttcagagctacttagattatctcaaaggaaacttaatgcaggtgctattgagcacgcttcatacacatgcctatgaaaggtacaatggatgatgccaaagggacctgtgatagtctgtattagagaaattgtagagaaattgcagacagtttatatacactaaaccatcaagaaatcccatgagaattgaggatatgtgtcgcaggtgagtattggggcaggtcagaaagaagggagataatttagtagggataggggtggtcagggaaggcctctgacagaaataagacttgaaagtgttggataagttttctggaaataatttgagcagagatgtggcagttacaatacatacttaaaaatggctggactggagtatgttggaaagactcgaggactttgaggtctgtcagcttcacaaataaggttgcagagtgttcccagttctctagcctggagcttgtgtgtactggttcttaccctgattatgtcctcttccaattctgagtttagtgacgtttcatttattgcctgagattggccacgctgggaatatttaaagcgtgcaaattgacaatcattttggaaatctgtctcccccaacttcctacccaccccaccagccagttgtcaaccatttaccagcacactactgattgtaatcctgagaattatgaacttcagagaggggaacgaacagaagatccagaggtggctggagaggtgtagagagagccagaggggaaaaagatactcgtaagggagatgacaaggcacaaatattcaatgctgaaagagaagtaggatttttgttgttgtttccaagagaactgaagcagtaggatgccttatcacaagcacacatgtaaaaagcacctctcatacaagtcttttcagaccttcagtaaacagtgctcctccttgcctcaacttgtctgatatatacacagcactttgatggtcaatgcatgcagtgcagaattaggtcctcccttctctgtgcttcctggtattctttcagtttctggcacatggaaggcagtcgtagtggctgaatgaatgaaatcatgaactaatccttattgcggtattgctcatactgtatgcttgcaatacaaaaccttgcttacttgtttatctacctcattgaagtgcaaacttcagaagaaccaggaattttgtatcttgttgtaccctagcacttgccactgcacagttggtgctcaagaaatgcttattgaaataatgaaattaggcaatttcagttttagataacatgcaattaccaaaagatcaaatagcattctgttccatgaaacaaacccatgtcctttcttaaaacattcaaaagaggtgctattgagttatgtaaaacatgctagtctctattgtgggagggcattagtctgccaatatctcagtttctttttaacagtacagaaattgaagcaacttactatcaaagtttcttccagatctaagatgctatgattctaagaggaaagaaaattcagaccttgtgggcttaaaaccaggggtcctttattgctttctgttaaggtggaaagttatatatgacatagacattttctgtacttttggcttctttatatggattctatctatataagtgataagtgattaagtgaggttggctagtaattattgcctcactctattcaatttctcttctgtcttatctgtggtaggctgaacaatggcccccctagatgtccaggtcataagccatgaaacctgtgaatatgttcccttatgtggcaaaagagactttgcagatgtgattaagttaaggatctcaaaatggggagattactctggattatctcagtgggcccaatgtcatcacagcatccttataagaaggaggcaggagagttagaaggagatgtgaggatggaagcagagattagaaagataaagatcggaaagatgttatgttgctgactttgaagatggagaaaggggccacaagccacagattataagaggcgagtagaagctgaaaaaagcaaggaaatggattctcctttagagcttccgtaagaactcagtcccccagtttgggcaatatggcaaatccctgtctctacaaaatatacaaaaagtagctgggcatggtggcgcatgcctgtaatcccagctacttgggaggctgcggcagggggattgcatgagcccaggaggtcaaggctgcagtgagctatgatcgcacctctgcactccagcctgggtgacagagtgagaacctgtcaaaaaaaaaaaataataaaaaaaaaaataaaggtgcagacaccttgacttcagcctagcagaactgattttgaacttctggcctcaagaactttcagagaataaatttgcattgttttaagcgattaaatccgtggtcattcgttacaacagccataggaaactaataaaacatctcttctgaagatttaaaaatagcattctttgctttccaaatttcactgtgcataggaccacctggggatcttgttaaaatgcagattctgattcaggggggtctgaggatggtcatgaagatttacaattgtcttgagatcccagatgctgctgctgctgctggttgtagcccacactttgaatgggaaagctctggaggaggtattcattgtctgggcttctctttcctttattgcctttggtcatcattactaaaatattgtatcctgttgggactctttggtttctgtgagcatgtagagaattagaaagccacaaagacttggagtagagccaacatggggaggattttaaaaagctgcaattgttcaacctgaagaaaagacagaagatgatttaataatgatatgtaagaaaccagagagttaatatgtgggaaatggtgattaactgcccctcatctttactttacaggataaaatagcaagaagaatttgggcttaagaactccatactggcagggaggtggtggttctctttgactgttagaattgtacagctgcaagggccctgggatccatctagttgtacccactcattttgtagatgaaactgaagctgagagtgacctttggaaggtcacaagcaaatgacagaatctgtactagaactggtggcttggccatgttcactgcaccaccgcagtggaggctgtgccatggggtttagataattggtagttgctcatcactttgaagtgatttaaaattggggctgtcccagggagccttctagggtggcagaagtgttctgtatcttgctcttgggttcagttatacaggtgtatgcatgtgtgtgtgtaaaactcatcaagttgtaaacttgacctttgcatacttgaccgtacactgattattcagcaattttgaaattttttgctagcatttagaaaatgaaaatgctgaactcttcgttgtagccaaacactggaaatgatccaaatgtccttcaaattagactagatacataaactgtggcaaatttatagaatggatttctatatagcagtgagagtaaatgaactgtaccatacagcaacatagatgagtctcacaagcatgttggtgactgaaagaagccagacacaaaagagaacattccataggattctatctatataaaagtcgaaactgagcaaacttaacatggccttaaaagtcaggggagccgggcgcggtggctcacgcctataatcgcaacactttgagagaccaaggtgggcagatcacttgaagccaggagtttgagaccagcctggccagcattgtgaaacctcatctctactaaaaatacaaaaattagccaggtatggtggcacgtgcctgtaatgccagctgcttgggaggctgaggcaggagaatcgcttgaacctgggaggtggaggttgcagtgaaccgagatcgcaccactgcactccagcctgggtgacagagcgagactctgtgtcaaaaaaaaaaggggagtggctaactatgagggaagtattagggacacaaggggggctctacctggctacatggttatatccactttgtgaaaatgaagcacaatgtattcatttgcacattttctttatgtacatttcaattaaaagttaaaattggttgagagaggttgggagaagaacttctcacaaacctctgtatactattaagctttgaagaatttaggttttttaaagctttttaaattgacaaataataattgttcatatccatagagtacatagtgatgtttcaatgcatataatgtttagcagtcagatcagggtaattagcatatccctcatctcaaacatttatttccttttgttaggaatgttcaatatcttcttagctatttgaaatgatatattgttaactctagccatcccagagtggtatagaacactaaaacttattcctcctgtctagctgtaattttggtttcattacttattttttaaaagcacaggtggaggtaattgcattagaaaacatgtactttcatagaatccctggaagataacttgctgtggagagaaaccttcagttaaggagtctgtatatttaaatctcagttctaagccaaaagccatctcttctcttgtcagctttctctctgagctagtacagtctttctttcatgaaaatctatgaagccagcaccatcctcagatcctttttggccctttgtagttctacagaatgggggcattttttaaaagaagcagcttgaaataaatagtaattttgttaggagacaatgttgtcatgccaggcacacttccctgcagcagtgcctggagtgccacagttggtttcaaatggtgtgaagcggttccagacaagcagccgaccaaacagaacttgtcaccccaagccagaattcccccaaagccatatctgcttcctgccactggtggtatagtttcaaaccagctggctagcctacctgagataatttcatcatgtgaggttgtacagaaaagggttgacttgaccaatctgagactatcttggacaaggccagcttgcaaggttggcccttggctggcatcgggaacttggtggtaagcagttccctgcagtgataagaactttccctaagtgataaggctggttcaggatggctagactgtgctaacactatggcttatgctgaacacctttccttccttcctggagtctggaatttcaatatgtttaggcagagggtgcctccatgaccagcctgcctttctaaccagcttttctgggcagaactgtcacacatattattgtgacttcattggtaggggcaaagtgtgcccatgcgatatctcctgggaagagagagcataaggaagtctgcatgtggattcttccagactccacgtgtgtctttttccctttttttttttttttttttttttgaggtggtgtctcaccctgtcgcccagggagtaacctcagctcactgcaacctctgcctcccaggttcaagtgattcttatgcctcaacctcccgagtagctgggattacaggcatgcaccactacgtctggctaatttttgtatttttagtagagatggggtttcaccatgttggccaggctggtcccgaactcctgacctcaagtgattcacccacctcagccttccaaagtgttgggattacaggcatgagccactgtgcccagcttgtgtctttttcctttatgatccttgtatccttgttaagttgctgtaataaatattggctctaagtacaactatatactaagtcccatggatccttctgtcgaatctcagaacatggggtggtctttgggacgcaggtacctaagtgaatatttaaagtagttttcagcttttttcctgatgaaaataaggtgagaagatactcctgggtgcttctggtgggagtacgaacatggaacaacccttgtcgaggacatgttgtcagtttctagcagatcatacattcattgaccctttgatccaggattcccacttctggaaatttatcctgtagctgtaacaatacctgtacaaaatgatacacataaaaggtttttggctgggcatggtggcgtgcacctgtagtcttagctacttgggaggctgaggcgggaggatcacttgagcccaggagtttgaaggtcaaggctgcagtgagccatggtcatgccactgcactccaacctgggtgacagagtgaaacccagtctttaaaaaaaaaaaaaaaaagtttttgttgtactcttcccccagcctttatttgtaatagcaaaagaccagaaactagtattgtcctgtatggggctgctgagtctctgagggtacattcacactaggaatgactgcagctagaatagaacgaagaagttgtatgtgattaatagaaagttttctcatgtgaattaaatcaaaagcagggtacagaacagttaagtctagtactgtgtgctccttttctgggcgaagggtgtgtgatgctctgaataactattaaaagtggtgacctgtagggggcaagttagacagtgaatgaaggcagaaatgagaactctgtgtatacttccttatattgctttcatttttgtgtcaattacctattaagttttttttaattgaaaatgaaaagagctgagaggaggcagtctgcttgaggtgaatcaaaatcaaggtattataagtgaaataaaaattttacatacttaattttctctttgtttacatcaggtatggcccatgagtcagccacctgtttttgtaaataaaaaaatcttggaacacagtcatgtccattgttttacatatgctccttggctgcttttttgctacggtggcagagttgagtcattgcaaaagagaccagatggcccacaaaacctaaaatattgactattctggccgtttacaaaaaagtttgatgaccctgcacctgtagtgtttagttatggcttatatcagtgttgatgccctgcctaaggatatcaggatggattggaatttgattcatctgtagtaggtaaggccaatggtagtcatttgaaagatgccattttttataaactctgagcaaactcatgttacgtgattgctggggggtcaggggagggggattttactctacaaagacacattagtctatttctaaaacctgccaagagaaattttaagaagcaatgaatgatctcttctctaaagtgtggtgcctctgagacaatctaccttcctggcaatgataccctagctaaatgttgtctttgaagatttatatcatcagaatcatggaaactggacctctccaggagaaactgaggtctgcactgtgcaagatgggatcattgtccctcgatttcagctggttttttttttttcattgcatgcctgaggtgactttacccatccttccagaacaaaatggattattctttgagatgtctggtgattatcataaaccattatcatatggttctgtgatataggaccgtaagcaaggcatttgaataatcatgattttatatgagtaatgatgatagctactgttcactgagggcctactgtgtgtcaggcagcgtgtaaggtgttttatgtgtattacatctatttaatcttcccctcaaccttcagggattgatatgatcattttcactctacaggtaaggaaaccaaggcttagagtttaagttactgaagaggtgatgttgctggtaagtggcagaggtgaaattagaacccagctctggctcagaatctatattctgttccatacttcagtgacttggaatgggaattagttacgaggtagaaccccattcagattaactaactttttttttttttttttttttggagatggagtctcgctctgttgcccaggttggagtgcaatggcacaatctcagctcactgcagcctctgcctcctgggttcaagcgattctcctgcctcagcctcccgagtagctgggactacaggcatgcaccaccgcgcccagctaatttttgtatttttagtagagatggagtttcaccagttggccaggctggtcttgaactcctgacctcaagtgatttgcccaccttggcctcccaaagtgctgggattacaggcacgagcccccatgcctggcctagattaactttttttcaaagaagtgagttcaatatagttttaatttattggtaaaatgaatcattacaaatattttaaataacgataccaataaaaacaatgcttttattcattgcatgtcctaaagactacatgtagtttcattgacgtcttccattgactttgtgaaagatatttagtattctcattttttcaaagaagctggatattaaagagcttaagtatattgcccatactcacatgtatggttcaaccaaggtccagactcccatcccctggaacctgttctgtctactgtgctacatggatttaaggcttgaattagtaacttggcagactgactgtccaagagacaaacatgctgttcaaagtatttgtcctagtccatttgtattgctataaaggaacgcctgaggctgggtaatttataagaaaagaggtttatttgactcacagttctggagactgtacaagaagcatggcaccagcatctgcatccagtaaaggcctcaggaagcttccactcatggcagaagggaaaggagctatcacatagagtgtgagagaggaagcaagagaaagaggggaaggaggtgccaggctctttttaacaaccagctctctcaggagctaacagaggaagaacccactcactcccttccactcagagaggacattaatgtattcatgagggattcacctccgtgactcaaacacctctcattgggccccatctccaatattggcatcagatttcaaaatgagatttggaggggacaaacatccaaactatagtagtgttcctatattttattattttttgagacagagtcttgctctgtcacccaggctggagcgcagtgatgccatctcggctcactgcagcctctcctttgtaggttcaagcgattctcctgcctcagcctcctgagttggtgggactacaggtgcgtgccaccatgcctggctaatttttgtatttttagtaaagatgaggtttcaccatgttggccaggctggtatcgaactcctgacctcaggtgacccgccccctcagcctcccaaaatgctgagattacagggatgagccaccacaccgggcctatattttattactctcccccccacccccaaaataacatatattaaaaatgttgcttttggccaactccctgattctgtttctattccctttttgccatcaattatggtagttatgttctaacaaattgatttttactttcttgtgctgatgactttagcaactcctatgtgaaggtaattgctagttttattgtcttaacattatgctaactgttagtgtaatccagagtaatcaatggtatccagcctggagctgattatgttcaattgtttcaccaatcatttgtctgtatttatgatacacccatgtacacatctggcctccaggcaatggcaatgactgtgtgtatgaaagaatcaagtgaatgtaatgtaaggcagtgtgtgattatgtcaaaatggatgggacagggtgttggtgccgtaagagttcacagaaagctaaagtggtaagaaaatgccttgtggaaaccctgatgattctatcttcttggcgtcagcctacttttgaattcagcctacctttctcaaattctgtttctacctggtccaagtcaccatcatctctgatgtggattactatgcttactccctatttcttccacatttatttttttaaacaattgtatttgggtataatttacatattataaaatttaccagagtatttccatcactcagtaaaattcgatgagcttatttacagttagttcctattcccatctctagtcccaggttccttgaggaaccatgcatcaagttttcatctctactgtgtgcctgttttggacattttatgtaaatgggcttacatatgttcttttgtgtctggcttttttctctgagcatggtatttttcaggttcatccatattgtaccatgtattagtactttgtttttattgccagaaaatgttccacagtgtggattgaccatattttgtttatccatgtaccagttgatggatgcttagattctgtgaacattcatgtacaagtttttgtgtggacagaagtttttatttctcttgagtatatacctaggagcagaattatcatatgataactctttaactttttgagaaacttccgtattgtttcccaaagtagctgcatcattttatattcagtgtatgagggttcctggttttccacatcctcactaacacttgttattgtcttttttcttatagccattctagtttgtgtaaagttgtatttcattccctctttcagtctctaaacaaccggcagaataattttttattgtttttttacaaatgcatatctgctatcttacaccctgactgaatctctttaatggcttccatcacatgtaaaataaagtctaaataaattctttgacctgttgtcacaggtcgggttccctaggaagtacactctgagatggagaggtttgttgaggattgctttcagggtaaacacctgtaggggcatgaaagaagcaggactgagcagagggagaagttgggctgcagcatcatcccaaccaaggtctcagcttatcctattggaaccttcagaggtgggaaggctctgcaaggttggctggacaaaggatctgggtctttatgcacccatattgaccagtcactgagtgccagatgcccctgagccagggacatgaccatgggcaagacggctttcttcagtagagtacaatcactaggaggaagtcctcagccacaagctgtcatctgtcaactttgccagcagctgggggtatcagtatatcagtccggaaggaggggaatctgggtgatatattacagcatccactatacctgagctgagagccatcacattctggtcttctcgacttatctcttaatacttcctttcttgctgtctgggctctagccacactgctttaaatttctttatgttctcaagtttcttccaaccttaggatctttgcacatactattcctattggtttatggccataccaatttaaacacctccaatcttatctagaaagtgagagcattttaaaaatcagtgtttaaatcgtatttgtaaagttgcttgaaaaaggactaggctattaggctagtgttaaagctgtcatttggagggcctttttagctttattataaattccaatattgggaattgctcatttgacatgatgtataggagccattttctaatggaccagcattaatccacttatagctgagtggccaacagattagcaagcacttccattttctataaagaaatggatattgtaaaggcctgggtgatgctgaggaggaggctcaataggatcatatttcttgtattcaaactgcaaaaatataagtaggattaatgttatgttagagtttagatggaggtattaatacattgcatttagaaataatacactgaaatctataaagaacaagagtatttgtttaaagtagactttggagagaaactcattggtaaatcttgaaatttggtctctaaataattaaaagttgtttggattttttaaaaaattgccatgtttccctcttaactgattttctgccaaattttcctgttcagcactcagaacttgggcagcagttggtgtgtaagggatgtttgcacacatataagatggtgttttttccttcatctctaatgatttcataaggtctcagttctatatgacatttggattttgaatttataataccatgtttatatatttaacatggacacatggcaagtgctgggaattaaagctaaatatagacttgttgactgaacaatcaaactatctgcttgtcttagtccattagtagtagtttcactggtatggttgatagaaagcactcaccctcctcatacgtgcatgagacgaggccaagaagtgattcctgtgtaaattggcagccatgacagtaatgatgtttgcctaaaacatgtgtcagtaataggaaagatgattaggcaaagaagaaaaagtttaaaaaaaaaaaaaaaaaaaagctggcgcagtggctcacgcctgtaatcccagcactttgggaggccgaggcgggtggatcataaggtcaggagatcgagtccatcctggctaacatggtgaaaccccgtctctactaaaaaaaatacaaaaatttagtctggcattgtggcgggcgcctgtagtaccagctacttgggaggctgaggcaggggaatggcgtgaacccagagggcggagcttgcagtgagctgagatcacgccactgcactccagcctgggcgacagagcaagactccatctcaaaaaaatgaaataaaaaataaaaaaaaagatggtcgagggagagatgcgtatttgctctgagtgttcagagatttccttacacttctctatatagataagaaaacaaatatgagcccacagtgggtataaagcaacctttttctaagaagtggactggaaataagtctggtttttggttcaaggagggcctgggaagtatccagcatgatgtccgggaacacagatcagaagtagacaactgagcctagaaatgctggggttgagtgggagatgggatggatgcatgagtaggtgggtgcgtgggtgggaattcagaatttcgtagaggaaatggaagtagggaaaagggacagcactcaggtgggaaactcagaggtttagctgtcactgggagacagccaaatgggagaggaagggaaaggtggaaaatgagaaagagagaaaggaatgcagaatggagaacggggttttggcattcttttctgtccttacttgttctacctgtgataaagaacccatcagtttggacacagtgtcccttcatggcctggcaagaatcctcagtaggacacaacctcctacgtgggagtggtgattcagaggaaacacatggtgaggataattaatttggaggttgaccatgttctgtgtgggtgtttacctctttcagaacatgtagctgaaagttcagcgtgtactattgaaaagctttcttgcaacgttgctggctgtccttggtcttgagactaaagcatcccatagaagtggtggaacgctaaagattgaaacaaaccactgaaaattgatttataaatatataactagttgtaagctgaagactaaagcatcccatagaagtggtagaatgctaaagattgaaacaaaccactgaaaattgatttataaatatataactagttgtaagctgaaatctaaataactttttaagttaaatatatatacaaaaatattagaagaaggagaattttcactctcaactcattcttgcatagaaaaataaaatctatcatctctgtatattagaagcattttgtttttggaagaggttgttggaataggttatatggaaggccatttcattcaaatgaacaaaaattacgtgagatggaaattggcaaatttatcccaagtaaatactgaaaaacctggaagcctttcaggtgctcagatttccactatagaaaagaaaacattctggccaggtgcagtggctcatgcctgtaatcccggcactttgggaggcccaggtaggtggatcacctgaggtcaggagtttgagaccagcgtggccaacctggtgaaacctcatctctactaaaaatacaaaaattagcagggcatggtgacgtatgcctgtagtcccagctactcgggaggctgaggcatgggaatcgcttgaacccaggagatggaggttgccgtgagccaagatcacaccactgcactccagcctgggcaacagagcgagactccgtctcaaaaaaaaaaaaaaagaaaaagaaaaaacgttctgaaaataaataaaaagaaacattctggcacatattagaaggtaccagagtaagagaggcaagataaatcccagctttgttggtcatactgcatatcaaaaacaatgaattgtcttttctgttttcttatttttgtttagagcatagtcagtggttcaagaactctaagccatagatagctcagacactaggaaagatgttggctgactttgagggggaaccacttgtagctatagacaaccagaaaatgctgtggtccataccatgaaatattttgtcttactgaagtttgaagatccttccagatcccggcattgatctggagaatgatattctccacatacttgggctccaagtctttgtgtccagggcttggcaattaccttattgtatccagtggaataataattttgatgctatttgttcaaataattctgaatgtactaaatggatgacattgttaaatgggacatttggctgttacaggatgtgtgtgtgattgattaaagcaaattttaactgtcagaagatgaaggcactaaaagtttttgccatctaacaagcatcagtcagatatgaaaataggtgtttccagtcacttttattaataacataatcaacatttgtgctaaactagagttctttcaaaatggaatttggcaatgccaaaatagccaaaactacaaagctaccgtgtggtactggcctaagaatggacatatagatcaataggatatcattgagagtccagaaataacccttatgtttatagtcaattgattttcatcaaggatactaagacaattcagtggggaaagaatactcttttcaataaatggtgctgggacaattggatatccacatgtaaaagaatgaagttgcacccctacctcatatacacaaaaattaactcacgatggatcatagacctagatgtaaaaactaaaattataaaactgttagaagaaaacacaggagtaaatcttcatgaccttggtttagacagtggtttcttagatgcaacaatagcaacaaaggaaaagaatagatacattggactttatcagaattaaaaactattgagctgcaaaggacaccatcaagaaagtaaaaagagaactcacagaatgggagaaaatatttaaaatcatatatctaagagacttgcatccagaatatattaaaattaataataagacaacccaaaataaaaataaaggatgtgataggcatttctctaaaaaatttacaaatatccaataagcttatgaaagatgttcaacatcattagttgggaaatgcaaattgaaaccacaatgagatatcacttcacacccactatcatggctgaaatcaaaagacagtaaatacatgttggtgaggatgtggagaaactgaaaccctcacatgctactagtgggaacgtaaaatggtacagctgctttggaaaacataatggcagtttctctaatggttaaatataggattaccatatgacccaacaattctactttcaggtatatacccaaaagaaatgaaaacttgtgttcacacaaaagcttgtacatgagtgttcatagtagtagtgttcataatagccaacaggtggaaacaactcaaatgtccatcaactgatgagtggatcaacaaaatgtggtatatcctgcaatgcagtatgattcagcaataaaaagaaaggaaatactaacacatgctacagcatcaatgacccttgaaaacattaagtaaaagactccagtcacaaaggactacatatccatgtgtccagaaaaggcaagtttatggagaaagtagaaagtttatggagaaagctcctaatggttgctttgaaccagagttgaggggtgagggtagggtagggaggaatacagattgactgctaatgggatcttttagtagggactgaagtgttcaaaattagatcgtgttaacagttgcgatcatatattttgaacaagtggaaaggggggaatatattaaaaattgtacacttaaaatggtgaattgtatggtatgtcaatgataataaaggtgtttgttaaaaaaatgagttttggcttcatcgtaatcagtgaaagaaatatgttgagtaaatattaatacattattttatgctgtgtccattgactcatattttaatctgggaaatatgcatctttaattactgccattgtgtgcttaaggctgatgtgtttgggtagcttttaaaaaattttttttcttttaaaaaattttttgtagacatgggggcctcactatgttgcccaggctgctcctgaactcctggcctcaagcaatcctcccatctcagcctcccagagcactaagttataggcatgagccaccaggtctggccacagatctttttgacaatggaaatggttgttctttgatcaggtcaataaaataattactgctggcagagggatgtgcctcctgttcaatgtggaggtcattaggggcccctgggcttcataaaccacagggggaaattgagaactacttagtgtttctatgcactgagctcctaccgacgtaatgtgttaggtgtctaaatttgcactttatgatatatttcgccaaattttctctccctggcaatgaagtgatgtttacttaacagtttcttaaaagagatggtactctgtgatccatttttatttatgataggaaaattacacttttattttaaaagccaaaggtcatagccattgcagatattctagtaattattatttgagaaatcagttctcactgaatgcaatgacaattttctaaacctagaataggtgctgtggcgtggtaccagaggagtaacatatgtggcccttgttccatgagagatcaaagtcgttttggaatgtaaaacttaaacacatgaatattttggagaaaaagaatgtcatattgtagtaaattggggggacatagacctatgacatggtgagaatcgattcattgaggtttcccacaagctgtagcccttgagttgcaccttgaagatgaatagaatagaattagaacaaatcgaaagggaggaagagtgagaaggaaactggtccaagaagcagaggtgagaaggtacatggggtagccaagagaaacatggtgggtgagcatggcagagagtccagcaatccatgaaggtcggtgatagccagcccatctattaagcaggggttccattgtagattggttgaacaactccatgaaagtgttagttctggacagataagccttggcctgtgatttgaagtgggagaacatagaagtagaaaaccaggtagattgccattacctccacccaagtctgaggccaggaggagaggctgaagaaaggggtgagggtggatttaaactactgacaaacacctcccaccaccgcccccacacatgtatatttggtgactaatcaaatgtggggaaaccctagctaactcatgtattttagagagaacatgcctacgatatgtaaaggcattctgtagatcttggatgactgctccagactctaaggtgatgtgaaaatatattatgacaaccatcatacagacatccagagggatggaagtgagataacttcccatagcgacctagctggcaaatggcagagctgaggttctgaagtcttgaaatgaagatgttggaagggtagtgatgcctttgatgggaaggacagccttgggaaggatgacggaggcatctgctggggagtgggaagatgaactcaacttatcatactgagtttaggaggatgtgaaatatttaagtgaaagtatgtgtacgtataaatgtgtatatgtgcatggatacatatgtatatgttatgtatatataaatgtgtatgtgtgggcacatgtgcgttcatgcatgtacatatgtttattcatatatgaacgtctaaagtatgcaggtatgccttatgcatgtatatatgagacatgcacatacacccatgcatgcatatatgcaatcacatactttcacttaaatattttacatcctcctaaattcaaaatattctaagctgaattcatcttctctgtccctatccgacacctcctttgtgcttcccttcatacgtgtgtatatgtgcatatatgtaaatgtgtatatacctacatacacacacacacacatttgtgtgtctgtgtggtaaatgagccattagagcttagaaaagaaatcatggcctaaaatttagaattgagagtttggagccgggaggaatcatgtgaatctattataaagggtaatgtccggggagaggagagagaggagccttttgaacattcacagatagatcacagggagaaatggagatgtagccacaacaaaggaagattcgctgggggtggaggaattccttcttacttgggcaactgctctagggagtgctagcttccaagtaggagcccaagaagtatcatctgatgtttgtcagtatttttaaaaatatatttattgcgcttctactatacaccagtcaacaagtgaggggatggggacaccaggaaatgtcaggcgcgtggtgtcagccttcccggagcccgcaggcagggaggtcgtgctaaaattgctagcatagcacactgaggtgagctgtggcttcccagtacagagcagcttagattgctgtaggtgggtggctggaggcaggggttacagaagagagcatcagagctgagcctggagggttggtggcatgctgcttagtcaggtactcctcttggaggacaggaatgaggtattgcatgtaaattccttagctaaatgaaatatgtctttaaaacttttcgtccaagtattacatgccttctcaagctatcattttaataaggtccacattgccaattgttttcatttgtggattgtacttttggtgttgtatctaaacacctttgtcaaaagccagttgactacatttctgtgggtctatttcagggcgttctattctgttctactaatccatgtacgtccatttatcactaccacactgccttgatctgcatagctttatagttgtcttgaaatccagtagtctgagtcctctttgttctttttcagaataaccttggctatcctagattcttttcctttccgataagaactttagaatcagcttgtcagtatctacaataaggcttgtcaggattttgacctgattgcattaaatctataaatgaaattgaaaatgaaaccctcattttgaacatcagttttccagttgggctttaattcctagaagacctggaattaggagaggcccaaattgagacatgatccaggccaatgaaacatcacttaacagggaaagaggggtgtgtgtgtgcggtacatgagaaagcgagatggaaatcagaaccagaaagaggctgagccaggatcaatgactggagactcggtcccacaggcatggatgttggtcccagtgtggtgtatcgctgaaaagagtcaaactctgtaaaaatatttaaagaagtttattcggagccaaatatgagtgaccacggcccaaggcacagtctcaagaggtcctgagaacatatgtctaaggtgattgggtaatagcttgattttaaacattttaggtagacaagttataggcagacatcaatcaatacatgtaagattggttcagtccagaaaggtgggacatcttgaagttggtggggcagagtccagaccataggtgcatttaaagatttcctgattggcagttggttgaaacggttaagctctgccttgaagggttgaaatcagcaaaaagaaatgatagtagttaagataaggggggttgtggaagccaaggttcttcttatatagatgaagcttccaggtagcaggcttcagagagattagatggtaaacatctcaaagtattatgggacctacaaatattctgtttggtccgttctgagatctcagttttaatgtgaatgctggtcagttgtgccttatttccaaattgggaggagggtatcatgaggcatcttggtctgaactagtttttcagatttactttggagtccccttggcaggaggggtccagtcaataggttgggggcttagaattttatttttggtttacaggaggatgggcagagctgagcacctaggcctgagggagagggacaatgtctaggcctctaataaaggcaataggctacagtagttctgcagggaccatgtgtaggatgccaagcacatggtcccttgccatcaggttcagctgcctccccttcctccctttgggcaggggaaggcaggaatgcatgggccttccagagcctagctcagcccccagctggtgcctggttccaccttggcccttaggagagctctgacactctgaatgtcactggccttgtcttaggggccttagaaaccaatgagtgataattaaggaactggagcttgtatgaagaaggtgccactttaagtgtccctgatggttttgagttgccactaaagagctcagagccctttcaaagaattcagtctgagccagatgaatcttaatttctcaccctcaaattgagatgcagtcctttggagaattaatatttagtggcatggaacacaaatcatttcttttgctggactcttaaagatgtactagattgattttgtttttatgacctttcaaaaacatcgcagtctgttttgctagctccagcctgttgaagttttagaactcatctttagcaacatcaaaggtgacagggacagcctttgagaaaggtacgcatgaagtgattgctggcatcccatagtcaagtctcaggataaagcatccatattgcctttttttttttttcttttttttcctttttactagtggagataggaaacctataaataagcatggcagaggtgtcccctctgaagattgccccttactaagtatttacagtaactggatttctttattttgtcagtttctccaggaagaaaggtgatgtcatgctccatagcaagatgagagaaggagtttagggtttgtaatttttttttaatcaaagaatttaattgcaatttaatgacgagagagaggatgtttattacacggtggtccaataaatactttctaataagtttttaagccatttgagggaaggcttgctacaacaaaattgacaatcaggcaagccgctttgaaggaagcaaatccatgaattttcagacactgttgctaagcgcagctttgctttcccctctgcttccccccccccccccccccaccaacttgctttgaaaaagcaaagcttaaaagcctctattgtgtggagggggggaatatgctaatttgcagcacatttcccatcagactctttttttggcctgtcatagctgagatatgaatgatgataaagagaggagaaggtggcattatgagggttcggggttttgttattgtgcagagagaaaggggatgaatagggtggcacctccagtcacccgtgaagcccccctgggtctgcgggctgcctggagttgagtgggttctcatgggtctgttctgcccttcccccaggcactgccacaatctactggtgactcagcggccccctcgggggaaggccgtgtgtgtaaaatgaataaacacgccagggtggggaacttctacaggggactaggaaaggggacttctacctcctagataagtcgtaacaaagaaaaagagaaatcagtgttttgacatggcagtaacaactttatgagatatcaaggttgtgattgaagggatatctagatacatatcccttcaaagctgtcatgtcgtggtttcatacaatttgggttgcgtttatttttgtcaagtcttcagcttattcagttggctctcttgccggataactggatatgtagttaaatttttatgcattaaacattgatttttatggggcaaagttagctagcatttctgaacaatgagacaacagtattggatgcttactcctgtgttcaacaatatgaaaaacatgttttccttcttgctctgagtggttgattttttttgcaggaaagcgcattgattttgttcctcgtgagcactccttagctcagttttttaaatgtatgaattttataactgaagaataatgcatgcattagcaaacagctattaagacctgcaaaagtgcttccaaattgaaatttcgcatgagtcattggaggcaatttgtatatgtcaggtacacacgtagtgtgttctgtatagttcatgaaagtgaatcgtttgaagctagaaaaggaatgttaattgcattctaggtttgtgttgagtacttagtcgatactgatggtagtatgctttaggtgtgaaacaaaaatataggatgtctttactgcaatagtaaggtgcttttaaaaataaatacataaataaataaacatagcatctttgcttctcttgactctaaattctgaacagctaaagcatgacaaatctttgcactgtaaaaatgggacgttatttatatccacagaacttcattggatagaaactagggttagagctcattcatttacctctacaaataggtagctcacttatccagatgcatgcaggtattaaatgattaagcctctgtagatttttttcttccttaaattaaggtctggagtcttctgtttggtgagtctttcactggtatggtaagcatgctttagcattagaatcacacaacccatttaagttaccattaatttttttctgattgaagttgtagcagatcaaggatatcatcgtgaaggagcagatcagccacctgtatgagtgatttaaagtgcaaactgctactggttgtaagctcaagacttgtctcattcaaactctggcaggtcacaaaacgtttaacacatcttgcttattaacctcaacaggtggtgtaagattagcatttgagagccacgtgttctgaagaccatcctgcatttgtttgagtcagctttggcatgcggctaagctgtcactctgttcatatcttcagaaactagaagctaatacattgtcttgccaagcatttttcacatctagcactgatggtgtacctctgtgttttactataaaatgtaaaagttgaatgaagttgggagttaagcagactctgaaagtgagacttcttgtcactgatttgaaactcagggatgcactagcccctcttagttcttgatgtttcaggcaaaaccctgatgatggtgccatgactggaaaaaaatcctgtatagacagctttttaaaaggtacacgtaagactagcttttatctacatgttgtatttaatacttaatctagccaggaactcttctcatctgtttactacatcctcatttaatcttcccagtcacttgaaggtggatatgactaaatattacagtgtacaggtgaggctctgaggcaccaaggagttaagaaacttgctcccattgtagagttgaagaaaaactcctagctttttcactggggtctaggacaccccccaaaaaactgaaattcctaaaagtgtatcagatagagaacttctgattatttctcaagtacccattcagatagtatttcttctaggaagccgtgcttgccacacatcctctgccccttccagcttttattggccattcttgctggcagagttaagcttgactacatacttgcccccatggttccactcatccttccatgggttgtatgagtttgggaaggctgaggaccagatggctcttgttggccatttagcaacaccaataatagttgtcccgggctagatgctgggtctatactggtgaatgaatgagacatggacccaacattcatgtactcatgcacggtttagtctgctgagatgctctgtggttctagctgccatgacagtggcaccacccccacacacagggaaacaggtaaatatttgctgaataaaaaaattaatgtttgtgtccctctgttcacatgagcccattagctcctccagtgagaagcagtctccactctttttatatccacagtacctgacacaatccttggcacatggctggtacttgataaatatccattaagtaaacagatgagttattaactgacagctaagatgtttcgaactggtatgtcttaatacgatgacaagtatccatttattcttatgtaccactgttgctgccttccactgagaagctttcctgagaatgagtgggatctcaggttgagagctagaaattgcttataatccaaggttctcccctgtgagtgggtggagcaggtgaccattatccatctactatactctgacagagacaggttgacaagctccatcccagagttttattgccttcatgaaaaaaatttttaagccctactctggcctcgcctatcaatcatcacaactactttttattgactgttccttggtcttgagcaaagcccatggcatgcattcgcttacttaattgtatggcatggtttgtcagtggcttttcattaaaaagataaattgacattaacaagcattgatttccaaagatttatgttgtcttctctattgtgctctctcttggcccagtaagattttacttttaaaaggcattttgtaaaaatacaggaatgtggcttggcaaagatgtatatctttaggaagaattatctctgcctagtgaatatattgtagatttggcatttgagccttatcctaacagaatatttgctttgctaactatacatcaggtgaaaaaagagcatgtttgggtgggaatcaagagacttgaattctttagtcctatccatcctgattacagactggaaaaggaaagatgagctggatggttttaaaatttccctcctgttttagaattctgggcacataatgtttatttcaaataagaccggataatcagaagaattgaacaaaattcttctcgttgtagtttctgggaagaaatcctaggttgtttgactccagtgccttcatcttaaatgtctgtgtggtaaaatgaaggtacatagcctgccctctcagggccctgggtgacattgtcaccttcatggcatgaaccaaagacaaagcccaatggcagagcactagaaaccttcctctctgaattgaaagccatcacttagttaccacttagaaagcacgttagcccgttctgattccacttgagtgtatgactaactgacctcaaattgtttgtacattgaaagcacagatgaacacagttttgtttttgttttttaatagggtctctctttgtcacccaggctggagtgcaatagtgtgatcatggctaactgcagccttaaactcctgggttcaagagatcctcacccctcagcctcctgaataggactacaggtgcatgccaccaagcctagctaattttttttctagtttttttttttttttttttaagagatagagtcttgctctgttgcccaggctgggctcgaactcctgggctcaagagatcctcccacctcagcctcccaaagtgctgggattacaggagtgagccacagtgcctggctgacacaatttttaaagtgtaccattatgttgctaacattgcactatcttattctcaaatatatggaaagaggttttatcaaatagcttgtgaggtcagcatagacaatagcattcacttgatctagtaatcctatctaaaaatagaaaatacatttgtttcggcaatacagtatgtcattgatgtagaaattatgaatgtacaattacaggataaattaaaactgcccagcccttaagttattatgggttaatgcgagtggatatttgtcatctgctgtatgaatgtcagcgtcatacacagatttttagggaatgctgaatgtcagacagctcacaaagaagcaaagatcataactcactataacctcaaactcctgggctcaagtgatcctcttggctcagctcttgagtagctaagactacaggcctgagccaccaagcccaactgttcctcagattttgacctttcctctgagatgatctaaatctgcagattctgtgctatgaaaacattgtgtgctttttaatgacttaaaatattattggtagattccatgagatcactgagatttactcttcattggttgccctttctacccaataggatattttatgtttgacctggcagggatcattatttcaagttgtcccaatgcttttcaattttcaaaggccactgactatttagtggattaaaggacctaaatgacttcatcctacttctaatttccatcctagaaggtaaacagatgagacaattgaacagaagattgcatttgaataatgtgaatatattttaaaatgtgtggccttgtcttagtgtgaattatcatcagcaatagaccaaatgaaatagctccaatttttgtgcagtttgtgttttataccaaccgtggaccacccaagcagctgacccaacaaggcactggttttctgtagactttagtctgagggccattgacttacatatctataagtcctgggtactttcctgaactagcaaaagcaagaatgctaacatcagaaagtaaatttcggatacttcaacaagccacatgttggtaaatttcaaatattttgtctaactgcgtgttggatagtcacgttcttctgtaaattaatggttttcagtctttggtgtatctcagaatcacctggtgtgaggctgctgggtctaggatgttcatctcccttcatttgagtaggtagcttcatgaaagtcacacttgcagtagagtcaaaggaaggtgacaactacatgctcactcagatcacctgaatccaccctgccagttagagggctggcaaatatattcctcctagtctatcaatagcctgtttttttaattgtaaaaagtacataaatatattgttttaattatatttaacaaattgtaattcccagttcatgaaaagatcttaaccaatcttaaaactctctatcagatttctgttgagggtggggaaatacattcgaatgttaagtttggtttttcaatttttatatatttgatagcactaaattttatccattttgtttctaaaatacatctccaagcagataacagagcctgaattttattataaaatatctttgtaatggttttattggtttatcttttcattttttgctcttagcaatctgaagataataatttcagtgtaactgctttgagaggttgaagggcacaggttagtaagatcaaggctgagaaaaacttaattgcaccatatactttcaaagaaacagttttgacatcttgccccaaagaacgccaggagcccagtggaatccatcccagggttggatgatgtttagaggtcagtaagagcaggtgcacagtcacttgacctgtacagtcagaggatggcttaggtcaataggagtggtgatggagctggggccatgcctgctgggttgtagggcttcctacctgatgttcttttttccttataaccatcctgctgaactggtcacttaagacctagcgtatcttagagccaggacaagctctataagcatcttgtccatggcctcgtgactggcaagtgacagagccaagattagaaccttagaaccgagacctcccaattcccatcccaaccatcagagccaaccatctcaatagatttttgagaccctaaatgtttagacagggcctgattgtaaataaaccagtttccatgtgggtcccccaagccatttgtgtgtgtgtgtgtgtgtgtgtgtgtgtgtgtgtgtgtgtgtgtgtgtactgagctcttctacatccctttactcaccatatattggaccgtaagcctgtgcctgccttgtactatagtatccatagcttatttatgaaatgtcattgagccagtaaggggaaggtaccagtgacctgccacagcagcaaaagaacagactcctatagaatcatcacatacacccttaatcccactgaaattgcattagcatgccaccacatggccacagcgacccctgccccctttcccttgcagtgacaatttactggatcaggccttgcagtgaggggccagcttctgaacttgcagagccaggtacaaaatgaaaatgcaggccagttgttcaaaaggcaggaaaaaagggccattcacgatactaaaataaaaacgtttccctttcttccagtttctctctcgatttgtcaagacatttttgtttgcaacttaatgtcattttaaattattagtgtgaatcttaccaaccatccttcaattgtacagtgcaaattttagatgcaagtttaagaccatttgccatgtatgtgggatcactgacacacaatttgtattttgtagctagtacatacgtgtattttatacgaactagaacagtggaaatgctgcacaaagttaactcaattgttttgattttacttattgatattagcacatcctcaacactccctccctgtggcttgctagtaagtaaggaagaactgaaaggaaaaggaactcggttgccctatctttccctttccttctggattattttcagtttaagtgcttggccaatacagggaagtaacaggagtaaggaaggatatggtcaggttccttggtcattcatgtctcttagaactccagtaccttctttctgcatttgaagcaagttgagcttagaacagaaagtgtgacctttaggactgttcacaccagtgcttacttagtcatagatggaacatgcttaccttttacggactttgagtccttattgaactccccatgcaccagggattcacaagaattctgagctcatgggacatcatgaatgtggtatgcaaatgaggtggcaaggagcacgtagctcctttgctcacatgcgtgcatcatggtcccgttggacttcacttgaaaacacaggttcgaagataaaatgattaagaatttcaagacagtgccatcagagtattaaaccaagcttcaggcccttctgagggcaaggctctatgcacatcacatgcccctgaagctgaccctgcttgcctgattctctgacatgaagaaagaaattccactgtgctttaaaaaaaaaaaaaaaaaaaaaattcaggacagatttaatttggacttgagtacccaggtgttagcaatatcctacagattccagaaaacaatttagtccattgttgaaagagtacccttgaaggcatgtctttttttaatcccattatcttattcatctcagttccttttatttatttgcaacttagtcaatctcaggtctcacatccaaattggacctcctcagggaggaccatgctacaatttgaggacagagcacaggtctggggtgggaccgggtggagtggggagtgcccctagaaatccaggccaggcaagggcacagaaatgaacttttcagggtcagggaaagatctagaaggacgtgaaatcaccagctagtctttcctctctctacctctccctgggacctgtatgatggtggtgggagcataaaggactttgaaaatagaaatagcattttgtaagtgtcatgtaggaggtatcatgctgaggtgctgcatgcagtgttacactcctaacaatagccttatgggggaagttctcttatgagtccttttggtagacaatgaagctgaaactcaggaaggtcacatggtatcataaggctggtaagcattggagtggggctggcagggatgctggacaaggttgcagacatgagagccttcctgagttgcggaagtgtgtggccccatgttttatcagagtttgaaggggaactccagattactaggttttggggagatagttgcaagtgatggaatagccattctgagtgaagctttctttggtggtgacctggaatctctgagttcaacagttgatgctgctgatcacctagtcacctggggccttattgagcttttgttcctgccatcattgctgcctgactcttggtttccctactctggcatccagtggcctgagtcaaggttcagctcagcttctgaccagcttcttgaccaccttggccaagtccgtgtacagctccctttggtcttcgtttcttcatccatgcaagggggatggatactgtcatgaaggcaaaaatgaaagaacttgggttaaagttattgtagtagtgctggtgctgaggagaccctcagctttgagtgttggcttctgtccattcctcctgagctactgtcacatctcatgtgggtgcagtgggtcctctggacacagcgttgagcccagtccatgggttcctcatatagccagcaccttggcctgtagcaaataaaaacaaaccacttgaaaggaactcgccaagtatccctgatagctggcactcacagtttgtttgtgtgatgactttgcgtattagtcattttcctgttgcttataacaagatacctgaaattgggaaacttacaaagaaaaaaaaattatttcttacagttacggaggctgagaagtgcaaggtccagggggctgcatctggtgagggccttcttgctgatggggacagtcccaaggtggtacagagcatcacatggcaagggggctgagtgtgctaactcaggtctctcttcctcttcttatgaaaccaccagtaccctcccatgataatccattcatccattaacacattaatttattaatcatgaatgattaattatcatgacccaatcacctcttaaaggactcacctttcagtactgccacattggggattaagtttccaacacatgaaatttggggatacgttcaaaccataacagttggtgatagttgcagaggagcatgtacaaagattagaaaaatataaccaacccctgggtttgttggatgctttctgttgctcagatcattgtgacatgagcactgtaggaggggtggatttgaaggggtctggttccccaagaggtatgtgggcatctgtgtgcctgcatgagaaagcacctttcctggcagcccgacaggtagaaactcattaatccacacattgactctatttcagggaaagatgacgtcaactcctgcatgttgaaggcagggagtggctgaaacagcatcaaggcgtgaaggcttccctgagccaccctgagttctcagaagggttcttaaagaagtcacgtcatctttatcgctacttctgctgcacttatcccataattttccaacttctgttgtgagaacttttacagcccaagtgtcctgtgatttaaccttcaatttggtaatgtctgtcttcctttagcaaagcaggctgaaggtgttgagatccgcctaccttgggaagctttccatggtggcacagtattgaaggttaggcctcatccaagttggcacaagcctttgtctccaacctgggtgggaggaaggtcaaggcagatgagtgtcctttcagtgcagggaactgccatccagggaggcttgcatttataactgagagacagcggggtgagttagaatgctaagaagggggaaatgggctgggcgtggtcacacctgtaatgccagctatttgggaggctgagacaggcagatggcttgagcccaggagtttgaggctgcagtgatccatgatcgcaccactgcaccccagcctgggtgataaagtgagacctggactctaaaagaaaaaaaaaaaaaaaaaaaaaaaggaagtcggtagttcaccaaggaggctttctaaaggagatggactttagcccgtgcctttcaggaggggacttggagctggggagatggggagacagtgcgattgggattttggcagatgatataaggcaaatcctcagcagagcaccccgggttccaccagctttgtggttgagttgcagactctttgagtgagagaataacccagccccggtggtttctgctgaaccgagaaggaactgctccagaaacatgacagggattccaataacggcggttaaacagctaacaaagaggagtctggaaggctggcccttgttcatgttggctggaacatgctgggtagatgagttaattgggggccctcacagggaatgctcattgtgccactcttaatgagagaatccaagtgccccatgggatgtaataattaggaagcatgttgtcagtagatcagctgtctgtctcctgatgtatgccttgtgtacacaggaagaaatagaagctttcctttaaaaaaaaaacaaaaaaacaaaaaacagggtctcactctgtcacccaggctggagtgcagtagtgtgatcatagctcactgcagcctccaactcctgggctcatgcgatcttctcacatcggccttctgagtaactggaactataggtgtgccccgctacacttggctatcttgtatgtatgtatgtatgtatgtgtgtatgtatgtatgtattttaatagaggcagggtctttctatgttgcccaggctggtcttgaactcctaggctcaagcaatcctctgccttgacctcccaaagtgctgggattacaggcatgagccacactgtacccggccagaaactttcttaaagctagtttaaaaaccgatcatttggtcctcatttcccattttggctttgtttcttcagtgtggctctgtcatgttggggcccattcccctcaggatgctgagacgtaaggtaagggtattccttgtctccttcactctacctccctagggtctctgtgcccctggaaactcagccctactcaggtccccgggcagtctagactcagggcaatccacctacctcactaagacccaagatcatcgtgccttccgttttgtcacccataaaacagagctgatgctttctccttcttagggctatgaggtgaactaaatcaagacacaaatgtacccttctcaatgctggacaggttgcccttttaacctctccatccctaccacctcttctaagatgaaattccttaaatcttggagttggatgacttttccttttccctctatttcctcttcctcacttccatttcagaaggagaagcatcacatcctgccacccacagctggccctcttcctctcctgtgatctccattcatcatctgtccatcttcaccggcatcttttgaaacctgtctttcagtggccgtcactgccttttcagcataagacatgtttgggcctctcttcctgactgtgtttttctccttaagctgcctgcatctttctctggccttcccctcaccaccaaatttctttagaaagtgggctgcccctgcttcctcttcttcacctcccaaccgaacttctgtagcccccctgtaaagtggtttccattccaggctttgcactgatgctggcaaggacatcggaattttccatttcagtggcctttgccaagtcctcgccttctggttgccttgactgtggggacaccccctccttcttaaaattccctcctcctctgtgacagggccctgtcctggatctttgccaacatcttgtgcgtccttcgagggtggttctcccactagagatcccctgaattaggaggcacctgaaaggttttctcctctgtaccttctgccttggcatcccacccactcctgtgatgataataggttcctctctgctggtggtaacgctcaagtcttcatttccaaactctgcttaggttgagcagctgcacagacaccacccacatggcttccaaacttgatagtccttctcactctccttatctggtgtgggtaggattgtgtcccccacccccctcaaaaaatatgttgaagtcctaactcctgctacctatgaatgtggccttatttggaagtagggtctttgtaggcataatcgagttaagatgaggtcatactcaatgagggtaggccccagtccaatgtgactggtgtccttataagaagagacacagacatacacacacagagaggacaccatgtgatgacggaggcagagatggagtgatgcatctgcaagccaaggaacgtcaggattgcaggctgaaaaaaggatcttcccctagagcattcagagaaaacatggaaaacacggccccgcccacaccttgactttggacttctcagctccagaactgtgagagaataatttctgttgtttaaagccacccactttgtggtactttgttctggcagccccagaaaaccaatacatcacccgatctctccagttccctatgggactcactatccttttagggatccaagctgaaagtctcaggatcaaccctgaatctctccctcttgccttaatacccagcttttcatttctgcctcaggtgagtatgcagtccccacctcttccctaatcaagtatggtcgccctgactctgccctcttcagtctcctatctgtccatccagctgccctctggacaattttcctaaaacagctctgattgtgtcaccatcatcgtagcacactttgtctgtttccctcctgcctccagcagttggctgcatattggaattacctggggagatttgaaagctctcatgcccaccacacaaccccatctgtcaaatcagaatctctggaggtgatgccccagcatcaatattttaaaaacttcccctatgattccagtgcacagctaggcctgagaaccatttgctgatagaatatcacaatagccagacaaagcttacggaagaaaagatagctctaaggcaatggttctcaactggggatgatattaccctccaggagacacttggcagtgtttagaaacattttaggtcatcagaaccggggtggtgctcctgggcatctactgagtagaggccagggatgctgttacacatccacaatgcccaggacagcctcacaataatgatccagccccaaacatcactagtgccaaggtggagcaatcctgatttaagagcgaggagaggagcagcaataccgaccttgactttgggacagacagatgcagtagacaccagtgctgaggaggcacatgccccctcatgccgcagtactgcctgtgctgtgcccatttggcagcccagtatgttgaaacttttcatgcagcaccagtttccatcacaggaagcctcagcctgctggtgccaaacttattctcttgctctccttttgaaaatgaggttcagtggaagctgggtgcggtggctcatgcctaatcgcagcactttgggaggctgaggcaggcggatcacttgaggtcaggagtttgagaccagcctggccaacatggcaaaaacccttctctactaaaaatacaaaagttagctgggcatggtggcacacgcctatagtcccagctatttgggaggctgtggcaggagaatcgcttgaactcgagaggcagaggttgcagggagccgagatcatgccactgcactccagcctgggaaacagatcaggactctgtcaaaaaaaaaaaaaaaaaaaccaggttcagtggaatgtttttgtcaggagagaaagggtcattacaactcaagttggcttttgccaaactcagcaatcactgttttggtggctcctgaggctcctaatgaggacactgacagtcgttaaataaacaagtgattaagttgagaagagactggctaacagaggttccatgtgtgctcattgtcatcgatgttagccagtttcatgacagtgacctgcctgggctccacctctaccattaaagagaaacactagcaatgacggcttatagttcacgtagctttaccatttataagcattttcctatacaccaaccagtttgatttgtcttttcaagtcttagctttatgcagtgtcatttcctataaaggaaagtatagcaaatatacaagaggtactcagaaaatacaagaagaaaaaaactaaaaagagtaagggatcaaaagatatttttttaaaaacccacattggatgaaaaatgagaaatttaattccggtaatggaggacaaagtctttgccaaattgataaagctttgggaaattctgattatggaaaggacccaaatgtagacagtcacattctaaattcctggctccatgctatgtgtccagtttctgtgtttttaaatgtatgcagcatttttaacatcacagaattattaatatgttgaatatcgttgctactttatataaaaagtatcttttctgtctactatttaagaattcttgctgtatttatcattctgttttctccaagtagacagagggccgatgtatttgataccagaacacatctttgattttgtcatggggagcagtgtgaaaataggagtcacaagaccaggcgtggtgactcatgtctgtaatcccagcactttgggaagccaaggtgggcagatcacctgaggtcaggagtttgagaacgtctggccaatatggtgaaaccccacctctactaaaaatacaaaaaaaaaaaaaaattagctgggcgtggtggccccacgcctgtagtcccagcgactggggaggctgaagcaggagaatcgcttgaacctgggaggcagaggttacagtgagccgagattgcaccactgtactccagcctgggcaacagcgcgagactccgtctcagaaaaagaaaaaaaaaaaataggagtcacttaacacaaacttattttaagcacaatttatttataatttagaaaaaagaaaaattgctgtgtaatggggcttgaagagaaaaagaaataaaatttgttgagggaggtgtagagcttgttctgggtattgatttcctttgaggggcaataaggaaggattatgccagggtgtttcttgttgcttaaatgttccatgaaacaccaaaattgcagaggtattagtagttagaaagaatgtggaaacatccctccttctgattaatgactgccccctgaggagtccttcaaaagccagaagaaacctaaaatatcatcctagaaagttggaaggaggcatttgacaaagtctttgctagctatgtgactaggataaggatgtgtcagtatatcattatgcaacttgatgaattctcggtcagctgaacagtcatagtcatattagcatagaatagtgattcgggtcaggcacgatggctcatgcctgtaatcccagcactttgggaggctgaggcaggcagatcacctgaggtcaggagctcaagaccagcctgaccaacgtggagaaacgccgtctctactaaaagtacaaaattagccagggtggtggtgcatgcctgtaatcccagctacttgggaggctgaggcaggagaatcacttgaacccgggaggcggaggttgcagtgagccgagatcacgccattgcactccagcctaggcaacaagagcaaaactccgtctcaaaaaagaaaaagaaaaaaaaagtgatttgatttctggcctttaataagtgcttaatgaatcttggatgaataaacgaatgaatgaacaaagaaatgaaagaatgaaccagccaactgaccaggacgatgtccatagaggtctacatgggattccctcaccttggtcttgttgtgttcaacatttctatcaatgatttgaatcccagacacacaaagcatatttactatacttggaaacagaacaaatctgggaagatcattaatgtaatagatcacagaagaaaaatccaatatgatcttgccaggttaaaaacagggccaagatgtacaggcatcagccaaagccctatgtatgagtttaacatgtcaactggaccttgggagcctcctattttgagggtgatcgtgaaagagactgggaagtgttatatccttccccatcattcagccttctcacagaagttccaaaggctatttggtggtaaaactcctttctgcttgctagtcctcatcctttttcctccttttatggtatttgacactattctacactgttaacttgatgcccttcacagaacctttctcgaatttcatgattccactttggtcttatttccctcgttttctaatttgtccttctttgtttcttttaccctctttttaaagtttttcctttacctttacatttaaaaggtagtgtaccctaagctctaatcttggcatacttgaaatctgtatctctccctggttgtttaacattgatttaaaatagattttgttgagaacccgctatgtgcccagaagtgttccaagagctcttagaatacagtggagaataagacaacaatttctgcctttaaggagcctgtattctaggaggatgggaagtgatgaacaaataagtgaataacagtgttgagtcgtggttaaagctatgatgaaactcaaatccagattaaggggaccaggaatgtcagggctgctattttagacaagagtcagggagagtcccctgagaagatggcatttgagcagaactgggcttcttgtactcccagggctgcctccacactgaagactcccggatgctgctctctggccagctcctctcttctggagccatattcctgaatgcctcttagtccctgcaggatgtcctaagagcaccttcaaccacgcttgataatctcccctaccaaacttcttccttctctttggttccccatattggttcccagcatgaccatctcctcactcacccaagctagaaactctagcctccccttcaaatcctcctccacccctactcatacagatccaatccaatgacatctgggtcctcacttcctccccgtgccatagttcaggttcacactatctcttactggtactgttgcaggagactcctgactagtttgccagcctctagtctcatactccacccaccctgtcttccacgttaccaatagaatgacctttgtaaagcacgatcagctctgctcttgagccttctatctctacctactgcctctagggctagcaaggtgttcaacctacctggttcccaacctactggctcagccatctcccttcagtccctctgtcagaaaaatcacttcctgaccctttgacagtaccctctttttcctctcatatgcccttcagtttttcctagaactctttccgttcctctttcctgcttttcccttccctaccctacccagcaggtttctaagcattactgcaatagccaactcaactctgcaaagcttttttcaaattctcttccccctccatccattttctttgttgtgatgccatagtgcttgtggcaggcaggagcaccctgttttagaagagttttctgtgtcccattagccgtgggttacctggagacaggcatcgtcacttgtgcatgtctgtgctgcttgtagatgttggcactagggaggttacttcatgcatgtttactgagctggctgcaattatacagaagacttacaaacatataagtcaaaccacgtgaaactgctgttcttcttggtcaatatcagcaatttcatatgtttattctaatctgttttgttcagtattttgtattcctgttttggctttcagaagtgttcttaccttcaaccagactgccttagagcatggggctcaaagaaatattttcagctctggaagacattttccatcctacttctacatatagaacttttctggccaaaaatggatgcatatctcagaaatgtaataagcaatactcttctctcttcctcttgacaattgtttttcaaatggtttatcataaacatcagtgagatcttgaggctgttataaagtgatataatggtaatttctagaattgtaatacattatcctagtgaaaagaaaatgatgaagttgtgaatcaggcaaaagtgatgaattgctcatttccatgtagtttttcaggtggaaagtagatgcaggtatcaactggaggatgtgtgaatattttgtctaatggttttgatctcgatatagaactagagttgttcttaaattaagaatgtctttcatattctgccttttcaccagcatcactattaaaataatattcttaagcaacagccaaaaaattattaggatctgctggttctataatcagatgtttttgctggacactttaaaaaccaataacagctaatcacagtgtcctcttttgtgctgaattgaattttgttttggttttaattctcatttgaactgctgggaaagcaagcctgttacataccaacacttgccacctttctatatttgaatggacctaagtagtctttgcaaaaaatgtctaagactgtcctatccggacacaccatagggttttcccatggaaataattatatcacaaacgaatcttttttctaaagtctgtggttttaggctgccatacttctcaatcccctgaccaggagacaataaaattggctggggccttaatttgagggaatacatatttgattgtgggcgtggtcttctaagacaatggtaaagggaaaagcaagatgtaaaattaaacgttgaaacaagctaaactggttttcaaaatcttctcgactgtaacacatctagaagttctaaatataagaaggtttgagggattatctaaaaccaaggtattaaaagatcaggtttttagaagattttgattcagtaccttatacttttttttcaaggagttgagcaagaaaccatcaaaacttaggagagtgattttaggagagggtggtctccaacttgtctttatgtttgcttccaagataagtgttaagcccaaccaactagcagactattcatgatctgggaatcctatcagtggtcatccctgtatttgacttgagtctctctaattttttatagggacggcgaaggccagttggtcagccaaatgcataaaaaatggtgcagaaattagtgatgcttggaaacatggctcataatcatgataaaggcttatatgttggtatgggttgagaatgttggcctcatggtatctgggtatgcaagaaggcaaatcattattggtatactagcctttatgttgaatatttagagagctcttgaaaacaccccttcgatttggagtgaggaattctaatgagtaaaactccatgtagaaataaccatatccgattaaaaaactattttgattttcattccaagaaactaccaaaatgtcagctcgatatacttgtgaacatgttatgcttatttttaaataaggaagggtgcctttttacaaattaggcttgagtttctcttactatcatatatattaactatagacaagggagtgggttctaataacaaattgctacattgctatcgttaaatccgtgtttgagttttcttccctctaatgtattttctccccctctttaatttatatttttaaaaagcaatgtacttatctagaaattgtatgaaagacaaatatttaagaaagtaaatagagactatgggcacgtcctttgaatatgttttgccagggtcgaggggtaaatgaaataaactgatacatcataaatggaccacacaggaaagaaagtgtcatgcctatgcaaagacatgcattctccttagagacgacatatattgctgtcgaccaacaaagtcacgtggtgggagggggctcttttctttctccttcacatcccctcctctgatgtcacaaatctattttttcctgggagaattaattagcattcattgggtgtacttggctagaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggtacccagcgctctgacaatagcctgtttaaagcttttcactggggggtgcttaaaaagggttagctgggttttgtctctcttttaaaatggctctgagacaatccctatggcatggtcttgctttcagggttgatttttttcctgtgggctgatgttaagttaatagagcagcctttcttcaatccattcctgttccaaatctttctaccgacgtgatatttcatagagggatgtctatagtttgtcaccttgggctgatgcattggggaaactgtctttttttattaatataattaatcgtaacttaggtcttgtgtcctgcatgttatattccaggaacgtggaatgtgtagttttctgctaatgctgaggaggaactggaggggcatgcatgttaattctgctttggttccgctaatgctgtagtgatttgggcattctctaattttcttattctaatatgattgctctttcttgtatcaggccctgactacgacatgtaataatcatttacagttggagcttcagagaggggacatcagctctgtcacccagtgctgatggaaaggcagggcgggggatcttctgctaattatgacttggagactggggggaagaaaattgataaaggtcctatttcttaaagagaatcttagaacgtaccacaattttcatatacagaatggttttttggagaataaagtgtttttgcagtaagaaaatggcagaaaggaactaaaattaatctcttttttctaaataatgactgatttcaagtttgatgtcccatagaatcggctcagccactgttaggttaatggatctcactgcattgtaattttccctcactcaaagtcatagactgtcataaatgcccaaaaacatattctgtaaccgcagtggctctaatataaaaagccatcatgctaaggttatttctcacagcccttgcgtccactgatagtcactaaagagtaattcgccagtacggggacaaaacttcgttttatttataaagatacaggctgaaccatatgaaattgctgatagtcaaccattttaaacctacaaaaacggcaattacatgtacttcagcttcacagtatgctggggtaaagactgcttgtttttatataaaatttctttggtacacaataatattttatcctaaacagagcaattttactttttaaattaatttttttaggtatcacacaatacacataacataaaatttaccattttaagtatacgattcagtggcattaagtacatagcaccttaattttaaaatcgtttgtttagttcaatcctcttaccaaatctacacctccccaccaaaaacccagcctgtattttcttgtgtgtctttaaaaaaaaaaaatcttcatcaatgaccaaatagctataagagaagctcttgggaatatttatcaagatgaagaagtgagatcaaagttttttccatgatgactagagactaagttgattgcatgttgtcggggtatgataatgtaatagcattgtcccaaggaagcctatcacgattttatcctaaaatgatgattttacttagtacatacttttaatttttattaatgtggtattcaaccatggcagataaaaccgttttggtctttgcaaaaaaatcccttttttaaatttctctctgaaaggaagcaaaggtcatataaccaatataaaatcattactacacaactgtgtatcttatcacttagtcttatggactgctattattttatgtcaattaaatcttatttaataacagatctacaggttgctagtacatccctgacaacccgtatatgaaaagtcattagttgtgattttagagacaaaattagaagcaaaagataatttgtgaaggaactttaaaaattacctaaatgtataaacactagctgcttgttaaataattcaaaaatatcacactaccagaagctagtgtgacatgtatggtacatgcttgaataagaatacaagccaggggatttgtttttcctgatctacagcaagaggggttgtgattgttgtgtgacccaccataattgttgatctggagggtggcttatctaatctgcatttagatgaacaagttcatatgctggctacacaaaatcaaagcccacacaagacactttgtagtttcccaatttgctcacccatcatcattaaggtacacataggataaaatgatagccacaaatgtttctgcgtgattgtcacatcagtattccttcagatttaactttaagtttattaaaaaattatttttccattgaaattaacatttgaaaacttgacataattatttatagaatgtgttatataattcttgagctggtggatccgttttttatgtttttcttttaagcctttcagcaaaggattttattcattaaatttaatcctgtaaattttgtcactttacgcagagttttttatgcacatatatattttttttcctgtgtttctcctttcccatctgttttcagtggttggtgatggagtgatgcctgtctcttaatttggggcattattgcccaatggctaatacccaatagcatgtgaattaatatctttggataattattgcagtgtctattaagaactaagaatgtaaattaaacttagctttataaattgaccttgcttttctagttgggatctttcctgggagtttcagcgggacaacacaacccagctattgtgattcactaactcctacaaagagagctctttctttaaacttaatcacaatgactttgtttctactttagacaaaattaatccatgtccttaaaaaaggaaagcatttgtgttttttcagtctgatagttttcatcacagcatgctaccagataccaaaattcacaagagtatttagtagatatttagggatttttaaggaaaacaagcagattttcttagatggatgtaagaaatgccaaattattacaaatgatagtttttaaattaaaagcattaaagtgtgaagattgagtaagcagattcactgacatggaataagcagaggaaatgaataagacagaatcaaaagaaatagatcatggaacccaataataaaaagatggagagtcggtttccattgatttcagtggagtattacttgttgtcatttcatttgtgaaaataaatgcatctgaaattgctgagagtggataatcactgagtagaaaaacaattgaatcataacaactttgtatgctctattatgggggaaaaatctatctgttatgaaaattattttcattatatgtaggtaattgaattctactgaaacaattatagtcaggttagttaacttcctatgaatcgttgctgaaataaattacaggcatcaaattaaattcctaaccacacaggaagaaaaatatagtgaatgggaaacaatgtgtaatttaaaataaattacaggatatagtcaaagtaagaaatgaatttaaattattgacttccttaaaaaattaatacatctattttaatctttttgatcaaatagatataatttcttatttttttttttaatttagcaaaatgtatgcacttttggctctcatttttcgtttaggaagaaaagcactcctctagaatatacgacttgtgtgattaaaaacccaaagggacacataacacacgtcacactattcctgatgatctgcgaattattgcattttgaaatttgtgttgacattttctaacttggctatataaatatggtacagaggaagttttagatgcagttattatctgtaagaatttgccaaggtggacatctgaagagttggtgtctggggaataggctgtagagaaaagtggctggccagatggtgcggaacatatgtggtaggtatgatacagcttcctttgattttttttttttttttttagaacatttaaatgtggaaaagatctcaacgagccatttggtacatcttctacttttacattattaattccattaggatttttttaaagacttggccttgctatttcgttagaaaaagaattctgggccatttctggaaatttagatttgccttccctgaaattgagtgtaaaccctgaattaagattattatgattttcaagatcacatttctctgttatttggaagtacagggtcaatttagactaaatgatcttaataaagtgactttgtcttgatgtatctgagaacatgcaaaataaccagtgtccccatgacttaaacttcccctctctgtgactgtgatggattggattggattgttacaaagacactctcgcttttttctcctttggaccaaatgtacatacatgggagatagttggccaggagtagggatggccatggaacggaggaagaaagtgaccacaccgactgtttttaagagaggaaggttacaatcccagtttcacaaatgtgctttgttgttcattcatttattcgtttaatggtgttctctgccgggtgtggtggctcacgcctgtaatcccaccactttgggaggccgaggcgggcggatcaagaggtcaagagatcgagaccatcctggctaacatggtgaaacccagtctctactaaaaatacaaaaacaaaattagccgggcgtggtggtgtgtgcctgtaatcccagctactcaggaggctgaggcaggagaatggcgtgaacccgagaggcggaggttgcagtgagccgagatagtgccgctgcactccagcctgggtgacagagcgagactctgtctcaaaaaaaaaaaaaaaaaaagaaagaaaagaaaagtgttctcctttgaaatgtcattcttcctctgtcccttcagctcacgttacaggagtacaggggtgctaagtcatcgtagggaccattaggggtagtataatcttggttttaataataattttgctgattggtggcagattaaatagcagacaaaatgccatagacgagaattttgatccttagccagctgagtgatatttctcgtcaaagagtgtataagagaaaatgtaataatttcctatttgataagctgattttatcaattgcattaactgctttatgtagccaagccttattatgctgtatttaaaatcaagggtcaacacactttttccgtaaaggtcagatagtaagtattttaggtgctgcagaccactcagtgtctgttgtaactattcaaatctgccactatagcatgaaagcagccctagatagtatgtaaacaaatgggtgcaactgtgttccaataaaaccttataaataaaaacagatggctataatttaccaacctttactatatttatagcattgttatggcattccttaatattttaaataatagctaaaaatgaaagataacaaatatagctttgaaagaccttgctcagtgaatatggtctttcttggaagctcagtgtttgtcacttagttgcttccggtgataatttcctaggtgctaagaagcatgacagtctgaagttcatttgttcagccttctcgctaaattacattaaataagtaaatggggaaaaataaacaaggcattgttttgctttcctttttgcaatttccccttgtttcatgcccacctttggcaatgaccactcacagctgtgtctgtcttcataagccaccactggtcacctcatctctatcttcactctcttagggggaacattttgcagttttccctctgcagggcataaaccattttcccatttcttgccaggtgcccagaatcaagacattttaaaagaccttttgagccaaggcatcctcttggaatcctgtgactgccttttaggtgttgggatcctgtccttgggattaaaatgtatactgtgttttttgaaattttataaataactttatatttaatgcctttatttaaatttggctcaaaaatataaaatagaagtgatttttcttttctttcatatctaaagatttactgttgtaaaaaggcccctccagaagtgtaagtccaggggatttggaacacatccatccagttgccgatcccatcggtgtgtcttctggatctattctttttttttttttttttttttaaatcctgaattaagggtcttaggcatggctgccatgtttttctcagaaaacacgttaacattgagcagtccatggtttttcattgtcattgcctagcagcctatgcttgcttgcctgaacatctggagacttaccccatccatatgaggagatgagcacagagcatggatgaatcttctgcagagataccctgaattgcatggcctggcttgggtaaaagtcagcatggtgggggatctagaggtccatttctggtccacagggtcccagggtgctcccttcctttcaaccaaatatttattcagccagcgtttattgggcacctgtgtgctgagtatgtagagacaaattttttaaaaggataaaaatttccagatcaaaagtgatagaactacttagaatcctcttgcttaggggtctatgtggagggctcatagccccctttaccaagaggaaatcagatcataccatgaagtgccttgaccttctgttttttttctgtcagccccactgggttttcttgcctttggagaatgtagcaacatctatttctgagagagaatctcctgaacagtaaagcaaaaatctaaatctgttttttgggggttttttttctttctttttttgagacagagtctcaccctgtcacccaggctggagtgcagtggcatgatctcagctcactgcaacctccacctcccaggttaaagtgattctcctgcctcagcctccagagtagctgggactataggcgtatgccaccatgcccggctaattttttttttttttttcctgagatggagttttactctttttttttttttttttgcccaggctggaatgcagtggcgcgatctcaactcactgcaacctccatctcctgggttcaagcaattcttctgcctcagcctcctgggtagctgggactacaagtgtgcgccactatgcccagctaatttttgtatttttagtagagacagggtttcaccatgttggccaggctggtatcaaactcctcacctcaggtgatctggctgcctcggcctcccagagtgttggaattacaggcatgagccaccacacctggccaattttttaatttttattttttatatattttttttatttttagtacagacagagtttcaccatgttggccaggctggttttgaactcctgacctcaagtgatccgcccgccttggcctcccaaagtgctgggattacaggtgtgagccaccgcacccagcccacaaaaatctcaatctaaggaagactgaaagttaagaaattttaagaagcctgagataacatcagtagcttaggacctggaccgtttctttaggagacacagaagcacaactcaactgcaaatgcacctcagaaaaactctcattgggttaactgttgcctcagcagaagagtagaaaattgcaatacatgcagaggtcacagtaggatgtatggtggtttccaaagtgtgccctcttgagtgaaattgctaaggttcacattcaggcttctctacctcctggctgaaagatcttgggcaagtgatcattaccttctccttgcccttgggttgttcccttgtaaaaatggaataataatagtacctatttcagagggtggttgtgacaaatgtaataagtaccacatgctgagtgcagtgcatagtacatcataagcactccataaatttttgctgtcatcatcattgaccacaaaaatagtttcattgtgcagttctgatcttatcccagcatcttttctgtacctccctaccctggttttaaatgagttatgtataccttaccttgaagtcaaaaagattttttctaaaacattctagaaaagcaggtttctgcttccaaacttgaaataccttacaagttttcagagattgtggagagtggagttgggattttataaaggctttgtgaggttttacttgcctcacactgtggctttagtaggttcttctcctcagagacctgagctgccagatggtgcattatgacctgatcttctgatggaatcattacccacatcaatggcacaatttttttttaatccttaaatatttgtggtgccccagaggatataaccccttattaggttttatgggattctcggagataaactggccatagcgaccttatgatctctttgagatttcaagattgtaattcaactaacttttatgagaagcctactctgtgccaggcaaattggtaggtatttttctttgcaatcccctaagaagtgggaaatattgtatcatattaccagatagagacctgagtcctcagggagtgccagctgtcaccatgtgtgtaattaagcagtggttcgagcccaagaccagtagccctttctgtatagcacatgggagaaaattggaacaggatttaatccagaacattctagactctgacgttctgagtttaagataaggtgacagacaatactgcagacgtcaatgggaggacaagcatttcatccaagaaacagcagaccattaggttgtttgccaggttttctggactagagctgggtacccttacagagagggagcctgcgttcacctttgctagtgcagctggcaataattatagtgctctgttagtgctctgttggtctgaaaaggaaacagaaagaaaaatattattgtgaggagccaaattttcactataaatagtatcttccccaaatgagcattttaagaagcaggatatggtgtgtgttgggggaaagatgtagaaaataaagatcattttggtgatttacataaacttcaatttagaaacggaggacattctcaatggatcatgctggtactgaagggttgcatttcaatagcatattttttaaactccccatttcctttctatggtaaagaataaataaaaatgctgatatagaatctttgctggagatagagacactgactctttgccacctgaaattggcagtgaacagcagagctgaaatggaaattggcaggtaccactggatgtacccaggctcaaagaaccaccagtaccatcccgtgccaaccctgggggacagggctagccccttgagcagtccaggtaaatacagccttggggtgaattctaatagcaagtcaactgttatctttaatattatttgtaatggctcttgcagcttggtgatattttatgttttgcttggtgcattaatttgttcacacgggcatgggtggaattcgccctataaacattttttaatcatctttctttttctctctccctctccattccaccccatctttctccactttcttctccttcttccctcttccctctttcaccttcaatcacttcgtcttctcaaagggaacaatgtacagtgagatatgcctttggttaaccatgaaatttccaatgcctgaaccaataatgggggaggggggccacccacatcccccatgtggccaagaactgggccagggccttcaaggagccttggccctgagagtactgtgagtgtccccaaatgtcttcccagccctgctgctctgcaccaccctctcacctcagtcattgcctttgagaaagagaaatcaaagctgtgaaagtaggattggataaccatgtacccgattcccatcaggtaggttcagtgggtccggtttccattttccttgctcgtgaggaacattggccattcagaaccgctaggtgctggatctgggtgaggtgtgcgacagctgatttggggacctagaaggggcaaaaggtgaagcagtatgaacatccaacctcccacgttcccaaaaccaacacaagttgtaatgcccagctcagttagctaaaactcagtgattttgccagtgtacaaccatagttcaaactacataaaatgcagacataaagggctggtggtaggtcggataaacacagtaagaggcttaaagtatttctgtgattttgcatcaatccataacatttctcccaaatgcttgctaactttttcaggagtaaatgtagcatggtacagctccagaaagggcaatcccaaggtacaatgtaagttacccattgaattacaaagtcataaaatccatgattaataaaaccttttcctttaaaatctaaattgtgttgtcaggttaattaaaatgaaatctgacgttggatttagttctgtcttgggttatgcattccttcatctgtcctatggctatcaggtgttggttctgtgtgtgcctgtgcagcgctggctaaatagggtgagcatgaggtgacatcagccatccattctcatggatcctataaagaatatggagggttctggaatcttgatttaaaaaaagtcattagacgtgatatatccatacaatagctactattcagcaataaaaaggaatgaaatatttgtgcatgctacaacatggatgaacctcaaaaacatcatgctaagtgaaagaagccagacacaagagaccaaatgttctaccactctgtttatgttaaatttacagaattggtgagataagaagtaggttaatggttgccagaggctgagagaagggaggattggggagcaactacagatgggtacaagggatcatttttgctgtgatgaaaatgttctaaaattagattgtggcgatggtcacacaacgctgtacatttactcaaagtcattgaattgtatacttgaaacaggtgaattttatagaatataaattatatctcagtaaagctgcttttgaaaaaaaaagcagcaaaaaaaaccatgagatgtgcataattcaagggtggggagcggggaaaggggtattttttaacataacaagaagcccccaagttatcagaaacaactgcttgagggaggagtccctcttcatcttaagagtctttaagagtcttcattttaagagtgttgaatgacatcaggccagctggaaacccagaaaaatacttattcttttctgtattttagttcactaaactggtaaagaataaacacaatatcttattgggggggaataaaagaaacctctatcaattgctcttgaagagttttctccacttgttgagcagttccctgtaaaagcattgcaataatatttgtgtgcttttgatcctacggtgaaacaccagaatctgggcattcatagcagcagtggcagctgagaagaaaaatacgaggctccattttctgtttttctgaaactgatttctttcagaattccaaagaatttgggtttccaaaagataacatagtgcatacatcatgtactgcatgataccaccactgagtgtctctgcagatctaactcattaatctttctggagagcccaagactataaacaactccttgtccattcaggtgagattttggcaccaaggaagaggagatcagaacaggttttgctgccagatgagttaggggagaaaaaaaaattacttttcaagttttttggaattccataatgatatgatgaaagattgtggaagtctaatagtatcaggttgctggtgatactactgcaagcgagaattccatgaactaacaggttcttgcctgagggggagaaacaaaatcactgaatttgatttaaagaattatcttcccagatcctgaaacaatctccacctacacatagttttaactttttgtgtgcattgatggaaataattggaaaaaagatgcctccacggggactgttaatgtctggagctgtctgcagagaccttatgtgtgatagtgtaaagcctacagcgcaggccacagagtgaagggacccactctagccatgccatcgcctttccagacacttacagattttgttgggtcctaaatcaatgccgttgccattctatacttagatctccaaccccaaccagatggtatgaggcaaaaaatagggaattctgtatggctcttttttttttctttttttttttattaatttttttgcagagttgtcagcctttttccatgggggaaaaagaggttttgatacaggctgaccaggaaatttttgccaaaggaaaatgcctctcccactcatgcagttactgtagcagagactgcccttctccaggaacttccttattccccattggaaaggtcatggcggttccagggtccttttcatggttttctttttcttgctactacttcccagtagaattccatctttaggggttagatagttattctttccttatctctttttccttttcaatttttagctgcgttggacatgtagtgtccacatcttttctgccttcaggagatgaaatgatgtatgaccacatgggctacccccgccccccgccccccccgccgtccatgatgctgccctaggggcctggcctgaggtggtggtctgagatgcaggcaagcgatgaagcagggagtagttcatgctaagtctccagtcagtggcatattgtgcttaacattggagggagcacttccagactgttgtagattgtgttacacaggctccagaggatagcctaagacaatctagattctctattccaagtgcgggctgtggaccagcagaatcaacacctccaggagctcgttagaaatgcagagtcccaggtcccacccagccccactgaatcagaatctgcattttcataagacttccaggtagttcctatgcacattaaagcttgagaagcagtaattaagagcaaggtccaagagcaagaagggagaagacaggaaggaattgattatgtgaatttaccctcaagagatctagaaatctttatctttggaaaagataaagaattgctcaaggtattcatcctttcttctttccgtttctatttaggaagaggcatgtctaagcaatgccaaggcagtcattaatctgttgagtcctggctggtttgaaaaacagtgaccttgcttctcttacctgcttgtctcatgagggggtttggggaaggggcagtgaaggtgagaaaggtttgtttctttgtggcaaagtgagggccagaggagaaagtagttgatggaagcttgggagaaattctcaaatgtctctcatctccctctttaatataatccaatgacatgcaagatgccgtgactaaatataggctgccatttttagtggactaagaatggttctttatatacagttaaatctgtaattcagaattcagtctcacaaggaaggagtagaataaccacccacttcacatatcaccaatttccgcctctcaaatccaaaatgctctgatgtttcagttaaaatggccacagataattccagaagtcgggacaaagagcacaccctctacatagggactgtcacagaggatgtcgggagaggagggccctctggagtgttggtatttagcaagaagcccaagtgttgtgatttgcaccacagagaatggattcctgagtcgccacggggttgtggggtgggggcgggtagcagactgacggagggcccagcactgctgttaactcatgttgcaccttgtctgcccagatgtaaccacaggctggctcctgggaactgcagactttatcccttggcccccttctaggctgagcctgggacttctctctcactgatctgctttgtagagggacacctgtagctataagtcctgggaaatgctactggatttttgtcattgttctttagtgtcactctttcctaacctaaggttgtaaggccactaagttcgaggtcttctcccaaaccacttgaaatgtattttaagggggaagaaaaacccttaatccttctgcgtgtaccattccacctctggccatagttgggtgtcgaccataactgacagtctggtcgtgccgtgtgggttctgctggtggtatcattctgtccccagaggctggttgcagaagcttttgtagcttatccagcctaagccagtggatgctctcagtctgtctgatgccttccagttactcaagatatttctgattacatagaggtaaatggtgaacacagtggaagcacgttgtagctcaggctcatgccgtaaagtccctgagatttttagagtactttgccttttgttttctgaaatgtatcaattctttcattttcaaagcacctgcagttttcaccaaaaaagtgccatatacagcagttaacgattttatagtttatttactgactgctatggcagtctttatatatatatatataaaataatttatatatagctgtaaacaaatacttatcgatataagtaatttcttgattgtttttgaacgttccattgtttatgcgctatattgttagtctgtgattagcacctaattatgtaacaatggcttactgtgtgtgtgacatatcagctccctttgtcttttggtcttacctttgcttctcaccttagagtaggcagacagagaaagcagagataaaaagcagatcgatgagtattgagtgttgatctcgggctttctgtcagacatgtctgattgtagggacactgacttggattattcaagactgagtacttctcggtctttgagaagtagtgtcatctggtctttgctgcctttgaaatgtcccttatgttatatgttttcatataaatctaactagagtccattaaaattaattttgctttgaaatcttttgccacccttagaggtaactggaattactctgaagtagctggggagtagctgaaatcagccacttaggtcttcccacctcctcaggctgtgtccttttgggtgccgaagttcactcccaaataagccacatataccctcaccccctgagtgcgtccacgtctatgaaaagcttatatgaattggcttttgtactaaacggaatgctctgggtgtcagagtcatttaggtgggacaaatcttcctctgaagatcatcatgcttgtattttctggagacttccatgaacaatgctttcacccccaaggaccagctctaggggtgaaatgtcaggctggtaggagaggtaatgggatcgaaacaagacttcctgtgtcttgagaaaaccttgtttatattcatgtgctgtttcccagtggcaataaatcgagattcctgtgaggatttgacagacgaggctggtgatgccacccactgtttttgtaaagaaaatgttatcggaaccagccaggcccatttgattgtctgtggctgctttcgtactccactagcagagttgagaagctgcaactatacaccctgcaaagccaaaaatatttgccatctggtcctttacagaaaacaattgccaatccttgaattagaatttgcaaagtgtgtcaaaatgcaatactctatctactgatgttaggcaacacctaaaaactttgctcggcactcagtttcctaaaatcttctccatcaaacatccctcatcctctgccctccaggccccagaatccttgttctctgtggggaatagggactccctgctcacaggctgtcaactaaggctcagcccttcttcagagaatttcttggtactttctagaagctcagcccctctggcctctttcaggtccttctctgagttttcccataataaaccaagtcccgttaagtggatactgtgagctactttcatctagtgttctattcagtgcactttagcaagttttatttcctgtgtatagaaaagatatttgtggtttactaaatgtagtgctggggatcatttctttctttttttttttttttaagtatgaggttccaatgccctgaatcggaatcgctaagaatgctggttaaaaattcagatttcatatgggcatggtggcacacatctgtagtcccagctacttgggaggctaaggcaggaggatcacttgagcccagaagttcaagttcagcctgggcaacatagcaagacccgatctcttaaaaagaaaaatcagattcccagtccccacctaccctctctgcgatgggtcccagaaatttggcccattttaagaagctcccccaggcaattctaatgcacagtaaagtttgaccaccactgctatatacatagaaggccataacccctcattataacatctttggtaaagtatcgtttcagttcagcctgtgtatgtatatgttcaacctgtatatgtatttacagttaagatgctcaaagtcaaacctccacatccttagcagacagtactattgaatttgaagtaaattcctcttgaagtaatgtttcgctattgccactatatctttgtgtataagagccaatgcaaaaacattagattgtaaagctgtaggcaaacatcagagctcaggctgtgtgttagttatcaattgttgcataacaaattcctccaaaacatagtggctagaaacaaaaatgtatattatctcggcttccttaggtcaggagtctggactcagcttagctgtctcagaaactctaatgagatttcagtctcatctgaaggcctaactggggaaggatccacttccaagctcattcatgtggctactggcaggacttggttactttgggactgagggcctcagttcctcacaagctgctggcctaaaacctcccttgatttttttccatgtgtgggctctccatagctacttcatggcatagcagatgacttcatcagatagagagagcaagtgagcaggtaagagaatgtgccagccagagagacaatgctaacaggacagaagtcaattttttgaaacctaatcagggaagtgacatctcatcacttttgccatattctagtcctaagaagtaagctactaggtccagcccacattcaggggaaggaattacacaaggccatgaatgtaggtttgtggggatcattgggggtggtgtcttagctgcctgccacagtctgtataaacatttcacagtgcaaatgcatcctccatctccttaatgatcataacctcttcactttctcaaagcctcacctctcagagaatgtatcactgggttaaatgagtacctggcaggtgtttgacggccttcctgaggtactagactctaagctctctgtgagcagaggtcttcatgccttgctccctgctttggcctggctcgggacctaggaccaagaaagcagtcgttcatagtgttgaatgatgatcactttatttttagcactcatgatgtgtgactctatatgaaattgtctaattttagtgtccattgtgtacatggctcatttcctgggccaggctggtcaagaccttgcactctgagagttgcataggagctcagcaggtgtttgttaagtaagttcagattggctactcgttgtcaggagtttgagaccagtctggccaacatggtgaaaccccatctctactaaaaaaaaaataataataataataatacaaaaatcagccgggagtattggtgggtgcctgtagtcccagctacttgggaggctgagacaggagaatcacttgaacccaggaggcagaggttgcagtgagcagagattgtgccactgcactccagcctggacaacagagcaaggctctgtgtcaaaaaaaaaaaaaaaaaaaaaaaaaaaaaaaaaaaaaaaattaggttggctaatcgaggtttctagaatcatctgcatgtaaatagggttaactttgtgggatgattttcttgaataagaagttctcagcctgagcttcacagtagaaccctggaaggaaggggaggtcttttaaaattccgaagccacatccagaccaagtcattcagaatcttgagggtgggacccaggcatcagcgttcttgaaagctcccccaccaggtgatcctctgtgcagccaaggttgagaaccactgtggtagaccagtgtttcccaatccgggggagtttctgcctttcaggagatgccttttaggcatctagtggtgtagaggtcagggatgctgctaaacatcctacagtgcacaggacggcccctccccaacaaaggatggcccatgccaatagtaccaagagttgagaacccctgggctaggtcctacgctttgagtcaggaaattggttctaagtgaagcagtagaagtccatggggtagctttgtcccagatgttaagcttattgcaggcatggatagcttgataagtctggaatattatatacaatctatgtatcggtgtttcctgaagagaaactcactcttttaaaaggcacgcagtgcataaaccaatacatttaaacctacatatatttatttatgcaacataataccatacacgtgtgtttgcatatagcacgtgctataaacaccctatgcatacagagatgtatgcagggcatatgagtgtgttattgtggttagaggaacaggtatgtcttcctcagcgccctttattttccttccccctcactgtagcctcctgccctctgcttgtctagtaaaagccctaaggcctccctgacccttgctgtccttaccctcagtccagaggatgcctctgctgtgccttgctgcctggagggttcccatcacccaggttaatgtggctcttggctttcaccaccaatccttagtttctcaaaggggttcacaacctttttaaattactagtgtgtcttgtagaaattgaacttcacaaacaggtcttctgaaaacgctttcttgtggtgtaattgatatgcatatggtgcatctctttaaagtgtctgacaagccttgacatacgtgtgtgctcatgaaagcagcaccatgagcagcatggcaatgtggctgccactcccaactctttccatccttcctatgctcccactctccccaagcaaccactgatctgctctccttctctgtggattagtttgcattttctagaatggcccttgtgaagatgtgttcacataaattctctcaccctttctcacccgaatagaaaatgttgcatgatgttgattgcttaatagctccacagctttgtccaatttttatccttcctgcttttactgaagatgtcctgcccccatgaataaacctcagaagacccattctgccaccgcctaccactgaagagttgagcttgcacccactccagtccagcccacacaccagtgccagattcatctcttaaaagcacatcctgagtcacgcctcgcctgctcacaaaccttccctctcttccccttgctgcaaagtgaagcacagaggcttgaggctggcttggacatcttccatggaccaggcaatggggggacctaccttcctgacttctccccaccattaccctggtgtccttgatgaactcggctacaccctgaacgctccccacgtctcccacatcacatgggtcctgctgtccttcctttgtgcttttcatggaatccttctgttcttcaaggcctcttcacctcctgccatccataaacctttgccttagcaacccacaccaaccaaagagatctgtccctacctcactcccccatatccctgtgtcagcactctctttattctactttagtgataccttatgtgtctgtgtgtcttaccgcccccctcaccccacccacaaggatcaaagccaggagggcacacttgcagaccccaccacagtggcttgcacatggcaggtattggacagacactcattgaatggaatggaatccaggaaagtagagacactgtcgcccagatggtcaaggaaactgattgctgctaaagctcaaaattgcagatattaaatacttctcaaatgtctggagtagcctccagattgctgtgctcttaaaatctgtgtcatctggacttagagctggcttcccctactctccattgatctccatgattccttgctgtcccactttaccaggctaaaagcctttgggaaaaccaaagccagttcccacaaaaggcaaaggaagagactaacaagtatctggttgttggatttgtttattcccagtcatggaagcgtatcattgcttttattgacttgcttatcttctgctagtaccatattgcaaatgttagaggctcatctattttaagacttccatagtgttttcacaaaaatgaaaatcccttattaaacagattttaggacaagcttctaaaaggacctgccaaaaagtgatttcctttctatcattagaaatagtttccacattcttatcgttatgtagttgaacttttatgtccaggactgcatgaaagacgtgagaactgagaagcaacctatatttgatttcgcactttgttcttggacaggaagcccctgtcaactgacttcacatctttttaatgcactatattagtggttcacagaactttctgggtgttaggtccctttatgtgcttagaaacagttgaccccaaaacgcctttgctcttctgagttgtgcctataaatattttctatattagaagctagaactgagggctgggcatggtggctcatgcctgtaatcccagcactttgggaggccaacgtgggcagatcacctgaggtcgggagttcaaaaccagcctggtcaacatggcgaaaccccatctctactgaaaatacaaaaattagccaggccagccaggcacagtggctcacacctgtaatctcagcactttgggaggccgaggtgggcggatcacctgaggtcaggagttcgagaccagcctgaccaacatggagaaaccccgtctctactaaaaatacaaaattagccagcatggtggtgcgtgcctgtaatgccagctacttgggaggctgaggcaggagaatcgcttgaacctgggaggctgaggttgcagtgagccgagctggcaccattgcactccagcctgggcaacaagagtgaaactccatctcaaaataaaataaaataataaataaataagccaggcatggcagcatgtgccttaattccagctatttgggaggctgaggcaggagaatcacttgaacccgggaggcagaggttgcactgaactgagatcgtgccactgcactccagcctttgagttttttaagatggagcgagactccatcttaaaaaaaaaaaaaaaaaaagaaaagaaattagaactgagaagtttattacttaataataaacttagtcatttaaaataatagcaaatccattatatgtcaacctaagtaatgtttaggaaagataacgattttcaaaaagaaaataatattttagtgtgaggaataggactgttttacatttttgcaaatctctttaatatctggcttaacagtagacagctggactcttacatctgcctctgcattcattcagaggcatcttggggtatcttgctttggttgaagtatatgaagaaaactcaaatttctcacaggtatgtgcttggagaatggaggagtgttttaatggcctttgcagataattatgaaattcttccttgatactacaccaaaattcagcagctagtggtttcttaaagactacttgtaatgtggaatctgaaaccatattgatgatatttttgtactcttttccactaaaattcattgcttgatcttgcactttgattgactcttatattcaagaattattttcccttggctatttggaaaatattggttctctgagttgtgcagatcttccagacgttgacacatttaattaaaccatgtcaaaaaaatttcattggttaatgtcaccaccaatttcatcaagaagtctggtaagtatttggaagctgtcagtctcactatggcaggtacaagttttccaaaattgattggcaacagatactatcagttgttttctttgaagtgacaagctgttcatttttgggaaagtttctgccaaatacttaagtctaaaaaactatatcttgtcaggcattctttcaagaaagggggtgtttgcccccagaaaggtacaagtttggctcataactcagttacataagaatgtttcctgcagcccactgtcacacgctggtttgtggtagaagggctctctgcatcctctcactcatttcattacacaaactgttcgaaaggcacatactcgggggttgagatttaatcaaattaataattttttattgcatcgaggacatttggaagtgaaactggctttttaatttattttcttgcgagcgcgtggtagtgaggaatgtgttcctgctaagtacactatggagccactgcccgattcacgctcaggcatcagcagttttactgtgcaaatgtcaagcagtgaaaaaagtaaataacatcttggtgctattataaaaagttttggcttcacagtcctcctgcaaggatcttgaggtctgccggggctgcacagaccgtctttgagggcccactcctggctcagagtgagactggtgggcaggcaggatagaatctcttgggagctcaatgtcctttccagacctgcctgaacagaatctgcgttttaatgaagtcccgaggagatttatacgcaggttaaagttttcctgtagtcccagctatttgggaggctgaggcaggaggatggcttgagcccaggaggcagaagttgcagagagctgagattgcactgctgcacttgaacctgggtaacagagtgagattgtatctgggaaaaaaaaaaaaaagagagagagagagagaaccactgctctttaacagaggtctgcaaaactttcctttaaagggccacatagtaaatacctgtggcaacaactcaaccctgcctttgtagcttgaaagtagccatagaccatatgtaaatgaatgagcgtggctgtgtgccaatacaactttatttatagacacagaaatttgaattttgtgtacctttcatgtgtcacaaaataggttttttaatatattctaagcggttaaaaaagtaaccacttggaatcatgtcaaaatcattctgagtttgcaggccatgaggagagccagatttagctggtgggccacagtttgctgacctgtgctatataacactgagtgctcattgaagttaccgggggagcttcaaaaaaacaaaccccaaccctctaattcctgagtcccgtccccaataaattctgataaaattggtctggggtgaagccagggcatcaggattttcagatgctccccagattattccaatgtgtaggaaaaatggagaacctctgctctataatgttttccaagaaagttagttttcttttaagcatttctttttaagattttagaatttggcagtgtcaccaaatgtctgagaccagaattatgtattgtaaccttagagcagggtttctcactcttggcactgtgaacccaaagctatctgagataggtctcaatcaatttagaaagttaattttagcaagcttaagaacctgtgacacagcctcgggagatcctaataacatgtgcctaaggtggacggggcacagcttacttttataccttttagggagacatgagacatcaatcaatacctgtgagatgtacattggttcaatctggaaaggcaggacaactcaaagggggtcagagggtggcttgcaggttataggaagatttaaaaattatgtaaagacctggaatccatagaaaggaatgtctgggttatgatgataaggggttgtggagagcaaagttttatcctgtaggtgaagcctccaggtagcaggcttcagagagaatagattgtaaatgtctcttagcagatttaaggtctgttgatgttaatgctggttggcttttcctgaattccagaagggaggagggtataatgaggtatgtttgactctcccttccaatcatggcctgaactagttttttcaggctaactttggaatccccctggcagagaccaggaatctattcagatggttgggggtggggtggggggtgcttagaatttttttttttttttttttttaaacggagtctcgctctgtcgccaggctggagtgcagtggcacaatctcagctcactgccacctccaactccctggttcaagcgattctcctgcctcagcctcccaagtagctgggattacaggcatgcgccaccacacccagctaatttttgtgtttttagtagagacggggtttcaccatgttggctgggatggtgtcgatctcctgacctcgtgatctgcctgccctggtctcccaaagtgctgggattacaggcgtgagccaccccgcccggcccagagttttatttttggtttatagcactattggcattttgggtgtgaccattctttatttggggatgggggctgtcctgtgtattctaggaggtttaggagcatccctggcctctacccactagatgccagtagtgtcccccaccctcagttgtaacaaccaaaactgtctccagacaccgctaaatgtccctgggtggcaaaattgcctggattaggaaccagtggtctaaacgatgtagatgttttttgtgctacttcagagaatctccacattggagctattgacatctggggctgggtaattctttgttataagagcatattctgtacactgtgggtgttgagcagcatccctggtctctactcactagatgccagaagcaccctctcccccagctttggcaacgaaaaatatctccagatattgccaaatgtcccctgaggggcacagtcaccccctgttgagaattgcttggccagctcagaatcagggaagcttctgtccactgacattcactgctgcttctcttaggattttcgccctctccattttcccattgcttgttgcttgaaagttgtaaagcttggttcctgcatcttttctttttaattttgtggctcattaggaatcagtaatatagcaaggaaggccccatgtagagaggtaagggggtggtttttttgtgtggtgtttgttggggggtgtttgggagggtgtgtgtgtgtgtgtatgtatgtgtgacattcattccctggggaagaatctgagcccttgttcctgccagccctacgtctgagccagcattaaatctgcagccaagatcacagacaacttgggcaaatcacttggccattatgaactcacagccatggcaacggccatccacaagcctgaggacaaaaggtgttttattctgttgttctgcacaaaaggttctagggatactggagacaaaatagcctttgagacttaaaggcattgatgtgtattttttttttccctactacatggcttatatttaaactgtcttaggctaatgtacactgtaatttttgtgtgaatcaaaacctaaaattctttttatccagaggccagctaaatgaaggcataagacagcccaacagaggcttttagggtttggtgagaggtattgagaattactagtaaaatgtgctagaaagcctggcattctagcctggccaacatggcaagaccccgtctgtactaaaaatacaaaaaattagctggatgtggtggcatgtgcctgtaatgccagctactagggaggctgaggcataagactcacttgaacccaggaggttgaggctgcagtgagcggagatcacaccactcactccagcctgggcaatagagtgagactctttctcaggaaagaaagaaaaaaaaaaaacctggcattgattattatttttttacatgaatacatcacagtcatcaaaaaaatgctttccttattttttctcgttcacgttacccaatgttgtcattgctggtttgaagcttgggaaaattcagtctgtggatttataggagcatccaagaaaagcactgatcttccttagctatcgtaaacttttaacagcatggtgttctgctggtacttggcaccacccctatatttaaaaacatcagcttgcctatgactactaaggacagcctgaatcccagatctacttcctttttgtgcacaggcactcccagcactttagggggtggttggagtgtgtgtgtttagaaatctgctttctcaggtgactcaattcccgtcttctcagaccctgtctatggcatgacactaaagcatgaaaaattccaaggttaacagtacttgtttggctcacaaaaatgcactctagctgcactcttttcaagatggctggacaacttggaacattttgtttttcttaactgtagtccttggaacttgccatttgattcacaagtgactggagggttatggccaaacccagtgggccacgtcttagagaaaaaacatcacacaccatcgaatatgaaagcaggcacttcaaacagactcaggatgccacacctgagaccgggaagatgccactgttgactagaaatgggcttctcaaattttcatgtgcacacaaatcaccccagaggccttgttaaaatgcagattctgactcagtctggggtcacttccaacattctttatttctcacaagttcctccctgctgaagctgacactgctggtccaatgaacacactttgcaaagcacatggaattgacaaatgacaaatggtccactcatatcttttcttgacctctgatagttttccttgttgcccagtagaagctgccagcatccaagttcagctcttctcagctacagatccatatatcccttcacatcatccagagtgatctttcacaaccccaatctgtttcccatgcttaaaaatgctccctggcagaccaggcatggtggctcacacctgtaattgcagcactttgggaggccgaggcgggaggatcacttgagcccaagagtttgagaacagcctgggtaacataaggagaccctgtcactacaaaaaaattaaaaaataaaaaatgagctgggtgcagtggcatgggcctgtggtcccagctacttgggaggctgaggtgggaggatcgcttgagccagagagttcaacaccgcagtgagcagtgattgtgccactgcactccaacctaggcaacagagcaagaccctgtttcaaaaaacaaaacaaaacaaaaaaaaaacgcagtggcttcccatgattttgttttttttgtctttttgtttttgtttttgtttttgttttgagatggagtcttgctctgtcacccaggctggagtgcagtggtgcaatctcggctcactgcaccctccgccttccgggttcacgccattctcctgcctcagcctcccgagtagctgggactacaggcgcccaccaccacgcccagctaattttttgtatttttagtagagacggggtttcaccgtgttagccaggatggtctcgatctcctgacctcgtgatccgcccgtcttggcctcccaaagtgctgggattacaggcgtgagccacggcgcctggtcaaggcttcccatgattttgaagataaagtccagaattcttaaggtggcctggaaagccctaggtggtctagctcctatattacctatatcctctagctcctaaataaacacatttagctttttcttactaactttttgcagcagttttggttcctctaggatgagtgtgtgatatgtgactaaattgcccagtgttcaaagatatcatgcacactgtgaccagaggtggcttctatactgacatagaagatacagtggagagtgatccatttatagattgttggatatctaccacacatgcaatcttaaccctgaagataactggtcaaccaagctagaataagctctacatccagctgtattatgtcctataaatttttcccatattttatgtcactagcttctagtcatgttggctggcacagtccgtaagagttttatctgtgccagtggagcaaagatggtgatttctgttctataggagccagggttcctacagccacaaataaaatcatctgctgaaaacctaagagcattggcatctgctgagagagcatgattcattgaagtgatcccccaaattcttgagttcctggttttccctgctgttataaaactagatccacagcatgaggtatatacagagtccttgagagatataaattggagggaaactttagctttgatctagtattgaatttgggattgaacagcatcattcttctaaccccacttggctttttgagcctgggagagctgtgatatttctttggaatgctctaaccatttggatgaaagaccgtttgaagtggcaactgtggatttggaaggatgagttctatcgttaaagggcgagtgtgctgcaccataacacctaaccctaactccaaatgatgaaaaagggtgtgggtttagtttaaaaatatatatagatgtatacatctatatatacacacagagaattaatgaacaattttatctggttatatatcagtgtcaccacatcagctgtttaagtattctggatactagatctttctgtagaaggacccatccagtatgaattatttgcccttctgatcttccctgtcccccttctctccactctctttccactggctctgcaggggtctgtatctttgcccccatcatgctggactataataattgtgttacttgtctgcctgcagtattggatttatcttgaagccagaaaggtatcttatttcagttttgtgtacttggcacccagtaggtcttcacaaaatactgaattaatgaaatccaacagaaaacccagttagaacccagctcctgggttatagaaaatcaaatatgtgacaattcaaaatgtatcttccaaagcagtgtgttctgtgatgatgaaatgtcctatatctgtgttgtccaatacggtagccactagtccatgtggcttttgagcatatgaaatgtggtttgtgcaacagaggacctgaaattttcattttatttaattttaaataaacgtaaatagctacatgtcttagtggctaccattttggaccacacagccccaaggcctcacatctttatcctttaagaaccagatacaactttgttagccaggaaagcaggcattcatctttttcttaacatgatcatagaggctgagaatgtggggaggttgtggatgatacaatacccatgtctgttttctctttataatgagatacgtcaaggccaaggattctagtttctcttagtttgggaacctggagagaatttggactttgagttgcattcctctcacctcagtccccagaaagtcatgtgacaaaataagattgagctctaacatctctgctcacaaatcccaagtgtctgaagctctttaagatactgacttgctagtgaacttgaaccatattgtgcactggttccctttttctttttttgagacggagtcttgctctgtcgcccaggctggaagttcagtggcgcaatctcggctcaccgcaacctcttcctcctgggttcaagcgattcccttgcctcagcctcccaagtagctgggactacaggtgcccaccaccacacccggctaattttttgtatttttagtagagacggggttttactgtgttagccaggatggttcccattttatatagtttccccaatccacttcagggaagttggtcttcctaaaaacagctgctcatcttttgaaattaaaggaagcacagctttcttatgaagccctgatattttttattttctaatgaactaaagagaaatctagtaatgagttttcatagtcactttccataggtttaagcgaatgctagtttaaaaggaatgctcactaaaatgaaaacattcatctatggtgttttatgctgggttgtcattccatgacaactatgaagaccatttgggggattttttttttttttttttttttttttttgctggcttaatgtgcttgccctaaagtaatgaagtgcccttgattgctgctaaacaccataatgcgtttaaagttcaatttccccgacaagccatttacttaagggtctggataatataaacagagacaggaggttaggagaggtactgacattatcctgaggccagtgctgcctttactgaaacgtaaatgtctccaaactgaaaacgtcacctggctctgcccctgaggcaggtctttatggacatctcaagtaaaagtttattttaaaaatgaatacaagtctcgtcttttcaagattaagagtgacttacggctgtctctccttcattccacttcatggatgttcattttggttttgtttttttcttctgttcttttttctccttcaagtacttaaatatcacccaccagttctgggttctgactctgaacgtgtgtgtcggggaagggggcaggtggaagccggggaggaggaggactgtgaatgaattgcttgggctgactgggctggggggaagcatttttattaaaaatttgagataatttctgatgtcaacttgaatgaaacttgagtagacccacttgagtggctcttggtgactttgttcttcactgaattatggaccaaaatacctgtgacctttccaaaacaatcaccttgctatttgtttgaacctggcgacggcataattgctgtatcagattctcccagttgccccggaggtccagggcttggggaaagccgttggttgccacagcagcagacgtattgaaaccccagaactgtgaggctggagacgacctgactgttgcttttcttcacagagctgcagcttcactgctgtcctctcttttgactgtgttagtggaatgagtgcttcttgttggcacttgagcggggctccccccaccactcagtcgatcaggaagctctagaactgtaactaccttataactctttgtcaattgactgctctgccattcactacccttccagattctgagcaaattaagttacattcccttttggagcctcagggtcctcaccgcagaatgtgagatcacggtaactaccacactggcccttgggatgtcgaagtattaatattaaccatagagcctgagaggggagatggaaaattgtaagccttctctgtgaatatggggtattcttgaagaccagaggtgttcttgcccgtaacggctatattttctctcctttgggttcaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgtaagtatccggttccctttaaaaatgcatctaaggcctggcgtggtggctcatgcctgtcatcccagcaatttgggaggctgaggcaggcagatcacctgaagtcaggagttcaagaccagcctggccaacatggtgaaacgccacctctactaaaaatacaaaaaaaaatttagctgggcgtggtggtgcgtgcctgtaatcctagctacttgggaggctgaggcaggagaaccagttgaacccaggaggtggatgttgcggtgagctggtgagccgagatggcaacactgcactccagcctgggtgacagagtgatactttgtttaaaaaaaaagtatctgagatgcaaccacctcatgatgtttttcagaaagactacagtgtgctttcctagcagaagatgaatgcttttacttaaagctcactttatgtagttagaaaaaggttcatgagagaaggaaaaagaaagggcctagaatatggtagctgtttaggccccagggtggaatgttacttgggaatggtaaggtgcacacataggacactccacacatggtagctgtggacatggggagctgtgacatggtgataggtgatgctgccgattgtctcaacagaattgtgttgttcccaagtaacagatgcctccagctttctcccaggaagtgaccatccctggaatggtaggagccctgttgaggactgaccccaactctaagcctacaggagcagtattttaacattaactcttccagcagaagagcagatcccagggcatcctccattgcagaagagcagatcccagggcatcctccattgcagaagagaggaaggtccaggggtttagcagcagatctctgcctttctttctggaaacattctcaatggagtcgcagtgactcccacacatagattcttgtagctgtgcaagctcagcagcaatctacttatttccttcacatgtcttcccctttctccatttccttctaccgtttctttttcttcccttgaatcccaaagttccagtgttagtgtgtcttatgattataagaaacttcttcaccagactgaaaaagacatgaatgaatttttatggaatggtcatggagtcatgttggagactcttcagtccttagggaattttattctttcttatctgttcacaaatgacctccaaagaaatgaacacaggttggggagattataaggagggctcaagcaggacaggggactcactgagttccaactatgtgcaaagaagaaatgtttaccaagactgaacctgggaaaggtgtgttgatttaattaggtagtgatctcagtctgtggctctcaaacttctgagaagctttaagaaaatccccatgccttaccccagaccaattaggacataatctctgggggcgggatccaggtaccagtattttccaagctccccaggtgattccagtgggcagccgaaggctgaggacatgtcatttgtctttgttagcttttgtgggacaaactgcattgtgaattaactttctgtatcttaaacctactcgacctactactatttgtgtggtgggagtcacagtgcaaaagacatctccccagattaccccctaaagaagccctgagtgcctacttaggggttttatcagagtgacattaaccactaggcctggttgggaggcattttgaaagggcagaaagaacatgttgtccattgggccagggttcagatgctggctttgccactaactgtgtatcctccgatgaggagcttaactcctcaatgcctgtgttttacttatgtgcaaaatgaggattctaacccttgccgcccaggactcaggtaaggattaaaagattacaactggatgctgccctgagcaaaggaaacatcattcccaccttggaaggaaggcccaggttgctgggacatgggcagggatgccgcccaggatgccccacaagtccatcaaagccatcagtggggcgagtgacgcactcacaggaacatccccctcatgtcctctctccagcgtccagaaacgtagtcactaccaggcagtgaatttaatggttcaggatctcttcttctctttgtaggatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatggtgagttgaacctctgataactgattgtttgatatacaaccagagccatgccttgatgtatttccttgtatttggcaaaagctaccaggtatcgagcgtgaatggagggtccatgacacaaatattggctttaccaatttagagttaggactataaaaaccttcaacatgctattgatagtaaactaaagtctatggctggcagaaataaatcaaatgttttcatcagtgtaaaggtgaaaagggtgctgaagatttttcaaatgccaagttcccactatagaaggaggtaactttcatgtggtctcagtgctcccctttggttgtctttaaatatggatcatagccataaagacatacatgaaccatggaaaatcgtcctgatccttctgtaaatacttaccagtacctgctgtacagagcgcctagctgggctttgctagccactagaggtgcaaagattaaaacacaggctgctttctcaagcagcttatagtctaagacaggggttagcaaactaggggctgtgggccaaatttgacctactacctgtttttgtacagctcaagagccaagaatttttttttttttcttttttttttttttttgagacggagcatcactctgtctccaaggctggggagggcagtgtcgcgatctccactaactgcaacctctgcctcccgggttcaagcgattctcctgcctcagcctcctgtacaagtcaggggaatggttacttttgtaggggaaggaggcagctgttaaataaaatgcctgtggaaagcagagggaaaatagccacaaatagtgggaatcctcctccaaaggaaaaaaaaaccaaaaacatctcctcacagctttaaaatgacagctttccccctcacttctacccatcaagtttcaaaaatagaggtctagtttccaccagggcacagcattaagtcatccactgcctgatgtttaacatatttggatcctttgagcattggtcaggacacagtacatggtggagaggagaggagcttgtttgtacttgagctagtggcacttcacctagagatggggacactgtgagggatccacagcccacctagcatggcccgcttttagctcttatgtcagattttgttggagaaagtcgaaagcccccttagactggagaggagcttgaccatcttgcttgatttcattgccagtcattcatgcgctgtctgcatctctggccactggcacctcatgtgcttccgtttcatccatacgcttaacagatcacaatgctgacctgccttggagggtgtgaggaagatgcaggtgacggggcagggctgaggatgctggggacagaaacaggacagaaagtcatgtgaggtggagaaggtggatgagatctgcccgctagggaagcaaagctgccactccatcaccaaaggcctttgtctcctcagtcctgtgaacccaaaagtatctgaaacaggtatcagccaatttagaaagtttattttgccaaagttaaggatgcacccatgacacagcctcaggaggtccggacaacatgggcccaaggtggtcagggcacagcttggttttatacattttagggagacgtgagacatttatcaatgaatgtaagatgtacattggttccgtccagaaaggtggggacaactcgaagcagggagggggcttccaggtcacaagtaggtgagagacaactggttgcattcttttgggtctctgattagcctttcattgaatatacaattcacatgggagaggagggtagaggaatagtcacttatgcctggtctggcttggtgaaaagacagggcagaggaagcaatcagatatgcatttgtctcacatgagcctcagagggatgactttgagctctgtcctttgtccacgaggaatttccttgtgggcaaattgtgagggaggtatgtagctttatctttgtgctatcttgtttaggaatagaatgggggatttgcctgtcgcagttcccagcttgacttttccctttggcttagtgatttgggggtctggagatttttctttcgtagtcctgtgtgggaggtttgtgcccaggaactcactgaggaagcagctctggacgctagaggcctccatgacagggccagctcgcagcggggacctctgggagggggacagtggccttccctctggagtcctggcctctgacagaagggaaggctcactgaagccaagaaccaccagctccctcctgctcaggtcctgttttcttttgaagggaaagaaacctagtctggagcagcagtgggaggaagtgggaggtggaactgctgaaatctgcttctctgaatatttttggagatgcaaatgcttccttgcagtgcaagggaaagtgtctcgtttctgcagtttcctggcattgtgaccatcaggaggtggcctccaaccgcccaggtatctcctgcagcacagaaagttaggggtgaccatcaggtctccaccatcagcttcaaaatagaaaagccaaactagcactccacaccctctgtgggcgcgccttctgagaacacaaataccacgtttttgaggccgcctcacaaagctctctgaaaagtggtcaaggcagaggaaagccaagcaacgggattctattcttcctggattgcccatgacagtgtgtgggtgaacacctgaagctttttccctaagccgttgctttgcttgcaaagctgctgtgaatcttagagacaaaagaaaagtagaggaaaatgagaattttatagatcgagcattaagcttgtattcgtgattatttgaaacttttggtaattttgcagaatcaggaaactagcaaagttctttttgagagggcttcttgtggcaattgctattctctgtgagccaacctgttacgaaaaataaaggtaacttttgagaaattaatatgaagttataattcagtggtatatggaatacatccagaatctatcccatgttaagtagcatgttctgcattttcagaacggctatttagaaagagcacctcttgagaggctgccactgattagctctgtgaccttggatgagtgagatcacctcttggggtctcctgtccttgttagttaagagtgacccgaaaggccctgacattgcttcgggcactccaattctagatcctctagctctggggaatgtggctggctcttacttcccctgctcccgtgctggcttttccttcttgctaccaatgccggggcgagggtccccacaatgtgttccacaggtcagtattgggcctgaaaatgcacaatccttccacttaggggacacacatctacctgtttcagtgatgattgtccttcctcttgttttggcctagttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgg

SEQ ID NO: 3063 - DNA, 164078 bp, human
gctcaggtggcgcctcctcggccacctctgcgacgaagccgggacgctggaggtgggaggggcgcggcgcaggtgtccggaacgcccaggtgcgcttccctgttgtatcctgtggggggggtggtccccgctccggctgcggccaggctgcacccccgcacgtgcggctcgcgggagcctaagagctgggtacccgggaggggttgcagagagaacagacggcgcgtcccgggctagtgctttattttaaggggccagtagagagtcgcttcttgcctgtttcccgggacgctctccctgtcgcccgagctcccagtccagtcctgccccgccccgccccgccgtgcttctgttctccttaagcccgcgcgaaacaaacacccggttccccaagcctggggtcttccgggagctcatttcgaaaccatgacccttgaaaccaggaaagtgacaggagagactctggacagcatgggacggaggctgagtctctcctctttgtcccttgttccaactattaaaatgcggcccgggtgcaggtggaggcggtgtgctgagcgggttccaatgcaacgggggaacgactagcaacggcaaaaggctcagctccggagggttaaaatctgaaatctccaacctggcccgaggctggtgtaaggcggctgtaggattctttttgtcacttcctaacaccctgaaatgctgccgtcagcaacatgtctttaagtggggactctgtattgggaggaaaactcgtaaagagtgctgtggaaatcagcctcattccgcagcactcctgaaaacgtgtgacagctgtgcttgggaaagggtttttctcctcctgctccgttatctttctctagtgacagactccagccacaagccacaaagactgtgaagagcattcctaacgaggacgtcagtgggtttaaccattgcgagttaatggtgagggcttgggaattgcttgcccgctcctccgcttcccctaatcattcatccccctctttcacattatctttgctattaattgtgtgtgggggggcgataattttgtacggattaaaattttggtgaggagtaaagggggcacttttttgcatttcaaaggaagctcaaataattttctggtttacatttttaaaaaatttactaggtgatcaaaatatgaaaggagataaggcccaccaaatccaacaggaaaatttctttctaaaaaggcaagaactagcataagatccttctagaaagggcagaatcgagtggcctgtaactcaggttcctacttctcttaatgtcccccatgtgagcagtcaaaccattcaacctccgttttaaatgaggctcatacacaaaatgaggctcagaggatgactgctactcagcctgtgatcactttggtgataattgccaccaaagatgttacagttacgaacaagtgtggtattgaggaaagcatcaactactttttctgaaatcgttattttaatttaacgctaggcgtttggatttgtacgtggaattatcacacggggaccttctccagaacagctttcacaatactttggactgatttaggggtagggtgggcttcatttttaaacaggtgtggagttgggtgcagttctcatgaagcaaaggcccgagccagagacctgttcttaaggaagtactttgtgttttggacaattgttggctccacatttcaattgccaatttatgttaatttgtgcatacttcactggttctggcagtatccttggttttggttttagtttttacattaaaaagaaagttcccttcatgtaaaaaaggaaacatactgatttcctttggtagactcttagtaaatacaccacagggccatgaactggttttatttttccagatgtatttaattaccgtgcatcctcttatgaatgttttaattgaaatgatttaacgttgggaaaattctgaccattggcccattaagtcgggactttggttcttaatacaattagttccttaaccaggatcagttaatttactggtaaaatagatgaggtttgtagaaataaaagtcccttcagactcaaattttaaggtatttgcaatctttaacctaaaaataaaataatgagtagtggtgatatgtgtaatttcacttttcattacatcttgaaagaaaacatgggtttttcattgttaagccagtttttttatagccttaagatgtaattcacatatcatacaattcacacgtttaagtatacaagtcagtggtcttcagtatattcagatttgtgcagccatcactactatctaatgttagaacattgtcatcaaccccaaaaagaaatcttgtacccatttcgcagtcactcctcattctcttctccccccagcccctggcaagcactaacctactttctgtctctatggatttgcctcttctggagggttcaggtaaatggaatgagccaattgatgtctgaagtgtatttgactgttcagtaactttggtcgttttgcacaatgagatgttgctgtattgtgtatgcagtacgctacctaaatgagtgtgttgaaactatttctctggctgaagggttccatgtttggctgcacatattgtgaaggtgagtgagagtgcacacacacagcacacagacacacacacccttcagtgttaactctggttttatctgataggaacttgcattgcccaacagaattttgattctgttaccttgttcataggcctgaaggcatagcaattaagtgaattccatgtaataacctcttataaggcatttgtggaatatccaagctgctttaatatggcttatgtatccagagagaaatgcggattttgtttctttgcctataattgttttatttttatttatttatcttttggagacagggtctcactctgtccatgctgtactgcagtggcctgatgtaataactcactgtggcctggaactcctgggctgaagcagtcgtcccacctcagcctcccaagtagctgggactacaggcatgtgtcaccatgcccgattaagctttacagttttttttttttttttttttttgtagagatagggtatttctatggtgcccaaactggtctcaaactcctggcctcaagtgatcctccctcctctgcttcccaaagtgctgggattacaggcgtgagccactgtgagtggccaattgcctatcattttaaatggaaactgtatacgaaatgatcagatacaacaaaatattgaaataattgtttcaacccattttgtggtaaggaagtttttataaggattatgtatttaaatgtcaataatttcactaaatagcattataaaaaattttggtctagagcagttctttttaatatgtgtacagatcatctagcgatcttgttaaaaaagcagtgtctgattcagtgggcctgggtggggcctgagtttctgcatttgtaacaagctcccagtgggtgctcatgcttctggttcctggagccaggaagcaaagaaggctgttaagcagagaggccctggtgcctgccccagcttgcccactagtttgctgtgtgatcgtgggtaaatcattttctcttcataattttagttgactataaaataaaagaatttgatgaaattatttctttgggtctttacaggtcaaccaatatgtaatttagaaaaaaagaaatgagagagtaatgttatgcttgaaaaccacgagaaaacagctccctgatggtctaaacactacttgaatgcatgaagccagcatcagaagtgtcacctgtagttgggttaaatgctggcatcttcgatgtgcatgcttccagtatgattggctcttctccaagggaactggtggaggaagctataatgttctccctctttaacacttccagctttggcttctcctgacctcttttccttaaatccctttcttccccgacatccaggctcaagccaccctcagaggctgcactcagaaagaagcacgctgaagacccatacatgcaatgcttggttctggaagcttgctcaggaattcagatgcagtgggagacaaaaaggaatggaatcctgctgaataactgggcaggaagtgatcccagaatatgctagcttccctccctctgagtctaaagatctagtaaggagcccacccttggatcttggagagagctcccttttaatatcgggacacaaaccgacattttgagtaaacctcatagtcgaataccacggagtactgtttgtgacaaacaggaagtcattaattctttattatatttttgctctaccgaaagctgttgaccaaaccacctggcttctccgagaaaacccttatctgctacatccaggaccaagcagctggatggtttattgaaaatgccaaagggatcaatcataaaacgtgccacttatgtagcctaaacattttgtttaactttaaacattaatttgctgatattttattgtagagtcaaggcctttgctttgagtgcaaggacctgattggagttcctagaagtctttcttacattaaatcacagccaaaattcattggcttctgattttcagcttcagattcttacattaaagtagaatgaaaacctaaaggcattgggaaccaatctctgggcagaatccctttatatcacctaccccactccccttaaacctttaaatttgcccgtacttacttttgcaactattttctcaagtgactcatttttgttaagactctccaaagtaatcaacctggttttcaaagaaaggaaaaaactctctcgtttggcactcctattttattagtttatgtaatatcgaattaagtttcataattctagtaacaagtacaactggcataaacaggtttgggaacaaacaccactgactcttcttaagtacactacttgggggagaagcagtacatacatatattgcaaaagagcctacaacccaagttctggacaatgatcagtatggtttagaaaaagaatggaggatatggggtaaatgggtggggtcctttaggtaaacattggtaagagagcatctgctatattttgagccatcatcatccatttaataattttaacatgatggctggcttgttagtgtttttcatatgcttctttctgttcaaataccaaatttgtcaagagcagaaatcgttttattcattgttataccccaatgttcattggaatgattggcatattataggtgttacacaaatatttgtttaaaaatgaggattcatatgcattttattaaggtctgtcaacattaaaattatagatttcaaggtatttaaattaacattgatgtactgcaaactctggtaaactatgctaaaatagggtaaattacgtaaattattgttctttaataataatacttttatcacagaataacaatttcagagcttgaagttgctttagaagtaatttgattgctgccaggcatacagacacagaaacaattgaaagagcagtttggatgttctttcattagctttttttttgccttgagctttttttcttctgctgctataaaatacttttctttctctggtgaaaagtacttccttctcatcaggtttttgaagttctggaaagattggggttgaaggctttgtttccctgaaactcattattgccctgagaattaaaaggcaatggcagctttgtgtttccatcctcaccatgtgtattagggttaaatgagtacctaccacaatatcatgcaactagcatgtgccagtctctaagcctttgaattcctgtcacatgtccatcaccatggggctctcaggggagtattggacagctgctcactcagcaagcattcacagagtcctgttcagatgagccaagtactgtgctaagtcttgaagcaaaaaataaacaagactctgttctcaaataaccacagtcatttctgaaaggcagataaacaactataataaaagtacaagatcctgtaggaaaaagagtatctgtctgaggaaaaaagcggggaggtggtatttcaaagagggattccctagggaggcagttactttaaatctgagagtcttcaagcatgagcaggaagataggggtcagggtgtccaggtgtctgggagaggatggtccaggccctggatacaaatgtgtaaaagcaggagccgtggcagaggctgctgtgtgggtatgttgagttgggaatggcctcaatgtgggggagtggggagagctgaggccagattgtaaagtaccaggaaataacttggtcattaccctgttggtcacagagaatcaggaagggattttaagcaggcacatggcagctggagggaaatgacagtctccccaaggggataaaagaaacccactgagagaatcgtttgtgtctaactataaaattccagataaaagtttagaagttctgataaaggtaaaaccttgtggcttatatgaagtttccagtggtgacttagatttgaggagtgttgagaagggtggaagggattaggataacccatgaaagagaggtaggagtgagcaaggtttgttggggcaattctgaagaaactgacctggccatagcagagagtaggtatgggagagagtaggaaatacgatttggtcagggaactgaaagccagatgggagtaatgaattttagttgattacaaatggacacatataaatgaatcttacaaaaatgtttttttgtaagtccattgtttcatcccttttgagaaggaagggaagtattagctttctgggatggaaagatattggggtgatctttggcatgactacagaggggttgaggattggaacagaaccaacttccatgtctatttatttactcgattattaattttatttatttatttttctttttttcttttttcttttttttttgagaaggagtctcactctgtagcccaggctggagtgcagtggtgcgatctcggctcactgcaagctctgcctcctgggttcacgccattctctcgcctcagcctccggagtagctgggactacaggcgcccaccaccatgcccggctaattttttgtatttttagtagagatggggtttcaccatgatagcctgaccttgtgatccgcccgccttggcctcccaaagtgctgggattacaggcatgatggattattaattttaaaagtgggatttgttgttgttgttgttttgtttttgtttttttgagacagtctagttctgtcacccaggctgaagtgcagtggtgtgatctcagctcactgcaacctcagcctcttgggtccaagcgattctcctgtctcagcctccaaagtaactgggattacaggtatgcaccaccatgcctggctaattttttgtatttttagtagatacagatttcactatgttggccaggctggtcttgagctactgacttcaggtgatctgcctgcctcagcctcccaaagtgctgggattaaaggtgtgagccactgtgcccagccatttttttttccttaaatatttgcaagaatttaccagtgaagccagttgggtctggagttttctttgtagaaatgtttaagttatgaagtgtatttctttagcagaggaatattcagactttctctttgtttcaattttggtaaattgtggctttcaagggctttgtccattttatctaagttatttgttggcacaaagttgttcataatattttgtattatctgtttaatcctgttatctatagtatctgtagtgatgttcccttgttcgtttctttttttttttttgagacggagtctcgctctgttacccaggctggagtgcagtggcacgatctcggcttactgcaagcttcacctcccgggctcacgccattcttctgcctcagtctctcgagtagctgggactacaggtgcccacaaccacgcctggctaattttttgtatttttagtagagacggggtttcaccgtgttagccagggtggtctcgatctcctgacctcgtgatctgcccgcctcggcctcccaaagtgctgggattataggtgtgagccaccgtgcccggcctcccttgttcatttctagtgatgtaggtaattggtattctcattatttttcttgatcaatatttctaaaatttattttaatagcttgatacttacatgtaataattatatctgataggtaagttgaccacttaatgaaaaaggagtacattttctagtaatcaaaaatagaatttaagtatctaaaagtaagaattgcttacttggttagaaaaaaataaaatctgccaaaagaaaaagtatttaaacctgatctttggaattttactcttaatggctgtatataattcagtatatttgaacttggtataacaaggtctattataaacaatcttgagttagagtagatcttgagttgagcttagtatttgcttgggtatttatttgtttagtttttgtaggactgttaaattctattttcttctttggaccaactggagatagatactaaaataaaagaagtccttttttcttcctttctaagtatagttttagagcagggtttctcaacctcagcactattgacattttgggctgggtgattctttgttgggggagtatgagggctgtcctgcgcattatagagtgttttgcagcatctgtgttctctacatactacatgttgtaacagtcctctagttgtaacaaccaaaaatgtctccagacattgccagataacccagggagggaggaggggagcaccatattgattaccactacttaaagggtaagagggattgaaaaccttttgtttctcacaatatcataaaatctgagtagtagcattgttgagaacttggttgagcacatctgcagaatgggaggatttcttgtctaaaaggtttttctttccaaaaggaatgcttggttttttttagttgaaggaagtttttttttttttaatctttttcttacatcatcagagaatctggagatataatggggagctttgcagaccacctaagtcattcttccttggagtaaaatggtgcctaaaccatctcgataatgaggccaacctcctggggaaatagtgtgcctggctttccttggtaacttctaatgattagtgcaccttatctctgaaaggactgaatctgtgaagatccttttgcttactaaaatagttttcatcatcttttgttctcattaagtggaaagacatgaaggatctagtcacatccttagttaccttgatggcctttccaaatttagaattcatcttcttagctgtaatcaaatctaaccagattaagcccttaaggcaaccttcctgcacgttccgtccttagtcatgtcttcattacgtttgttcatgtgtttgagagatgcaggagttggaagagaaaggactgatttcccccttgtttagagatccgttttctatagccattgatctctgccattcctacatcccagcccccacaacctagactcctccctgcaaatggagactataagtcaatgttttctgagacatctgaccatacttgcaaaatagttccagcgcaaaaagaacaagaacattggaagcgagggtcagaaggagcctagaaaacctgctatattgtatgtgcattgggtcactgttttagatttagaaatgtttcacaatgtcttcccgaaaagaatgtttaaatggtggattttaagatgggtgcttaaattcaggcatctgttccttcacacaatgggcaaagaatggaaatgtaattagcaatgtaagtcaagctcttaagataatgtgatttgatgcagtactttatattttcctttttgttttctcatttggcatattctgacagtttccatggtaattaaaaagaatttgggaccttaaagggatgaatttccatcctatgaattcttaccattttgcaaagccactgtaccggtttactaaaaactgttttgagctctattatatgatgtcacaaatatttttagatgttttgtaagaggcacaaatatcgtaaactcattaaaaattgttattgaagtataatatgtgtacacgaaaagtgggcaaatcataagtgtacagcttaataagtttttataaatgtaaccagcagttatagattaataagcagaatattaccagccccttagaagccgcctcaggctgccttacagatatacctgatcaaggctaatcacccctaatttctgtcagcagagctttgcactttatataaatggaataatacagtatgagctcttgtgactggtgtggcttgcccaacatttgataacattattttgaaacaggaggatgttttctgtctggaaaagagatctgcttctaaatcattatggttaaaagcatttattaaatgctttcgtgtgtagaaccgtactaggaagtacacatatcattggttcctaccctctattttaagtggaaagcattgacacagcagctgtgagaaggactttgaaaatccttgatgaaagatgagatagatacatgaaaacatgtatacagctggagagattacaaaaataaagtgtccccattatccccttcagaaatggaaagtacattttgaggagttgtgaatgaagacaaagctgtaagtgttgcatacctattcaggatttgatcaacgtgaatgcttgctaacttcaggacttaaggatgtaatagatgttgaggcctgcctcctcccaattagtttcctgtagaaggtgaaattttaggaattgtttgaattagcagtagttagtgaatctttggctagtggatattccaaatggagtagaggtgtggacaaaggcccaaaggcctgggatgatttttggttctcatcctgaaaatggaactacataggaaattgtggtttgccagttgacttttcttctcgtttgtttggacttagacaataatactttgcctatgttccttcagtgaggaactttgtcatcttcttaaccagagtaaatgatgcagtcagcaaaatgaatgctttgtcaccacactgaactagctttaaatcgtatggtgttaccactgcttctcaagtggtggtatcaatttatactctcaccaggagtgaatgaacattccagcttctttgtatctttaccagcatttgctattgtcacattgtttattttttcaaatatctgataggtgtgaagtggtatttcattgtttttttttttatgttgaatttctctagagaggttgaaagttttgtgtaggttattggtcatttgggttttctcttccatttagatccttatttgtatttgtcttgatttgtagtagttctttatgccttctgtatactaatccttagttaaaatgtgttttcaatatcatcttcctctctatggcttatcttttaacttggttgaatacatcttttgttgtactaaatcttttttattgtaataaagtcctaattatcaatcttttcctttaattttttatgacttgtgctttttatctttgccttgttttaaaattgtttctatccccaaagtcatgaaaatgttcttctaatcctcagtattttctaaaagaaagtttttctaaaatcacgcttttcacttttcagcctttattccattgggattctattttttggtatagttttagatagaaagctatttttaaatttgtttatttcctatacagaaataccatgcacttaataattcactctttcctcccgataatatctatatctgtacttccttactatatgtgtgagtacatctatggacttcattctattccttgatctgttttggcatctctgtgctactattacactgtcttcattactatagatttagagtaagcctggctatttcttaggagaaattttccccttttgctcttatttaaaagtgacctattcttgatcctctgctttttttgtgtgttttttttttttgtttgtttgtttttttgagatggagtctcgctctgtgtcacccaggctggagtgcagtggcgcaatctgggctcactgcaagctccgcctcctgggttcacgccattgtcctgcttcagcctcccgagtagctgggactacaggcgcccgccactacgcccggctaattttttgtattttttttttagtagagacggggtttcaccgcgttagccaggatggtctcgatctcctgacctcgtgctctgcctgcctcggcctcccaaagtgcgatcctttgcttttggaatcagcgttttatgctccacaaacatacctgtcaggattttgagtggggttgcagtgaacttatagaataattttttttttttgagatggagtctcgctctgttgcccaggctggagtgcagtggtgcgatctcgggtcgctgcaaactccgcctcctgggttcacgccattctcctgcctcagcctcctgagtagctgggactacaggcgcccgccaccatgcctggctaatgtttttgtatttttagtagagatggggtttcaccatgttagccaggatggtctcgatctcctgacctcgtgatccacctgcctcggtctcccaaagtgctgggattagaggtgtgagccacggcgcctggccagaataatttcatgatagtcaatgtatttactatattaagtctttcatttgtgtatatggtatatctcttcatacatttagattttcctttgtaccccaagatgtttttgcatacctttaaaaattttatttcaaggtccctcatagtttttgtggcattttttaaaggtaaaatgtaaggtaatcccagtgctttgggaggccaaggcaggaggatcacttggggccaggagtttgagcaacatagcgagaccccatctctaccaaaaaaaaaaaaaaaaagccagacatggtggtgcctgcctgtagttccagctacttgggaaacagaggtgggaggattgcttgagctgaggattttgaggttacagtgaactatgaattgcactccagcctgggtgacagaatgacactctgtttctaaaaaataaaaaagtaaagcaattagggttaaatctaattccatgcaatgccatggttcccttccatagacctgtgacttctgaaagtccagctggatggacaaacttgttcagattagcatagaaactgtgaagggaagctgattctgagttatcacataccagcctggtcataagagctgtatatggtaactctgtgactatgtcccagaacctgctgagtagcaaacgtatgggatgcatcatgggctacatcctttgaatagaatttcatctcttcctggaagagaacagaatccatcatcactgagggaaaactcagtttctaagctgagttttagctgcttgcttgtgctatattttccaactagtagtattttcatgaaagatattgatttcattgtcatattgatgcagaatgagaagtcaaatcagttcttctactaattcaagaataaaatctgtttgccaatggaagacaaagctagtgggtaacataccacaattaattttgcttgcctgatattttctccaagagcagggagcccatgagtcctgggagtcacatgttgaatgttaaaacttccaaacagtgatagagttcacaatttagctaagaagggacctcatcaaagtccacaggagtcctgaagatgggatcctgtttttagatatttatgcagaatacaagaaaagaggaaatagagtttgagttagatattggaatatccttccgttgaaggtggttgtggccgggcatggaggctcattcctgatcccagcacttcgagaggccgaggtgggagggtcgcttgagcctagcagtttgagaccagcctaggaaacatgatgaggccctgtttctattaaactaaattttaaaaattagcctggccggtgatacgcacctttagtcccagttactcaggaggctgaggtgagaggattgcttgagcctagtagatcaaggctgcagtgagccatgattgcgccactgcactccagcctgggcgacagagtgagaccttgtctcaaaaaagaataaaaataaaaaataaaggatcgattttatccattcaccaaatacttattagactgagtgctaagcttgtaatagaaggatggttaagtcatgattttcacacccggtaagtgatttggtcccatgcaggtgaattaaggttatatgcagatgagtctgctgtgtagcaattgtactctgtgttggctagtgatgacgtgtaacagtttctgccctcaaggcactctgccttcattgaggatagtcaacaaggtaacacctgtcatgatcccatgtggaaaacgttacggataaaacaggtggaagacccacagtgccactcagtggaggtaaaatgcccgggaggagccttggagggtgaactaaagtgaaatgagatatttttacttaaaccaaccttcaccatatcataacataagaaaataaaaaagaaaataaaaatccttaatatgttaaaatgcagatttcttctataagaaaaatatgacttgatgtgcaccattacaaagaccaagtttacattcaagatgcaaattcttggttgaaagaaagaaaaaaggccagtttttattatcttagagcgatacagctaaagtaacccaggaaagatttaattggagctcttctgttcaaacattacttccatgtttggagatgttattcatgataatgaaatttccttggtcaattcaagattacctagtttccctaagacatttaatggaaaacttctcctggcagattttacatagctgctcaccctgcgaagaaggggccagcacttgggctgtagcaagagcttgatttattccggaaagcagtttgttcagctgtcaaatgagattatatgtgtggctgttagccatcacttcacagaaatattcttattcctcaacaaggcctcaaacttttgtttatttaagggcaacaaaaatcacaaatgtagattctcctaaaacatctctttggaaatgtgatttttcacagggtgctgccattccctgtctgctgatgatggctacaaccaaactggactgccagacattttctacatgtcacctgctgtccctgggcagcagtatcccccactagccagcacacttaggtatgcttaggttttttttttttttctgagacggagtttcactcttgttgtccaagctggagtgcaatggcgtgatctcagcttattgcaacctctgcgtcctgggttcaagctattctcctgcctcagcctcccaagtagctaagattacaggtgcgtaccaccacaccaggctaatttcttgtatttttagtagaaatgggtttcactgtgttagccaggctggtctcaaactcctgacctcaggtgctttgcccgcctcgacctcccaaagtgctgggattacaggcgtgagccaccgcacccggccaggtacacttaggtttgtgtaatcctgaaaggcctcaggcataaaaatccctttttaaaattaacttcttttgtcatatgtttctgtcttgggggtggtctctcaatgtagaaactctagaatttaaaattgaagtctaaatttggatgtgaaagtgaagtttattttttatcttattttagcatttagggatttgagtaaaagtggtggtatttctactctgtgattcaattgcagtttcctcagcccaacatgacaagtgacatagcattaaaaagaaaaactcatatgtgaagtagctgtgacgtagagtgggctgttgattcaaaaggtcgacctggttggaggcttgaaggcgttgggctttccgcctggcagtctctccctcgtgtacctacaggtaatgtttggaaagtcaaggactggggagaaattgagacttcagattccttaagaagcaaaggcgaggttctttttgtctcaagaagagtttgtcagttagactcatggttctcaactagggtagattctgtccccctcaagggacagttggcaatgtctggagaccttgttggttgttacagattcgggggatggggaggtgctcctggcatctagtgggtggaggccagggttgctgctaaccgtcctatagtgcacaggacagcctctcctcaacaaagagttatcaggccccaaatgtcaagagtgctgaggttaagaaacaataaggcagactgagttttgaagtgaggtagaaagcgggactctactccagagacaggctcagatgctggaccaaattgaggactaggtaaaacagggccagggtggaagcagctttctgtaagacatgcccactagtgtgccatgtcagcttaccattgccatggcaacacctgggcattacctcccctttacatggcaatgacctgatgacctaaaaggtactaccccttccctagaaatttctgcatgtaataccccttaacctccatattattaaaagtgggtataggccgggcacggtggctcacgcctgtagtcccagcactttgggaggccgaggcaggtggatcacgaggtcaggagtttgagaccagcgtgaccaacatggcgaaaccccgtctctactaaaaatacaaaaactagctgggcatggtggcacacgcctgtaatcccagctacttaggaggctgaggcaggagaattgctgcttgaactcgcgaggcggaggttgcagtgagctgagattgcgccacggcactccagcctgggtgacagagtaagactctgtctaaaaaaaaaaaaagggggggggttataaatgtggttgcaaaactgctctgagctgctactctctggccatggggtagccttgctctacaggagcagtcacagagctgtaacatctcctcttcaataaagctgttttttcctctacctctggctagcccttgaaatcttccctgggcaaagccaagaacccctgtgggctaagccccactcttctactaaagtagtgtaagaccatcattgcaaacctttaaaacatataacctgtaggaaggtttgggatttgggctggaatagggcaaaaaattctagacagcaaataaagagacccaggtatagataggagttgcccagttcaggaggtactttctgaagggcatctttcaggacaaatcttttcctgatgcagacagacgtagtactggttttcattcattactattgctgatgtgggcctacttgtgtaagtcagttgatattcattaaactcttacaaggcattctttatgataatgaaacataaatgatgatagcatatatgatataaaactgaattgtaattagctttggaaaatagtacttggaagtttctatttaagcctctttctagcaaactctcaaatattcatgtaacaaaagaagacagcataaaacattgaagtgaactgtttttttcatttacccattaatttcttttttttttttttgaggcggaatctcactctatcgcccaggctggagtatagtggcgcgatctcggctcactgcaagctctgcctccggggttcacaccattctcctgcctcagcctcccgagtagctgggactgcaggcgcccgccaccacacccggctaattttttgtatttttagtagagacggagtttcaccgtgttagccaggatggtctctatctcctgaccttgtgatctgccctcctcagcctcccaaagtgctgggattacaggcgtgagccactgcacccggccttacccattaatttcaagcaataggtttaatctttttattttcttctaagagctgctaatgaatagtacaatggctggtttacgtatcgtgtttccctggctttcccaatccttggtgaagatgttaggttcagattatgaaatagacaatatttgaccctttgtggtatacaaatatagcattttcctgtggttctaatagaagaaggtagtgatctaaatacaaccccaccacccctaccagggccgtttccagcctgatactgaagtaggacaaataaattgcctatttttctttctttttttttctttctttctttcttttttttttttttttttttttgagacagagtcttactctgttgcctaggctggagtgcagtggcccagtcttggctcactgcaacctccgcctcctgagttcaagtgattctcctgcctcagcctcccgagtagctagctgggattataggtgcgtgccaccacgcctggctagttttgtatttttagtagagatggggtttcaccatgttggccgggctggtctcgaactcctgaactcaagtggtccacctgcctaggcctcccaaagtgctgggattacaggcttgagcacctgcgcctggcctctttttcttctgaaactttgcagatgtagctatagtctcattctgaccagtcttcaaaggactctggctttagacctggggtttctctccaaaatacttaagagccagaggatgctgtccttcaacagctcctttggagaagcaaagactcatcccccagtttctctcctctgtaagtattgatttctgtgtgttctcttttctgcaggcgtatggtattcctgtttgggtaattgttaaggatgacatgggagaaattctcggttatgttcagtctgtcatttaatttatatttcataaatgcttctcagtaactaaatataggtgtataaaattgattgtaatagatatttgcaggaaagttttcacccatatatttagttgaagtcagtaaaaatgtcattttcagataattattcaatgtcaggtgcttatgtttatacagtttacttattcctaaatatatttggatctctatcttactataaattttcagttggtgcatctttaacatctttgtgagaaaaattcaatataatctcacatactacaggttgtttgaaagtcttattttttcattgtttatgtaaaactgttaaacattcatgaacattatttaaaataaagatgttggtctttgaggatgaaattaagaatgtagaaatgcataccttggtttcccagaattgagttcatcctaatatgaaacagcaagaaatcagaaccctgtttattatagtattatctttgtatttgaaagcaggtgtgtgttcttgaaaatattaaacagaagtcatagagctacatattggccagtcaggaaactctcttcttcttaccttccatcccacctccagactgtttgcctaatcccgctttgtgatgtctgttgtgctggtataacgatatttgaactctctgatgaaaactttggccgcaattgacccttccctaaagttgaagagatttctccaaataaggaaatgaagggagttaagagggtaagtcatacagtttggatgtgtatccccgcccaaatctcatatggaaatgtaatccccagcattggcaatgctgcctggtggaaggattgtgggagtggatttgtcatgaatggtttagcaccatctgccttggtactgtcctcctgatagttctcatgagctctgatcttttaaaagtgtttggcacctccctgctctctctcttggtcttgctctggccatgttaggtgcctgcttcccctttgtcttctgccgtgattgtaagtttcccgaggcctccccagaagccaagcagatgccagcatcatgctttctgtacagcctgcagaaccatgagccagttaaactttttaaaataaattacccaatctcgggtgttttctttacagcagtgtgagaatgggctaatacaataagtgagaaagaaaggaaaatttgcccaactatatatcatctttcccaggtaattgggagttttctgtgctttcattcccatgaggaaatgtctctatacatgctacagaaaagatctactcttttgtgattgtcatagtcagctacagtgatgcctctggaaaaataagactgccacagctgaagcccaagctcttaatgaccaaggtagttatttgctgtgatgttgctgcttttgttgataccatcaaaggcattatttgaggcatagcttgctttcctagccagcttcccaactgtcgttgtgcacgttcattgcccaagtgcaattgcaagtgcaggggctacagtgatgaataagacagtccttgtccttgaggaagagcccacagtctggtgggcggaaaaattataagggttataagcaaaacaatagcaatttttattgtgttcaaaaacgcactttcttctggtgacaggatagtcctaatactggtctacatttctaccacatatgaatatgtaacatgcatttctcttttcttttacatagtagctggctatcttaatgactgtattaacaattttcagattttagttatatctaaatgtcgctacttttgcaagtgaacatcctgctgaaacgtattcagttgggaagaatctggcctttttgaaagggcattttctgaatgtagcaaattaccactgatagtttaatgcaattaggaaaatggaagtgaatggcaacgaaactgattaaaaccatgagttgtgtcacagaataaaccataaatgatatgagtaactataatgccataataagacactgtcattacttggtacttccttcttcagaagcctggtaacagcatcacaggagcctgaaaatggattaagtcattgtttgaatgtggacatattctagtctcacatattttagtctcagatacgatgcttcatttaattatgtctataaatttattacctacagacattatctttagggtcaaggagacaaggtatatgttattgttcccatggtaactttgtacttaaaatggcaggctgcgcttacttgatttaaaaatatctacagtttgattgctgtaaaaacctgtgttcataatttgctcacgtccagtgactcactcctcatttaactggcatttcagcaaatggcttgatcacataaattgtttggagaactaacagaaggttattgctctagggcactaaagatattttagatttctatcatttaagattttgagttttaaaaaatagtttacatgtgtttttgccaagttaagagtgaaacaaccttagtggaatgtttcttttctttttgagacaggatctcaccctgttgcccaggctggagtgcagtagcagtgattatggctcattgcaacctcggcctcctgggctcaagcgattcccccacctcagcctcccaagtagctggaaccacagttgtgcaccaccacatctggctaatttttgtgttttttgtagagatggggttttgccatgttgtccaggctgatctcgaactcctgagctcaagctgtctgcctgcctcagcctcctaaagtgctgggattacaggcatgagccactggacctggcctcatgtttgttgataattcatgggcacagtgatgaattgtactttggtgtgatatggggcatattaagctagcagaagttataaggcagatgtgcctactggcttttcacttgaatttataacagtggacttgaaagtttcgatctatttgtatctctcctctgctgtcacagaagtcccattttagccaacctgctgccttattttttaagatggagcctccttacacacacacacacacacacacacacacacacacacacacattaataaactaatacatgttcttttcaaacaaacttaaacagtgcagacatgctgcattagtttccatccaatagcttggcgtgggtgcctgggaacagctctacctcaggaggaaggtgctgggctttgtggctgcccttaaccactgagagtctttatacgtgactattttgcagatgactggggtttccaacgcacttcaaatttgagacaagcagggaataacaatttatgtagatatatctgagcctgaattgcattgtgtatccccattggtgactccaaagtctcctactttggagacgtgagcaatgacaattctgtgttggttttttctttctgtttagatatccattccaaaaacttggggacagtgtaggaagagaactgcttccactgtgagcttctcttttatccatctctgcctttatggcactctttcattggcagagtgtgtgtgtatttctgtgttggcatctttttttgatggctcagacaacctcccttggtctctgagaaaataaaattatagctctagcctcatgaggcaggcccagagactgctgcctcaggcgcccttcctgctgtatacctcctgaggttggatagagcagctgaaaatccggccgagcctttcagagcctcttaggggatatttaagtggcagatgcacttaattattagatatgttccaaatgcaggagaatgagctttgagagagttttgaatttgggacaaaaggatgcttcttatgaatcaacttgattttcacagaaatcagaatgtgtatatcagtcaagaaatgaagggatatatacacacacatatacgtaatacatatatacatgtacatacatacctattataaaatggcagatatgcaggcagacatgcatatacaagtatgtggtgtgtatataacaaccattgtacacatatatacatattatatgcacatatacatgatacatatatacgcgcaaaaaaatttactgagtccttactatgtgtaagtcctgtttcacctgaatcaactaatgtaatcctcattgtatcacagatgtgacaaccgaggtcacatggctagggagtggcaaggccagtatttaagcccaagaattctggctccagctgtgtttctcacctcctcctgatggagggggtgcagtcagtgtcatttaaaggcatgattgatttggtttgttgggtgttggtgttcataaccacaaagggacctgctgagagagagagagaatggagaatgccatttttcctacctgttttcatcagccagtacaggagagagaataggggaacttgtggctcattttaaaatggtaccaatgatggcacaggcacaccttttttttttttttttttttttacacattttttagagacggggtatggctctgttggccaggctggagtacagtggtacagtcacagctctctgcagcctcagatcctgagctcaagtgatcctgccacttcagcctcccaagtagctggaactacaggggcacaccaccacgcccagctaatttttgtatttctggtagagatggggtcccactatgttgcccaggctggtcttgaactcctgggcttaactgatcctcctgtcttggcctcccaaagtgctgggattaccggaatgagccaccgtgcccagctgtggcacacttttgttggtgggttagatctggggaaagtagtcacaatcaattgggccagatctgatgagtaaggtggatgacaccccagaggtctgtcattttaggattcagtaaaaataatgtaaattgttgatcctctctggaggcacttccaaaggaagagtgggagcatctttggctgccaggtggcttgaaagaacagtttgctgtatggatgcttttgtaattattaataaaacacacctaatttcattacttcattatactctgttagctacaatatagatttgtttgctctaatagaaccccccaaaatgttattcagcatgccagaagtttccatacctctgatgtggaagtccaagctggcacagggacactcctccccaaaggggtcagagacctaggctctgtcttattctatcatactcaacacgtggcttccatttcatgatctaagacagctgctgcagttcctgcaatcaccttcacatccctgctcataggaagaagaaaagggagttcaggcccttctctttaaaggccattctgtggacgttgcatctgtcacttttcacatcccagtagccggaacttggtcatagaatcacacctagcttcaaaagactctggaaaatgtaatctttagctgggcagccagctaaaaatattattaccatagaagatgggggagtagatattggaaaacagtgaagagcatctgccatacttatgtataaaaaaagtaaaactagtaaaaacatatcacatgaaccttcagattttttaaaaatctcagatgttagaataatttgatttttctttcagaataatgatacactggcaattaatgttccacattaacattgcaaatgtaaaactttgaaagacccatgtagcttatggtataactattaagaaatccatgatgaggcagggtacagtggctcacatctgtgatttcagcactttgggaggccgaagtgggcagatctcttgagcccaggagttcgggaccagcctgggcaacatggcgaaaccccatctctataaaaaataaaaaaattagccaggcatgttggcacatgcctgtggtcccagctactcgggaggctgagatgggaggattgcttgagcctgggaggttgaggctgtggagagccgtgttcatgccactgcactccaacctgggcaacagaatgagaccctgtctcgaaaaattcatgatggagaaaagggagagtttttcacatagttgagagtatgaaagcatgttgagtataaattttgttattttgtgaaatgctccaaaattaagaccgaacaagacagaacaagaagatacccaactgtttatggttagcatttgaagttggttcaccctctgcttttgattcatgttttgaccagtgtaaattgagaaaggatatatttcataatatgagattatgctagtttgaagttacattgaacactgaggcctaaccctacctcaaggtcaggtgcagtgtagtgatctaaaaagaatggaggctgggcatggtggcttacgcctgcagtcccagcactttgggaggctgaggtgggcagattgcttgagcccaggagttcgaccagcctgggcaagatggtgacatcctgcctctacaaaaaaaaaaatacgaaaattagccaggcatggtggtgcatgcctgtggtcccagctgctcaggaggctaaagtgggaggatcacttgagcccaggaggtcgaggctgcagtgaaccaaggttgtgacactgcactgcagcctgggcaacaaagtgagatcctgtctcagatagatagatagacagacagacagacagggaagactgggacgtgctataattgtcttgaactgtttattcaaggtaatatctaatatcttcctatgttctaattataagcatatggctctcagctacacaaacttttgattacaaatatttaatacttttcatctaaataaaaggtaactaaagtatatgctgtattttcctcacactgacataagatggattcagtgattttgcagatgtcaagtggagttttcttcaggccaagatacggaaacaaaataaacaaactggaaatttgtaattttcttcctatagtaaccatatggggagtcatttttaaatagccaagattgtatcaagtgcagaaggcgatgattatcctagtggcacttgtaaaatgaagtgacagtttcttacaatgttccaaccttccactgaggaaaagtaggaattcctgccctccctaagctaagtgccccaactatttctttcattgcctgagcagttctctcttttgccttcacattattggctctctatttagattaacattttaattttttttttcaaatttgaaaaaatactgacctttttccagttgtatctatcaaaaggattgcttcaaaagcatcttgttccctagtcttttaccaaattattctaggcacaaacctcatattaacatcaaaatcataaagaacaaaagtaatggaggaggtcagatgatttggggtgttaaagcaagtttctgcagttgggttttagatgctattaaagcattctgtgtatgaagtgctttaaacagtaacaacaatttcatcttttattggttcagcatctcttggctgtctgaactatagagattttgcagcagtggaatatacatccgtagagaaactacacaaaaattgtactttctttagcagtgtttttggaattgaattttagaaatagaagttaatattttggattttattcttggattcactatagattaagcctattcactatagatttggtaagtttgttcacctttgtcttggcctcagttttctgttctatgaaaagaaaatagtggtaggacaaaggaaataacgccctatgtggttggagcctggggaagggcgtctggtggtaataatgtcttaaatgtcacaaatttgtgacagtatttcaggtcagccaggagattggttattggtgagtggagttcacatttgccttaccttgaaatgttttccaacactttggtagcaaactacatcctcagtgtgaagggaaatgtgtaacagtttttctttgggaaatatttttattgacttagctccattttgtgagtcacatattccagcttatagcagagcctgctgcagttagtttgccaggcaaatacccaataagatcacagagctcaagcttgtattatgtaaacctcttggtgtgttattttatttcaggagggcttgagacagactgatgagctgttacatgatcgtggaaacagagcctagttttagaagtaaatttagtttgaaaagtaattgtaaaggccaaaattgatagacctttcatggtctgtgtagctgcctttccaatatgatggtcactagctgtttaaattgaaattagttacaattaagttaaactcagttctttaaccgcagtaactacatttaaaatcttcagtggtggcatgtggcttgagactactatgttggacgacaaaatacagtatatttccatcatcaccaaaatttccttgctggacagcatttgtctgtagccacctaagaaagaattatggtatagcaaggaggaggtttgagatggaagttaagagatgactctattctaatttgggcccttaaaagttctgtgaccatatatctgaaccactctaggcctcagtgcacacatcagtactgcagtgacttctgtatacttttgtatatttatattgcaatgctaacatgaagatcggatatactagtatcattttatggtttagagagtggactttggagtcagactgccagatttaaaataccagttacttctaaattaatgtctgggccttgattttctgatctgaaaaactggagcaataaaatacctcctttgcatgattgagtgttaaatagtttcatacatgtgaagtgcatagaacaattcctggcccatggaaaatagtgttttaactattatgtatatcatccattgaagagtataaggtgctatcaaaagcttttgttacaaatgctgttttcagtttgccgttactttctgggtctttgaacctccttgtaacatgttatataggaatgtaaatgtgccacatggtagcttcttaatgcttagttgtcctgcataaattaatcccctttagaaagtaaattacttacaatttagaatggcatactcatggtctgttctttaatccacctgtataattggttcttctccaaagatattaacaagcttgacgtcgatgctgagaaattctagagcagaagagcagactctcccttcactgttatttgtgttcctctctctccaattccttagattgtaggacgaagtaaatcacaagggccagtgtcttgtttagaaaggttttgtcataccgcacaggcggcctgcatccgttttcagtggggtggtttaacttgatgaggctaatgccaagatacagtactcagagtccaccgtgtttgacatagtcatcaacggtcttccttttggacttctttttggatgaggggaaatgtgcattcgcccagtggctctcaccctgactgtacagtggagtcacctagagagctttaaaaatgccgatgcctggccccactcacagaggttctgatgtaattgtgcagggtgctgactgggcttggggatttttaaaagcttcccaaatgattctgatgtgcagccagggttgagaagtgctaggatggcctgcactgagtgatatggaaaggatactttttgaaatatggcccaaacattgccggttaagggggagccacaccaccctccagggtggaggtagctggtggcttttctccgggtcttgtccagttccacagttttatcagtaataggaatcagtgcaaagtatactgatcagacccatggataacgcggttcacctgaaaggggagactagctgttaggttacaggtgccaaaggccttattgacgggtaggagggaaagatgagtgaatctaaggggaaggcaaaccttttagttactttaaataaaaccaactgagcaggtataggatacagaaagcttagctcaacagctgcatggaagttttggttgactgacagctgcagtagttaagagtgtatacttagaaaccagtcctgtgtttgaatctggctttactgtttcctcctgggggatctggagcatgttccttaacctttctgagcttcggcctcctcttctatttagtgggaataagaaaaggcacccacttaatttcattattatgataattaaatgagatgatttatgaaaactgtgactataatacctggcccatagtcagtaccatgattataaataataagggcatgattagcatcatgttgatcttcgtcatcatccttgtaataagcctgtctgaagagcctgtggcatcagcaacgacataaattgaaatatctggcatggagcatcttcattgttcaaatataccatactaatgtaagatattaacaatatggctgagcacggtggctcacacctgtaatcccagcactttgggaggcctaggtgggcaggcggattacttgaggacaggagtttgagaccagccttgccaacatggtgaagccctctctctactaaaaatacaaaaattagctgggtatggtggtgcacacctgtaatcccagctactcaggaggcagaggcacaagaatcacttgaacctgggagatggaggttgtagtgagttaagatcatgccactgcactccagcctgggcaacagagtgagactgtctccaaaaaaaaaaaaaaaaaaaaaaggatatgaacaatagggcagattagatgtgaggtatgttatgaacaatagggcagactgggtgtgaggtatgtgggaaccctctgtaccatctttgcaataattctgtaaatctaaaaatgctttaaaggttaaaaatgttattgccaatgtagtacttggcttaagtgggaatataatatttttttgttcattttccaacaaatatttgtgtgctagctttgtgttcagtaaatctgaagtttagccctcacatgaagaacgaaaatgtttttgtgttaagtatttctgaggcagacgtttctaagatatgtatctccatatgcatgctgaaccaaatttgatccatttaaaatttctttattttgaaataattttggatacagaaaagttataaaaatagtacaaagtttctgttaaaccgttcaccaagcttcccctaaccttaacaacttacataatcttagtacaactgtcaaaactgggaaattgacactgataaaatgccagtaactatagcatttacttggatttccccagtttttctctttgctgtggcaggatccaattcaggatctcacatggcattgagttgtcccatctccttagtttcctccaacttgtgatagttcctaagtttttccttgtctttcgactttgactcttgaagagtacgagtcaggtattttgtagcatgtccctcaatttggatttgtctgacattttctcatgagtacattaaggttgtacatttgaggcaaaaatgccacagatgggatgttgtaccctttgcagtgtgtcatataagggggcacatgatgccaatatatctcactgctggtgatattaatcctgatcatttggttaaggggggcatctgcaggttttgatcaattttttttaagacaatgttttcagaatagtttcaggttcacagcaaaattaaaagcaaggtacagagatttcctatatactcactgccctcacacatgcattgcctcccccaagttttaatgtattttttataagtatctttgataatagataccactcatgtgccatatcacaatataagagtgagatgggaggaattatgccaacacattaagtggtttcaaatagctgtgcttttgactttttacatgtaatttccataattttctctctttaatctcatttgtgctctcagtaatgacttctccctattttcagagttgtgccaccagtagcaattgataaagcggagaagctgttataattgtgtgtaaagtaaaagtgaataggctataaatcaagacttgagagagtcctctggaaataaaatacattaataggtgttatttgaagcatttttttctgccaattttaagaacgaagtgcaatcttcaatagtccattttaacattaaacaaacctggatttgaatctataagtttgtttttgtttttttagagacagagtttcgctcttgttgcccaggctggagtacaatggtgtgatctcggctcactgcaacctccgcctcccgggttcaagtgattctcctgcctcactgggattacaggcatgcaccactacacttggctaattttgtatttttagtagagacggggtttcaccatgttggtcaggctggtctcgaactcctgacctcaagtgatccacccacctcggcctcccaaagtgctgggattacaggcgtgagccactgtgcccagccgaatttaactataactttaaatggttaagagtaatttgtaaagtcagacgaacctgggtttaaatcctggtattacccctcactagcaaattatttagcttttccaagccacagtctctacaaccaaaaaaccatctcttgggttgtcataaagagtaaatgaaaagatgtagggaatgtgctaggcactgtgtcagtacatgggaagtacccaatcaatgtcagttgctgtctttgatattatcccccatagggcttttgtggtcgcttaagagttgacagagcacaaaaggataaataattagctttacaccctaattaatctgtaattgtgctgtaggactaccaggagacacagaaacagaaaaagcatagagactattttgtatatttattccatcatatttatgtgtagttgagatcattctaaagttagtggtcttgcttttatgaccatcattcctgaatcaatctggagatgaccggagaacacaagagcattttgccccataactaccacataatttactagtaaaagagggatctgttgagattagcttatgaaaattgtcctttggagtcaagtttgggaatatctgatcattaaaaagagtttatgaacttgggtgatttttccttcccaataattctttgaagtactagatatttctaatgaatttgagcctaaaatatgaagatcatataggctagacatttcttttaaaacccataaaaatcctatatttgctctatgtctagaaaggtaaggtctagttaggttgtggtttgaaagatatgagttacaacatgagtgatatagagtacatccattgagtttaaaatttcatctaatcacaattatttcaaactgataatcttttaacagcctagctctatgggtagccgttaaagaaaaaatgtatcaaatctccaatacttagtgaccagtagagtcaaattcagctatcctccccacccccttcccccaatagggacatggtgtcctagaaacagccagacctatactggattccattttagtgctgagcctccaaaatgggtctttagaattaaatttggctattagcccagacttactcaaatttgtaacaagcagtgctttgtatttcagcatgctccctagcccccaactttgtaactggttaggggaggggaagtgggaggaggtgcatgaacaaaaaacaaaagcagctgctggagagaaaacccagtgaaagggggtgaagaaaaacaattcggccacaacagctgttcagattctcaaaagaagaagccttcactttacatttgatctctctaaagtttttgaaggtttcgagatgttctttatttggggagaaatgaaatgaagtctatgaagctggtggattaatgtataaatgaaattgatttaggagaccagtgactcttgaattaacacagcccttgcctctttttacaattctgaactattgtttaatattcagcatcaagatggattcagagggtttttttttttaatcccattgtgtcacgaatggaggatataactggctcagaccaaatcttctcacatccaagatcaaataggggtttttaagcttatggcagtagaataacaagtacatgtggtacaaggctaggaaactgggaaggcaggcagcagtagaaccttgatctatcttgtgggaagctcttatgatagctaattacacatattgctggtctaaaaaatcagaattacccaggcaacatggaagaggcagaatggttggctggactagaaaactccttcttggaggcggtcatcttcatgttgtactagaaaactccttcttggaggcggtcatcttcatgttgtacagatggcctacgtatgtgcaatatttacatcattgcgtttcttagcaccacgggcgagtttggcattttacaaggtagctcactctgaaaggtaattttatcatagtatttaggaaatattccacgtcagccactgagtttaagaaactgtgtgaagaactaaaattcttcatagagccacatttgagtatggaatgatttggtatgctggaggccatagcacatctttgaacatcaaataattggattttttgagcatcaaataattgaatttttcttttcttttcttttcttttttttttttttttgagacagggcctcactctgctgcccagtctgaagtgcagtagcatgatcacagctcacggcagtcttgacctcctgggctcaaacgatcctcttaccttagtctctcgagtagctgggactacaggcgtgcaccaccatgcctggctaattttttaattgtagagatgaggtctcgccatgttgcccaggctggtctcaaactcctgggctcaagcaatcctcctgccttggcctctcaaagtactgagattataggtgcgagccaccacatctggcgtgatttttcttgaaggcagatgtgggcctgaactggaggaagcctgctctgagcctcactctatcttgatcccagaaataaatttattgtatagccttaagttttagagagttcaggacacctagaggatggttgtggtgtaaactgcttgcctggtcaaaccttaaggatctgcttggactcttcaggacacataccccgagagtgtcaggcctgagccccagctggtcccagaggtttaattcctagcacacctagtttgtctaacgtaggggtctgcaaactgtgtctgcaaagagccagatagtgaatatctgttgcaagtaaacggtgttgtcgtagtacaaaagcagcactagatgatacggaagtgaatgggtgtggggctctgtgtcgatataatttgatttgtgctatagtttgctaacccctgatctggagagagggctcccaaacaagtgagtccacatgcctccaacaggactgtgggggatagaactcaggagggattgggataggaaaaaaaatctatctgtattgtcactaacctctaactgaaacagcgtttgttctcttacgaatacaggcagcaaaccagtgacttagcaatacttgtgactttggtcattaatagaaatcaaaggtaatttcatatcccattacagttattgcaggtatctcaaaatatcattaaactcatcactactttggaagtgtatgttatacctccactagcattaacagaacatatgtattctacatttatataaaattaaatgattacatatatttattatatattatgtatttcaaacttgttttttattttgatgtatttcaatttagttttctttctaatgctatgtatattttttcgtgcatttaagaacattgttctgtaaaggagatctggagggttcagctgactgcccagggagtctaagaagccctgtctaactggtgtcttcataatggggagaacctccccttcctcaaatgatcctatccctctcctcccagccactgaggggcagtcatctctagctctacggagatgcccccaccccattttcccatatcatattccacccagccttcaaagccctgcatgagtccacctagtcctttgttcctctggctccaccaccctggctgccagacacaggcattcacccccggcccgtctcatggggtgttctatttgtttagtttatgtttcagccctagtgagagtcagttctggaatccaatggatctgtgattccttgttggaaggaaccacttctcttgcgctgagtaacgcattggtgttggatgacggtgttcatgatgacgaacttatgctgtcctgaccatgcctggagactggccctgcattggagaagatccaagagtctgcgtggtaaaatgataatgaacgtgagcttaggggcagaatgctgatgtgtttattctgctaactatgtgctttgggcaagtgcctatacttattctccctgagcttcaatttcctcattggtaaattggggattatacttacctttcaggatgacatcaagagtaaataatatactgactctaagaaaagtgcctggagtggtgcctggtgcatggcaaatgctcagtacctgtgaggtagtatttgcctgggctggttgatggttgggcgctgggggttagcctggtataaatcgagattttgaggtggtcctgtgaacccaaagatgccttgagaccctgcgtgggagacagatggaaggagatgtctaagcctggtgtcaaggtgctctcaccttgcagaatcacagtgggctgtggtggaccaggagaagaccccttaacaaagtatgggagtgagtctgtctaagtcagctagcccttaatgaggtcctcctcgagtgaagctctgattctgacacccatgttaggttgtggtcatttctaggacccagggtccagccccagagattcctagatagttctaggaccatctggtggaatcaaactatggatagacccattaatatccaactgggtcctctttcgttgagtctcccgccctcttgagggagactgatctttagtaacttctttatgagactgggtcaggtgggcctcctgttgttgtctgtggtgctgcaggtcatgtgctttggtgggcaccagtaactgtcattggaattgccaaggtggtgggaataaagagagatgggcttctctgtgattgaattgaagtttggttgtgagtgtgggtcatgagccctgaccgggtaggagacagaagcctgtggttcttctcctggtttccttagggattttcagctggctcttgggcagctccttcaggtggtagctgttgtggcagaatagaagagtgctggactgaggagcagagacctgggtctcatgagatcatgagatcaaaccacttaaactctgtgtgcttaagtgacttcgttggcaatagagtaataccctccctgaagaataaatgaggcgatgttgagaaagcattttatgagcaagccattttcattaatgcaatgggggaaacatgctatgtctagcttagagggctgaaacggtcaaatgaaataatcaacgtaaatgctaaaaaaaaaaaatccagtccacatttatggaattgcctttattgacaaattgagcgagggtaaacattcgtgtatttaaggcatggagtgtttcccagttgcttttgaaggtacccattgtcacaaaggagtaaagaccttactaaatgggatcttatttgtatttctgtagcaaaggatttttgttaaagaagattcaaactcagagatggtagactgagtctgccaggaaaaccacacacttatactcctgttccatagtcaactaatattctgcttctgctacaaacttaatgatcatataggaattatgaatttagaccaacaaatgccaaaacttgaactatacaagtgtatagttttagtgtaactttgtgttgtcactttttgcttctatgtgacacttagcaattctttttttaaaataaaacaacattagaggtcatttaattgtaatgacaaataaaatcagcaggtagacttaggatttcaaagcatctctttcttggttgggaaagctccctggaggtccaacttgtagtcctaggttgagtagggatcaataggagaatttactgaaggggccctatgctcagtttcaccaagttcacagccaggttcttatgatctgcatccttcaggtacaagtgtgtgttctctactccagtagcagacttgaacccagagtccccagtacaaggaagcacatatttttggattttgccgtgtgaccttgtctggctggctggactttaggaacaactggtcctcatccctggcaggtttagggggagagtgaaaccaagtcagatgactctgaagctccttcaaacaccacgacagaaggaatggattgagcaagaataatttttatagacttggaagtttgagtcctttttttttaaaaaaaaaaacaaggaagtggggcattccagatggtaacacaagaaaccagggagatgagagcagatgaaaccttgagggagaaaatgaaattctctctgaattaggagaagcggctgctttccctcacatcttcctgtgtctgtaactagcttagtgtttgggatgcttattttctattttctctgcatttttttagctgcctcagtgaccacttgaccatttatgccgaggcagtagtggatgtttccaattcagtgctccttacctcttagaaagagaaggattatgctttcttcatgattgtgagtcagtctatgttcagatttacattcaactaatatttttcaaatattggcccagataatttcaagatatgctatctgatcctcaaaacaatcttataaatgaggctcagagaggcaaagggacattgcaagtcatacaggggtttgcatatagcctcctctctgtaagtctagaaccatctctgcagcttcctcctgcgttcaccatgttgtgtgacttttgtaaatacttgaactctatggaaactcaggaatgatgtgaaatgttattagttggaagccttgtcagagaaaaatgggctagagagttccgtttgcaggcttgagactatagttgatgggtctgattctgaattaaaacatcctttagaaaatagatcccgctttttttagagactatccaagatttaaaagttaagcagctttggaatatagcaggcagatagttctcctgtaatgcttgctttgaaaccatgaacaatgtgtgcataatcagaatcttggatttgcttaataccattttttcttgctgaaacattaggtgaatgcagaaaactgcgcccacctgaactacatgacgtcagaatacacaaaacacgcacgtggcacaacctcatatgtctacagctacctcagtttaccccgcgtgttaagagccacacctgtccatacctggtgttatgactgtccctccaatttcgggtaaccctccctccagcccttcccagtaactcaccaaccgcagcccttccgacacccaccccacagccaacttcaggcctttttctaggcgaagtgacacatttattgttgtgtttatgtatttcttaactatttaatgtgtgtaaaatggtgctactatttttattaggttgcaatctttttgtaaatgtcactgattaaatttttgagtgttgctttcctaaccccatttttcccataagccctgtgttttttattgtgcattttgcaaagagtgatgatttttaggaccacctatgaggcattaccgaacaagtgactgtgtgaagcttttggactaaaccttccatctaacttcactctattaaatgagttattttcaggataagacagtctcatctatttacaaatactttatcatataatgaagttctacttatgatttattcagaatccacacaagaaggcgtagatttgctcaaggaacaaaattaatgacattttaaaatcttacaactggagaggatgattaatgggaaaagagctaacatttcatgaaaactagctttatgccaggtcctgttggatgccttccaataatgactgcatttcattctcatgtcaacctgttcgggtggtagggaattttggcatggagagagtgaaagttgctcaatgtccgtacagctcctaagtgactgggctgcgagtcaccactgaggagcagcccatctggaggtatgatcacagcaacatgggctccagactgttcttggtccttgttgttcatcgtctttcccattccatacttgcgtgtttctgtcttctgacacaaatagactactagtgggttcctgtgggttgctgctgacaatccatccatttacccaggctacatttttgtatccatttttttcaaccttttaattttttatcaccccacaacctgggagactttttaagcattttttttcctaattgcctccctatgcaatcttttttttttttttttttttttttttgagacagagtctcgctctgtcatccaggctggagtggcaccatctcggctcactgcaacctctacctcttgggttcaagtgattctcctgtctcagcctcctgagtagctgggattacaggcgcccaccaccacgcatggctaatttttgtatttttagtagagatggggtttcaccatgttggtcaggctggtcttgaactcctgagctcaagtgatctgcccacctcagcctcccaaagagctgggattacaggcatgagccaccatgcccagcccctatgcagtcttaacaccccagatacactgcatatctgtctatgtgctgtgtgtatatttgtgctttatatgcattaaagagtaaagttgtttttgcccctcaagaagtcattttcatcctattggggtgatcttgcctgtgttgaaaaggcatgttctgtatcttcagttatttttaatatgtagatccgcttttaaaattagtatcatgctaccttagaagcatatacctgagtttgtgaagacaagcccccttgtctgggctgtgattcctagtatcttatgatgagcccgacaggatgacacagccaggtgactcacatagagctaagctctgtgagaaagcgaggcctcagaggtagcacatgatttcccttcttccagtttctctatataaagaaataaagagcacacatcaaaccaaacataaatggaaagaaatcaatggttgaatgacacatgattctggcttgtcagccctagttggcacctttcgctccaaatcatcatctttctaagatactaaattatagattccaaccaaggtgattagtgctgctcacactttaatgtgcattggcatcacccatgaatcttgttaaattgcagattctcattcaagtaggcctgggattctgcatttctgacaaactcccaggtaatacagccactgcttggtcccagaaccatactttgagcagcagtagcctaagaatacacagaggcaattaaaactagctctcaaactattttaagaatttcagaaagccgaaagcagtggttctcactcagaagcgatttgttccccaggggccatttggcaatgtcttgcagacatttttggtcgttataactagaggatgctactgacatctagtgggtggaggccagggatgctgctaaatagtctacaattcacaggacagcccccatcagaaagaattatctggcccagaatatccattgtgctgaggttggaaacccttgcctaaaggaaatcacacacttactcccagtaaagcagcatggacaaatacagataccctctctccttggcaagagtgatattcaattcaatgtgatagccccaaatagtttgtagtggtcaagctctgcagttgacattaatagattactctaactgatatggggaagtaagttaattgtaatataaagaaatgcagttaagcagattaaaaggaaaacacttttggagtcatgagctgtcagaggagatttacatgtagcaaaggagaccctgctggttgaaggatgggaatgcctgtcccttattgggcaggaattgggtgggctgaccaggctgtgtacgcctggctggcactgtttattggagtggtgttcgagcgagcccatctggacatttttggaacaaacttgggacattcctttggccttctgaatatgacttgcagctgggtagggaagtagtgcaatattatccacagattgaagattctttcaaacaacagaaataatcaagaattcactgtggaggattttcccctccagagagtaacagatagattgatgcgtagatctaggtatgcttattaacaaaccattcctgtttcatgggatgtacatgtggcagcatctggattatttaatgtgttaatatagtcagtttgtatatgaataatttaaaacagtagcaagagataaaagtagctcatctgaagaagggttgtttgagagctttttttctgtcaagtataattttactctcaggttaaatgaaatttattaagatgcaatttgctcctgggaggtatttgtgagtttaaccacagtctgtcttggaagatattatgacagtaagtaaatgtcacctggataatactgatccattcacagaagggagaaaaagtgtgttgggtcaattaaggtggtttaaaaatgtgttgactctgaagaagaaaagtatctaaagtacacaactctaacaaatctcaaggccagtgggactttacagactgagcccaattgtgttgagtctgtgtattgtatatacttaacacaagcaaacacagactttttctacaaatgaaaacatgtctgctgagcagttgactcagtcatctggaataaatgttctttatttgtgtttccatgggtaaaatcaagttaatgaactgaaccatcacaatttctcttatttaatttttaaaactctagattaccctgtcttctatctctatgtaattcctgtgttagagcaaacataggaaattgtcaatatggcagagtgcggtggctcatgcctgtaatcccagcactttgggaggccgaggcaggtggatcacctgaggtcaggagttcgagaccagcctggctagcatggtgaaaccccgtctctactaaaaatacaaaaattagctgggtgtggtggcacacacctgtagtctcagctacttgggaggctgaggcaggaaaatcacttgaacctgggaggcagaggatgcagtgagccgagatcacaccactgtgcactccagcctgggcgacagagcaagactctgtctcaatttgaaaaaaaagagagaaattgtcaatatggggccatgttttacctacaaaactagcaatttcatgttgttctgtctaatattacttaggaacattttaattcttgcattaaaaagtagcttttataagcatgagggttaatatctaggcataatgtgttttctgaacagctggctctgtttttcgtctctgtgcaggatatgatttcacaccagtaacccttcaacttggggtgacacctttcataggagtcatggtagttctttctgttatttttctagccatatggaggtctcatttctcttaattcttaaaatgatggactacctgtcttctagctgtatattatttacttttttgttcataagcaccatacttaagatttttttcttttatttttaaggagaaaaaaaggctgcagtgagctatgattatgacactacactcacccaggatggagtgcagtgtcatgatcatagctcactgcagcctcgacctcctgggctcaagagatcctcctgcctcagcctcccaaatagctgggactacaagtgtatgccaccacacacggttaattaaaaaaaaaaaaaaaaagtttttctagcaacagtgtctcactatgttgcccaggctggttttgaactcctgggctcaagtggtcctcccatctgggcctcgcaaaatgttggcattacaggagtgagccaccatgcccagtcccatatttaagatttttctaaagccctaattttaagattttcaaaaatgctaattgtatcctactgtttctgccccaagaaccagacacctagatctcaagatatggacaggtatttattggaaagaaatgaggattttgaggtcatagaagtgtctaaaacatcaagatttattaaaatgattttttacagctgatgttctaacattcattattgtttcctatgatagagatacaaattgagtcacttttcaaacatactttactgttgaatacctataaaaatctcatggaactagcagtccttagtatacagtcaggaaaattctgttttacactagtcactttccagaaaggtttattaataactggctatataattctttccccagaatatgttgttctttgtggattttttcaccccccacccccagcttttggtctattccaaaatacacacgggcttgacctaagaattttgctaaaggaattattctcctctagggaaatgaagcagcatgtttcaacacaagcttagaaatcttaaaacaactaaaaatgaaaaaaaaaagtaccaggtcgttattatgttctgcaaaaattagatttacgggttttactgtagccattgtcaatgccttactgagggataggatcatagcagaaagatgctaaggagcttatggtccccctgggctgttgtgattatgtggatatatttagaagctacaaagaaagcagagcatcagctgagatgccccagtagacactctcaaattcagatctctcccattatgagaaaaaccctcaaaagaaaatattcacttggcaaggaatgaagagcttttttactcaccaaaatgatgtcgtaatgtttcagggagaacagtgactgcgacttacttattattgtcatttatatctcctagggctgaacagttgtcagagaggataagagatagggggagtgtatgggaggcctgctttggttctctgcttatataaacctccacattttagcagatttatgtttcatccttaaaatgagttaaaaacagcagacccttttgttgcagatgcaagatataacatgtaaagtggttccatagcaaattgctatttagaaaagaacccaacgttatttttaaccaactgtttgatctcctgtattctttcttatgtggttttatgaatttttgtttcacttgtaaataatcggtagcaaatgagtgtgtgaggctatgatttaatttgtaacaaggtacaataaaatacctcagcctgtgactcaactattttaagaggacaaatatgctaaataggaatattcgtttctaaccctatagtaaatgaaatgtacctaagatccatggctgaaaaaacctgccttatacaaattcacataagagagatcaaatgtggtgaaggttgcttgataaacttctattgtctagcttgtctgatgagctagatttcacagtattatgtccagatttaccacaataatactgcatagtttttttcaagtcttcgatctaagaggttctagtttgaagaggaggggttctgtgtcattcatacagtggctgtgatgcacatccgtttgatctgtgggctcatttaaaggcttagtggactgaaatgttttggggtcacctggaggggatcagtgtgtctgggctttgcttccctgtcttccttacgtatgtggaaacggtgagtgttgttccctgagatgtcctagagagacaaccttttcccaagtgacagtgagtttccgtcttggaatcagctttgcttatcccagggaggatccaggcctggcgccagcaagttctccccatgaggtctctgaggatgtggagagaaggaatgccctgcagagtttcagcctgttactctaaacctccaggcatgtttaagaccccttgggagaagaggagggagacctccatccgtttacaacatctctgcacagaaggcaaattctcttctcttgcatagtaccctaatggcaaaggcatacatgcaccaggctcaattacttttagtgaagaaaataaaccagatctgtggaaggcttcccttcagtgacttggggaactctagtttatgagtgaaagtaaagatacgagctagtaggtgacttttggtgtatgagcccttatttgtggggtattaaaaaccatgggctatccagtaactcagtaactcaggacacacacagcattttgtggtccctgatgtctttcttcgttttggctgctgctttggccattcagtcaaatttgaccattggttttcattaagattggccctcagatacagagcagggaaaagaaatgaaatttaagcttgtacatgatataaattgtcatcaactccattaatgtgttggtcagagagaaggcggaagccaatatttgacaggaagcatgtttttttttttttgtagattcagtgtgaccaccacaccgtctcgtgcttgtaggtaatttaatttaacctaggaggaaaatctagtcatttgagaaactaagataattaattatatgcttttaagatggagttcttagatgtgagatcttggagatccctgagaccatgtttaagaaatgctacatttgtactgaaaatctttgacttgatattaagttatgataaacacaactgccaattcaggtatgtaatttagggatgaaatctgatcataaaatggccgtctagatcagagtttggcaaagcatgacccatggaccaaatctggcccgctgtttttgaacagctcacaagctaacaatggtttttaaatgtttattatgtatttgtttttgagtcatggtcttgctcaagtcacccaggatggggtacaatggtgcaatcatagctcactgtaaccttcaacttctgggctcaagcaatcccaagtagctgggactgcaggtatgcaccaccatacccggtgaaggtattttatttttgtagagacatgggatcttgcccaggctggtcttgaattcctgacctcagtactcctgcctcggcctcccaaagtgctgagattacaggtaaagattttgttatttgcaaagagcttttcagaggagggactaaaatgataattcaccctgtatttactgggtaaacagtattaagaccccagattttgccagtagcagtggcatgtgcctgtagtcccagctactttgggaggccaagacaggagaatcacttgagcccaggagtttgaatccagcctgggtgacagtgagaccccatctattaaaacaaaacaaaaaacagattttgtctgaagaagtgagtattcttggacttctcaaaatgtcagtttggagacagttttggtaggccacttggtatataagcatggacagaaattgattgtgtgtgttgtattaggttggtgcaaaagtaattgtggcttttaccattaaaagtaatggcaaaacccgcaaatattatgatctatgttagtccatgtgagagcatatttatggagaatactgacatgatttgtcaagttagtagacaaataatgactgaacactcaaaggcaacatgattatcctccagctgtgcctaggagattcttgataccattttactatgtcaatattcagctacgtggacaaccgctattgttttgaacgctcgcttttccttgagaaagggatttccagaaaaagaaattctgtcatagcaccaagagctatgctggacaggaggttcaaatgttcatttttctggccctgaaatgaaatgcttcttaggtacacaatttgctgtccaggtctagagccgagcccagcaagaaacatgcccagtgcatggtaggcagaattttctgcctgtggactttcacaaggctgcattgtgggaacagaagctgctcagattgttcattgttctgtgactcctatttggcagccagtggagaattcattatgcagtgactggcatacttttcttctgttttttccctgccctgagtacagcagtgcatccgtgctctctgtaaccccttgcttcaccccttactgttctaatcttcccctccttgccttcctccagcctcactgctttgcaaaacctagagacaagcagacttaaatcatatgaactgattaggggatcaatttcccccaatgctgaggaaacacactttgttctcacatttgggtgggtgagcctgccaccaaatattaaacacccacggacacatagcagtgcgtcggttccccttttggggactgcaagctcagacaaatgtccacaatggcgaacatgccacatttctccctctgtgtttccgcccccaaaagtgtggcctcctgggctgagaggaagaaaattgagaagcagctctttcaaaattaccatttgcagggtttgttgttgttgttgttgttgtttggtttttttttggtttctatctgacttgctttgtaaagctggaagaaaagattagcatgactccgaaagcactattttttatgaattccagagcagcagttctcaacctttaaaatgtatttgaatcacctgggggtctggttaatatgcagattctgatttgttgggtctggggtggggccagatttctaatgaccttccgggtaatgctgagactactgggccatggaccaccacatttgaatagcaagtattaggttggtgcaaaaataattgtggtttttgcccttttttttgaaagtaatggcaaaaactgaaattacttttgcatcaatctaaacactagttcagtggctctcaaccttggctgcacgttgggatcacctggggagctttaaaaactactgatgccagagccccaccctcagagattctggtttaactggtctggagtgtgatctgagcctagggagttttttaaacgcctcagatggtctcaatatgcaccattgtggttatattgcagctttacaggtgtaagaatcggatttgttctcttaaaagggaagataagtcttctttttggtcctaggtcaatctgagctgagttcttcagcccttgaagaaagagcatccttctaactcaccagttctcaaccaggggacatctggcagatgcgtttggttgtcacaactggagttgggggtgctactggaattaagtggatagagtccaggggtgctactaaacatcctacagtgcaacagctccccacagcaaagaatgaaagggccccaagtatcgatggtgctgagacagaaaccctggtatagcttacctcactcctgccctcaaaaggctgggaagttcaacacttccttcttcaatgactattgagagtaactaactaatagtgttacaacaaaggggtcccaatccagatcccaagagagggttcttggatctcatgcaagaaagaattcagggcgagtccatagagtaaagtgaaagcaagtttattaagaaagtgaaggaataaaagaatggctactccatagagccattttatggttgtttcttgattacatgctaaacaaggagtggattattcatgcctcccctttctagaccatatagggtaactttctgacgttgccatggtatttgtaaactgtcatggcgctggtgggagtgtagcagtgaggacaaccagaggtcactctcatcaccgtcttggttttggtgagttttagccagcttctttactgcaacctgttttatcagcaaggtctttatgacctgtatcttgtgccgacctcgtatctcatcccgtgacatagaatgccttaaccatctgagaatgcagcccagtaggtctcagcctcattttacccagctcctatttaagatggagttgctctggttcacatgcctctgacaatagcacgtagctaatagcatttctttcatgtctaattctgttttacaacacactactgtcgcaagtattctgaactggaaagtcagtcttcctcccctgtaaaattaggctattgaaatacaagcttccaaagtccttttcagttaaaaaaaaaattatgtgattggcagggggaatggggagtagttatttcatggttacagattttctgcttctggtgataaaaaaaaaaaagttctggaaatgggtggtgagagttacataactttgtgaatgtcgttaatgccactgaactgtaaagttcatgttatgtatagtttaccacaattttttttaaaaaaaaccatgattctgagatcattggttgaaccataaaccatatgcttgcctgcatctaatgtgaaaccatccctgctccatgttcttagcatcctaggttcgtttccttcttggcactcaccgtggcttgaaatcacatggatttatgtgattatttgagtatgcctttccccactaaactgtcagcttcatgaaggtaagaaccaagtctgttttattcttcatggtactcccaatgcccagcacagttttcctgggatttagtaggcattccacagatatttgttgggtaggtggttttactactagtacatatgttaacctccctaggaacaggaattagccattatccacacatttgtatttagtatcatctgtctcctagccctttgctactggaggaattgtggaatggagaggttatggctaagtactattttatgatgttattctctgggaattggcttagattagaatcacctggagtagttttataattattaatggccacatcacaaggattcaggttcttcaggttctgttgatctgcggtggggttgggcatcagtagtttataaaggtctccagttaattccaacgtgcatcaagacggaaaaccaccgtgtaactccttgcttctcaaaatgtcccaggacaaaggccccaggtaaattgtttgtatattcaagcctgagaaacctacaggttcctttctagttaaaagcccattgttctagttggcctagagagctgttgactccgcaatgaaggaaagtgttgtatatttctggaggcagagagaggtctgcaatgcaaaaatagtttacagagaaagcggtattgttaccatcagaatcagttgtgattctattttagatcattggcttcagaggaaaaaggcaaaaaaacattttttttctacttcatttctagtcttggtttttcaccaccaaacaaaacaggaaaaaaaagggggtgggggttggtggtggcgagggactgcaggaaccaaatggatagaataaaatagtcttgtctcatgcagaagaaaaataaaagacaagttacatctttttctgctagagaaaagaatgtatttcctgtttgccctcgccgagagcctgggcataatgcggcagtgtgcacagagccgctgaacaaagaatacagaaatggctgagaggacagagtttgaaccgccaaatactggctcagttagaaaccatgtgacagatgcagcttctgatttcatttactagggcgaaacagaaatgtgtaagtgtttctctatatcctcggaggctttgagtgaaagaaaatggaaggtaattaattttcccttccagagttttgcatgtacattggaagatctgttatgattgaaagccttttaaataccaagcttgttaaccaaatggcttctgcaagaaagtgggctttataataagccctggctgcataaagaaatgttcccaaaccatgacgttttccgttggtgtttataacattccatagattatgtgagatgctattcgaatcactgaaaaatagttgggtactgaaagtgtctttagggatcatctaattcagtggttctcaatctgtttttctgtcctcaacacacccatagaatataaaattctgcaattagcgccagctgtatgtctttttaagctgggtgggtcatagcagaatcaggaggggtggagaagagcccattttataacaaaaaatcctcagtagttctgagatgcccatatcccactggttctcaaacttcactgtacattggaatcagctgaggagctttgcaagcgactgctctctgggttccatttgcagaaattctgatttaatttttctagggtgcagcctagtgagagactatgaaactctacccaggtgattctaagtgcagccaactttaagtctaatttccttaaaaaccaccactcttttctccctccattgcaaatggctgtattttgaatacttacagaggggagaggttgtatgtttcctcctgtcccatttatttgcatctttgtctctttgatctggagtccttggtcaggaatccaggctcagttatctaatgtctgtgggaaaacgcagcccacttaattataacttcaaggaggaaagtaagcccaggaggctcaaatctgtgactggtctgtggtaaaaacagactggtgggcttctgagactttcctgtggacgctgttgcctctgcagccactggaagagatgtggtgtcctcttgttaccagtgtgtcttgtgtaatcaagatggtatgccatgctattcactccaacatgcttttctgtatcttcccccaagatgtccctacaggccctcctgaaggagaaacccaaagtgattaacttaactcttccctctttagtcctcatcatttgaggttatcttttgtcattgttaccagcagggaaaacacaaagcatttatcagtggacagattggcatggataggatggcagttaatgtcgttcaaagatgaaggctcgggccaggcacagtgactcacgcctgtaatcccagcactttgggaggccgaggtgggcagatcacttgaggtcaggaattcgagactagcctggccaacatggcaaaaccctacctctactaaaaatacaaaaaaattagctggctatggtggcatgcacttgtagtcccagctactcgggaggctgagggaggagaatcactggaaccctggagacagaggttgcagtgagccatgatcatgctactgcactccagcctgggtgatagagtgagactccatctccaaaacaaaaagatgaaggctgtgttagagggggcatttgtagactggtacccaacatcatacatcaaacactgagaacaagagtttctagatttttttttttttttttttttttagtagtgacttaaggtagagagaggtggcacttaggagatgtcattctctttggtttgatgttgatggtcagtcctgttcagggctggggaagtgaccatgtcagcagaagaacgactgcttagggttttgtggcctcttttcatgtaggctaagagaggaaatgtcttgaaattcgggtatagaggtgtggaatgactgggattatatagggactctatcccttccatgccctgtaatgtccatagtgctgggaacttataaatactgcctttgtgtggaagcgtttttcaggtactcaagtaaagtaactctatcctgatactcacagtactataaacataaagatgaaaaaatgcaggatttaggggaaatgttttcagatttcactggagaaaaatgtagtagcctacaaagatagcaattgagttcctaaaggcatttgggttaaattaatcattgattaaacgtgaaacttcagagagattttgctttctgattcattagcttagatttgaatacatttgcatccctgcatatgtagaaagctaattcagtgaggtctttttgcagcacataatgaaaaaaatgaatgtgttttatgcttaggtgttgtagaatcaggagaaagtggtagataggtcaaaattttatttctgttgctaacttaacatattacaagtatatcgcaaaagcatacgtatacattttgtgcttcttaggcattcgttctttgtgttttagcttaacaaaaagatatgtcagtttttcatttggagccattataacattggaaagcagtaggagtgaaaaactaaaaccactcgaaactcaaacataaaatactatcagacttcctctctaaggcagccttgtttccctggcacgcaccctttgcttctccgctcattcttgcggtcactgactgccttgactgtacttcataggcaccatccatcacgcttgtctgcagcagtgacttaagatggaggggggtgggaccacaagatgcctggcccttggtggggcggggacggggggttgttgttcatacaaaagacctttgcatccttccgaagcgggtggcacctccctgccatcacttgggcatcctccaccagcctctgaagatttcactgaggaggaggggccagaagtagcagggtataggatggaggccagggccacctctaggagtcctggcccgctcaccccaatcagactttacatgccttctttcactattgagaaactgtaagggttaattttggggatgtcatttttgaatgcttctatttgccaggggcaaactgattaaaaggaaaaaaagagagagattgagcttaaacttcctgaacatctatttgaacagctaagaattcctttttctaaggtggcaagtaagataattaatggaatatttggtgcttatgttatctaatatgttagtttgggatgaaataaagtcacaatgaaattttattttttatatgatacctatatactttatagtaaaccaatcctccgtgtatacttgataattttacttatgcacagtttaggactttgtaagaaaagtggtacagatagttgttttcaaatgtcctgttctgggaatgcagagttggggaacaagatgccttcctgtactaagaaattactggatgtctccctcgatgaggtgacatatgaagaatatatagagatgcccaacaaatgttattttctacccctttttctgggtttttcgttttctctcctataaattttgggcaggccgtgtgctctgttgggtcgtgtcatttgagtccatcactacataggaccttctctcaatatttcaaatacttacacaagctagaggttgtatgtttccttctgtcacatttatttgcatctttgtctcttttatctggagtccttggtcaggaacccaggtttaattatctgatgtctatgggaaaactcaacccacttaatgacatgctgcattattttgtagctctcaggggaaaatgtggcaagaaaatggagactgcttattatttcttcttacgccatggttccagaatcttttcatgagagtaaataaaagtgaggtaaaatctgcagaatccttaggttagagagtttgcattatcgattgataggtccttaaaaacattttctctttatttcagaacaatggtttatgacaaccccattcactactcttgaaactgatgaggaacatcagattatgtaatcttgtgcatttggctaagtcagaggaggcctggtgaattcatttgtcattcagagtctagaggaatctaatatttgtttccagataaaaacctgactgagaaagtatatatttctgacatggagaactatgctagatattttatataatatgaactattctagagtattctagaccagcactgtctgatagaaatgtgagccacatatgtaacttttttaaggttagcagcctattgaaaattatttgaatggataaaatcaggtgaaattaactttttaaaatttatttattttttgaaatggagtctcactctgtcgcccaggctggagcgcagtggtgggatctcggctcaccgcaacctctgcctcccgggttcaagccattctcctgtctcagtccccctgagtagctgggattacaggcgtgtgccaccacgcctggctaatttttgtactttttagtagagacagagttttaccatgttggccatgctggtcttgaactcctgaccttgtgatctgcccgccttggcctcccaaagtgctgggattacaggcatgagctaccacgcctggccgtgaaattaatttaacaatatgtttaaaatttttttttttttggtttagagacagggtctcacgctatcgcccaggctggaatgcagtggtgcaatcatagctcactgcagcctcagactcctgagttcaagcgatcctccttagtagctaggactacaggtgtgtaccaccacgcctgactaattttttttttttttttttaagagacgaagtctcgttatgttccccaggctggtgtcaaactcctgggctcaagtgattctcccaccttgacctctccaaagtgctgagattataggcttgtatgccactgtgcctggccctaacaatacatgtcatttaacccagtatttccaaaatgttatttcaacatgtgaccaatataaaaaattactgagttgttttacattatttttgaagtccaatgtaaattttacacttagagcacttctcatttgggattagccccaatcatatgcccactggtgacatgtggccagcggctaccatgttggacaacacagctttggaccttcattcctaaacccaggcactgagagattgataaccaatcaagactcctgctccaatttagaaaggggacttaaacattgagaaaaggagctctctgaaaaaaaaaatatgaaagactccttcaaatagttgatattagaaactaaaccactttccacataaaatctgtgtttttgtctgaagagcgcagtggggaactagcaatttgtaaaatgtttctatgtgaattggaagaacattctgccttcagattgtgcttctggaaaaccagatcaggatgacattgagaggcagatgattgtattgtagcttttaagagaataagctctgtagcttcaatgcctggattcacagccaagctctgctatttaggttggtgcaaaagcatttgcagttttggccattgcttttgatggctaaagccgcaattgcttttgcgccaacctaatacttgctcgctttgtgatctttggcagattcctcttcatgtgtacttttcctcacctgaagactcaggacagtaatagtaactatctcctagggtcatgaggattaaataaactaaaacaaaggcctcagattggtacttagcagtgagctattctattacagcattagctattaaatcatcatcatcgtcactgaaaattgtgctcttatatctcattctttttttttttggtgacagggtcttgctctgtcacccaggccggggtgcagtgatgcaatcatggctcactgcagcctcagtttcctgagttcaagcgatcctccttagtagctaggactacaggtgtgtaccaccacgcctgactaattttttttttttttttttaagagacgaagtctcgttatgttccccaggctggtgtcaaactcctgggctcaagtgattctcccaccttgacctctccaaagtgctgagattataggcttgtatgccactgtgcctggccctaacaatacatgtcatttaacccagtatttccaaaatgttatttcaacatgtgaccaatataaaaaattactgagttgttttacattatttttgaagtccaatgtaaattttacacttagagcacttctcatttgggattagccccaatcatatgcccactggtgacatgtggccagcggctaccatgttggacaacacagctttggaccttcattcctaaacccaggcactgagagattgataaccaatcaagactcctgctccaatttagaaaggggacttaaacattgagaaaaggagctctctgaaaaaaaaaatatgaaagactccttcaaatagttgatattagaaactaaaccactttccacataaaatctgtgtttttgtctgaagagcgcagtggggaactagcaatttgtaaaatgtttctatgtgaattggaagaacattctgccttcagattgtgcttctggaaaaccagatcaggatgacattgagaggcagatgattgtattgtagcttttaagagaataagctctgtagcttcaatgcctggattcacagccaagctctgctatttaggttggtgcaaaagcatttgcagttttggccattgcttttgatggctaaagccgcaattgcttttgcgccaacctaatacttgctcgctttgtgatctttggcagattcctcttcatgtgtacttttcctcacctgaagactcaggacagtaatagtaactatctcctagggtcatgaggattaaataaactaaaacaaaggcctcagattggtacttagcagtgagctattctattacagcattagctattaaatcatcatcatcgtcactgaaaattgtgctcttatatctcattctttttttttttggtgacagggtcttgctctgtcacccaggccggggtgcagtgatgcaatcatggctcactgcagcctcagtttcctgggcccaagcgattctcccacctcagcctcccaagtagctgggactagagacatgcgccaccatgccacgctattttttaaaaatattttgtagagatggggtctcgctgtgttgcccaggctggtctcgagctcctgggctaaagcagtcctcccaccttggccttccaaaatgttgggattacaggcgtgagccacgtgcccagttctgtatttcactttcacactctctatgctccacttagtgtttcagttgcctgtttcagttgctgggcctatagtggtgggcaaggtagacaagattcctgttctcacatcttacattttagggatgggaaataggcaataaacaagacaggagaacaggcaaatgaacaaggtatttccagagtgtgagcagagtgttcagagagtctctagaacaggttaacatgaccatgagaagctggaggtgatgtttgagccaagacatgcatgacttggtgcaaatttggggcagagcatcaagcccagggaacggcaggttgcaaaggccccatggagaaaccggtgtaacgtatttgaacacctgaaagctggctcctgtgtttggagtgtaagaagggggtaaagattggagatgaggtcaataagcaggcaggggctggaacctcaaaggccttgcagagcttgataaagagtttgaaattttattctaagagcctcgaaaggtttaaggcagggaagtaatagaacctgatttgccttttttttttttttttgagatggagccttgctctgtctcccaggctggagtgcagtggcacaatcttggctcactgcaagctctgcctcccgggttcacaccattctcccgcctcagcctcccgagtagctggaactacaggtgcccaccaccacgcccggctaattttttgtatttttagtagagacggggtttcaccatgttagccagggatggtctcaatctcctgacctggtgacccgcccgcctcggcctcccaaagtgctgggattacaggcgtgagccaccgcgcccggcctgatttgcctttttaaatggtcactctggcttcaggagatttaatgggagcaggagagagacgaccactactatctgctttcaagaatgtaagattggacatagctctctgtcccctgctttgagcatagctgattcctctacaacaaccccatcactggccttgtgttgtgaaagagatcattttctgcttgtataggagagtagagagacctttacgctaacgtggcctgccatttcagactatgacataaccatgcacatgctcgcacattcctagaagaatccgtgtgttagcaaaaggattgttgtgttctttgcgaagcaagagcaaagaatccctcacagaagctgaaaattgccactgatgagtcaaatggccatgctctggtcttcataaacaaaaggcaggctctgattcctccaagtgcagctaattttcaggtagtactaatgggtttatactagcggttctcaaagtgtgcttcctggacgagcaacatcagcatcacctgggaacttgctagaaatgcaaatcctcaggtcccaccccaggagacatactgaactctgaagtgggcccagcaatgtgttttaacaagccctccagctgatgcacctcagaatttggggaatccctgttttttgctgctagagatgattgctcagagtaaaaagcactactaaacatggctgaggagcagagtgatactcctttcattgtaatctttttaatgtaaatgctgagtatttgggtagcttttggaatcaagtgtttgaaccacgccttttgtgtttgaagctattcatgttttatttaggttcttttgttggatgctgctgtatggtataatatttacaaggtttctgggctggcttctccttactggaattttcagaattgatgtaattacatcctccctgagtcgaatttaacagtctaaattggaagaagcctctggctgtcctgatagaaagttcccactgaaaacaaccagcagcattgtatttgaatctttgttgtccacaggtagactgtctatactacagcttcccttcagtgagtttttaacccctgggtggctcatgctgccagccaatctgttcttatgtggatcttcaccgtaagttatgacctgcttacggaaagcagacagatttttagtttagatacatcataaaaggtatatctacttgttgggggagggagggaaataaacattccaaatacagtactgttgtcaaagccaaggatgttctactgtggggctgttcttatatccctgctgtatctgtttcctgtggccgctctaagacactaccacaaatttagtggcttaaaacaatgcaaatttgttatagtcctggaggtcagaagtctgacgcaggtctcactgggctaaaatccaggtgtagatgaactgtgtttctttctagaagccctaggggagaatccatttccttgccctttccaccttctagaggctacatgcattttttggcttgtggccattttcctacatcttcaaagccaggaactgtgggttaagtttttctcacatcgcatcacttggacctcttctgcctctctcttgtacacttaagtaccctgtgataacgttgggtctacctggatgattcaggataatctttggtcatctgattagcaaccttaattctatctgcaaccttaatcccccgtttgccatgtcatgtaattcacaggttccaaggattaggatgtggacatcttggggtggggggtatgatgctgcctaccacagcaggccactaaacttccttacagcctcagtttccttatctgcataatgacattagtaaaaaattattgaaggctctccttgagcattacaggagatacatgtgaaattatttggcacagagctgcccttcagtagatgctggtggcctaacactattttatgttcacaaagtgtctacatagattcttttaaaaattatttgaatgcttgcttctcactcccagacccctctgctctgttctttggtaccccttcccccaccttcccattgggtggtctccctgacccatgctgataggaataattagagcatatgcaagtggaaagggtaggggagaggaaaaaaaaaaaaaaccttcttgtctctaatcagttactattttcccccatactttaaactctgaatagaatattcgtaagagtttgggagattcctttgatttttttttttaacagctttattaaggtataattttccatttgttgttctctaccttgctagagttacttctgacctcgtcaaatcctgattcaatcaaaccaactgtcattaactatttggggggataattgttgaaatttgaatataggcagatcttggatgatattaagaaacattaactcttgtatgagtgataatagtgttgtgcttatgtaagaaaatgcttattttttcaagatacttactgagatatttagttgtgaaatgtcagaaggacttaaactaggggaaaaaaaaggcgaagcaaatatggtgaatttttttttttttttttttttttttttggcagagtctggctctaatgcccaggctggggtgtagtggcatgatcacagctcactgcagcctcaacctccctaggctcaggtgatcctcccacctcagcctcccaagtagctttgactacagaaatgtaccaccatgcctggctaattttcaggggttttttttgtaaagatgggattttgccatgttgctcaggctggtcttgaactcctgggctcaagcgatctgcctgccttggcctccaaagtgctgggattacagatgtatgccactgtgcctggttcatttttttaaaatattagatacaatcaagtgatgcaaaggacccaggtggccagatgtatagtttctggaacaacttctttttcttaatacttcacttaaatgacttggttctctgtgaactttaccaattctagtccactcactcccaaactctgctctgttgacatagctcatgctttatcagatgtcctaaggaaactctacttcactatccttgtcaagtttacatgctcccacaccttttggtggaacataatttacattttagagaacactgggatcttgttaggtttgtttcgtcccatatcacaatccactcttcaactgctagatgatgcatcccacttctagaaagagagccttacttagtgggactgagagctgctctaatcatctgcagttctagctgttacgcgtttcccagtggatcttgagctgccttggggtggtgaggggctgttttgtgggagtgtaaggtcagggaagtgtcctctcctgccctgtgacccaggccttgcaatgatactgaaatacacagctggaaattgtgtgatccaaaaaatggtcttgtctgtgcacttgcatgaactacagccctgcccccaaattcgggagttgagatggtgttcccaaattactccagtgagttgtctgttattccaggaggtgacacagcatcatggtatgtgcatgatgtcacctcagacgttgccagacaacaagcccactcaagtcggacatacagcactttataatggaggctgggttccaccgagaacagccattctcttgtctgctgtccccagtgattataggcagatgtgctgtgacttgagcttgcacaggcttaaagttccttctgccttcagagtcagcagtcagccatcttcacaaatggaagattgttccagaccaccattgaccatctggctggatccatcccaccatctgccctgcacagtggcctctcatttcctaatgtttctcataaacagcttaaagttccctgtgacattatctactgcagcagggcttttggtaccactcctgggcatgccaggaacatagggcctatgggtattcatcagagaacatttgtatgtcaaaaattttaacaaatgagacttccattttgaagataatgatgcagacatgttgtacgttcacttatgtgtcttccttgataaccagtcaacaatttatcagtgatcctttatggacatattaatacacttattggtgatctggaagtagtgtaggacctaatctgtaatcttaaactgtgcagagccttgaggatggccattgtttgttggttatggtgtcctccttgatctttgatgaaagaaagattgccttaggtgcttatatcaagttaatctcatctctgtgacaattgaaattaccattggttctcttctttccacataacacatcgttgtaactcagcatgtctttttcatcgttgttcttgtggaattcttttaatttaatttattgtggtaaaatatgtccaacataaaactgatcattgtaaccattttaaagtgtacaattcagtagcatttagtacattcacaatgttgtacaaacatcactatctagttctaggacatttttgtcatccaaagaaaaccctataccattaagcagtcactccccatctccttcccccacctctggcaaccactaatctgctttctgtctctatggatttgcttatcctggacatttcatataaatagaatcacacaacatgtggcctaccgtgtctggcttctttcactgagcataatgttgtcaacattcatccatgtcgtagcatgtgccaggagttcattcctttgtatcgttgactgctattccattgtacagatagatcacatttcatgtatccattcctcagttgatgggcatttgggctgtttttaccttgtggctattgtgaagagtgctcctgtgaccatgtgtgtacaagtgtttgagcacctgttttcaattcgtttgggtatgtagctagaagtggaattgttgggtcagacagtaattggatgtttaacttcttgaggagctacccgtgcggccttttgctcatgccagtcctcctctgccatatgatgtctgttctctttcaaacctatgttaggactcgcctccaccttgattccttttcctgatagtcccctgcagcttcccataattcatgcatccttactagtccctatgagcacccctcattcagctctgcctggagaaacttcacttttgcctcctcatatattcatctggggttaccctacttcttttggctttgaggatgtttttcccactaactgcatgcaactgtcaccatctcaaggatggagatggatactcgttctctgtgctcaaaggcacttgtcactatttttgcctttctattgttgggctattctagtaacagctggaaattacagaaataggttttgattttattgctcatcaaggtcaggtttccactgaaatacaggcatcatagggcctatcctgtttgaaatattaaaatgtcagaagattcaaacaggccaaagagggagagtttgaagcgggggtgggggggggattggtatgtgtatggagtataaataaagaggttcaaaataacaataatagcattaatgcaaccttcttgagtttgacctcgtttagtcttcacaacgaccatgtgagatggagatttagtgtgcatggctcaaagccacacatcccttatgtggcaaaatcagtatgtttgactccagagtctgtgtttttttgtttttgtttttgtcttttgtttgtttgtttttggagatggagtcttactctgtcacccaggctggagtgcagtggcacgatctcagctcactgcaacctctgcctcccaggttcaagcaattctcctgccctggcttcccaagtacctgggattacagggatgtgccaccatgcccagctaatttttttttttttttttgtatttttagtagagatggggtttcaccatgttggccaggctggtcttgaactcttgacctcaagtgatccacccatctcagcctcccaaagtgctgagattataggcgtgggccactgcgcctaccctgggcctcccactttaaaagttgctcaccagttcttgtatccctagcaccttccagaatgtgttgagtatagtcagtgctcagtgaatatttattgaatctaattgtcaaggaatatgccatttgctgtgttaattttccccaatatagtttttgttgttacatttttctccttaagccctagaaaagtgtaggctttttaaaaaatgaaaatgtttcattttatttcaagaaaggagccttaatctttatttgtatctatttacaaactgttaaagattttgactgcctcctaatgtctttcttaatctcacactttttgaataaaaagtgttaatatatccgttgtaaattgctggcagctcaatttgaaatatctttttgcacaatatgtactattaagtattctcgtgttattgctcagggtaagaaaagatgactgtttttttgccatttaaagcagtcgtctttttttaatgctgtatttaatttttaaaagacaaagtacagcttaatgaaacaggaacttgctgtttcaatgtgaaggacatgatactccagacacattctaaaaggaaatacatttttaaatataaatgtttggtgtttaatcattcattaggcaaaaatggagacatttgagttgtctggatcccttgagcacattttcatggcacttacatgtaatgaagcagctggcccaggatatattcataatcagtgtcactggagggcttaccatatgccaggcttggttctaattgcttaatgtggattgacccatttaatcccaaaataaccctacaaagttgatgtagtcatccctcttttaaaattgagattaaatttgcatagcataaaatgaaccattttaaggtcaacaatttagtgacatttagtctattcaccacattgggcaaccaccagctctatttccaaaacattttgatcaccctcaaaggaaccccataatccctcgtttaagaatcgggaaacagagacatggagataagcccctttccttaagttacccaactgggaagtgatggagccatgtttgagcccggacactgggactcaaggccactctctgtcgctctctgaagatctatactttagtcccactgccaccttacccacctcctaccaacctccagtgtagtgggggcaaagcacttcacttctaacctcaggttcttgaagtgaaaagcagtaagataatgtgctggttgccaagatctcagggctgcaaaaaaaaaaaaattccttacgctattctccatgggaatcaggccaaagcttttcttcatcaaatttcccgaccccatttctgcagaacaaacagcacaccaggcagggactcccctctgtttcttgatatcccacttccacatttatctattatcatcactctctcattcatgtttcagaagattcccacctcttcactagggtcgagactagcataaaacaaaagagatgaccagggtgcgaaatggaagggggcactccctctcagggtcctgtaagccgagtaagtactctctggcctcacgtagtcctggtcctgccccacacctcctccaagatcatgttcagttgctactccctctcattccttgcctccctctaaagaattctaggatccttttcacttctgactccttgtcctgtctctgaccatttatgtccctcctctctggagatgctcctgctctgttcgccctctaaattgtcttttttttttttcttactctatatccagctgggtcatctcgtccgctctgtgtgctactgtctttgtgttaactctcatacctgcagttctctttcaccctcagcctaggtgaccatatgtcctggttggcctggaaagtcccagtgtatgcttgttgtcttggaatcattattggcagtgcctcttgtcactctcaaaagtgatatgtaggcttggcatggtggctcacgcctgtaatcccagcactttgggaggccaaggcaggaggattgcttgagcccaggagtttgagaccagcctgggcaacatagtgaaaccccgtatctacaaaaaataaaaaaatagcccggtgtggtggcacatgcctgtagtcctagctacgtggaaggctgaaggtgggaggatcatgagcctggtaggttgaagctgcagtgagctaaaatcacgccactgcattccagcctgagtgacagagtgagaccctgtctaaaaaaaaaaaaaaaaaaaaaaaaaaagtgatgtcacatattgcagccttctccccagcactcctattctgctagcacgtttctcaggcatacaaaatgcaacagatcagaaataaaacttctcagggtcttgcctaaaggctgcaccacctcaattttctctatcttgactaattatatccacaaggaaagctgttggctcttcataaactcaatctcagttctccaaggctgaaggaagaccaccacacctggaagaacagctggacccagcagtctgcacctctgttccctgtcacccttccttggaatcaagggctactgctcatttaattctctagcccagcacttcccagcagctctttccgccatgacagaaatgctctatatttgtgttgtccgatttggcagccactagcacatgtggctattgagcacatgaaatagggcttgtgcagctgaggaactgacttaacaaagtacaagtagctagtggctactatatgttatagagcagctctacctcagtacttctcaaactttaacatgcatacaaaacacctggatctcactgaaaggtgcaatctgcttcagtacatctgcaacaagacctgagcgtccccattgtagtaggcttccaggtgaaactgacactgctggtctaagggccacactttgaggagaaaggcgctaatctaactcgattctcatccctggctcacatgagccacacgggggaaggtttaaaaatgtgtcagatgcccagggcctttcccaagccaattaaatcaggacctcagagagtaacctgggcattgacatgttttgaaagctcctcaggtgattctaatgtaagatgagcccagactgagctgctcaaataagactttactaaagatttagggttaagaagatggaattaaccagtgaatacaagtcagttagccactgggatttctgtgtggcacctactcatcttcagcctgaagtccctaatagagtctctgtatctgccttctcccccagatctcctgaaactggcagagaatgaaacagctctaacttcttttttttttgttttgttttgttttgttttgttttgttttgtttttgtttttgttttagagatagggtctcgctctgtcaccgaggctggagtgcagtggtgtgatcatggctcactgcagcttcaacctcctgggcccaagtgatctacttcaacctcccaagtagctgagactgcaggtgtgcaccactgcacctacctagtttttatttttttttgtagagacagggtcttgctatgttacccagcctggtctaacttctttaaatagatctggaaggtgccagacttagcctcacagttgtaaaagatttctgtctttgcaaagggctgttctagataatgtggcttttctgacatattgcatacatactctttgaattactttatacttttcttcacacacatgttcattgtatactttttaaaaagcaaatacagagaccagagctgtttaatagctgaggacctccctggactcagattctccctgaagcagtgttaggggctctgttttctgtgttcatataaccctcagtccataccttgttggaatggttgttattgctttatgatttctctatttgtacttctttctagactgagagctccttcaaagtagggccactgccctatttctctctgcctgtctatcccggccactatcagaacctcctggggaattcctccctcagacctactggttcagaatcttaagtggatgagccctggaatgtgtatgtttaaaaggcttcacagatgatctttattttcagacaggaatgaacatcattgccttagagactgacattatatctggaacatggtaaacattaaataactatttgttgagtgcatgaaaatcagtcttaaattcgacttgtggcatctcgaggcagatgccaccttagccaagtgatcaaggttaatgtcatgagtaacctgcatcaataccatttgccccccatgcaatgcattgcaaaggatacagtattactactctggtttccttccaagtgatgcataaccccagctgaatcatgaggaaacagcagacaaacccaaattgagggatattctacaaaatttgtgaccaatactcttcaaaagagtcaaggtcatgaaaaacaagtaaagactggggaatttgcacagattgaaggagaccaaggagacaggacaactaaatgccgcacaagattctgaattgtatcctggaatggaaaagggacattagtgggaaaactggtgaaatccaaataagttctgtgctttagttaacagcattgtgccaaggctaatttcttagttttgataaatgttctgtagttatgtaagatgttaacataaggagaagctcagtgaaggatgtattggaactctttgtaatatttttgcaacactgctgaaagtctgaatttatctcaaaaccaacaaaaggttaaatttaaaaaatgaatggaagataattgaaatgtcactgaacaagggcattctggaaggagagtaaagaagtccaaggggagaccattggttcgacaatcggaaccaaactggaccatcatagattacaagttgatgcccctatggttttgtcaaaactccctcatgtttttatagctattttgaggtataatttacataccatacggttcacccatttaaagtgtataattcactgtgttttagaatatttacagggttgcaccaccatcatcacaatctaattttggaacgtttttgtcccctttaaaaaaaaaaaaaacaacctatatccatttgctgtcactcaatatcccaccccaccagctgctgccaagcaaccattttttcctttctgtctctataggttttcctattctggacatttattttaaattgaatcatatgtgatattttgtgtctggcttctttcacttagcatgatgtttctgaggtttatccatgtggtagcatgtgtcagtacttcattcctatttgtggcccaataacattctgttgtatgaatacggaccacatttatttattcattcatcagtcgatgaacacctaataccttttggactattattctgatgggtttggttgaatactagggtagactgcccttccagcctcccatgctctatgcatccattgctccagaagatagactcttaggataaagagttgacaccatctccaagcatcccaaacagcattgtgtacttatatacatgattagccactttggaatgtctttagtgttaaggcaagaaatgtccttagagtcccagagagggaaaaaatgtgggttatgttatgtccaaatccataaccaccacttcagggagttgtgcagtgaattgctttattgaataagtgtgagaaaggaaagatattagttgtccaagaatgctattgccaaactttgtggaaacagagtattttctgtggaaacagcatacattttattctgtgccatggaatttcccctcatttgacccaaggggtaaagaaaaactcttatgcaaccatcccattttaaaagttattcttttatatgtaggctggttaataaccaacaacagacaattttatctaagatgactaagatcttgcatttcgcttttagtgagagctgatttacatatctaattcatgttctattagcagagttatgggaatataaggaaatgcaagaaaaacccaggacttggatcagattttaaagtcctacagttatatacagttgtgaagatgtccttcaaaatccagaaaccaaacagactctgtcatcttactttttgctgaggtgttggccttttatttttgaaatctagcaattttcacttcttgttatctaaaagttattaatacaaagcatttcctcccgtcatttacataactcttttccagcagtatgcacacgtacacacacacacacacacacacaatttaaatgtctatgagcaacttttgactttctggaaaattctttccccagcttgaaactttctccatattctggtgtttcacctgaatgtgaaatgaagacatttcacagaatctaagagttcagaaagaggcaccgtgctagatactcatgtgcatagtttctggtcttctcactggcccttccagtaacttgtggttattctagaagtccatgtccagaacagaacactgagcaacagatatcatctgggatccatgtttttggtctaattggccttttgggtgaacacatcatttgggctcaagttgatgattgtatcaagtaagccttttcagtctcttctgtgctgccactgagcctgttccaccaccaccttccctcacccccatcttgaaatcatgcatttggttgctgagacccaagtgtaggatacaaccgtttgttcccatgaccttttcaggtcctcctcatctttctggtttgtcttcctttcagcatctggtaattttgttgttgaatgggttggcctcacttcctagcttcatgttacctgcagacttggtcacgaagatgtgtataacttcatgtgagccattgataagcagggcaaaatagggaaagtgccacccccacaccatgcctgtcactggagactgctcggcagtttcatactttattacccctgagatctgttgtgaatcagcctcactaaaggtcttcccctctacattcccttgtgaacaagaatagctggaaagcccttacaaatgccttgcctgccaggcacagcggctcacgcttgtagtcccagcactttgggaggctgaggtgggtggatcgcttgagcccaggagtttgagaccagctggggcaacgtggcaaaaccccatctctacagaagatacaaaaattagccaggcgtagtggcacacacttgtagccccagctgcttgggaggctgaggtgggaggatttcttgagcccaggagattgaggctacagtgagctgtgattgctccactgcactccagcctgggtgacagagtgagaccctgtctcaaaacaaaaataaatgcctcttcatgattcccatggtttgtgtctagagatttccctcagcctaagaatctaaccgtaccaagtgaaagcaagagaggctgatcttgcatgtaatagtcactgaatgttctaagtgcttgcagaatattcttcaattgtctcttctagactcttgactaggatgtatatcagattcaccaatctgtggtttttgaagcatgttttttccttttcccttttgaaaactgcaaatgcatctctctgactccattcgtattacaggggaagatttagttattttatcttcaagttctccaagtatctgggtataatttgtcttcactataatgctaaaattcatttagaatatcttctaatcaatttgggacctcagttctctcttcattagatttttttcgtctactcttccctggctgaagctcattgtttttttaaaaatagatatatattttaaatttttaaatatttaattgacatgtaataattgtacatatttatggggtacaatgtgatatttctgtacattaatgcattgtgtaatgatcaaatcagggtaattggtatatccatcacttcaaacatttatcacttctttgtggtgaaaatattcaaattcctgtcttctagcttttttgaaatatgtgttgttaactatagtcattccagtgtgcattagagcaccagaacttattcctcctaactggtgatgttgtacccattgagtgacctcttcctacttttttgagacggagtttcactcttgttgcccagactggagtgcaatggcgcgatctcagctcaccgcaacctccgcctcccaggttcaagtgattctcctgcctcagcctccctagtagctgggattacaggcatgtgccaccacgcccggctaattttgtatttttagtagagacggggtttctccatgttggtcaggctggtctcaaactcccgacctcaggtgatccgccagcctcagcctctcaaagtgctgggattacaggcgtgagccactgcgcccggcttgacctcttcctacttctaactcccctcaccataaccctccatagcccctagtaacttctatccaattctctacttttatgagctcaacttttaaaaattccacatacaagcaggatcatgaggtatttgtctttctgggcctggcttatttatttcacttaatatgatgtcctccaggtgtatccgtgttgtcaaaaatgacaggatttattgttttttttatggctgaatagtagtctgtgtttttatccaagcagtcagaagcaaagtgcagaagagaatggggtttttttctttcattttttatttttactttttctttttgagacagggtcttgctctgtcacccaggctggagagcagtggtacaatctcagctcactgcagccttgacctcttggactcaagtgatcctcctgcctcagcctcctgagtagctgggactataggtgtgcaccaccatgcccagctaatatttttctttgttttttttttcttttcttttctttctttctttcttttttttttttttttttttgaagagatggatttttaccgtgtggtccagtgatctgccggcctcaggctcccaaagtgctgagactacaggcatgaaccaccgtgcctggctgagaatggggttttctttgcctattgtaatggaaacataaatccgtgaatttggcccgtgacctctttgctgttttttatcacaatgtcatgaactgctttgcagtttacaaagtgcccgcatgtgcatgtgatctttacaaccaccttgtgagctagtgagtttactacctgtattttagaaacaaagaagcagagttgaacttgcatttagtgacatggagggttgggtgacttttccaagttgtggagcctgttcatgaccaagttggatgcctcccagctttttcactatgcaatctttgccacatttatcacatacagtagtccccctttattcacggtttcactctccatggtgtcagttacctgtggtcaacagtggtccaaaataggtaagtacagaacaataagataagaaagagagactacattcacataactttgattacagtatattgttatagttgatctattattagttattgttgctaatttctcactgtgcctaatttataaatgaaactttattgtatgtatatacagggaaaaacactgtatatagggtttgttactatctgcagttttaggcatccactgggggtcttggaatgtatacctcatggataagtggggacctgtactttactatacgttggaagcacacctttctgactttctcccctgaaatccttgtttactctttaattcatgccattctctgtctttcatacacagtatgtgggaagggtgatgcccataagccactctaacttcctgcactccctttcatttctctgtggggctcaccgatgagtgagtatatttccagaacatcatttctgacatcatccaaatcctctaaagcagccttcctttaaaaactccaaccctggaatctaatctgcatttttggaacgtttgcaatatgctgaagtcagagctactccctttgctgtgccccacgtgcctgggcaccagcccctcggctccaccacctgatgtgcaagtcatgtcagtgtcctcccaagattcctttcacttccccaacttggtgcccaagggggatctgcactgggtctagtgcagcatcccccctaacgtgctttctacaagagggaattggcagcaatgctaggcaaggcgattcagaatcagcgactctacttttttgctgaataagacactgcagatctatttcgctgatttatttacattattctgcatgtccttggagagatggcagaaggttaagggacagcatcgattctttcagattcctcaaggctcttgcagatttcccatggtcctttgtactacaaagtgggagaatcaagcatcagatgaccttttcaatgttactctgttggttcaatctgtaacaactttttctcttgtcttcaccaacctctcactgctttccacaaaaaatgaaccatggcctgctattatttgttttcaattctgaatataataagatatcataaattgctttcacgaaagtactgatttgattatcacttatgatacaaattatgaaactgcaacatgagtgttttctctctgattcctttcaccatttcactgcagacttgaaaagggaccagaatggaccaaaaagaaattatttctttgttgttttgccaaagacctttcctttcaaaatgcacacatcctggagttttgaaaactgctataattatcacaaggcagtctttctgtgggaagaaagtgagtgaatttcccattaggagatcatggttaaaataatctctcggctctgggaccaaatggaactagaaagtgtgttcaaaagctgcattcatttcagaagggagaaagaacaacctttctcataatgagccttgggaagcagccagcgtggaaaaaggtcacacaattgccactttggtatctgaataactactcttagcttacttttgcttgtggtgtgatagcttttgtggttttctctggggctgaatccctgctgtcttcaagcatagttttcactgagtctgtcttggaaaccactgtgcgtgtggcattgtcatctaccatttttataggagacagaaacagttactctgacccaagtgactgaaatgcagctcagtaaattttttttcccaatagtcttagcatgtggataggacatttgttcttatccagaaatgaaatgtgttaagattgtgtgaaattatctgtatcttttgctgctcatttttcaaagattgccccggagggtgttttggtgaaattatttatggaatatgtaaaaatgttcaagaccctttatcagaacagaactgaggaggatgctgttcctgaagattctgcctactgcctatccaagatgcaaaatattagtggtattgaagagagatgagaggggagattattttaaggttatgtgtctttctacaattataccaatttttaaagtgtatttccagctgggcatggtggctcatacctgtaatcccagcactttgggagaccaaggtgggaggattgcctaaaccttggaatttgagaccagcctgggcaatgtagcaaaaccccatctctacagaaaaaaaaaaaaatcacaaaagttagccgggcatggtggcatgtacctgtagtcccagctactggggaggctggggtgggagggtcacttgagcccaggaagtcaaggctgtagtgagccgtgattgtgccactgcactccagcctgggtggtagagaccctgtatcaaaaaataaaaataaaaaatagtaaagaatatttccacaaatcagaagtgaaagagacagctcttggagaagggttcatattcataatacttttctcattgcttattttccaaaagctctaaaatggacttctatgtattaccactgcttcatattgcccacctacccaccttgttgctcctgtcatctaatgttatgaaaatagtgtttgggatttaaagcggaagccatgggttgatttttaagaagtcacagaagccaagactgctgagcactctggtgtcatcagaatgaacattccctgactccagtgagtatcctgacgtgtgtagttaactctcacaaactcaggcacgtgaatgatctcagcagaagagagagaagggccagtggtttaccccattgtctctcccctctttcaacatgggtcttgactaccttgcttccaggaagcaagggtgacagctgaaaaccaaccggaagcgttatttttgttgttgttgttttttgttgtagttgttgttgctgttgcttttgagcctccaaagaccaagatccacttaatagaccgtggcatttttgcctcatctactgacttaagaacttaatccatgaccctgtcactacaccccctgcacccccacccacgcacatttacatgctcactcgtacactcattcacactcacctctacctttagatttaacccactgagctgtactgagccagatgaactggactgttgattcttaccatttctggatcgtgggttcctgaagaatctggtgagaagttgtaaaccctcttccctgaaaagtgtctatacaaatgtgtgcagatttggcttatgattctggagggattcatggccaggaaatccatgttaggggatttacttttcactatataccctttgtttctgttgtgaggttgttactgtctgtgtatattacttctgttaattgaatctgtctaggttactttttcaattaacaaattaattagaagactaagagcctaaaagagatttttcttatctgattaagttcagtattgaatcctgagagtccatttgaaagcatagtattcgtcggctttttcaattgcaaaatatttatcgtgattgccaagaaatattgctgagagccaaaataataatagaggaaatgatctacagttgaatttttatctgaattattttgaacatagaaaatgaatttttgtaaataaaaaaataatagatgttggtgtggatgcagtgaaagggaacacttctacactgctggtgggaatgtaaactagtacaaccactatagaaatagtggggagattgcttaaagaactaaaagtagatctaccatttgatccagcaattccactactagctgtctacccagggggaaaaaaaatcatatgaaaaagatacttgcacgtgcatgtttatagcagcacagtttgcaattgcaaaagtatggaaccagcccaagtgcccatcaatcaacgagtggataaagaaaatgaggtgtgtgtgtatatatatatgtatgtgtgtatatgtatatatgtatattatatatatatgtatgtgtatatatatgtgtgtatatgtatgtgtatatatgtgtgtatatgtatatatatgtatgtgtatatatatgtatatatgtgtgtgtgtgtgtgtgtgtgtgtgtgtgtgtgtgtgtatgcacattcattctgtggaatactcagccatataaaggaactaaacaatggcattcgtggcaacctggatggaattggaggcaattattctaaatgaagtaactcaggaatggaaaaccaaacattgcatgttctcagttgtatgtgggagctaagttatgaggatgcaaaggcataagaatgatacactgggatttggggactcggggggaaaggctgggggtggcaagggataaaagactacacattgggtacagtgtacactgcttgggctatgggtgcaccaaaatctcagaaatcaccactaaagaagttattcatgtaaccaaacactacctgttccccaaaaacctattgaaataaaaaataaaatattaaaatgaatttttgtgttaatggtctcatattcaggtgggaaaaatcttcttacagttgccaaaaatggttacctggtagtatgaaaagggtaagagttgataatcctcgagaataaggataccttcctacagtgttttcagcatagcttattttgtgtgattctttgagagcaaaaaaaaaaaaaaaaaccccacgttttgggattgtagtgactgctttgccttgattgggctcctcatgggagccatttcttatactgaatctttcaccataccaaagagtgttataaccttcatgtacattttaaatgacagtcatattttacccttcccaacagggtttatgtaacatctttgtgcagtatgcttaaaatccacaaaactaaaatatctcaaaggagaaaagagaggttagtgatgaataaaaattgtagtgaagattgtcttgttttttccttctaaaattccttcctgtgtaaaagccgcctggccaactgatagtttttctttcaactcactgtgaaatatttttcttagcttgcatgttagcaccaagtgatgtatccattgtcactactgtgtgatatcagttgctgaggtgataaaacatggatttcttttttaacctggtactggaatggaggatggggaagaaaagagagtcaagaaaaggaatgatgcaactgacaggcatacattagtgaggtgccctattcatttatttcagtagctgtacatccttactttccagcactattgaatactctgtgggtggtaggatcgtgtgggggaaagagcatagttataatagctgacatttattgaacatttgctattctaagcacattatttatattaactcatctaatccctatgacaactatatggattagctgggttcaaatccggactcctccacttcctagctgtataaacttgtgcaacttcacttttttttttagatgaacaaaaactatccatctcttagggtagatgttagcattaattgagatggtagttctattgcatatataatcatgtctggtatataaaagaactcaaatgatgtaaaaaaaaatctctgtacacaaagacttcatggcagcatgattcataatagctccaaactgaagacagcccaaatgtccttcaactggtaaatagatttaaaaaagaattgtggtatattcatagtatggaatactactcagcaatgaaaaaaaggacatggatacacacaaaaacatggaaaaatctcaaacattatgttaagtgaagaaatagaaacacaaacatactgtgtgatttcatttatgtaacattctagaaaagcctaactgtggcaacaaaaagtagatcagtggttgccagaggttggggaaggagatcagctgcagaaaggtactaggaaactttgtaaagtgggggaactgttctgtatgttgattgtggtgattacaaaactgcatatgattactaaatttcgtaaaattgtacacttaaaaatgggtgaagcttaatgtatgtaaattatacctcaaagctagaaaaacacttgctgcaaattgtaaggttgtataacattagactttctcatattttagaacagttgaatgggttttatgcagctcgggttttcagagctacttagattatctcaaaggaaacttaatgcaggtgctattgagcacgcttcatacacatgcctatgaaaggtacaatggatgatgccaaagggacctgtgatagtctgtattagagaaattgtagagaaattgcagacagtttatatacactaaaccatcaagaaatcccatgagaattgaggatatgtgtcgcaggtgagtattggggcaggtcagaaagaagggagataatttagtagggataggggtggtcagggaaggcctctgacagaaataagacttgaaagtgttggataagttttctggaaataatttgagcagagatgtggcagttacaatacatacttaaaaatggctggactggagtatgttggaaagactcgaggactttgaggtctgtcagcttcacaaataaggttgcagagtgttcccagttctctagcctggagcttgtgtgtactggttcttaccctgattatgtcctcttccaattctgagtttagtgacgtttcatttattgcctgagattggccacgctgggaatatttaaagcgtgcaaattgacaatcattttggaaatctgtctcccccaacttcctacccaccccaccagccagttgtcaaccatttaccagcacactactgattgtaatcctgagaattatgaacttcagagaggggaacgaacagaagatccagaggtggctggagaggtgtagagagagccagaggggaaaaagatactcgtaagggagatgacaaggcacaaatattcaatgctgaaagagaagtaggatttttgttgttgtttccaagagaactgaagcagtaggatgccttatcacaagcacacatgtaaaaagcacctctcatacaagtcttttcagaccttcagtaaacagtgctcctccttgcctcaacttgtctgatatatacacagcactttgatggtcaatgcatgcagtgcagaattaggtcctcccttctctgtgcttcctggtattctttcagtttctggcacatggaaggcagtcgtagtggctgaatgaatgaaatcatgaactaatccttattgcggtattgctcatactgtatgcttgcaatacaaaaccttgcttacttgtttatctacctcattgaagtgcaaacttcagaagaaccaggaattttgtatcttgttgtaccctagcacttgccactgcacagttggtgctcaagaaatgcttattgaaataatgaaattaggcaatttcagttttagataacatgcaattaccaaaagatcaaatagcattctgttccatgaaacaaacccatgtcctttcttaaaacattcaaaagaggtgctattgagttatgtaaaacatgctagtctctattgtgggagggcattagtctgccaatatctcagtttctttttaacagtacagaaattgaagcaacttactatcaaagtttcttccagatctaagatgctatgattctaagaggaaagaaaattcagaccttgtgggcttaaaaccaggggtcctttattgctttctgttaaggtggaaagttatatatgacatagacattttctgtacttttggcttctttatatggattctatctatataagtgataagtgattaagtgaggttggctagtaattattgcctcactctattcaatttctcttctgtcttatctgtggtaggctgaacaatggcccccctagatgtccaggtcataagccatgaaacctgtgaatatgttcccttatgtggcaaaagagactttgcagatgtgattaagttaaggatctcaaaatggggagattactctggattatctcagtgggcccaatgtcatcacagcatccttataagaaggaggcaggagagttagaaggagatgtgaggatggaagcagagattagaaagataaagatcggaaagatgttatgttgctgactttgaagatggagaaaggggccacaagccacagattataagaggcgagtagaagctgaaaaaagcaaggaaatggattctcctttagagcttccgtaagaactcagtcccccagtttgggcaatatggcaaatccctgtctctacaaaatatacaaaaagtagctgggcatggtggcgcatgcctgtaatcccagctacttgggaggctgcggcagggggattgcatgagcccaggaggtcaaggctgcagtgagctatgatcgcacctctgcactccagcctgggtgacagagtgagaacctgtcaaaaaaaaaaaataataaaaaaaaaaataaaggtgcagacaccttgacttcagcctagcagaactgattttgaacttctggcctcaagaactttcagagaataaatttgcattgttttaagcgattaaatccgtggtcattcgttacaacagccataggaaactaataaaacatctcttctgaagatttaaaaatagcattctttgctttccaaatttcactgtgcataggaccacctggggatcttgttaaaatgcagattctgattcaggggggtctgaggatggtcatgaagatttacaattgtcttgagatcccagatgctgctgctgctgctggttgtagcccacactttgaatgggaaagctctggaggaggtattcattgtctgggcttctctttcctttattgcctttggtcatcattactaaaatattgtatcctgttgggactctttggtttctgtgagcatgtagagaattagaaagccacaaagacttggagtagagccaacatggggaggattttaaaaagctgcaattgttcaacctgaagaaaagacagaagatgatttaataatgatatgtaagaaaccagagagttaatatgtgggaaatggtgattaactgcccctcatctttactttacaggataaaatagcaagaagaatttgggcttaagaactccatactggcagggaggtggtggttctctttgactgttagaattgtacagctgcaagggccctgggatccatctagttgtacccactcattttgtagatgaaactgaagctgagagtgacctttggaaggtcacaagcaaatgacagaatctgtactagaactggtggcttggccatgttcactgcaccaccgcagtggaggctgtgccatggggtttagataattggtagttgctcatcactttgaagtgatttaaaattggggctgtcccagggagccttctagggtggcagaagtgttctgtatcttgctcttgggttcagttatacaggtgtatgcatgtgtgtgtgtaaaactcatcaagttgtaaacttgacctttgcatacttgaccgtacactgattattcagcaattttgaaattttttgctagcatttagaaaatgaaaatgctgaactcttcgttgtagccaaacactggaaatgatccaaatgtccttcaaattagactagatacataaactgtggcaaatttatagaatggatttctatatagcagtgagagtaaatgaactgtaccatacagcaacatagatgagtctcacaagcatgttggtgactgaaagaagccagacacaaaagagaacattccataggattctatctatataaaagtcgaaactgagcaaacttaacatggccttaaaagtcaggggagccgggcgcggtggctcacgcctataatcgcaacactttgagagaccaaggtgggcagatcacttgaagccaggagtttgagaccagcctggccagcattgtgaaacctcatctctactaaaaatacaaaaattagccaggtatggtggcacgtgcctgtaatgccagctgcttgggaggctgaggcaggagaatcgcttgaacctgggaggtggaggttgcagtgaaccgagatcgcaccactgcactccagcctgggtgacagagcgagactctgtgtcaaaaaaaaaaggggagtggctaactatgagggaagtattagggacacaaggggggctctacctggctacatggttatatccactttgtgaaaatgaagcacaatgtattcatttgcacattttctttatgtacatttcaattaaaagttaaaattggttgagagaggttgggagaagaacttctcacaaacctctgtatactattaagctttgaagaatttaggttttttaaagctttttaaattgacaaataataattgttcatatccatagagtacatagtgatgtttcaatgcatataatgtttagcagtcagatcagggtaattagcatatccctcatctcaaacatttatttccttttgttaggaatgttcaatatcttcttagctatttgaaatgatatattgttaactctagccatcccagagtggtatagaacactaaaacttattcctcctgtctagctgtaattttggtttcattacttattttttaaaagcacaggtggaggtaattgcattagaaaacatgtactttcatagaatccctggaagataacttgctgtggagagaaaccttcagttaaggagtctgtatatttaaatctcagttctaagccaaaagccatctcttctcttgtcagctttctctctgagctagtacagtctttctttcatgaaaatctatgaagccagcaccatcctcagatcctttttggccctttgtagttctacagaatgggggcattttttaaaagaagcagcttgaaataaatagtaattttgttaggagacaatgttgtcatgccaggcacacttccctgcagcagtgcctggagtgccacagttggtttcaaatggtgtgaagcggttccagacaagcagccgaccaaacagaacttgtcaccccaagccagaattcccccaaagccatatctgcttcctgccactggtggtatagtttcaaaccagctggctagcctacctgagataatttcatcatgtgaggttgtacagaaaagggttgacttgaccaatctgagactatcttggacaaggccagcttgcaaggttggcccttggctggcatcgggaacttggtggtaagcagttccctgcagtgataagaactttccctaagtgataaggctggttcaggatggctagactgtgctaacactatggcttatgctgaacacctttccttccttcctggagtctggaatttcaatatgtttaggcagagggtgcctccatgaccagcctgcctttctaaccagcttttctgggcagaactgtcacacatattattgtgacttcattggtaggggcaaagtgtgcccatgcgatatctcctgggaagagagagcataaggaagtctgcatgtggattcttccagactccacgtgtgtctttttccctttttttttttttttttttttttgaggtggtgtctcaccctgtcgcccagggagtaacctcagctcactgcaacctctgcctcccaggttcaagtgattcttatgcctcaacctcccgagtagctgggattacaggcatgcaccactacgtctggctaatttttgtatttttagtagagatggggtttcaccatgttggccaggctggtcccgaactcctgacctcaagtgattcacccacctcagccttccaaagtgttgggattacaggcatgagccactgtgcccagcttgtgtctttttcctttatgatccttgtatccttgttaagttgctgtaataaatattggctctaagtacaactatatactaagtcccatggatccttctgtcgaatctcagaacatggggtggtctttgggacgcaggtacctaagtgaatatttaaagtagttttcagcttttttcctgatgaaaataaggtgagaagatactcctgggtgcttctggtgggagtacgaacatggaacaacccttgtcgaggacatgttgtcagtttctagcagatcatacattcattgaccctttgatccaggattcccacttctggaaatttatcctgtagctgtaacaatacctgtacaaaatgatacacataaaaggtttttggctgggcatggtggcgtgcacctgtagtcttagctacttgggaggctgaggcgggaggatcacttgagcccaggagtttgaaggtcaaggctgcagtgagccatggtcatgccactgcactccaacctgggtgacagagtgaaacccagtctttaaaaaaaaaaaaaaaaagtttttgttgtactcttcccccagcctttatttgtaatagcaaaagaccagaaactagtattgtcctgtatggggctgctgagtctctgagggtacattcacactaggaatgactgcagctagaatagaacgaagaagttgtatgtgattaatagaaagttttctcatgtgaattaaatcaaaagcagggtacagaacagttaagtctagtactgtgtgctccttttctgggcgaagggtgtgtgatgctctgaataactattaaaagtggtgacctgtagggggcaagttagacagtgaatgaaggcagaaatgagaactctgtgtatacttccttatattgctttcatttttgtgtcaattacctattaagttttttttaattgaaaatgaaaagagctgagaggaggcagtctgcttgaggtgaatcaaaatcaaggtattataagtgaaataaaaattttacatacttaattttctctttgtttacatcaggtatggcccatgagtcagccacctgtttttgtaaataaaaaaatcttggaacacagtcatgtccattgttttacatatgctccttggctgcttttttgctacggtggcagagttgagtcattgcaaaagagaccagatggcccacaaaacctaaaatattgactattctggccgtttacaaaaaagtttgatgaccctgcacctgtagtgtttagttatggcttatatcagtgttgatgccctgcctaaggatatcaggatggattggaatttgattcatctgtagtaggtaaggccaatggtagtcatttgaaagatgccattttttataaactctgagcaaactcatgttacgtgattgctggggggtcaggggagggggattttactctacaaagacacattagtctatttctaaaacctgccaagagaaattttaagaagcaatgaatgatctcttctctaaagtgtggtgcctctgagacaatctaccttcctggcaatgataccctagctaaatgttgtctttgaagatttatatcatcagaatcatggaaactggacctctccaggagaaactgaggtctgcactgtgcaagatgggatcattgtccctcgatttcagctggttttttttttttcattgcatgcctgaggtgactttacccatccttccagaacaaaatggattattctttgagatgtctggtgattatcataaaccattatcatatggttctgtgatataggaccgtaagcaaggcatttgaataatcatgattttatatgagtaatgatgatagctactgttcactgagggcctactgtgtgtcaggcagcgtgtaaggtgttttatgtgtattacatctatttaatcttcccctcaaccttcagggattgatatgatcattttcactctacaggtaaggaaaccaaggcttagagtttaagttactgaagaggtgatgttgctggtaagtggcagaggtgaaattagaacccagctctggctcagaatctatattctgttccatacttcagtgacttggaatgggaattagttacgaggtagaaccccattcagattaactaactttttttttttttttttttttggagatggagtctcgctctgttgcccaggttggagtgcaatggcacaatctcagctcactgcagcctctgcctcctgggttcaagcgattctcctgcctcagcctcccgagtagctgggactacaggcatgcaccaccgcgcccagctaatttttgtatttttagtagagatggagtttcaccagttggccaggctggtcttgaactcctgacctcaagtgatttgcccaccttggcctcccaaagtgctgggattacaggcacgagcccccatgcctggcctagattaactttttttcaaagaagtgagttcaatatagttttaatttattggtaaaatgaatcattacaaatattttaaataacgataccaataaaaacaatgcttttattcattgcatgtcctaaagactacatgtagtttcattgacgtcttccattgactttgtgaaagatatttagtattctcattttttcaaagaagctggatattaaagagcttaagtatattgcccatactcacatgtatggttcaaccaaggtccagactcccatcccctggaacctgttctgtctactgtgctacatggatttaaggcttgaattagtaacttggcagactgactgtccaagagacaaacatgctgttcaaagtatttgtcctagtccatttgtattgctataaaggaacgcctgaggctgggtaatttataagaaaagaggtttatttgactcacagttctggagactgtacaagaagcatggcaccagcatctgcatccagtaaaggcctcaggaagcttccactcatggcagaagggaaaggagctatcacatagagtgtgagagaggaagcaagagaaagaggggaaggaggtgccaggctctttttaacaaccagctctctcaggagctaacagaggaagaacccactcactcccttccactcagagaggacattaatgtattcatgagggattcacctccgtgactcaaacacctctcattgggccccatctccaatattggcatcagatttcaaaatgagatttggaggggacaaacatccaaactatagtagtgttcctatattttattattttttgagacagagtcttgctctgtcacccaggctggagcgcagtgatgccatctcggctcactgcagcctctcctttgtaggttcaagcgattctcctgcctcagcctcctgagttggtgggactacaggtgcgtgccaccatgcctggctaatttttgtatttttagtaaagatgaggtttcaccatgttggccaggctggtatcgaactcctgacctcaggtgacccgccccctcagcctcccaaaatgctgagattacagggatgagccaccacaccgggcctatattttattactctcccccccacccccaaaataacatatattaaaaatgttgcttttggccaactccctgattctgtttctattccctttttgccatcaattatggtagttatgttctaacaaattgatttttactttcttgtgctgatgactttagcaactcctatgtgaaggtaattgctagttttattgtcttaacattatgctaactgttagtgtaatccagagtaatcaatggtatccagcctggagctgattatgttcaattgtttcaccaatcatttgtctgtatttatgatacacccatgtacacatctggcctccaggcaatggcaatgactgtgtgtatgaaagaatcaagtgaatgtaatgtaaggcagtgtgtgattatgtcaaaatggatgggacagggtgttggtgccgtaagagttcacagaaagctaaagtggtaagaaaatgccttgtggaaaccctgatgattctatcttcttggcgtcagcctacttttgaattcagcctacctttctcaaattctgtttctacctggtccaagtcaccatcatctctgatgtggattactatgcttactccctatttcttccacatttatttttttaaacaattgtatttgggtataatttacatattataaaatttaccagagtatttccatcactcagtaaaattcgatgagcttatttacagttagttcctattcccatctctagtcccaggttccttgaggaaccatgcatcaagttttcatctctactgtgtgcctgttttggacattttatgtaaatgggcttacatatgttcttttgtgtctggcttttttctctgagcatggtatttttcaggttcatccatattgtaccatgtattagtactttgtttttattgccagaaaatgttccacagtgtggattgaccatattttgtttatccatgtaccagttgatggatgcttagattctgtgaacattcatgtacaagtttttgtgtggacagaagtttttatttctcttgagtatatacctaggagcagaattatcatatgataactctttaactttttgagaaacttccgtattgtttcccaaagtagctgcatcattttatattcagtgtatgagggttcctggttttccacatcctcactaacacttgttattgtcttttttcttatagccattctagtttgtgtaaagttgtatttcattccctctttcagtctctaaacaaccggcagaataattttttattgtttttttacaaatgcatatctgctatcttacaccctgactgaatctctttaatggcttccatcacatgtaaaataaagtctaaataaattctttgacctgttgtcacaggtcgggttccctaggaagtacactctgagatggagaggtttgttgaggattgctttcagggtaaacacctgtaggggcatgaaagaagcaggactgagcagagggagaagttgggctgcagcatcatcccaaccaaggtctcagcttatcctattggaaccttcagaggtgggaaggctctgcaaggttggctggacaaaggatctgggtctttatgcacccatattgaccagtcactgagtgccagatgcccctgagccagggacatgaccatgggcaagacggctttcttcagtagagtacaatcactaggaggaagtcctcagccacaagctgtcatctgtcaactttgccagcagctgggggtatcagtatatcagtccggaaggaggggaatctgggtgatatattacagcatccactatacctgagctgagagccatcacattctggtcttctcgacttatctcttaatacttcctttcttgctgtctgggctctagccacactgctttaaatttctttatgttctcaagtttcttccaaccttaggatctttgcacatactattcctattggtttatggccataccaatttaaacacctccaatcttatctagaaagtgagagcattttaaaaatcagtgtttaaatcgtatttgtaaagttgcttgaaaaaggactaggctattaggctagtgttaaagctgtcatttggagggcctttttagctttattataaattccaatattgggaattgctcatttgacatgatgtataggagccattttctaatggaccagcattaatccacttatagctgagtggccaacagattagcaagcacttccattttctataaagaaatggatattgtaaaggcctgggtgatgctgaggaggaggctcaataggatcatatttcttgtattcaaactgcaaaaatataagtaggattaatgttatgttagagtttagatggaggtattaatacattgcatttagaaataatacactgaaatctataaagaacaagagtatttgtttaaagtagactttggagagaaactcattggtaaatcttgaaatttggtctctaaataattaaaagttgtttggattttttaaaaaattgccatgtttccctcttaactgattttctgccaaattttcctgttcagcactcagaacttgggcagcagttggtgtgtaagggatgtttgcacacatataagatggtgttttttccttcatctctaatgatttcataaggtctcagttctatatgacatttggattttgaatttataataccatgtttatatatttaacatggacacatggcaagtgctgggaattaaagctaaatatagacttgttgactgaacaatcaaactatctgcttgtcttagtccattagtagtagtttcactggtatggttgatagaaagcactcaccctcctcatacgtgcatgagacgaggccaagaagtgattcctgtgtaaattggcagccatgacagtaatgatgtttgcctaaaacatgtgtcagtaataggaaagatgattaggcaaagaagaaaaagtttaaaaaaaaaaaaaaaaaaaagctggcgcagtggctcacgcctgtaatcccagcactttgggaggccgaggcgggtggatcataaggtcaggagatcgagtccatcctggctaacatggtgaaaccccgtctctactaaaaaaaatacaaaaatttagtctggcattgtggcgggcgcctgtagtaccagctacttgggaggctgaggcaggggaatggcgtgaacccagagggcggagcttgcagtgagctgagatcacgccactgcactccagcctgggcgacagagcaagactccatctcaaaaaaatgaaataaaaaataaaaaaaaagatggtcgagggagagatgcgtatttgctctgagtgttcagagatttccttacacttctctatatagataagaaaacaaatatgagcccacagtgggtataaagcaacctttttctaagaagtggactggaaataagtctggtttttggttcaaggagggcctgggaagtatccagcatgatgtccgggaacacagatcagaagtagacaactgagcctagaaatgctggggttgagtgggagatgggatggatgcatgagtaggtgggtgcgtgggtgggaattcagaatttcgtagaggaaatggaagtagggaaaagggacagcactcaggtgggaaactcagaggtttagctgtcactgggagacagccaaatgggagaggaagggaaaggtggaaaatgagaaagagagaaaggaatgcagaatggagaacggggttttggcattcttttctgtccttacttgttctacctgtgataaagaacccatcagtttggacacagtgtcccttcatggcctggcaagaatcctcagtaggacacaacctcctacgtgggagtggtgattcagaggaaacacatggtgaggataattaatttggaggttgaccatgttctgtgtgggtgtttacctctttcagaacatgtagctgaaagttcagcgtgtactattgaaaagctttcttgcaacgttgctggctgtccttggtcttgagactaaagcatcccatagaagtggtggaacgctaaagattgaaacaaaccactgaaaattgatttataaatatataactagttgtaagctgaagactaaagcatcccatagaagtggtagaatgctaaagattgaaacaaaccactgaaaattgatttataaatatataactagttgtaagctgaaatctaaataactttttaagttaaatatatatacaaaaatattagaagaaggagaattttcactctcaactcattcttgcatagaaaaataaaatctatcatctctgtatattagaagcattttgtttttggaagaggttgttggaataggttatatggaaggccatttcattcaaatgaacaaaaattacgtgagatggaaattggcaaatttatcccaagtaaatactgaaaaacctggaagcctttcaggtgctcagatttccactatagaaaagaaaacattctggccaggtgcagtggctcatgcctgtaatcccggcactttgggaggcccaggtaggtggatcacctgaggtcaggagtttgagaccagcgtggccaacctggtgaaacctcatctctactaaaaatacaaaaattagcagggcatggtgacgtatgcctgtagtcccagctactcgggaggctgaggcatgggaatcgcttgaacccaggagatggaggttgccgtgagccaagatcacaccactgcactccagcctgggcaacagagcgagactccgtctcaaaaaaaaaaaaaaagaaaaagaaaaaacgttctgaaaataaataaaaagaaacattctggcacatattagaaggtaccagagtaagagaggcaagataaatcccagctttgttggtcatactgcatatcaaaaacaatgaattgtcttttctgttttcttatttttgtttagagcatagtcagtggttcaagaactctaagccatagatagctcagacactaggaaagatgttggctgactttgagggggaaccacttgtagctatagacaaccagaaaatgctgtggtccataccatgaaatattttgtcttactgaagtttgaagatccttccagatcccggcattgatctggagaatgatattctccacatacttgggctccaagtctttgtgtccagggcttggcaattaccttattgtatccagtggaataataattttgatgctatttgttcaaataattctgaatgtactaaatggatgacattgttaaatgggacatttggctgttacaggatgtgtgtgtgattgattaaagcaaattttaactgtcagaagatgaaggcactaaaagtttttgccatctaacaagcatcagtcagatatgaaaataggtgtttccagtcacttttattaataacataatcaacatttgtgctaaactagagttctttcaaaatggaatttggcaatgccaaaatagccaaaactacaaagctaccgtgtggtactggcctaagaatggacatatagatcaataggatatcattgagagtccagaaataacccttatgtttatagtcaattgattttcatcaaggatactaagacaattcagtggggaaagaatactcttttcaataaatggtgctgggacaattggatatccacatgtaaaagaatgaagttgcacccctacctcatatacacaaaaattaactcacgatggatcatagacctagatgtaaaaactaaaattataaaactgttagaagaaaacacaggagtaaatcttcatgaccttggtttagacagtggtttcttagatgcaacaatagcaacaaaggaaaagaatagatacattggactttatcagaattaaaaactattgagctgcaaaggacaccatcaagaaagtaaaaagagaactcacagaatgggagaaaatatttaaaatcatatatctaagagacttgcatccagaatatattaaaattaataataagacaacccaaaataaaaataaaggatgtgataggcatttctctaaaaaatttacaaatatccaataagcttatgaaagatgttcaacatcattagttgggaaatgcaaattgaaaccacaatgagatatcacttcacacccactatcatggctgaaatcaaaagacagtaaatacatgttggtgaggatgtggagaaactgaaaccctcacatgctactagtgggaacgtaaaatggtacagctgctttggaaaacataatggcagtttctctaatggttaaatataggattaccatatgacccaacaattctactttcaggtatatacccaaaagaaatgaaaacttgtgttcacacaaaagcttgtacatgagtgttcatagtagtagtgttcataatagccaacaggtggaaacaactcaaatgtccatcaactgatgagtggatcaacaaaatgtggtatatcctgcaatgcagtatgattcagcaataaaaagaaaggaaatactaacacatgctacagcatcaatgacccttgaaaacattaagtaaaagactccagtcacaaaggactacatatccatgtgtccagaaaaggcaagtttatggagaaagtagaaagtttatggagaaagctcctaatggttgctttgaaccagagttgaggggtgagggtagggtagggaggaatacagattgactgctaatgggatcttttagtagggactgaagtgttcaaaattagatcgtgttaacagttgcgatcatatattttgaacaagtggaaaggggggaatatattaaaaattgtacacttaaaatggtgaattgtatggtatgtcaatgataataaaggtgtttgttaaaaaaatgagttttggcttcatcgtaatcagtgaaagaaatatgttgagtaaatattaatacattattttatgctgtgtccattgactcatattttaatctgggaaatatgcatctttaattactgccattgtgtgcttaaggctgatgtgtttgggtagcttttaaaaaattttttttcttttaaaaaattttttgtagacatgggggcctcactatgttgcccaggctgctcctgaactcctggcctcaagcaatcctcccatctcagcctcccagagcactaagttataggcatgagccaccaggtctggccacagatctttttgacaatggaaatggttgttctttgatcaggtcaataaaataattactgctggcagagggatgtgcctcctgttcaatgtggaggtcattaggggcccctgggcttcataaaccacagggggaaattgagaactacttagtgtttctatgcactgagctcctaccgacgtaatgtgttaggtgtctaaatttgcactttatgatatatttcgccaaattttctctccctggcaatgaagtgatgtttacttaacagtttcttaaaagagatggtactctgtgatccatttttatttatgataggaaaattacacttttattttaaaagccaaaggtcatagccattgcagatattctagtaattattatttgagaaatcagttctcactgaatgcaatgacaattttctaaacctagaataggtgctgtggcgtggtaccagaggagtaacatatgtggcccttgttccatgagagatcaaagtcgttttggaatgtaaaacttaaacacatgaatattttggagaaaaagaatgtcatattgtagtaaattggggggacatagacctatgacatggtgagaatcgattcattgaggtttcccacaagctgtagcccttgagttgcaccttgaagatgaatagaatagaattagaacaaatcgaaagggaggaagagtgagaaggaaactggtccaagaagcagaggtgagaaggtacatggggtagccaagagaaacatggtgggtgagcatggcagagagtccagcaatccatgaaggtcggtgatagccagcccatctattaagcaggggttccattgtagattggttgaacaactccatgaaagtgttagttctggacagataagccttggcctgtgatttgaagtgggagaacatagaagtagaaaaccaggtagattgccattacctccacccaagtctgaggccaggaggagaggctgaagaaaggggtgagggtggatttaaactactgacaaacacctcccaccaccgcccccacacatgtatatttggtgactaatcaaatgtggggaaaccctagctaactcatgtattttagagagaacatgcctacgatatgtaaaggcattctgtagatcttggatgactgctccagactctaaggtgatgtgaaaatatattatgacaaccatcatacagacatccagagggatggaagtgagataacttcccatagcgacctagctggcaaatggcagagctgaggttctgaagtcttgaaatgaagatgttggaagggtagtgatgcctttgatgggaaggacagccttgggaaggatgacggaggcatctgctggggagtgggaagatgaactcaacttatcatactgagtttaggaggatgtgaaatatttaagtgaaagtatgtgtacgtataaatgtgtatatgtgcatggatacatatgtatatgttatgtatatataaatgtgtatgtgtgggcacatgtgcgttcatgcatgtacatatgtttattcatatatgaacgtctaaagtatgcaggtatgccttatgcatgtatatatgagacatgcacatacacccatgcatgcatatatgcaatcacatactttcacttaaatattttacatcctcctaaattcaaaatattctaagctgaattcatcttctctgtccctatccgacacctcctttgtgcttcccttcatacgtgtgtatatgtgcatatatgtaaatgtgtatatacctacatacacacacacacacatttgtgtgtctgtgtggtaaatgagccattagagcttagaaaagaaatcatggcctaaaatttagaattgagagtttggagccgggaggaatcatgtgaatctattataaagggtaatgtccggggagaggagagagaggagccttttgaacattcacagatagatcacagggagaaatggagatgtagccacaacaaaggaagattcgctgggggtggaggaattccttcttacttgggcaactgctctagggagtgctagcttccaagtaggagcccaagaagtatcatctgatgtttgtcagtatttttaaaaatatatttattgcgcttctactatacaccagtcaacaagtgaggggatggggacaccaggaaatgtcaggcgcgtggtgtcagccttcccggagcccgcaggcagggaggtcgtgctaaaattgctagcatagcacactgaggtgagctgtggcttcccagtacagagcagcttagattgctgtaggtgggtggctggaggcaggggttacagaagagagcatcagagctgagcctggagggttggtggcatgctgcttagtcaggtactcctcttggaggacaggaatgaggtattgcatgtaaattccttagctaaatgaaatatgtctttaaaacttttcgtccaagtattacatgccttctcaagctatcattttaataaggtccacattgccaattgttttcatttgtggattgtacttttggtgttgtatctaaacacctttgtcaaaagccagttgactacatttctgtgggtctatttcagggcgttctattctgttctactaatccatgtacgtccatttatcactaccacactgccttgatctgcatagctttatagttgtcttgaaatccagtagtctgagtcctctttgttctttttcagaataaccttggctatcctagattcttttcctttccgataagaactttagaatcagcttgtcagtatctacaataaggcttgtcaggattttgacctgattgcattaaatctataaatgaaattgaaaatgaaaccctcattttgaacatcagttttccagttgggctttaattcctagaagacctggaattaggagaggcccaaattgagacatgatccaggccaatgaaacatcacttaacagggaaagaggggtgtgtgtgtgcggtacatgagaaagcgagatggaaatcagaaccagaaagaggctgagccaggatcaatgactggagactcggtcccacaggcatggatgttggtcccagtgtggtgtatcgctgaaaagagtcaaactctgtaaaaatatttaaagaagtttattcggagccaaatatgagtgaccacggcccaaggcacagtctcaagaggtcctgagaacatatgtctaaggtgattgggtaatagcttgattttaaacattttaggtagacaagttataggcagacatcaatcaatacatgtaagattggttcagtccagaaaggtgggacatcttgaagttggtggggcagagtccagaccataggtgcatttaaagatttcctgattggcagttggttgaaacggttaagctctgccttgaagggttgaaatcagcaaaaagaaatgatagtagttaagataaggggggttgtggaagccaaggttcttcttatatagatgaagcttccaggtagcaggcttcagagagattagatggtaaacatctcaaagtattatgggacctacaaatattctgtttggtccgttctgagatctcagttttaatgtgaatgctggtcagttgtgccttatttccaaattgggaggagggtatcatgaggcatcttggtctgaactagtttttcagatttactttggagtccccttggcaggaggggtccagtcaataggttgggggcttagaattttatttttggtttacaggaggatgggcagagctgagcacctaggcctgagggagagggacaatgtctaggcctctaataaaggcaataggctacagtagttctgcagggaccatgtgtaggatgccaagcacatggtcccttgccatcaggttcagctgcctccccttcctccctttgggcaggggaaggcaggaatgcatgggccttccagagcctagctcagcccccagctggtgcctggttccaccttggcccttaggagagctctgacactctgaatgtcactggccttgtcttaggggccttagaaaccaatgagtgataattaaggaactggagcttgtatgaagaaggtgccactttaagtgtccctgatggttttgagttgccactaaagagctcagagccctttcaaagaattcagtctgagccagatgaatcttaatttctcaccctcaaattgagatgcagtcctttggagaattaatatttagtggcatggaacacaaatcatttcttttgctggactcttaaagatgtactagattgattttgtttttatgacctttcaaaaacatcgcagtctgttttgctagctccagcctgttgaagttttagaactcatctttagcaacatcaaaggtgacagggacagcctttgagaaaggtacgcatgaagtgattgctggcatcccatagtcaagtctcaggataaagcatccatattgcctttttttttttttcttttttttcctttttactagtggagataggaaacctataaataagcatggcagaggtgtcccctctgaagattgccccttactaagtatttacagtaactggatttctttattttgtcagtttctccaggaagaaaggtgatgtcatgctccatagcaagatgagagaaggagtttagggtttgtaatttttttttaatcaaagaatttaattgcaatttaatgacgagagagaggatgtttattacacggtggtccaataaatactttctaataagtttttaagccatttgagggaaggcttgctacaacaaaattgacaatcaggcaagccgctttgaaggaagcaaatccatgaattttcagacactgttgctaagcgcagctttgctttcccctctgcttccccccccccccccccccaccaacttgctttgaaaaagcaaagcttaaaagcctctattgtgtggagggggggaatatgctaatttgcagcacatttcccatcagactctttttttggcctgtcatagctgagatatgaatgatgataaagagaggagaaggtggcattatgagggttcggggttttgttattgtgcagagagaaaggggatgaatagggtggcacctccagtcacccgtgaagcccccctgggtctgcgggctgcctggagttgagtgggttctcatgggtctgttctgcccttcccccaggcactgccacaatctactggtgactcagcggccccctcgggggaaggccgtgtgtgtaaaatgaataaacacgccagggtggggaacttctacaggggactaggaaaggggacttctacctcctagataagtcgtaacaaagaaaaagagaaatcagtgttttgacatggcagtaacaactttatgagatatcaaggttgtgattgaagggatatctagatacatatcccttcaaagctgtcatgtcgtggtttcatacaatttgggttgcgtttatttttgtcaagtcttcagcttattcagttggctctcttgccggataactggatatgtagttaaatttttatgcattaaacattgatttttatggggcaaagttagctagcatttctgaacaatgagacaacagtattggatgcttactcctgtgttcaacaatatgaaaaacatgttttccttcttgctctgagtggttgattttttttgcaggaaagcgcattgattttgttcctcgtgagcactccttagctcagttttttaaatgtatgaattttataactgaagaataatgcatgcattagcaaacagctattaagacctgcaaaagtgcttccaaattgaaatttcgcatgagtcattggaggcaatttgtatatgtcaggtacacacgtagtgtgttctgtatagttcatgaaagtgaatcgtttgaagctagaaaaggaatgttaattgcattctaggtttgtgttgagtacttagtcgatactgatggtagtatgctttaggtgtgaaacaaaaatataggatgtctttactgcaatagtaaggtgcttttaaaaataaatacataaataaataaacatagcatctttgcttctcttgactctaaattctgaacagctaaagcatgacaaatctttgcactgtaaaaatgggacgttatttatatccacagaacttcattggatagaaactagggttagagctcattcatttacctctacaaataggtagctcacttatccagatgcatgcaggtattaaatgattaagcctctgtagatttttttcttccttaaattaaggtctggagtcttctgtttggtgagtctttcactggtatggtaagcatgctttagcattagaatcacacaacccatttaagttaccattaatttttttctgattgaagttgtagcagatcaaggatatcatcgtgaaggagcagatcagccacctgtatgagtgatttaaagtgcaaactgctactggttgtaagctcaagacttgtctcattcaaactctggcaggtcacaaaacgtttaacacatcttgcttattaacctcaacaggtggtgtaagattagcatttgagagccacgtgttctgaagaccatcctgcatttgtttgagtcagctttggcatgcggctaagctgtcactctgttcatatcttcagaaactagaagctaatacattgtcttgccaagcatttttcacatctagcactgatggtgtacctctgtgttttactataaaatgtaaaagttgaatgaagttgggagttaagcagactctgaaagtgagacttcttgtcactgatttgaaactcagggatgcactagcccctcttagttcttgatgtttcaggcaaaaccctgatgatggtgccatgactggaaaaaaatcctgtatagacagctttttaaaaggtacacgtaagactagcttttatctacatgttgtatttaatacttaatctagccaggaactcttctcatctgtttactacatcctcatttaatcttcccagtcacttgaaggtggatatgactaaatattacagtgtacaggtgaggctctgaggcaccaaggagttaagaaacttgctcccattgtagagttgaagaaaaactcctagctttttcactggggtctaggacaccccccaaaaaactgaaattcctaaaagtgtatcagatagagaacttctgattatttctcaagtacccattcagatagtatttcttctaggaagccgtgcttgccacacatcctctgccccttccagcttttattggccattcttgctggcagagttaagcttgactacatacttgcccccatggttccactcatccttccatgggttgtatgagtttgggaaggctgaggaccagatggctcttgttggccatttagcaacaccaataatagttgtcccgggctagatgctgggtctatactggtgaatgaatgagacatggacccaacattcatgtactcatgcacggtttagtctgctgagatgctctgtggttctagctgccatgacagtggcaccacccccacacacagggaaacaggtaaatatttgctgaataaaaaaattaatgtttgtgtccctctgttcacatgagcccattagctcctccagtgagaagcagtctccactctttttatatccacagtacctgacacaatccttggcacatggctggtacttgataaatatccattaagtaaacagatgagttattaactgacagctaagatgtttcgaactggtatgtcttaatacgatgacaagtatccatttattcttatgtaccactgttgctgccttccactgagaagctttcctgagaatgagtgggatctcaggttgagagctagaaattgcttataatccaaggttctcccctgtgagtgggtggagcaggtgaccattatccatctactatactctgacagagacaggttgacaagctccatcccagagttttattgccttcatgaaaaaaatttttaagccctactctggcctcgcctatcaatcatcacaactactttttattgactgttccttggtcttgagcaaagcccatggcatgcattcgcttacttaattgtatggcatggtttgtcagtggcttttcattaaaaagataaattgacattaacaagcattgatttccaaagatttatgttgtcttctctattgtgctctctcttggcccagtaagattttacttttaaaaggcattttgtaaaaatacaggaatgtggcttggcaaagatgtatatctttaggaagaattatctctgcctagtgaatatattgtagatttggcatttgagccttatcctaacagaatatttgctttgctaactatacatcaggtgaaaaaagagcatgtttgggtgggaatcaagagacttgaattctttagtcctatccatcctgattacagactggaaaaggaaagatgagctggatggttttaaaatttccctcctgttttagaattctgggcacataatgtttatttcaaataagaccggataatcagaagaattgaacaaaattcttctcgttgtagtttctgggaagaaatcctaggttgtttgactccagtgccttcatcttaaatgtctgtgtggtaaaatgaaggtacatagcctgccctctcagggccctgggtgacattgtcaccttcatggcatgaaccaaagacaaagcccaatggcagagcactagaaaccttcctctctgaattgaaagccatcacttagttaccacttagaaagcacgttagcccgttctgattccacttgagtgtatgactaactgacctcaaattgtttgtacattgaaagcacagatgaacacagttttgtttttgttttttaatagggtctctctttgtcacccaggctggagtgcaatagtgtgatcatggctaactgcagccttaaactcctgggttcaagagatcctcacccctcagcctcctgaataggactacaggtgcatgccaccaagcctagctaattttttttctagtttttttttttttttttttaagagatagagtcttgctctgttgcccaggctgggctcgaactcctgggctcaagagatcctcccacctcagcctcccaaagtgctgggattacaggagtgagccacagtgcctggctgacacaatttttaaagtgtaccattatgttgctaacattgcactatcttattctcaaatatatggaaagaggttttatcaaatagcttgtgaggtcagcatagacaatagcattcacttgatctagtaatcctatctaaaaatagaaaatacatttgtttcggcaatacagtatgtcattgatgtagaaattatgaatgtacaattacaggataaattaaaactgcccagcccttaagttattatgggttaatgcgagtggatatttgtcatctgctgtatgaatgtcagcgtcatacacagatttttagggaatgctgaatgtcagacagctcacaaagaagcaaagatcataactcactataacctcaaactcctgggctcaagtgatcctcttggctcagctcttgagtagctaagactacaggcctgagccaccaagcccaactgttcctcagattttgacctttcctctgagatgatctaaatctgcagattctgtgctatgaaaacattgtgtgctttttaatgacttaaaatattattggtagattccatgagatcactgagatttactcttcattggttgccctttctacccaataggatattttatgtttgacctggcagggatcattatttcaagttgtcccaatgcttttcaattttcaaaggccactgactatttagtggattaaaggacctaaatgacttcatcctacttctaatttccatcctagaaggtaaacagatgagacaattgaacagaagattgcatttgaataatgtgaatatattttaaaatgtgtggccttgtcttagtgtgaattatcatcagcaatagaccaaatgaaatagctccaatttttgtgcagtttgtgttttataccaaccgtggaccacccaagcagctgacccaacaaggcactggttttctgtagactttagtctgagggccattgacttacatatctataagtcctgggtactttcctgaactagcaaaagcaagaatgctaacatcagaaagtaaatttcggatacttcaacaagccacatgttggtaaatttcaaatattttgtctaactgcgtgttggatagtcacgttcttctgtaaattaatggttttcagtctttggtgtatctcagaatcacctggtgtgaggctgctgggtctaggatgttcatctcccttcatttgagtaggtagcttcatgaaagtcacacttgcagtagagtcaaaggaaggtgacaactacatgctcactcagatcacctgaatccaccctgccagttagagggctggcaaatatattcctcctagtctatcaatagcctgtttttttaattgtaaaaagtacataaatatattgttttaattatatttaacaaattgtaattcccagttcatgaaaagatcttaaccaatcttaaaactctctatcagatttctgttgagggtggggaaatacattcgaatgttaagtttggtttttcaatttttatatatttgatagcactaaattttatccattttgtttctaaaatacatctccaagcagataacagagcctgaattttattataaaatatctttgtaatggttttattggtttatcttttcattttttgctcttagcaatctgaagataataatttcagtgtaactgctttgagaggttgaagggcacaggttagtaagatcaaggctgagaaaaacttaattgcaccatatactttcaaagaaacagttttgacatcttgccccaaagaacgccaggagcccagtggaatccatcccagggttggatgatgtttagaggtcagtaagagcaggtgcacagtcacttgacctgtacagtcagaggatggcttaggtcaataggagtggtgatggagctggggccatgcctgctgggttgtagggcttcctacctgatgttcttttttccttataaccatcctgctgaactggtcacttaagacctagcgtatcttagagccaggacaagctctataagcatcttgtccatggcctcgtgactggcaagtgacagagccaagattagaaccttagaaccgagacctcccaattcccatcccaaccatcagagccaaccatctcaatagatttttgagaccctaaatgtttagacagggcctgattgtaaataaaccagtttccatgtgggtcccccaagccatttgtgtgtgtgtgtgtgtgtgtgtgtgtgtgtgtgtgtgtgtgtgtgtgtactgagctcttctacatccctttactcaccatatattggaccgtaagcctgtgcctgccttgtactatagtatccatagcttatttatgaaatgtcattgagccagtaaggggaaggtaccagtgacctgccacagcagcaaaagaacagactcctatagaatcatcacatacacccttaatcccactgaaattgcattagcatgccaccacatggccacagcgacccctgccccctttcccttgcagtgacaatttactggatcaggccttgcagtgaggggccagcttctgaacttgcagagccaggtacaaaatgaaaatgcaggccagttgttcaaaaggcaggaaaaaagggccattcacgatactaaaataaaaacgtttccctttcttccagtttctctctcgatttgtcaagacatttttgtttgcaacttaatgtcattttaaattattagtgtgaatcttaccaaccatccttcaattgtacagtgcaaattttagatgcaagtttaagaccatttgccatgtatgtgggatcactgacacacaatttgtattttgtagctagtacatacgtgtattttatacgaactagaacagtggaaatgctgcacaaagttaactcaattgttttgattttacttattgatattagcacatcctcaacactccctccctgtggcttgctagtaagtaaggaagaactgaaaggaaaaggaactcggttgccctatctttccctttccttctggattattttcagtttaagtgcttggccaatacagggaagtaacaggagtaaggaaggatatggtcaggttccttggtcattcatgtctcttagaactccagtaccttctttctgcatttgaagcaagttgagcttagaacagaaagtgtgacctttaggactgttcacaccagtgcttacttagtcatagatggaacatgcttaccttttacggactttgagtccttattgaactccccatgcaccagggattcacaagaattctgagctcatgggacatcatgaatgtggtatgcaaatgaggtggcaaggagcacgtagctcctttgctcacatgcgtgcatcatggtcccgttggacttcacttgaaaacacaggttcgaagataaaatgattaagaatttcaagacagtgccatcagagtattaaaccaagcttcaggcccttctgagggcaaggctctatgcacatcacatgcccctgaagctgaccctgcttgcctgattctctgacatgaagaaagaaattccactgtgctttaaaaaaaaaaaaaaaaaaaaaattcaggacagatttaatttggacttgagtacccaggtgttagcaatatcctacagattccagaaaacaatttagtccattgttgaaagagtacccttgaaggcatgtctttttttaatcccattatcttattcatctcagttccttttatttatttgcaacttagtcaatctcaggtctcacatccaaattggacctcctcagggaggaccatgctacaatttgaggacagagcacaggtctggggtgggaccgggtggagtggggagtgcccctagaaatccaggccaggcaagggcacagaaatgaacttttcagggtcagggaaagatctagaaggacgtgaaatcaccagctagtctttcctctctctacctctccctgggacctgtatgatggtggtgggagcataaaggactttgaaaatagaaatagcattttgtaagtgtcatgtaggaggtatcatgctgaggtgctgcatgcagtgttacactcctaacaatagccttatgggggaagttctcttatgagtccttttggtagacaatgaagctgaaactcaggaaggtcacatggtatcataaggctggtaagcattggagtggggctggcagggatgctggacaaggttgcagacatgagagccttcctgagttgcggaagtgtgtggccccatgttttatcagagtttgaaggggaactccagattactaggttttggggagatagttgcaagtgatggaatagccattctgagtgaagctttctttggtggtgacctggaatctctgagttcaacagttgatgctgctgatcacctagtcacctggggccttattgagcttttgttcctgccatcattgctgcctgactcttggtttccctactctggcatccagtggcctgagtcaaggttcagctcagcttctgaccagcttcttgaccaccttggccaagtccgtgtacagctccctttggtcttcgtttcttcatccatgcaagggggatggatactgtcatgaaggcaaaaatgaaagaacttgggttaaagttattgtagtagtgctggtgctgaggagaccctcagctttgagtgttggcttctgtccattcctcctgagctactgtcacatctcatgtgggtgcagtgggtcctctggacacagcgttgagcccagtccatgggttcctcatatagccagcaccttggcctgtagcaaataaaaacaaaccacttgaaaggaactcgccaagtatccctgatagctggcactcacagtttgtttgtgtgatgactttgcgtattagtcattttcctgttgcttataacaagatacctgaaattgggaaacttacaaagaaaaaaaaattatttcttacagttacggaggctgagaagtgcaaggtccagggggctgcatctggtgagggccttcttgctgatggggacagtcccaaggtggtacagagcatcacatggcaagggggctgagtgtgctaactcaggtctctcttcctcttcttatgaaaccaccagtaccctcccatgataatccattcatccattaacacattaatttattaatcatgaatgattaattatcatgacccaatcacctcttaaaggactcacctttcagtactgccacattggggattaagtttccaacacatgaaatttggggatacgttcaaaccataacagttggtgatagttgcagaggagcatgtacaaagattagaaaaatataaccaacccctgggtttgttggatgctttctgttgctcagatcattgtgacatgagcactgtaggaggggtggatttgaaggggtctggttccccaagaggtatgtgggcatctgtgtgcctgcatgagaaagcacctttcctggcagcccgacaggtagaaactcattaatccacacattgactctatttcagggaaagatgacgtcaactcctgcatgttgaaggcagggagtggctgaaacagcatcaaggcgtgaaggcttccctgagccaccctgagttctcagaagggttcttaaagaagtcacgtcatctttatcgctacttctgctgcacttatcccataattttccaacttctgttgtgagaacttttacagcccaagtgtcctgtgatttaaccttcaatttggtaatgtctgtcttcctttagcaaagcaggctgaaggtgttgagatccgcctaccttgggaagctttccatggtggcacagtattgaaggttaggcctcatccaagttggcacaagcctttgtctccaacctgggtgggaggaaggtcaaggcagatgagtgtcctttcagtgcagggaactgccatccagggaggcttgcatttataactgagagacagcggggtgagttagaatgctaagaagggggaaatgggctgggcgtggtcacacctgtaatgccagctatttgggaggctgagacaggcagatggcttgagcccaggagtttgaggctgcagtgatccatgatcgcaccactgcaccccagcctgggtgataaagtgagacctggactctaaaagaaaaaaaaaaaaaaaaaaaaaaaggaagtcggtagttcaccaaggaggctttctaaaggagatggactttagcccgtgcctttcaggaggggacttggagctggggagatggggagacagtgcgattgggattttggcagatgatataaggcaaatcctcagcagagcaccccgggttccaccagctttgtggttgagttgcagactctttgagtgagagaataacccagccccggtggtttctgctgaaccgagaaggaactgctccagaaacatgacagggattccaataacggcggttaaacagctaacaaagaggagtctggaaggctggcccttgttcatgttggctggaacatgctgggtagatgagttaattgggggccctcacagggaatgctcattgtgccactcttaatgagagaatccaagtgccccatgggatgtaataattaggaagcatgttgtcagtagatcagctgtctgtctcctgatgtatgccttgtgtacacaggaagaaatagaagctttcctttaaaaaaaaaacaaaaaaacaaaaaacagggtctcactctgtcacccaggctggagtgcagtagtgtgatcatagctcactgcagcctccaactcctgggctcatgcgatcttctcacatcggccttctgagtaactggaactataggtgtgccccgctacacttggctatcttgtatgtatgtatgtatgtatgtgtgtatgtatgtatgtattttaatagaggcagggtctttctatgttgcccaggctggtcttgaactcctaggctcaagcaatcctctgccttgacctcccaaagtgctgggattacaggcatgagccacactgtacccggccagaaactttcttaaagctagtttaaaaaccgatcatttggtcctcatttcccattttggctttgtttcttcagtgtggctctgtcatgttggggcccattcccctcaggatgctgagacgtaaggtaagggtattccttgtctccttcactctacctccctagggtctctgtgcccctggaaactcagccctactcaggtccccgggcagtctagactcagggcaatccacctacctcactaagacccaagatcatcgtgccttccgttttgtcacccataaaacagagctgatgctttctccttcttagggctatgaggtgaactaaatcaagacacaaatgtacccttctcaatgctggacaggttgcccttttaacctctccatccctaccacctcttctaagatgaaattccttaaatcttggagttggatgacttttccttttccctctatttcctcttcctcacttccatttcagaaggagaagcatcacatcctgccacccacagctggccctcttcctctcctgtgatctccattcatcatctgtccatcttcaccggcatcttttgaaacctgtctttcagtggccgtcactgccttttcagcataagacatgtttgggcctctcttcctgactgtgtttttctccttaagctgcctgcatctttctctggccttcccctcaccaccaaatttctttagaaagtgggctgcccctgcttcctcttcttcacctcccaaccgaacttctgtagcccccctgtaaagtggtttccattccaggctttgcactgatgctggcaaggacatcggaattttccatttcagtggcctttgccaagtcctcgccttctggttgccttgactgtggggacaccccctccttcttaaaattccctcctcctctgtgacagggccctgtcctggatctttgccaacatcttgtgcgtccttcgagggtggttctcccactagagatcccctgaattaggaggcacctgaaaggttttctcctctgtaccttctgccttggcatcccacccactcctgtgatgataataggttcctctctgctggtggtaacgctcaagtcttcatttccaaactctgcttaggttgagcagctgcacagacaccacccacatggcttccaaacttgatagtccttctcactctccttatctggtgtgggtaggattgtgtcccccacccccctcaaaaaatatgttgaagtcctaactcctgctacctatgaatgtggccttatttggaagtagggtctttgtaggcataatcgagttaagatgaggtcatactcaatgagggtaggccccagtccaatgtgactggtgtccttataagaagagacacagacatacacacacagagaggacaccatgtgatgacggaggcagagatggagtgatgcatctgcaagccaaggaacgtcaggattgcaggctgaaaaaaggatcttcccctagagcattcagagaaaacatggaaaacacggccccgcccacaccttgactttggacttctcagctccagaactgtgagagaataatttctgttgtttaaagccacccactttgtggtactttgttctggcagccccagaaaaccaatacatcacccgatctctccagttccctatgggactcactatccttttagggatccaagctgaaagtctcaggatcaaccctgaatctctccctcttgccttaatacccagcttttcatttctgcctcaggtgagtatgcagtccccacctcttccctaatcaagtatggtcgccctgactctgccctcttcagtctcctatctgtccatccagctgccctctggacaattttcctaaaacagctctgattgtgtcaccatcatcgtagcacactttgtctgtttccctcctgcctccagcagttggctgcatattggaattacctggggagatttgaaagctctcatgcccaccacacaaccccatctgtcaaatcagaatctctggaggtgatgccccagcatcaatattttaaaaacttcccctatgattccagtgcacagctaggcctgagaaccatttgctgatagaatatcacaatagccagacaaagcttacggaagaaaagatagctctaaggcaatggttctcaactggggatgatattaccctccaggagacacttggcagtgtttagaaacattttaggtcatcagaaccggggtggtgctcctgggcatctactgagtagaggccagggatgctgttacacatccacaatgcccaggacagcctcacaataatgatccagccccaaacatcactagtgccaaggtggagcaatcctgatttaagagcgaggagaggagcagcaataccgaccttgactttgggacagacagatgcagtagacaccagtgctgaggaggcacatgccccctcatgccgcagtactgcctgtgctgtgcccatttggcagcccagtatgttgaaacttttcatgcagcaccagtttccatcacaggaagcctcagcctgctggtgccaaacttattctcttgctctccttttgaaaatgaggttcagtggaagctgggtgcggtggctcatgcctaatcgcagcactttgggaggctgaggcaggcggatcacttgaggtcaggagtttgagaccagcctggccaacatggcaaaaacccttctctactaaaaatacaaaagttagctgggcatggtggcacacgcctatagtcccagctatttgggaggctgtggcaggagaatcgcttgaactcgagaggcagaggttgcagggagccgagatcatgccactgcactccagcctgggaaacagatcaggactctgtcaaaaaaaaaaaaaaaaaaaccaggttcagtggaatgtttttgtcaggagagaaagggtcattacaactcaagttggcttttgccaaactcagcaatcactgttttggtggctcctgaggctcctaatgaggacactgacagtcgttaaataaacaagtgattaagttgagaagagactggctaacagaggttccatgtgtgctcattgtcatcgatgttagccagtttcatgacagtgacctgcctgggctccacctctaccattaaagagaaacactagcaatgacggcttatagttcacgtagctttaccatttataagcattttcctatacaccaaccagtttgatttgtcttttcaagtcttagctttatgcagtgtcatttcctataaaggaaagtatagcaaatatacaagaggtactcagaaaatacaagaagaaaaaaactaaaaagagtaagggatcaaaagatatttttttaaaaacccacattggatgaaaaatgagaaatttaattccggtaatggaggacaaagtctttgccaaattgataaagctttgggaaattctgattatggaaaggacccaaatgtagacagtcacattctaaattcctggctccatgctatgtgtccagtttctgtgtttttaaatgtatgcagcatttttaacatcacagaattattaatatgttgaatatcgttgctactttatataaaaagtatcttttctgtctactatttaagaattcttgctgtatttatcattctgttttctccaagtagacagagggccgatgtatttgataccagaacacatctttgattttgtcatggggagcagtgtgaaaataggagtcacaagaccaggcgtggtgactcatgtctgtaatcccagcactttgggaagccaaggtgggcagatcacctgaggtcaggagtttgagaacgtctggccaatatggtgaaaccccacctctactaaaaatacaaaaaaaaaaaaaaattagctgggcgtggtggccccacgcctgtagtcccagcgactggggaggctgaagcaggagaatcgcttgaacctgggaggcagaggttacagtgagccgagattgcaccactgtactccagcctgggcaacagcgcgagactccgtctcagaaaaagaaaaaaaaaaaataggagtcacttaacacaaacttattttaagcacaatttatttataatttagaaaaaagaaaaattgctgtgtaatggggcttgaagagaaaaagaaataaaatttgttgagggaggtgtagagcttgttctgggtattgatttcctttgaggggcaataaggaaggattatgccagggtgtttcttgttgcttaaatgttccatgaaacaccaaaattgcagaggtattagtagttagaaagaatgtggaaacatccctccttctgattaatgactgccccctgaggagtccttcaaaagccagaagaaacctaaaatatcatcctagaaagttggaaggaggcatttgacaaagtctttgctagctatgtgactaggataaggatgtgtcagtatatcattatgcaacttgatgaattctcggtcagctgaacagtcatagtcatattagcatagaatagtgattcgggtcaggcacgatggctcatgcctgtaatcccagcactttgggaggctgaggcaggcagatcacctgaggtcaggagctcaagaccagcctgaccaacgtggagaaacgccgtctctactaaaagtacaaaattagccagggtggtggtgcatgcctgtaatcccagctacttgggaggctgaggcaggagaatcacttgaacccgggaggcggaggttgcagtgagccgagatcacgccattgcactccagcctaggcaacaagagcaaaactccgtctcaaaaaagaaaaagaaaaaaaaagtgatttgatttctggcctttaataagtgcttaatgaatcttggatgaataaacgaatgaatgaacaaagaaatgaaagaatgaaccagccaactgaccaggacgatgtccatagaggtctacatgggattccctcaccttggtcttgttgtgttcaacatttctatcaatgatttgaatcccagacacacaaagcatatttactatacttggaaacagaacaaatctgggaagatcattaatgtaatagatcacagaagaaaaatccaatatgatcttgccaggttaaaaacagggccaagatgtacaggcatcagccaaagccctatgtatgagtttaacatgtcaactggaccttgggagcctcctattttgagggtgatcgtgaaagagactgggaagtgttatatccttccccatcattcagccttctcacagaagttccaaaggctatttggtggtaaaactcctttctgcttgctagtcctcatcctttttcctccttttatggtatttgacactattctacactgttaacttgatgcccttcacagaacctttctcgaatttcatgattccactttggtcttatttccctcgttttctaatttgtccttctttgtttcttttaccctctttttaaagtttttcctttacctttacatttaaaaggtagtgtaccctaagctctaatcttggcatacttgaaatctgtatctctccctggttgtttaacattgatttaaaatagattttgttgagaacccgctatgtgcccagaagtgttccaagagctcttagaatacagtggagaataagacaacaatttctgcctttaaggagcctgtattctaggaggatgggaagtgatgaacaaataagtgaataacagtgttgagtcgtggttaaagctatgatgaaactcaaatccagattaaggggaccaggaatgtcagggctgctattttagacaagagtcagggagagtcccctgagaagatggcatttgagcagaactgggcttcttgtactcccagggctgcctccacactgaagactcccggatgctgctctctggccagctcctctcttctggagccatattcctgaatgcctcttagtccctgcaggatgtcctaagagcaccttcaaccacgcttgataatctcccctaccaaacttcttccttctctttggttccccatattggttcccagcatgaccatctcctcactcacccaagctagaaactctagcctccccttcaaatcctcctccacccctactcatacagatccaatccaatgacatctgggtcctcacttcctccccgtgccatagttcaggttcacactatctcttactggtactgttgcaggagactcctgactagtttgccagcctctagtctcatactccacccaccctgtcttccacgttaccaatagaatgacctttgtaaagcacgatcagctctgctcttgagccttctatctctacctactgcctctagggctagcaaggtgttcaacctacctggttcccaacctactggctcagccatctcccttcagtccctctgtcagaaaaatcacttcctgaccctttgacagtaccctctttttcctctcatatgcccttcagtttttcctagaactctttccgttcctctttcctgcttttcccttccctaccctacccagcaggtttctaagcattactgcaatagccaactcaactctgcaaagcttttttcaaattctcttccccctccatccattttctttgttgtgatgccatagtgcttgtggcaggcaggagcaccctgttttagaagagttttctgtgtcccattagccgtgggttacctggagacaggcatcgtcacttgtgcatgtctgtgctgcttgtagatgttggcactagggaggttacttcatgcatgtttactgagctggctgcaattatacagaagacttacaaacatataagtcaaaccacgtgaaactgctgttcttcttggtcaatatcagcaatttcatatgtttattctaatctgttttgttcagtattttgtattcctgttttggctttcagaagtgttcttaccttcaaccagactgccttagagcatggggctcaaagaaatattttcagctctggaagacattttccatcctacttctacatatagaacttttctggccaaaaatggatgcatatctcagaaatgtaataagcaatactcttctctcttcctcttgacaattgtttttcaaatggtttatcataaacatcagtgagatcttgaggctgttataaagtgatataatggtaatttctagaattgtaatacattatcctagtgaaaagaaaatgatgaagttgtgaatcaggcaaaagtgatgaattgctcatttccatgtagtttttcaggtggaaagtagatgcaggtatcaactggaggatgtgtgaatattttgtctaatggttttgatctcgatatagaactagagttgttcttaaattaagaatgtctttcatattctgccttttcaccagcatcactattaaaataatattcttaagcaacagccaaaaaattattaggatctgctggttctataatcagatgtttttgctggacactttaaaaaccaataacagctaatcacagtgtcctcttttgtgctgaattgaattttgttttggttttaattctcatttgaactgctgggaaagcaagcctgttacataccaacacttgccacctttctatatttgaatggacctaagtagtctttgcaaaaaatgtctaagactgtcctatccggacacaccatagggttttcccatggaaataattatatcacaaacgaatcttttttctaaagtctgtggttttaggctgccatacttctcaatcccctgaccaggagacaataaaattggctggggccttaatttgagggaatacatatttgattgtgggcgtggtcttctaagacaatggtaaagggaaaagcaagatgtaaaattaaacgttgaaacaagctaaactggttttcaaaatcttctcgactgtaacacatctagaagttctaaatataagaaggtttgagggattatctaaaaccaaggtattaaaagatcaggtttttagaagattttgattcagtaccttatacttttttttcaaggagttgagcaagaaaccatcaaaacttaggagagtgattttaggagagggtggtctccaacttgtctttatgtttgcttccaagataagtgttaagcccaaccaactagcagactattcatgatctgggaatcctatcagtggtcatccctgtatttgacttgagtctctctaattttttatagggacggcgaaggccagttggtcagccaaatgcataaaaaatggtgcagaaattagtgatgcttggaaacatggctcataatcatgataaaggcttatatgttggtatgggttgagaatgttggcctcatggtatctgggtatgcaagaaggcaaatcattattggtatactagcctttatgttgaatatttagagagctcttgaaaacaccccttcgatttggagtgaggaattctaatgagtaaaactccatgtagaaataaccatatccgattaaaaaactattttgattttcattccaagaaactaccaaaatgtcagctcgatatacttgtgaacatgttatgcttatttttaaataaggaagggtgcctttttacaaattaggcttgagtttctcttactatcatatatattaactatagacaagggagtgggttctaataacaaattgctacattgctatcgttaaatccgtgtttgagttttcttccctctaatgtattttctccccctctttaatttatatttttaaaaagcaatgtacttatctagaaattgtatgaaagacaaatatttaagaaagtaaatagagactatgggcacgtcctttgaatatgttttgccagggtcgaggggtaaatgaaataaactgatacatcataaatggaccacacaggaaagaaagtgtcatgcctatgcaaagacatgcattctccttagagacgacatatattgctgtcgaccaacaaagtcacgtggtgggagggggctcttttctttctccttcacatcccctcctctgatgtcacaaatctattttttcctgggagaattaattagcattcattgggtgtacttggctagaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggtacccagcgctctgacaatagcctgtttaaagcttttcactggggggtgcttaaaaagggttagctgggttttgtctctcttttaaaatggctctgagacaatccctatggcatggtcttgctttcagggttgatttttttcctgtgggctgatgttaagttaatagagcagcctttcttcaatccattcctgttccaaatctttctaccgacgtgatatttcatagagggatgtctatagtttgtcaccttgggctgatgcattggggaaactgtctttttttattaatataattaatcgtaacttaggtcttgtgtcctgcatgttatattccaggaacgtggaatgtgtagttttctgctaatgctgaggaggaactggaggggcatgcatgttaattctgctttggttccgctaatgctgtagtgatttgggcattctctaattttcttattctaatatgattgctctttcttgtatcaggccctgactacgacatgtaataatcatttacagttggagcttcagagaggggacatcagctctgtcacccagtgctgatggaaaggcagggcgggggatcttctgctaattatgacttggagactggggggaagaaaattgataaaggtcctatttcttaaagagaatcttagaacgtaccacaattttcatatacagaatggttttttggagaataaagtgtttttgcagtaagaaaatggcagaaaggaactaaaattaatctcttttttctaaataatgactgatttcaagtttgatgtcccatagaatcggctcagccactgttaggttaatggatctcactgcattgtaattttccctcactcaaagtcatagactgtcataaatgcccaaaaacatattctgtaaccgcagtggctctaatataaaaagccatcatgctaaggttatttctcacagcccttgcgtccactgatagtcactaaagagtaattcgccagtacggggacaaaacttcgttttatttataaagatacaggctgaaccatatgaaattgctgatagtcaaccattttaaacctacaaaaacggcaattacatgtacttcagcttcacagtatgctggggtaaagactgcttgtttttatataaaatttctttggtacacaataatattttatcctaaacagagcaattttactttttaaattaatttttttaggtatcacacaatacacataacataaaatttaccattttaagtatacgattcagtggcattaagtacatagcaccttaattttaaaatcgtttgtttagttcaatcctcttaccaaatctacacctccccaccaaaaacccagcctgtattttcttgtgtgtctttaaaaaaaaaaaatcttcatcaatgaccaaatagctataagagaagctcttgggaatatttatcaagatgaagaagtgagatcaaagttttttccatgatgactagagactaagttgattgcatgttgtcggggtatgataatgtaatagcattgtcccaaggaagcctatcacgattttatcctaaaatgatgattttacttagtacatacttttaatttttattaatgtggtattcaaccatggcagataaaaccgttttggtctttgcaaaaaaatcccttttttaaatttctctctgaaaggaagcaaaggtcatataaccaatataaaatcattactacacaactgtgtatcttatcacttagtcttatggactgctattattttatgtcaattaaatcttatttaataacagatctacaggttgctagtacatccctgacaacccgtatatgaaaagtcattagttgtgattttagagacaaaattagaagcaaaagataatttgtgaaggaactttaaaaattacctaaatgtataaacactagctgcttgttaaataattcaaaaatatcacactaccagaagctagtgtgacatgtatggtacatgcttgaataagaatacaagccaggggatttgtttttcctgatctacagcaagaggggttgtgattgttgtgtgacccaccataattgttgatctggagggtggcttatctaatctgcatttagatgaacaagttcatatgctggctacacaaaatcaaagcccacacaagacactttgtagtttcccaatttgctcacccatcatcattaaggtacacataggataaaatgatagccacaaatgtttctgcgtgattgtcacatcagtattccttcagatttaactttaagtttattaaaaaattatttttccattgaaattaacatttgaaaacttgacataattatttatagaatgtgttatataattcttgagctggtggatccgttttttatgtttttcttttaagcctttcagcaaaggattttattcattaaatttaatcctgtaaattttgtcactttacgcagagttttttatgcacatatatattttttttcctgtgtttctcctttcccatctgttttcagtggttggtgatggagtgatgcctgtctcttaatttggggcattattgcccaatggctaatacccaatagcatgtgaattaatatctttggataattattgcagtgtctattaagaactaagaatgtaaattaaacttagctttataaattgaccttgcttttctagttgggatctttcctgggagtttcagcgggacaacacaacccagctattgtgattcactaactcctacaaagagagctctttctttaaacttaatcacaatgactttgtttctactttagacaaaattaatccatgtccttaaaaaaggaaagcatttgtgttttttcagtctgatagttttcatcacagcatgctaccagataccaaaattcacaagagtatttagtagatatttagggatttttaaggaaaacaagcagattttcttagatggatgtaagaaatgccaaattattacaaatgatagtttttaaattaaaagcattaaagtgtgaagattgagtaagcagattcactgacatggaataagcagaggaaatgaataagacagaatcaaaagaaatagatcatggaacccaataataaaaagatggagagtcggtttccattgatttcagtggagtattacttgttgtcatttcatttgtgaaaataaatgcatctgaaattgctgagagtggataatcactgagtagaaaaacaattgaatcataacaactttgtatgctctattatgggggaaaaatctatctgttatgaaaattattttcattatatgtaggtaattgaattctactgaaacaattatagtcaggttagttaacttcctatgaatcgttgctgaaataaattacaggcatcaaattaaattcctaaccacacaggaagaaaaatatagtgaatgggaaacaatgtgtaatttaaaataaattacaggatatagtcaaagtaagaaatgaatttaaattattgacttccttaaaaaattaatacatctattttaatctttttgatcaaatagatataatttcttatttttttttttaatttagcaaaatgtatgcacttttggctctcatttttcgtttaggaagaaaagcactcctctagaatatacgacttgtgtgattaaaaacccaaagggacacataacacacgtcacactattcctgatgatctgcgaattattgcattttgaaatttgtgttgacattttctaacttggctatataaatatggtacagaggaagttttagatgcagttattatctgtaagaatttgccaaggtggacatctgaagagttggtgtctggggaataggctgtagagaaaagtggctggccagatggtgcggaacatatgtggtaggtatgatacagcttcctttgattttttttttttttttttagaacatttaaatgtggaaaagatctcaacgagccatttggtacatcttctacttttacattattaattccattaggatttttttaaagacttggccttgctatttcgttagaaaaagaattctgggccatttctggaaatttagatttgccttccctgaaattgagtgtaaaccctgaattaagattattatgattttcaagatcacatttctctgttatttggaagtacagggtcaatttagactaaatgatcttaataaagtgactttgtcttgatgtatctgagaacatgcaaaataaccagtgtccccatgacttaaacttcccctctctgtgactgtgatggattggattggattgttacaaagacactctcgcttttttctcctttggaccaaatgtacatacatgggagatagttggccaggagtagggatggccatggaacggaggaagaaagtgaccacaccgactgtttttaagagaggaaggttacaatcccagtttcacaaatgtgctttgttgttcattcatttattcgtttaatggtgttctctgccgggtgtggtggctcacgcctgtaatcccaccactttgggaggccgaggcgggcggatcaagaggtcaagagatcgagaccatcctggctaacatggtgaaacccagtctctactaaaaatacaaaaacaaaattagccgggcgtggtggtgtgtgcctgtaatcccagctactcaggaggctgaggcaggagaatggcgtgaacccgagaggcggaggttgcagtgagccgagatagtgccgctgcactccagcctgggtgacagagcgagactctgtctcaaaaaaaaaaaaaaaaaaagaaagaaaagaaaagtgttctcctttgaaatgtcattcttcctctgtcccttcagctcacgttacaggagtacaggggtgctaagtcatcgtagggaccattaggggtagtataatcttggttttaataataattttgctgattggtggcagattaaatagcagacaaaatgccatagacgagaattttgatccttagccagctgagtgatatttctcgtcaaagagtgtataagagaaaatgtaataatttcctatttgataagctgattttatcaattgcattaactgctttatgtagccaagccttattatgctgtatttaaaatcaagggtcaacacactttttccgtaaaggtcagatagtaagtattttaggtgctgcagaccactcagtgtctgttgtaactattcaaatctgccactatagcatgaaagcagccctagatagtatgtaaacaaatgggtgcaactgtgttccaataaaaccttataaataaaaacagatggctataatttaccaacctttactatatttatagcattgttatggcattccttaatattttaaataatagctaaaaatgaaagataacaaatatagctttgaaagaccttgctcagtgaatatggtctttcttggaagctcagtgtttgtcacttagttgcttccggtgataatttcctaggtgctaagaagcatgacagtctgaagttcatttgttcagccttctcgctaaattacattaaataagtaaatggggaaaaataaacaaggcattgttttgctttcctttttgcaatttccccttgtttcatgcccacctttggcaatgaccactcacagctgtgtctgtcttcataagccaccactggtcacctcatctctatcttcactctcttagggggaacattttgcagttttccctctgcagggcataaaccattttcccatttcttgccaggtgcccagaatcaagacattttaaaagaccttttgagccaaggcatcctcttggaatcctgtgactgccttttaggtgttgggatcctgtccttgggattaaaatgtatactgtgttttttgaaattttataaataactttatatttaatgcctttatttaaatttggctcaaaaatataaaatagaagtgatttttcttttctttcatatctaaagatttactgttgtaaaaaggcccctccagaagtgtaagtccaggggatttggaacacatccatccagttgccgatcccatcggtgtgtcttctggatctattctttttttttttttttttttttaaatcctgaattaagggtcttaggcatggctgccatgtttttctcagaaaacacgttaacattgagcagtccatggtttttcattgtcattgcctagcagcctatgcttgcttgcctgaacatctggagacttaccccatccatatgaggagatgagcacagagcatggatgaatcttctgcagagataccctgaattgcatggcctggcttgggtaaaagtcagcatggtgggggatctagaggtccatttctggtccacagggtcccagggtgctcccttcctttcaaccaaatatttattcagccagcgtttattgggcacctgtgtgctgagtatgtagagacaaattttttaaaaggataaaaatttccagatcaaaagtgatagaactacttagaatcctcttgcttaggggtctatgtggagggctcatagccccctttaccaagaggaaatcagatcataccatgaagtgccttgaccttctgttttttttctgtcagccccactgggttttcttgcctttggagaatgtagcaacatctatttctgagagagaatctcctgaacagtaaagcaaaaatctaaatctgttttttgggggttttttttctttctttttttgagacagagtctcaccctgtcacccaggctggagtgcagtggcatgatctcagctcactgcaacctccacctcccaggttaaagtgattctcctgcctcagcctccagagtagctgggactataggcgtatgccaccatgcccggctaattttttttttttttttcctgagatggagttttactctttttttttttttttttgcccaggctggaatgcagtggcgcgatctcaactcactgcaacctccatctcctgggttcaagcaattcttctgcctcagcctcctgggtagctgggactacaagtgtgcgccactatgcccagctaatttttgtatttttagtagagacagggtttcaccatgttggccaggctggtatcaaactcctcacctcaggtgatctggctgcctcggcctcccagagtgttggaattacaggcatgagccaccacacctggccaattttttaatttttattttttatatattttttttatttttagtacagacagagtttcaccatgttggccaggctggttttgaactcctgacctcaagtgatccgcccgccttggcctcccaaagtgctgggattacaggtgtgagccaccgcacccagcccacaaaaatctcaatctaaggaagactgaaagttaagaaattttaagaagcctgagataacatcagtagcttaggacctggaccgtttctttaggagacacagaagcacaactcaactgcaaatgcacctcagaaaaactctcattgggttaactgttgcctcagcagaagagtagaaaattgcaatacatgcagaggtcacagtaggatgtatggtggtttccaaagtgtgccctcttgagtgaaattgctaaggttcacattcaggcttctctacctcctggctgaaagatcttgggcaagtgatcattaccttctccttgcccttgggttgttcccttgtaaaaatggaataataatagtacctatttcagagggtggttgtgacaaatgtaataagtaccacatgctgagtgcagtgcatagtacatcataagcactccataaatttttgctgtcatcatcattgaccacaaaaatagtttcattgtgcagttctgatcttatcccagcatcttttctgtacctccctaccctggttttaaatgagttatgtataccttaccttgaagtcaaaaagattttttctaaaacattctagaaaagcaggtttctgcttccaaacttgaaataccttacaagttttcagagattgtggagagtggagttgggattttataaaggctttgtgaggttttacttgcctcacactgtggctttagtaggttcttctcctcagagacctgagctgccagatggtgcattatgacctgatcttctgatggaatcattacccacatcaatggcacaatttttttttaatccttaaatatttgtggtgccccagaggatataaccccttattaggttttatgggattctcggagataaactggccatagcgaccttatgatctctttgagatttcaagattgtaattcaactaacttttatgagaagcctactctgtgccaggcaaattggtaggtatttttctttgcaatcccctaagaagtgggaaatattgtatcatattaccagatagagacctgagtcctcagggagtgccagctgtcaccatgtgtgtaattaagcagtggttcgagcccaagaccagtagccctttctgtatagcacatgggagaaaattggaacaggatttaatccagaacattctagactctgacgttctgagtttaagataaggtgacagacaatactgcagacgtcaatgggaggacaagcatttcatccaagaaacagcagaccattaggttgtttgccaggttttctggactagagctgggtacccttacagagagggagcctgcgttcacctttgctagtgcagctggcaataattatagtgctctgttagtgctctgttggtctgaaaaggaaacagaaagaaaaatattattgtgaggagccaaattttcactataaatagtatcttccccaaatgagcattttaagaagcaggatatggtgtgtgttgggggaaagatgtagaaaataaagatcattttggtgatttacataaacttcaatttagaaacggaggacattctcaatggatcatgctggtactgaagggttgcatttcaatagcatattttttaaactccccatttcctttctatggtaaagaataaataaaaatgctgatatagaatctttgctggagatagagacactgactctttgccacctgaaattggcagtgaacagcagagctgaaatggaaattggcaggtaccactggatgtacccaggctcaaagaaccaccagtaccatcccgtgccaaccctgggggacagggctagccccttgagcagtccaggtaaatacagccttggggtgaattctaatagcaagtcaactgttatctttaatattatttgtaatggctcttgcagcttggtgatattttatgttttgcttggtgcattaatttgttcacacgggcatgggtggaattcgccctataaacattttttaatcatctttctttttctctctccctctccattccaccccatctttctccactttcttctccttcttccctcttccctctttcaccttcaatcacttcgtcttctcaaagggaacaatgtacagtgagatatgcctttggttaaccatgaaatttccaatgcctgaaccaataatgggggaggggggccacccacatcccccatgtggccaagaactgggccagggccttcaaggagccttggccctgagagtactgtgagtgtccccaaatgtcttcccagccctgctgctctgcaccaccctctcacctcagtcattgcctttgagaaagagaaatcaaagctgtgaaagtaggattggataaccatgtacccgattcccatcaggtaggttcagtgggtccggtttccattttccttgctcgtgaggaacattggccattcagaaccgctaggtgctggatctgggtgaggtgtgcgacagctgatttggggacctagaaggggcaaaaggtgaagcagtatgaacatccaacctcccacgttcccaaaaccaacacaagttgtaatgcccagctcagttagctaaaactcagtgattttgccagtgtacaaccatagttcaaactacataaaatgcagacataaagggctggtggtaggtcggataaacacagtaagaggcttaaagtatttctgtgattttgcatcaatccataacatttctcccaaatgcttgctaactttttcaggagtaaatgtagcatggtacagctccagaaagggcaatcccaaggtacaatgtaagttacccattgaattacaaagtcataaaatccatgattaataaaaccttttcctttaaaatctaaattgtgttgtcaggttaattaaaatgaaatctgacgttggatttagttctgtcttgggttatgcattccttcatctgtcctatggctatcaggtgttggttctgtgtgtgcctgtgcagcgctggctaaatagggtgagcatgaggtgacatcagccatccattctcatggatcctataaagaatatggagggttctggaatcttgatttaaaaaaagtcattagacgtgatatatccatacaatagctactattcagcaataaaaaggaatgaaatatttgtgcatgctacaacatggatgaacctcaaaaacatcatgctaagtgaaagaagccagacacaagagaccaaatgttctaccactctgtttatgttaaatttacagaattggtgagataagaagtaggttaatggttgccagaggctgagagaagggaggattggggagcaactacagatgggtacaagggatcatttttgctgtgatgaaaatgttctaaaattagattgtggcgatggtcacacaacgctgtacatttactcaaagtcattgaattgtatacttgaaacaggtgaattttatagaatataaattatatctcagtaaagctgcttttgaaaaaaaaagcagcaaaaaaaaccatgagatgtgcataattcaagggtggggagcggggaaaggggtattttttaacataacaagaagcccccaagttatcagaaacaactgcttgagggaggagtccctcttcatcttaagagtctttaagagtcttcattttaagagtgttgaatgacatcaggccagctggaaacccagaaaaatacttattcttttctgtattttagttcactaaactggtaaagaataaacacaatatcttattgggggggaataaaagaaacctctatcaattgctcttgaagagttttctccacttgttgagcagttccctgtaaaagcattgcaataatatttgtgtgcttttgatcctacggtgaaacaccagaatctgggcattcatagcagcagtggcagctgagaagaaaaatacgaggctccattttctgtttttctgaaactgatttctttcagaattccaaagaatttgggtttccaaaagataacatagtgcatacatcatgtactgcatgataccaccactgagtgtctctgcagatctaactcattaatctttctggagagcccaagactataaacaactccttgtccattcaggtgagattttggcaccaaggaagaggagatcagaacaggttttgctgccagatgagttaggggagaaaaaaaaattacttttcaagttttttggaattccataatgatatgatgaaagattgtggaagtctaatagtatcaggttgctggtgatactactgcaagcgagaattccatgaactaacaggttcttgcctgagggggagaaacaaaatcactgaatttgatttaaagaattatcttcccagatcctgaaacaatctccacctacacatagttttaactttttgtgtgcattgatggaaataattggaaaaaagatgcctccacggggactgttaatgtctggagctgtctgcagagaccttatgtgtgatagtgtaaagcctacagcgcaggccacagagtgaagggacccactctagccatgccatcgcctttccagacacttacagattttgttgggtcctaaatcaatgccgttgccattctatacttagatctccaaccccaaccagatggtatgaggcaaaaaatagggaattctgtatggctcttttttttttctttttttttttattaatttttttgcagagttgtcagcctttttccatgggggaaaaagaggttttgatacaggctgaccaggaaatttttgccaaaggaaaatgcctctcccactcatgcagttactgtagcagagactgcccttctccaggaacttccttattccccattggaaaggtcatggcggttccagggtccttttcatggttttctttttcttgctactacttcccagtagaattccatctttaggggttagatagttattctttccttatctctttttccttttcaatttttagctgcgttggacatgtagtgtccacatcttttctgccttcaggagatgaaatgatgtatgaccacatgggctacccccgccccccgccccccccgccgtccatgatgctgccctaggggcctggcctgaggtggtggtctgagatgcaggcaagcgatgaagcagggagtagttcatgctaagtctccagtcagtggcatattgtgcttaacattggagggagcacttccagactgttgtagattgtgttacacaggctccagaggatagcctaagacaatctagattctctattccaagtgcgggctgtggaccagcagaatcaacacctccaggagctcgttagaaatgcagagtcccaggtcccacccagccccactgaatcagaatctgcattttcataagacttccaggtagttcctatgcacattaaagcttgagaagcagtaattaagagcaaggtccaagagcaagaagggagaagacaggaaggaattgattatgtgaatttaccctcaagagatctagaaatctttatctttggaaaagataaagaattgctcaaggtattcatcctttcttctttccgtttctatttaggaagaggcatgtctaagcaatgccaaggcagtcattaatctgttgagtcctggctggtttgaaaaacagtgaccttgcttctcttacctgcttgtctcatgagggggtttggggaaggggcagtgaaggtgagaaaggtttgtttctttgtggcaaagtgagggccagaggagaaagtagttgatggaagcttgggagaaattctcaaatgtctctcatctccctctttaatataatccaatgacatgcaagatgccgtgactaaatataggctgccatttttagtggactaagaatggttctttatatacagttaaatctgtaattcagaattcagtctcacaaggaaggagtagaataaccacccacttcacatatcaccaatttccgcctctcaaatccaaaatgctctgatgtttcagttaaaatggccacagataattccagaagtcgggacaaagagcacaccctctacatagggactgtcacagaggatgtcgggagaggagggccctctggagtgttggtatttagcaagaagcccaagtgttgtgatttgcaccacagagaatggattcctgagtcgccacggggttgtggggtgggggcgggtagcagactgacggagggcccagcactgctgttaactcatgttgcaccttgtctgcccagatgtaaccacaggctggctcctgggaactgcagactttatcccttggcccccttctaggctgagcctgggacttctctctcactgatctgctttgtagagggacacctgtagctataagtcctgggaaatgctactggatttttgtcattgttctttagtgtcactctttcctaacctaaggttgtaaggccactaagttcgaggtcttctcccaaaccacttgaaatgtattttaagggggaagaaaaacccttaatccttctgcgtgtaccattccacctctggccatagttgggtgtcgaccataactgacagtctggtcgtgccgtgtgggttctgctggtggtatcattctgtccccagaggctggttgcagaagcttttgtagcttatccagcctaagccagtggatgctctcagtctgtctgatgccttccagttactcaagatatttctgattacatagaggtaaatggtgaacacagtggaagcacgttgtagctcaggctcatgccgtaaagtccctgagatttttagagtactttgccttttgttttctgaaatgtatcaattctttcattttcaaagcacctgcagttttcaccaaaaaagtgccatatacagcagttaacgattttatagtttatttactgactgctatggcagtctttatatatatatatataaaataatttatatatagctgtaaacaaatacttatcgatataagtaatttcttgattgtttttgaacgttccattgtttatgcgctatattgttagtctgtgattagcacctaattatgtaacaatggcttactgtgtgtgtgacatatcagctccctttgtcttttggtcttacctttgcttctcaccttagagtaggcagacagagaaagcagagataaaaagcagatcgatgagtattgagtgttgatctcgggctttctgtcagacatgtctgattgtagggacactgacttggattattcaagactgagtacttctcggtctttgagaagtagtgtcatctggtctttgctgcctttgaaatgtcccttatgttatatgttttcatataaatctaactagagtccattaaaattaattttgctttgaaatcttttgccacccttagaggtaactggaattactctgaagtagctggggagtagctgaaatcagccacttaggtcttcccacctcctcaggctgtgtccttttgggtgccgaagttcactcccaaataagccacatataccctcaccccctgagtgcgtccacgtctatgaaaagcttatatgaattggcttttgtactaaacggaatgctctgggtgtcagagtcatttaggtgggacaaatcttcctctgaagatcatcatgcttgtattttctggagacttccatgaacaatgctttcacccccaaggaccagctctaggggtgaaatgtcaggctggtaggagaggtaatgggatcgaaacaagacttcctgtgtcttgagaaaaccttgtttatattcatgtgctgtttcccagtggcaataaatcgagattcctgtgaggatttgacagacgaggctggtgatgccacccactgtttttgtaaagaaaatgttatcggaaccagccaggcccatttgattgtctgtggctgctttcgtactccactagcagagttgagaagctgcaactatacaccctgcaaagccaaaaatatttgccatctggtcctttacagaaaacaattgccaatccttgaattagaatttgcaaagtgtgtcaaaatgcaatactctatctactgatgttaggcaacacctaaaaactttgctcggcactcagtttcctaaaatcttctccatcaaacatccctcatcctctgccctccaggccccagaatccttgttctctgtggggaatagggactccctgctcacaggctgtcaactaaggctcagcccttcttcagagaatttcttggtactttctagaagctcagcccctctggcctctttcaggtccttctctgagttttcccataataaaccaagtcccgttaagtggatactgtgagctactttcatctagtgttctattcagtgcactttagcaagttttatttcctgtgtatagaaaagatatttgtggtttactaaatgtagtgctggggatcatttctttctttttttttttttttaagtatgaggttccaatgccctgaatcggaatcgctaagaatgctggttaaaaattcagatttcatatgggcatggtggcacacatctgtagtcccagctacttgggaggctaaggcaggaggatcacttgagcccagaagttcaagttcagcctgggcaacatagcaagacccgatctcttaaaaagaaaaatcagattcccagtccccacctaccctctctgcgatgggtcccagaaatttggcccattttaagaagctcccccaggcaattctaatgcacagtaaagtttgaccaccactgctatatacatagaaggccataacccctcattataacatctttggtaaagtatcgtttcagttcagcctgtgtatgtatatgttcaacctgtatatgtatttacagttaagatgctcaaagtcaaacctccacatccttagcagacagtactattgaatttgaagtaaattcctcttgaagtaatgtttcgctattgccactatatctttgtgtataagagccaatgcaaaaacattagattgtaaagctgtaggcaaacatcagagctcaggctgtgtgttagttatcaattgttgcataacaaattcctccaaaacatagtggctagaaacaaaaatgtatattatctcggcttccttaggtcaggagtctggactcagcttagctgtctcagaaactctaatgagatttcagtctcatctgaaggcctaactggggaaggatccacttccaagctcattcatgtggctactggcaggacttggttactttgggactgagggcctcagttcctcacaagctgctggcctaaaacctcccttgatttttttccatgtgtgggctctccatagctacttcatggcatagcagatgacttcatcagatagagagagcaagtgagcaggtaagagaatgtgccagccagagagacaatgctaacaggacagaagtcaattttttgaaacctaatcagggaagtgacatctcatcacttttgccatattctagtcctaagaagtaagctactaggtccagcccacattcaggggaaggaattacacaaggccatgaatgtaggtttgtggggatcattgggggtggtgtcttagctgcctgccacagtctgtataaacatttcacagtgcaaatgcatcctccatctccttaatgatcataacctcttcactttctcaaagcctcacctctcagagaatgtatcactgggttaaatgagtacctggcaggtgtttgacggccttcctgaggtactagactctaagctctctgtgagcagaggtcttcatgccttgctccctgctttggcctggctcgggacctaggaccaagaaagcagtcgttcatagtgttgaatgatgatcactttatttttagcactcatgatgtgtgactctatatgaaattgtctaattttagtgtccattgtgtacatggctcatttcctgggccaggctggtcaagaccttgcactctgagagttgcataggagctcagcaggtgtttgttaagtaagttcagattggctactcgttgtcaggagtttgagaccagtctggccaacatggtgaaaccccatctctactaaaaaaaaaataataataataataatacaaaaatcagccgggagtattggtgggtgcctgtagtcccagctacttgggaggctgagacaggagaatcacttgaacccaggaggcagaggttgcagtgagcagagattgtgccactgcactccagcctggacaacagagcaaggctctgtgtcaaaaaaaaaaaaaaaaaaaaaaaaaaaaaaaaaaaaaaaattaggttggctaatcgaggtttctagaatcatctgcatgtaaatagggttaactttgtgggatgattttcttgaataagaagttctcagcctgagcttcacagtagaaccctggaaggaaggggaggtcttttaaaattccgaagccacatccagaccaagtcattcagaatcttgagggtgggacccaggcatcagcgttcttgaaagctcccccaccaggtgatcctctgtgcagccaaggttgagaaccactgtggtagaccagtgtttcccaatccgggggagtttctgcctttcaggagatgccttttaggcatctagtggtgtagaggtcagggatgctgctaaacatcctacagtgcacaggacggcccctccccaacaaaggatggcccatgccaatagtaccaagagttgagaacccctgggctaggtcctacgctttgagtcaggaaattggttctaagtgaagcagtagaagtccatggggtagctttgtcccagatgttaagcttattgcaggcatggatagcttgataagtctggaatattatatacaatctatgtatcggtgtttcctgaagagaaactcactcttttaaaaggcacgcagtgcataaaccaatacatttaaacctacatatatttatttatgcaacataataccatacacgtgtgtttgcatatagcacgtgctataaacaccctatgcatacagagatgtatgcagggcatatgagtgtgttattgtggttagaggaacaggtatgtcttcctcagcgccctttattttccttccccctcactgtagcctcctgccctctgcttgtctagtaaaagccctaaggcctccctgacccttgctgtccttaccctcagtccagaggatgcctctgctgtgccttgctgcctggagggttcccatcacccaggttaatgtggctcttggctttcaccaccaatccttagtttctcaaaggggttcacaacctttttaaattactagtgtgtcttgtagaaattgaacttcacaaacaggtcttctgaaaacgctttcttgtggtgtaattgatatgcatatggtgcatctctttaaagtgtctgacaagccttgacatacgtgtgtgctcatgaaagcagcaccatgagcagcatggcaatgtggctgccactcccaactctttccatccttcctatgctcccactctccccaagcaaccactgatctgctctccttctctgtggattagtttgcattttctagaatggcccttgtgaagatgtgttcacataaattctctcaccctttctcacccgaatagaaaatgttgcatgatgttgattgcttaatagctccacagctttgtccaatttttatccttcctgcttttactgaagatgtcctgcccccatgaataaacctcagaagacccattctgccaccgcctaccactgaagagttgagcttgcacccactccagtccagcccacacaccagtgccagattcatctcttaaaagcacatcctgagtcacgcctcgcctgctcacaaaccttccctctcttccccttgctgcaaagtgaagcacagaggcttgaggctggcttggacatcttccatggaccaggcaatggggggacctaccttcctgacttctccccaccattaccctggtgtccttgatgaactcggctacaccctgaacgctccccacgtctcccacatcacatgggtcctgctgtccttcctttgtgcttttcatggaatccttctgttcttcaaggcctcttcacctcctgccatccataaacctttgccttagcaacccacaccaaccaaagagatctgtccctacctcactcccccatatccctgtgtcagcactctctttattctactttagtgataccttatgtgtctgtgtgtcttaccgcccccctcaccccacccacaaggatcaaagccaggagggcacacttgcagaccccaccacagtggcttgcacatggcaggtattggacagacactcattgaatggaatggaatccaggaaagtagagacactgtcgcccagatggtcaaggaaactgattgctgctaaagctcaaaattgcagatattaaatacttctcaaatgtctggagtagcctccagattgctgtgctcttaaaatctgtgtcatctggacttagagctggcttcccctactctccattgatctccatgattccttgctgtcccactttaccaggctaaaagcctttgggaaaaccaaagccagttcccacaaaaggcaaaggaagagactaacaagtatctggttgttggatttgtttattcccagtcatggaagcgtatcattgcttttattgacttgcttatcttctgctagtaccatattgcaaatgttagaggctcatctattttaagacttccatagtgttttcacaaaaatgaaaatcccttattaaacagattttaggacaagcttctaaaaggacctgccaaaaagtgatttcctttctatcattagaaatagtttccacattcttatcgttatgtagttgaacttttatgtccaggactgcatgaaagacgtgagaactgagaagcaacctatatttgatttcgcactttgttcttggacaggaagcccctgtcaactgacttcacatctttttaatgcactatattagtggttcacagaactttctgggtgttaggtccctttatgtgcttagaaacagttgaccccaaaacgcctttgctcttctgagttgtgcctataaatattttctatattagaagctagaactgagggctgggcatggtggctcatgcctgtaatcccagcactttgggaggccaacgtgggcagatcacctgaggtcgggagttcaaaaccagcctggtcaacatggcgaaaccccatctctactgaaaatacaaaaattagccaggccagccaggcacagtggctcacacctgtaatctcagcactttgggaggccgaggtgggcggatcacctgaggtcaggagttcgagaccagcctgaccaacatggagaaaccccgtctctactaaaaatacaaaattagccagcatggtggtgcgtgcctgtaatgccagctacttgggaggctgaggcaggagaatcgcttgaacctgggaggctgaggttgcagtgagccgagctggcaccattgcactccagcctgggcaacaagagtgaaactccatctcaaaataaaataaaataataaataaataagccaggcatggcagcatgtgccttaattccagctatttgggaggctgaggcaggagaatcacttgaacccgggaggcagaggttgcactgaactgagatcgtgccactgcactccagcctttgagttttttaagatggagcgagactccatcttaaaaaaaaaaaaaaaaaaagaaaagaaattagaactgagaagtttattacttaataataaacttagtcatttaaaataatagcaaatccattatatgtcaacctaagtaatgtttaggaaagataacgattttcaaaaagaaaataatattttagtgtgaggaataggactgttttacatttttgcaaatctctttaatatctggcttaacagtagacagctggactcttacatctgcctctgcattcattcagaggcatcttggggtatcttgctttggttgaagtatatgaagaaaactcaaatttctcacaggtatgtgcttggagaatggaggagtgttttaatggcctttgcagataattatgaaattcttccttgatactacaccaaaattcagcagctagtggtttcttaaagactacttgtaatgtggaatctgaaaccatattgatgatatttttgtactcttttccactaaaattcattgcttgatcttgcactttgattgactcttatattcaagaattattttcccttggctatttggaaaatattggttctctgagttgtgcagatcttccagacgttgacacatttaattaaaccatgtcaaaaaaatttcattggttaatgtcaccaccaatttcatcaagaagtctggtaagtatttggaagctgtcagtctcactatggcaggtacaagttttccaaaattgattggcaacagatactatcagttgttttctttgaagtgacaagctgttcatttttgggaaagtttctgccaaatacttaagtctaaaaaactatatcttgtcaggcattctttcaagaaagggggtgtttgcccccagaaaggtacaagtttggctcataactcagttacataagaatgtttcctgcagcccactgtcacacgctggtttgtggtagaagggctctctgcatcctctcactcatttcattacacaaactgttcgaaaggcacatactcgggggttgagatttaatcaaattaataattttttattgcatcgaggacatttggaagtgaaactggctttttaatttattttcttgcgagcgcgtggtagtgaggaatgtgttcctgctaagtacactatggagccactgcccgattcacgctcaggcatcagcagttttactgtgcaaatgtcaagcagtgaaaaaagtaaataacatcttggtgctattataaaaagttttggcttcacagtcctcctgcaaggatcttgaggtctgccggggctgcacagaccgtctttgagggcccactcctggctcagagtgagactggtgggcaggcaggatagaatctcttgggagctcaatgtcctttccagacctgcctgaacagaatctgcgttttaatgaagtcccgaggagatttatacgcaggttaaagttttcctgtagtcccagctatttgggaggctgaggcaggaggatggcttgagcccaggaggcagaagttgcagagagctgagattgcactgctgcacttgaacctgggtaacagagtgagattgtatctgggaaaaaaaaaaaaaagagagagagagagagaaccactgctctttaacagaggtctgcaaaactttcctttaaagggccacatagtaaatacctgtggcaacaactcaaccctgcctttgtagcttgaaagtagccatagaccatatgtaaatgaatgagcgtggctgtgtgccaatacaactttatttatagacacagaaatttgaattttgtgtacctttcatgtgtcacaaaataggttttttaatatattctaagcggttaaaaaagtaaccacttggaatcatgtcaaaatcattctgagtttgcaggccatgaggagagccagatttagctggtgggccacagtttgctgacctgtgctatataacactgagtgctcattgaagttaccgggggagcttcaaaaaaacaaaccccaaccctctaattcctgagtcccgtccccaataaattctgataaaattggtctggggtgaagccagggcatcaggattttcagatgctccccagattattccaatgtgtaggaaaaatggagaacctctgctctataatgttttccaagaaagttagttttcttttaagcatttctttttaagattttagaatttggcagtgtcaccaaatgtctgagaccagaattatgtattgtaaccttagagcagggtttctcactcttggcactgtgaacccaaagctatctgagataggtctcaatcaatttagaaagttaattttagcaagcttaagaacctgtgacacagcctcgggagatcctaataacatgtgcctaaggtggacggggcacagcttacttttataccttttagggagacatgagacatcaatcaatacctgtgagatgtacattggttcaatctggaaaggcaggacaactcaaagggggtcagagggtggcttgcaggttataggaagatttaaaaattatgtaaagacctggaatccatagaaaggaatgtctgggttatgatgataaggggttgtggagagcaaagttttatcctgtaggtgaagcctccaggtagcaggcttcagagagaatagattgtaaatgtctcttagcagatttaaggtctgttgatgttaatgctggttggcttttcctgaattccagaagggaggagggtataatgaggtatgtttgactctcccttccaatcatggcctgaactagttttttcaggctaactttggaatccccctggcagagaccaggaatctattcagatggttgggggtggggtggggggtgcttagaatttttttttttttttttttttaaacggagtctcgctctgtcgccaggctggagtgcagtggcacaatctcagctcactgccacctccaactccctggttcaagcgattctcctgcctcagcctcccaagtagctgggattacaggcatgcgccaccacacccagctaatttttgtgtttttagtagagacggggtttcaccatgttggctgggatggtgtcgatctcctgacctcgtgatctgcctgccctggtctcccaaagtgctgggattacaggcgtgagccaccccgcccggcccagagttttatttttggtttatagcactattggcattttgggtgtgaccattctttatttggggatgggggctgtcctgtgtattctaggaggtttaggagcatccctggcctctacccactagatgccagtagtgtcccccaccctcagttgtaacaaccaaaactgtctccagacaccgctaaatgtccctgggtggcaaaattgcctggattaggaaccagtggtctaaacgatgtagatgttttttgtgctacttcagagaatctccacattggagctattgacatctggggctgggtaattctttgttataagagcatattctgtacactgtgggtgttgagcagcatccctggtctctactcactagatgccagaagcaccctctcccccagctttggcaacgaaaaatatctccagatattgccaaatgtcccctgaggggcacagtcaccccctgttgagaattgcttggccagctcagaatcagggaagcttctgtccactgacattcactgctgcttctcttaggattttcgccctctccattttcccattgcttgttgcttgaaagttgtaaagcttggttcctgcatcttttctttttaattttgtggctcattaggaatcagtaatatagcaaggaaggccccatgtagagaggtaagggggtggtttttttgtgtggtgtttgttggggggtgtttgggagggtgtgtgtgtgtgtgtatgtatgtgtgacattcattccctggggaagaatctgagcccttgttcctgccagccctacgtctgagccagcattaaatctgcagccaagatcacagacaacttgggcaaatcacttggccattatgaactcacagccatggcaacggccatccacaagcctgaggacaaaaggtgttttattctgttgttctgcacaaaaggttctagggatactggagacaaaatagcctttgagacttaaaggcattgatgtgtattttttttttccctactacatggcttatatttaaactgtcttaggctaatgtacactgtaatttttgtgtgaatcaaaacctaaaattctttttatccagaggccagctaaatgaaggcataagacagcccaacagaggcttttagggtttggtgagaggtattgagaattactagtaaaatgtgctagaaagcctggcattctagcctggccaacatggcaagaccccgtctgtactaaaaatacaaaaaattagctggatgtggtggcatgtgcctgtaatgccagctactagggaggctgaggcataagactcacttgaacccaggaggttgaggctgcagtgagcggagatcacaccactcactccagcctgggcaatagagtgagactctttctcaggaaagaaagaaaaaaaaaaaacctggcattgattattatttttttacatgaatacatcacagtcatcaaaaaaatgctttccttattttttctcgttcacgttacccaatgttgtcattgctggtttgaagcttgggaaaattcagtctgtggatttataggagcatccaagaaaagcactgatcttccttagctatcgtaaacttttaacagcatggtgttctgctggtacttggcaccacccctatatttaaaaacatcagcttgcctatgactactaaggacagcctgaatcccagatctacttcctttttgtgcacaggcactcccagcactttagggggtggttggagtgtgtgtgtttagaaatctgctttctcaggtgactcaattcccgtcttctcagaccctgtctatggcatgacactaaagcatgaaaaattccaaggttaacagtacttgtttggctcacaaaaatgcactctagctgcactcttttcaagatggctggacaacttggaacattttgtttttcttaactgtagtccttggaacttgccatttgattcacaagtgactggagggttatggccaaacccagtgggccacgtcttagagaaaaaacatcacacaccatcgaatatgaaagcaggcacttcaaacagactcaggatgccacacctgagaccgggaagatgccactgttgactagaaatgggcttctcaaattttcatgtgcacacaaatcaccccagaggccttgttaaaatgcagattctgactcagtctggggtcacttccaacattctttatttctcacaagttcctccctgctgaagctgacactgctggtccaatgaacacactttgcaaagcacatggaattgacaaatgacaaatggtccactcatatcttttcttgacctctgatagttttccttgttgcccagtagaagctgccagcatccaagttcagctcttctcagctacagatccatatatcccttcacatcatccagagtgatctttcacaaccccaatctgtttcccatgcttaaaaatgctccctggcagaccaggcatggtggctcacacctgtaattgcagcactttgggaggccgaggcgggaggatcacttgagcccaagagtttgagaacagcctgggtaacataaggagaccctgtcactacaaaaaaattaaaaaataaaaaatgagctgggtgcagtggcatgggcctgtggtcccagctacttgggaggctgaggtgggaggatcgcttgagccagagagttcaacaccgcagtgagcagtgattgtgccactgcactccaacctaggcaacagagcaagaccctgtttcaaaaaacaaaacaaaacaaaaaaaaaacgcagtggcttcccatgattttgttttttttgtctttttgtttttgtttttgtttttgttttgagatggagtcttgctctgtcacccaggctggagtgcagtggtgcaatctcggctcactgcaccctccgccttccgggttcacgccattctcctgcctcagcctcccgagtagctgggactacaggcgcccaccaccacgcccagctaattttttgtatttttagtagagacggggtttcaccgtgttagccaggatggtctcgatctcctgacctcgtgatccgcccgtcttggcctcccaaagtgctgggattacaggcgtgagccacggcgcctggtcaaggcttcccatgattttgaagataaagtccagaattcttaaggtggcctggaaagccctaggtggtctagctcctatattacctatatcctctagctcctaaataaacacatttagctttttcttactaactttttgcagcagttttggttcctctaggatgagtgtgtgatatgtgactaaattgcccagtgttcaaagatatcatgcacactgtgaccagaggtggcttctatactgacatagaagatacagtggagagtgatccatttatagattgttggatatctaccacacatgcaatcttaaccctgaagataactggtcaaccaagctagaataagctctacatccagctgtattatgtcctataaatttttcccatattttatgtcactagcttctagtcatgttggctggcacagtccgtaagagttttatctgtgccagtggagcaaagatggtgatttctgttctataggagccagggttcctacagccacaaataaaatcatctgctgaaaacctaagagcattggcatctgctgagagagcatgattcattgaagtgatcccccaaattcttgagttcctggttttccctgctgttataaaactagatccacagcatgaggtatatacagagtccttgagagatataaattggagggaaactttagctttgatctagtattgaatttgggattgaacagcatcattcttctaaccccacttggctttttgagcctgggagagctgtgatatttctttggaatgctctaaccatttggatgaaagaccgtttgaagtggcaactgtggatttggaaggatgagttctatcgttaaagggcgagtgtgctgcaccataacacctaaccctaactccaaatgatgaaaaagggtgtgggtttagtttaaaaatatatatagatgtatacatctatatatacacacagagaattaatgaacaattttatctggttatatatcagtgtcaccacatcagctgtttaagtattctggatactagatctttctgtagaaggacccatccagtatgaattatttgcccttctgatcttccctgtcccccttctctccactctctttccactggctctgcaggggtctgtatctttgcccccatcatgctggactataataattgtgttacttgtctgcctgcagtattggatttatcttgaagccagaaaggtatcttatttcagttttgtgtacttggcacccagtaggtcttcacaaaatactgaattaatgaaatccaacagaaaacccagttagaacccagctcctgggttatagaaaatcaaatatgtgacaattcaaaatgtatcttccaaagcagtgtgttctgtgatgatgaaatgtcctatatctgtgttgtccaatacggtagccactagtccatgtggcttttgagcatatgaaatgtggtttgtgcaacagaggacctgaaattttcattttatttaattttaaataaacgtaaatagctacatgtcttagtggctaccattttggaccacacagccccaaggcctcacatctttatcctttaagaaccagatacaactttgttagccaggaaagcaggcattcatctttttcttaacatgatcatagaggctgagaatgtggggaggttgtggatgatacaatacccatgtctgttttctctttataatgagatacgtcaaggccaaggattctagtttctcttagtttgggaacctggagagaatttggactttgagttgcattcctctcacctcagtccccagaaagtcatgtgacaaaataagattgagctctaacatctctgctcacaaatcccaagtgtctgaagctctttaagatactgacttgctagtgaacttgaaccatattgtgcactggttccctttttctttttttgagacggagtcttgctctgtcgcccaggctggaagttcagtggcgcaatctcggctcaccgcaacctcttcctcctgggttcaagcgattcccttgcctcagcctcccaagtagctgggactacaggtgcccaccaccacacccggctaattttttgtatttttagtagagacggggttttactgtgttagccaggatggttcccattttatatagtttccccaatccacttcagggaagttggtcttcctaaaaacagctgctcatcttttgaaattaaaggaagcacagctttcttatgaagccctgatattttttattttctaatgaactaaagagaaatctagtaatgagttttcatagtcactttccataggtttaagcgaatgctagtttaaaaggaatgctcactaaaatgaaaacattcatctatggtgttttatgctgggttgtcattccatgacaactatgaagaccatttgggggattttttttttttttttttttttttttttgctggcttaatgtgcttgccctaaagtaatgaagtgcccttgattgctgctaaacaccataatgcgtttaaagttcaatttccccgacaagccatttacttaagggtctggataatataaacagagacaggaggttaggagaggtactgacattatcctgaggccagtgctgcctttactgaaacgtaaatgtctccaaactgaaaacgtcacctggctctgcccctgaggcaggtctttatggacatctcaagtaaaagtttattttaaaaatgaatacaagtctcgtcttttcaagattaagagtgacttacggctgtctctccttcattccacttcatggatgttcattttggttttgtttttttcttctgttcttttttctccttcaagtacttaaatatcacccaccagttctgggttctgactctgaacgtgtgtgtcggggaagggggcaggtggaagccggggaggaggaggactgtgaatgaattgcttgggctgactgggctggggggaagcatttttattaaaaatttgagataatttctgatgtcaacttgaatgaaacttgagtagacccacttgagtggctcttggtgactttgttcttcactgaattatggaccaaaatacctgtgacctttccaaaacaatcaccttgctatttgtttgaacctggcgacggcataattgctgtatcagattctcccagttgccccggaggtccagggcttggggaaagccgttggttgccacagcagcagacgtattgaaaccccagaactgtgaggctggagacgacctgactgttgcttttcttcacagagctgcagcttcactgctgtcctctcttttgactgtgttagtggaatgagtgcttcttgttggcacttgagcggggctccccccaccactcagtcgatcaggaagctctagaactgtaactaccttataactctttgtcaattgactgctctgccattcactacccttccagattctgagcaaattaagttacattcccttttggagcctcagggtcctcaccgcagaatgtgagatcacggtaactaccacactggcccttgggatgtcgaagtattaatattaaccatagagcctgagaggggagatggaaaattgtaagccttctctgtgaatatggggtattcttgaagaccagaggtgttcttgcccgtaacggctatattttctctcctttgggttcaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgtaagtatccggttccctttaaaaatgcatctaaggcctggcgtggtggctcatgcctgtcatcccagcaatttgggaggctgaggcaggcagatcacctgaagtcaggagttcaagaccagcctggccaacatggtgaaacgccacctctactaaaaatacaaaaaaaaatttagctgggcgtggtggtgcgtgcctgtaatcctagctacttgggaggctgaggcaggagaaccagttgaacccaggaggtggatgttgcggtgagctggtgagccgagatggcaacactgcactccagcctgggtgacagagtgatactttgtttaaaaaaaaagtatctgagatgcaaccacctcatgatgtttttcagaaagactacagtgtgctttcctagcagaagatgaatgcttttacttaaagctcactttatgtagttagaaaaaggttcatgagagaaggaaaaagaaagggcctagaatatggtagctgtttaggccccagggtggaatgttacttgggaatggtaaggtgcacacataggacactccacacatggtagctgtggacatggggagctgtgacatggtgataggtgatgctgccgattgtctcaacagaattgtgttgttcccaagtaacagatgcctccagctttctcccaggaagtgaccatccctggaatggtaggagccctgttgaggactgaccccaactctaagcctacaggagcagtattttaacattaactcttccagcagaagagcagatcccagggcatcctccattgcagaagagcagatcccagggcatcctccattgcagaagagaggaaggtccaggggtttagcagcagatctctgcctttctttctggaaacattctcaatggagtcgcagtgactcccacacatagattcttgtagctgtgcaagctcagcagcaatctacttatttccttcacatgtcttcccctttctccatttccttctaccgtttctttttcttcccttgaatcccaaagttccagtgttagtgtgtcttatgattataagaaacttcttcaccagactgaaaaagacatgaatgaatttttatggaatggtcatggagtcatgttggagactcttcagtccttagggaattttattctttcttatctgttcacaaatgacctccaaagaaatgaacacaggttggggagattataaggagggctcaagcaggacaggggactcactgagttccaactatgtgcaaagaagaaatgtttaccaagactgaacctgggaaaggtgtgttgatttaattaggtagtgatctcagtctgtggctctcaaacttctgagaagctttaagaaaatccccatgccttaccccagaccaattaggacataatctctgggggcgggatccaggtaccagtattttccaagctccccaggtgattccagtgggcagccgaaggctgaggacatgtcatttgtctttgttagcttttgtgggacaaactgcattgtgaattaactttctgtatcttaaacctactcgacctactactatttgtgtggtgggagtcacagtgcaaaagacatctccccagattaccccctaaagaagccctgagtgcctacttaggggttttatcagagtgacattaaccactaggcctggttgggaggcattttgaaagggcagaaagaacatgttgtccattgggccagggttcagatgctggctttgccactaactgtgtatcctccgatgaggagcttaactcctcaatgcctgtgttttacttatgtgcaaaatgaggattctaacccttgccgcccaggactcaggtaaggattaaaagattacaactggatgctgccctgagcaaaggaaacatcattcccaccttggaaggaaggcccaggttgctgggacatgggcagggatgccgcccaggatgccccacaagtccatcaaagccatcagtggggcgagtgacgcactcacaggaacatccccctcatgtcctctctccagcgtccagaaacgtagtcactaccaggcagtgaatttaatggttcaggatctcttcttctctttgtaggatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatggtgagttgaacctctgataactgattgtttgatatacaaccagagccatgccttgatgtatttccttgtatttggcaaaagctaccaggtatcgagcgtgaatggagggtccatgacacaaatattggctttaccaatttagagttaggactataaaaaccttcaacatgctattgatagtaaactaaagtctatggctggcagaaataaatcaaatgttttcatcagtgtaaaggtgaaaagggtgctgaagatttttcaaatgccaagttcccactatagaaggaggtaactttcatgtggtctcagtgctcccctttggttgtctttaaatatggatcatagccataaagacatacatgaaccatggaaaatcgtcctgatccttctgtaaatacttaccagtacctgctgtacagagcgcctagctgggctttgctagccactagaggtgcaaagattaaaacacaggctgctttctcaagcagcttatagtctaagacaggggttagcaaactaggggctgtgggccaaatttgacctactacctgtttttgtacagctcaagagccaagaatttttttttttttcttttttttttttttttgagacggagcatcactctgtctccaaggctggggagggcagtgtcgcgatctccactaactgcaacctctgcctcccgggttcaagcgattctcctgcctcagcctcctgtacaagtcaggggaatggttacttttgtaggggaaggaggcagctgttaaataaaatgcctgtggaaagcagagggaaaatagccacaaatagtgggaatcctcctccaaaggaaaaaaaaaccaaaaacatctcctcacagctttaaaatgacagctttccccctcacttctacccatcaagtttcaaaaatagaggtctagtttccaccagggcacagcattaagtcatccactgcctgatgtttaacatatttggatcctttgagcattggtcaggacacagtacatggtggagaggagaggagcttgtttgtacttgagctagtggcacttcacctagagatggggacactgtgagggatccacagcccacctagcatggcccgcttttagctcttatgtcagattttgttggagaaagtcgaaagcccccttagactggagaggagcttgaccatcttgcttgatttcattgccagtcattcatgcgctgtctgcatctctggccactggcacctcatgtgcttccgtttcatccatacgcttaacagatcacaatgctgacctgccttggagggtgtgaggaagatgcaggtgacggggcagggctgaggatgctggggacagaaacaggacagaaagtcatgtgaggtggagaaggtggatgagatctgcccgctagggaagcaaagctgccactccatcaccaaaggcctttgtctcctcagtcctgtgaacccaaaagtatctgaaacaggtatcagccaatttagaaagtttattttgccaaagttaaggatgcacccatgacacagcctcaggaggtccggacaacatgggcccaaggtggtcagggcacagcttggttttatacattttagggagacgtgagacatttatcaatgaatgtaagatgtacattggttccgtccagaaaggtggggacaactcgaagcagggagggggcttccaggtcacaagtaggtgagagacaactggttgcattcttttgggtctctgattagcctttcattgaatatacaattcacatgggagaggagggtagaggaatagtcacttatgcctggtctggcttggtgaaaagacagggcagaggaagcaatcagatatgcatttgtctcacatgagcctcagagggatgactttgagctctgtcctttgtccacgaggaatttccttgtgggcaaattgtgagggaggtatgtagctttatctttgtgctatcttgtttaggaatagaatgggggatttgcctgtcgcagttcccagcttgacttttccctttggcttagtgatttgggggtctggagatttttctttcgtagtcctgtgtgggaggtttgtgcccaggaactcactgaggaagcagctctggacgctagaggcctccatgacagggccagctcgcagcggggacctctgggagggggacagtggccttccctctggagtcctggcctctgacagaagggaaggctcactgaagccaagaaccaccagctccctcctgctcaggtcctgttttcttttgaagggaaagaaacctagtctggagcagcagtgggaggaagtgggaggtggaactgctgaaatctgcttctctgaatatttttggagatgcaaatgcttccttgcagtgcaagggaaagtgtctcgtttctgcagtttcctggcattgtgaccatcaggaggtggcctccaaccgcccaggtatctcctgcagcacagaaagttaggggtgaccatcaggtctccaccatcagcttcaaaatagaaaagccaaactagcactccacaccctctgtgggcgcgccttctgagaacacaaataccacgtttttgaggccgcctcacaaagctctctgaaaagtggtcaaggcagaggaaagccaagcaacgggattctattcttcctggattgcccatgacagtgtgtgggtgaacacctgaagctttttccctaagccgttgctttgcttgcaaagctgctgtgaatcttagagacaaaagaaaagtagaggaaaatgagaattttatagatcgagcattaagcttgtattcgtgattatttgaaacttttggtaattttgcagaatcaggaaactagcaaagttctttttgagagggcttcttgtggcaattgctattctctgtgagccaacctgttacgaaaaataaaggtaacttttgagaaattaatatgaagttataattcagtggtatatggaatacatccagaatctatcccatgttaagtagcatgttctgcattttcagaacggctatttagaaagagcacctcttgagaggctgccactgattagctctgtgaccttggatgagtgagatcacctcttggggtctcctgtccttgttagttaagagtgacccgaaaggccctgacattgcttcgggcactccaattctagatcctctagctctggggaatgtggctggctcttacttcccctgctcccgtgctggcttttccttcttgctaccaatgccggggcgagggtccccacaatgtgttccacaggtcagtattgggcctgaaaatgcacaatccttccacttaggggacacacatctacctgtttcagtgatgattgtccttcctcttgttttggcctagttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtacttccttctaattcacccctcccccagttatttcattatcctctcgtgcatatgtctggacctaattattacatgcgcatccttttaattgtcatgatctgtttcatcccttctattagagtaattttatacttttcccttcaatatgctattttctgggtggaaacttcagggaggcttttagcttgctaggtatcaaaatttcgttatattttcatgttaagtgtgtagtgaaagaagcttttcttaatatgaaactactttataatgcagttcaatcaaaaaagacttctggatctccgctacaaaaagattgtattttttctttattttcagttttataacatccaactttccattcaaaataatattgcacacattgtataattcaattaatttgcacatccaactcctcaaatctggtctttttaaaatgaccaactgcttaaacttcatctgtattgaaaaatacaacattagatccagccatattttaaagtcatcagaacatactctataaatcattatcagctgttagaaaccagttcaaacattttctaatgagtgagatccttacaatggggatctaaggttggttcattgtgacaaaccccagaagagaccactggctcctcctgtcagttaatttgggacttgacttcgctgctgagtaagagagggcagctgagtaagagggcagcatcctgagggaggagtctaattactgcttccagccaccatggtaggaaatcttttcttggcagaaacaaccgggggtgggggggaatagctttcatcagaattgaagaggaaataactgtccttccagagcttttctgaagagagatgactatttcatttttgctgtttttctcatgtggcttagtctcaacatcttaccttacaacataatactaaatttgcttgaaactacctatcagactaacctcttctcacaaagaccaaggctgaacaacactgttctttatgatagagctaaaaacggagcctaaagttggctgttaaagttatttgtaaatgaatatctaaatgtatatcattctcctattccttaaaagtaagtgttttgccacaaatttttggtaatcagcaatcatctttttaaatcctctatatttgcctatttattgttatagttactggtttcactgataatttggggtaatttcccatgcttctgaagtataaagatgtactcttggcccgtgtcaaggatgaaaggaataaggattttttttcttctaatactcctttccttaacctcctaggagtgtttaatatttaagcacaaacttatgcattaaaggggaaaaaaagcagcagcccactggacaactgtcattgcagaggagcctcagggtttaagtgagagagaaatcatagactctgcttgtcccaccctctggggtaaaggacagtagtgttttttctttttaaaaaatttccggccacgcacgatggctcatgcctgtaatcccagcactttgggaggctgaggcgggtggatcacgaggtcgggagttcaaagaccagcctggctaagatggtgaaaccccgtctctactaaaaatacaaaacttagctgggcatggcggcaggcacctgtaatcccagctagttgggaggctgaggcagagaactgcttgaacccgggaggtggaggctgcagtgagccaatattgcagcactccactccagcctgggcgacagagcaagactgtctcaaaaaaaaaaaaaaacaaaccaatttgattttcagtccaaaaatattttctaatacgtttataagacataataaaaatgaatataaaaacaaagacaaagtacaaatccagagttttttattggattcccacaaacataaattactccgtcaaattgccatgaaagtttgagtgtatacttgcaattttggaacttaactcctggcagaccagtaacagagcttggacagcaaggccacagaccacagcattcatgaggaaatgtattttgacctcaatgtgataaaatgctttatgagggggttgtcctgcagtaactatagggaaagcctggctttgaaaattaatgtttacaaatatgaacttccaaatgtgaaccctcactgaataaagcacaatttgtaggggaaaaaaatatcaggctgtttaaatctcttatggactagttggctttgcttttggcctattgttcaaatggggctatttattccaaaatgcttgttctgcagacagcagatccatcaattcttaatgaagaacatagcctacaattacactgtaactggcatccgaagtggtggggtctgttaagaacatgaggcgctatagtttgtactaacatcctattggggttcattttacaggtatcattccttggaatgctttccccggaaaaatatgtggctctgccctggagaacatctgcaacacaaacgaggtaaactcatcacagttcagaataacccttgagtattaggctgagaaaaaagggttctcccagctgtagaaagagcgagagagatggttaaaatgccattaaggaaagctccttgtttagaatctttaagatagagctatatgtaaccatcactattcagccatttttgacctacaaaaatggtcacttcatatggtccaacacatttggtgagaatccttaagaagtggagggcttttcctttgggcaataatttagaggtgatcccaaacctagaaatctaataatatatctagattcttctctcacctcttctacttctactctttctactttgaaagattttcaaagtagaacacctgtcacagaacggatgtaagttaattttcatagaggagtccctctatttcatagaggaatttgtgtatatacccaacttttaataaatgaggccacagttaatcatttatatttctggaatgacttgctacttctctaattctcattcgtccttactagggagtgtgtcctaacaatttggtttaaattgtctcagccctagaacattcttcagtcattggcttgtaactgtttataaaggaaaattcttaaatgcattcgtaggtgcttgtatatttaagaaaatcctggcaagcttttaagaagcagtgagttacagaaataatcagctcctaccctatctgacttgtcaatttgtatatccataatatgcagtggcttgaagcagggctccccaccgtggctgcatgttacagccatcaaggcagcactatgttatactgatggctgaggcccagcccttaggtattcagatttaatcgatttggggggcagtctgggcatcagaaagtttttaaagctcctcgggtgattccaccatgaggccagagcatgaagagaaggcaggcctgtgcccagtcttgcagagaagagctgcaaaggagacagatgaagcagcaccccacaatgagtgtaggccatttcatttaacatcaaatgcttatgttgatgccctgttcttttgtagttctacatgtcctatcacctgttcattgtggcctgtgcaggagctggtgccaccgtcattgccctggtgagtaatggccccaagaccaccctagtctagcctcctccctccagcttctaaatgacagatttcccttccagcttttaccagcctattgaagccaatgattctggcactcaaccttggttaactggcgcctgtgttaacttaccacatgtagtttacagaaagtattagttggttgccttggcactgattgtaggtgatgtaatttggactctggaaagaaaagagggtatcaacacctatcaactaggcctagcatattaccttgttgcactgagcacttagcttcatgacttcagtcgcagacagatgcaatgctcacgtgaggcattacccatttctttgccaagggatattaatttacaagtggagatatgcacatatacatacatttatatagtcactcatacagggtagctgtgttccataaagtcacctcaagcaatgaattagcgaatgctggaccactgctcctaggggaaatacatggctaggtttctgtgagcctctggtcacatcattttcagcaacctatcaacacataagcttgtttcgtgtgtttctgtgtaaatacaccgtatttaatatatattgttgattccttaatattgaattcatggccaatagctctatccctatgcctgaatgaagcttctctaatgaacattttctctggtcaggcagtttgcaaccttcttgcacttagggactctagacagcactgcagcactatgcttgggagccattttaagcagcaaaatcacccacaaaatgcacaaaaatgtgaaaaacgtggcactaaatatacttcgagtatacttatttacagtctgagagctgaaacaagaaggcagagtattgccttgttcagcctcagctgggaatgtgcataccgggcaactcaactttcaccgctctgcacatgtctgctaataactgcgaaagaagtgcctcaagtattaaggattacaaatgaatcttagcaagtaggcagtcacaaatgtggaatctacaagtaatgaaaatcaactgtataaatacacgctcttatgtatgtatgtttgtatacatgtaattttggagggcttggtttgtgatttcaggaaaaccaactaagattggtagagcaagggaaaaatctcagctgcttgtaaattattcattcccagtttttctgaccattaaatccccttagaatctatgaaaaaaaccacctttaaaatcatggggtgacctgttcttttggttgagcaacagggaggaaagataactgcctgctgctgagcaggtggttttggaaagatgagaggattaaggcatttagcttcatccttctcatgctgttgacccagctctctgtcttgttattcttgaaacgcatccaagtccttttagtaaactcactgagggcagaaccaatgacttacattgtacatgtgtgatgagaaaaagtttgtgtgtgctagataggaaaattgtctgttgtgattttaagtgggaaaaaaacaccttagactatgagcaggcacccgtccccacccaagtttagaagtgtcatggcatcggccctcactgcctgtatcttactgtcctgttttgttctcttccaccagctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacatttt

SEQ ID NO: 3064 - DNA, 109704 bp, human
aaccatatgcttgcctgcatctaatgtgaaaccatccctgctccatgttcttagcatcctaggttcgtttccttcttggcactcaccgtggcttgaaatcacatggatttatgtgattatttgagtatgcctttccccactaaactgtcagcttcatgaaggtaagaaccaagtctgttttattcttcatggtactcccaatgcccagcacagttttcctgggatttagtaggcattccacagatatttgttgggtaggtggttttactactagtacatatgttaacctccctaggaacaggaattagccattatccacacatttgtatttagtatcatctgtctcctagccctttgctactggaggaattgtggaatggagaggttatggctaagtactattttatgatgttattctctgggaattggcttagattagaatcacctggagtagttttataattattaatggccacatcacaaggattcaggttcttcaggttctgttgatctgcggtggggttgggcatcagtagtttataaaggtctccagttaattccaacgtgcatcaagacggaaaaccaccgtgtaactccttgcttctcaaaatgtcccaggacaaaggccccaggtaaattgtttgtatattcaagcctgagaaacctacaggttcctttctagttaaaagcccattgttctagttggcctagagagctgttgactccgcaatgaaggaaagtgttgtatatttctggaggcagagagaggtctgcaatgcaaaaatagtttacagagaaagcggtattgttaccatcagaatcagttgtgattctattttagatcattggcttcagaggaaaaaggcaaaaaaacattttttttctacttcatttctagtcttggtttttcaccaccaaacaaaacaggaaaaaaaagggggtgggggttggtggtggcgagggactgcaggaaccaaatggatagaataaaatagtcttgtctcatgcagaagaaaaataaaagacaagttacatctttttctgctagagaaaagaatgtatttcctgtttgccctcgccgagagcctgggcataatgcggcagtgtgcacagagccgctgaacaaagaatacagaaatggctgagaggacagagtttgaaccgccaaatactggctcagttagaaaccatgtgacagatgcagcttctgatttcatttactagggcgaaacagaaatgtgtaagtgtttctctatatcctcggaggctttgagtgaaagaaaatggaaggtaattaattttcccttccagagttttgcatgtacattggaagatctgttatgattgaaagccttttaaataccaagcttgttaaccaaatggcttctgcaagaaagtgggctttataataagccctggctgcataaagaaatgttcccaaaccatgacgttttccgttggtgtttataacattccatagattatgtgagatgctattcgaatcactgaaaaatagttgggtactgaaagtgtctttagggatcatctaattcagtggttctcaatctgtttttctgtcctcaacacacccatagaatataaaattctgcaattagcgccagctgtatgtctttttaagctgggtgggtcatagcagaatcaggaggggtggagaagagcccattttataacaaaaaatcctcagtagttctgagatgcccatatcccactggttctcaaacttcactgtacattggaatcagctgaggagctttgcaagcgactgctctctgggttccatttgcagaaattctgatttaatttttctagggtgcagcctagtgagagactatgaaactctacccaggtgattctaagtgcagccaactttaagtctaatttccttaaaaaccaccactcttttctccctccattgcaaatggctgtattttgaatacttacagaggggagaggttgtatgtttcctcctgtcccatttatttgcatctttgtctctttgatctggagtccttggtcaggaatccaggctcagttatctaatgtctgtgggaaaacgcagcccacttaattataacttcaaggaggaaagtaagcccaggaggctcaaatctgtgactggtctgtggtaaaaacagactggtgggcttctgagactttcctgtggacgctgttgcctctgcagccactggaagagatgtggtgtcctcttgttaccagtgtgtcttgtgtaatcaagatggtatgccatgctattcactccaacatgcttttctgtatcttcccccaagatgtccctacaggccctcctgaaggagaaacccaaagtgattaacttaactcttccctctttagtcctcatcatttgaggttatcttttgtcattgttaccagcagggaaaacacaaagcatttatcagtggacagattggcatggataggatggcagttaatgtcgttcaaagatgaaggctcgggccaggcacagtgactcacgcctgtaatcccagcactttgggaggccgaggtgggcagatcacttgaggtcaggaattcgagactagcctggccaacatggcaaaaccctacctctactaaaaatacaaaaaaattagctggctatggtggcatgcacttgtagtcccagctactcgggaggctgagggaggagaatcactggaaccctggagacagaggttgcagtgagccatgatcatgctactgcactccagcctgggtgatagagtgagactccatctccaaaacaaaaagatgaaggctgtgttagagggggcatttgtagactggtacccaacatcatacatcaaacactgagaacaagagtttctagatttttttttttttttttttttttagtagtgacttaaggtagagagaggtggcacttaggagatgtcattctctttggtttgatgttgatggtcagtcctgttcagggctggggaagtgaccatgtcagcagaagaacgactgcttagggttttgtggcctcttttcatgtaggctaagagaggaaatgtcttgaaattcgggtatagaggtgtggaatgactgggattatatagggactctatcccttccatgccctgtaatgtccatagtgctgggaacttataaatactgcctttgtgtggaagcgtttttcaggtactcaagtaaagtaactctatcctgatactcacagtactataaacataaagatgaaaaaatgcaggatttaggggaaatgttttcagatttcactggagaaaaatgtagtagcctacaaagatagcaattgagttcctaaaggcatttgggttaaattaatcattgattaaacgtgaaacttcagagagattttgctttctgattcattagcttagatttgaatacatttgcatccctgcatatgtagaaagctaattcagtgaggtctttttgcagcacataatgaaaaaaatgaatgtgttttatgcttaggtgttgtagaatcaggagaaagtggtagataggtcaaaattttatttctgttgctaacttaacatattacaagtatatcgcaaaagcatacgtatacattttgtgcttcttaggcattcgttctttgtgttttagcttaacaaaaagatatgtcagtttttcatttggagccattataacattggaaagcagtaggagtgaaaaactaaaaccactcgaaactcaaacataaaatactatcagacttcctctctaaggcagccttgtttccctggcacgcaccctttgcttctccgctcattcttgcggtcactgactgccttgactgtacttcataggcaccatccatcacgcttgtctgcagcagtgacttaagatggaggggggtgggaccacaagatgcctggcccttggtggggcggggacggggggttgttgttcatacaaaagacctttgcatccttccgaagcgggtggcacctccctgccatcacttgggcatcctccaccagcctctgaagatttcactgaggaggaggggccagaagtagcagggtataggatggaggccagggccacctctaggagtcctggcccgctcaccccaatcagactttacatgccttctttcactattgagaaactgtaagggttaattttggggatgtcatttttgaatgcttctatttgccaggggcaaactgattaaaaggaaaaaaagagagagattgagcttaaacttcctgaacatctatttgaacagctaagaattcctttttctaaggtggcaagtaagataattaatggaatatttggtgcttatgttatctaatatgttagtttgggatgaaataaagtcacaatgaaattttattttttatatgatacctatatactttatagtaaaccaatcctccgtgtatacttgataattttacttatgcacagtttaggactttgtaagaaaagtggtacagatagttgttttcaaatgtcctgttctgggaatgcagagttggggaacaagatgccttcctgtactaagaaattactggatgtctccctcgatgaggtgacatatgaagaatatatagagatgcccaacaaatgttattttctacccctttttctgggtttttcgttttctctcctataaattttgggcaggccgtgtgctctgttgggtcgtgtcatttgagtccatcactacataggaccttctctcaatatttcaaatacttacacaagctagaggttgtatgtttccttctgtcacatttatttgcatctttgtctcttttatctggagtccttggtcaggaacccaggtttaattatctgatgtctatgggaaaactcaacccacttaatgacatgctgcattattttgtagctctcaggggaaaatgtggcaagaaaatggagactgcttattatttcttcttacgccatggttccagaatcttttcatgagagtaaataaaagtgaggtaaaatctgcagaatccttaggttagagagtttgcattatcgattgataggtccttaaaaacattttctctttatttcagaacaatggtttatgacaaccccattcactactcttgaaactgatgaggaacatcagattatgtaatcttgtgcatttggctaagtcagaggaggcctggtgaattcatttgtcattcagagtctagaggaatctaatatttgtttccagataaaaacctgactgagaaagtatatatttctgacatggagaactatgctagatattttatataatatgaactattctagagtattctagaccagcactgtctgatagaaatgtgagccacatatgtaacttttttaaggttagcagcctattgaaaattatttgaatggataaaatcaggtgaaattaactttttaaaatttatttattttttgaaatggagtctcactctgtcgcccaggctggagcgcagtggtgggatctcggctcaccgcaacctctgcctcccgggttcaagccattctcctgtctcagtccccctgagtagctgggattacaggcgtgtgccaccacgcctggctaatttttgtactttttagtagagacagagttttaccatgttggccatgctggtcttgaactcctgaccttgtgatctgcccgccttggcctcccaaagtgctgggattacaggcatgagctaccacgcctggccgtgaaattaatttaacaatatgtttaaaatttttttttttttggtttagagacagggtctcacgctatcgcccaggctggaatgcagtggtgcaatcatagctcactgcagcctcagactcctgagttcaagcgatcctccttagtagctaggactacaggtgtgtaccaccacgcctgactaattttttttttttttttttaagagacgaagtctcgttatgttccccaggctggtgtcaaactcctgggctcaagtgattctcccaccttgacctctccaaagtgctgagattataggcttgtatgccactgtgcctggccctaacaatacatgtcatttaacccagtatttccaaaatgttatttcaacatgtgaccaatataaaaaattactgagttgttttacattatttttgaagtccaatgtaaattttacacttagagcacttctcatttgggattagccccaatcatatgcccactggtgacatgtggccagcggctaccatgttggacaacacagctttggaccttcattcctaaacccaggcactgagagattgataaccaatcaagactcctgctccaatttagaaaggggacttaaacattgagaaaaggagctctctgaaaaaaaaaatatgaaagactccttcaaatagttgatattagaaactaaaccactttccacataaaatctgtgtttttgtctgaagagcgcagtggggaactagcaatttgtaaaatgtttctatgtgaattggaagaacattctgccttcagattgtgcttctggaaaaccagatcaggatgacattgagaggcagatgattgtattgtagcttttaagagaataagctctgtagcttcaatgcctggattcacagccaagctctgctatttaggttggtgcaaaagcatttgcagttttggccattgcttttgatggctaaagccgcaattgcttttgcgccaacctaatacttgctcgctttgtgatctttggcagattcctcttcatgtgtacttttcctcacctgaagactcaggacagtaatagtaactatctcctagggtcatgaggattaaataaactaaaacaaaggcctcagattggtacttagcagtgagctattctattacagcattagctattaaatcatcatcatcgtcactgaaaattgtgctcttatatctcattctttttttttttggtgacagggtcttgctctgtcacccaggccggggtgcagtgatgcaatcatggctcactgcagcctcagtttcctgagttcaagcgatcctccttagtagctaggactacaggtgtgtaccaccacgcctgactaattttttttttttttttttaagagacgaagtctcgttatgttccccaggctggtgtcaaactcctgggctcaagtgattctcccaccttgacctctccaaagtgctgagattataggcttgtatgccactgtgcctggccctaacaatacatgtcatttaacccagtatttccaaaatgttatttcaacatgtgaccaatataaaaaattactgagttgttttacattatttttgaagtccaatgtaaattttacacttagagcacttctcatttgggattagccccaatcatatgcccactggtgacatgtggccagcggctaccatgttggacaacacagctttggaccttcattcctaaacccaggcactgagagattgataaccaatcaagactcctgctccaatttagaaaggggacttaaacattgagaaaaggagctctctgaaaaaaaaaatatgaaagactccttcaaatagttgatattagaaactaaaccactttccacataaaatctgtgtttttgtctgaagagcgcagtggggaactagcaatttgtaaaatgtttctatgtgaattggaagaacattctgccttcagattgtgcttctggaaaaccagatcaggatgacattgagaggcagatgattgtattgtagcttttaagagaataagctctgtagcttcaatgcctggattcacagccaagctctgctatttaggttggtgcaaaagcatttgcagttttggccattgcttttgatggctaaagccgcaattgcttttgcgccaacctaatacttgctcgctttgtgatctttggcagattcctcttcatgtgtacttttcctcacctgaagactcaggacagtaatagtaactatctcctagggtcatgaggattaaataaactaaaacaaaggcctcagattggtacttagcagtgagctattctattacagcattagctattaaatcatcatcatcgtcactgaaaattgtgctcttatatctcattctttttttttttggtgacagggtcttgctctgtcacccaggccggggtgcagtgatgcaatcatggctcactgcagcctcagtttcctgggcccaagcgattctcccacctcagcctcccaagtagctgggactagagacatgcgccaccatgccacgctattttttaaaaatattttgtagagatggggtctcgctgtgttgcccaggctggtctcgagctcctgggctaaagcagtcctcccaccttggccttccaaaatgttgggattacaggcgtgagccacgtgcccagttctgtatttcactttcacactctctatgctccacttagtgtttcagttgcctgtttcagttgctgggcctatagtggtgggcaaggtagacaagattcctgttctcacatcttacattttagggatgggaaataggcaataaacaagacaggagaacaggcaaatgaacaaggtatttccagagtgtgagcagagtgttcagagagtctctagaacaggttaacatgaccatgagaagctggaggtgatgtttgagccaagacatgcatgacttggtgcaaatttggggcagagcatcaagcccagggaacggcaggttgcaaaggccccatggagaaaccggtgtaacgtatttgaacacctgaaagctggctcctgtgtttggagtgtaagaagggggtaaagattggagatgaggtcaataagcaggcaggggctggaacctcaaaggccttgcagagcttgataaagagtttgaaattttattctaagagcctcgaaaggtttaaggcagggaagtaatagaacctgatttgccttttttttttttttttgagatggagccttgctctgtctcccaggctggagtgcagtggcacaatcttggctcactgcaagctctgcctcccgggttcacaccattctcccgcctcagcctcccgagtagctggaactacaggtgcccaccaccacgcccggctaattttttgtatttttagtagagacggggtttcaccatgttagccagggatggtctcaatctcctgacctggtgacccgcccgcctcggcctcccaaagtgctgggattacaggcgtgagccaccgcgcccggcctgatttgcctttttaaatggtcactctggcttcaggagatttaatgggagcaggagagagacgaccactactatctgctttcaagaatgtaagattggacatagctctctgtcccctgctttgagcatagctgattcctctacaacaaccccatcactggccttgtgttgtgaaagagatcattttctgcttgtataggagagtagagagacctttacgctaacgtggcctgccatttcagactatgacataaccatgcacatgctcgcacattcctagaagaatccgtgtgttagcaaaaggattgttgtgttctttgcgaagcaagagcaaagaatccctcacagaagctgaaaattgccactgatgagtcaaatggccatgctctggtcttcataaacaaaaggcaggctctgattcctccaagtgcagctaattttcaggtagtactaatgggtttatactagcggttctcaaagtgtgcttcctggacgagcaacatcagcatcacctgggaacttgctagaaatgcaaatcctcaggtcccaccccaggagacatactgaactctgaagtgggcccagcaatgtgttttaacaagccctccagctgatgcacctcagaatttggggaatccctgttttttgctgctagagatgattgctcagagtaaaaagcactactaaacatggctgaggagcagagtgatactcctttcattgtaatctttttaatgtaaatgctgagtatttgggtagcttttggaatcaagtgtttgaaccacgccttttgtgtttgaagctattcatgttttatttaggttcttttgttggatgctgctgtatggtataatatttacaaggtttctgggctggcttctccttactggaattttcagaattgatgtaattacatcctccctgagtcgaatttaacagtctaaattggaagaagcctctggctgtcctgatagaaagttcccactgaaaacaaccagcagcattgtatttgaatctttgttgtccacaggtagactgtctatactacagcttcccttcagtgagtttttaacccctgggtggctcatgctgccagccaatctgttcttatgtggatcttcaccgtaagttatgacctgcttacggaaagcagacagatttttagtttagatacatcataaaaggtatatctacttgttgggggagggagggaaataaacattccaaatacagtactgttgtcaaagccaaggatgttctactgtggggctgttcttatatccctgctgtatctgtttcctgtggccgctctaagacactaccacaaatttagtggcttaaaacaatgcaaatttgttatagtcctggaggtcagaagtctgacgcaggtctcactgggctaaaatccaggtgtagatgaactgtgtttctttctagaagccctaggggagaatccatttccttgccctttccaccttctagaggctacatgcattttttggcttgtggccattttcctacatcttcaaagccaggaactgtgggttaagtttttctcacatcgcatcacttggacctcttctgcctctctcttgtacacttaagtaccctgtgataacgttgggtctacctggatgattcaggataatctttggtcatctgattagcaaccttaattctatctgcaaccttaatcccccgtttgccatgtcatgtaattcacaggttccaaggattaggatgtggacatcttggggtggggggtatgatgctgcctaccacagcaggccactaaacttccttacagcctcagtttccttatctgcataatgacattagtaaaaaattattgaaggctctccttgagcattacaggagatacatgtgaaattatttggcacagagctgcccttcagtagatgctggtggcctaacactattttatgttcacaaagtgtctacatagattcttttaaaaattatttgaatgcttgcttctcactcccagacccctctgctctgttctttggtaccccttcccccaccttcccattgggtggtctccctgacccatgctgataggaataattagagcatatgcaagtggaaagggtaggggagaggaaaaaaaaaaaaaaccttcttgtctctaatcagttactattttcccccatactttaaactctgaatagaatattcgtaagagtttgggagattcctttgatttttttttttaacagctttattaaggtataattttccatttgttgttctctaccttgctagagttacttctgacctcgtcaaatcctgattcaatcaaaccaactgtcattaactatttggggggataattgttgaaatttgaatataggcagatcttggatgatattaagaaacattaactcttgtatgagtgataatagtgttgtgcttatgtaagaaaatgcttattttttcaagatacttactgagatatttagttgtgaaatgtcagaaggacttaaactaggggaaaaaaaaggcgaagcaaatatggtgaatttttttttttttttttttttttttttggcagagtctggctctaatgcccaggctggggtgtagtggcatgatcacagctcactgcagcctcaacctccctaggctcaggtgatcctcccacctcagcctcccaagtagctttgactacagaaatgtaccaccatgcctggctaattttcaggggttttttttgtaaagatgggattttgccatgttgctcaggctggtcttgaactcctgggctcaagcgatctgcctgccttggcctccaaagtgctgggattacagatgtatgccactgtgcctggttcatttttttaaaatattagatacaatcaagtgatgcaaaggacccaggtggccagatgtatagtttctggaacaacttctttttcttaatacttcacttaaatgacttggttctctgtgaactttaccaattctagtccactcactcccaaactctgctctgttgacatagctcatgctttatcagatgtcctaaggaaactctacttcactatccttgtcaagtttacatgctcccacaccttttggtggaacataatttacattttagagaacactgggatcttgttaggtttgtttcgtcccatatcacaatccactcttcaactgctagatgatgcatcccacttctagaaagagagccttacttagtgggactgagagctgctctaatcatctgcagttctagctgttacgcgtttcccagtggatcttgagctgccttggggtggtgaggggctgttttgtgggagtgtaaggtcagggaagtgtcctctcctgccctgtgacccaggccttgcaatgatactgaaatacacagctggaaattgtgtgatccaaaaaatggtcttgtctgtgcacttgcatgaactacagccctgcccccaaattcgggagttgagatggtgttcccaaattactccagtgagttgtctgttattccaggaggtgacacagcatcatggtatgtgcatgatgtcacctcagacgttgccagacaacaagcccactcaagtcggacatacagcactttataatggaggctgggttccaccgagaacagccattctcttgtctgctgtccccagtgattataggcagatgtgctgtgacttgagcttgcacaggcttaaagttccttctgccttcagagtcagcagtcagccatcttcacaaatggaagattgttccagaccaccattgaccatctggctggatccatcccaccatctgccctgcacagtggcctctcatttcctaatgtttctcataaacagcttaaagttccctgtgacattatctactgcagcagggcttttggtaccactcctgggcatgccaggaacatagggcctatgggtattcatcagagaacatttgtatgtcaaaaattttaacaaatgagacttccattttgaagataatgatgcagacatgttgtacgttcacttatgtgtcttccttgataaccagtcaacaatttatcagtgatcctttatggacatattaatacacttattggtgatctggaagtagtgtaggacctaatctgtaatcttaaactgtgcagagccttgaggatggccattgtttgttggttatggtgtcctccttgatctttgatgaaagaaagattgccttaggtgcttatatcaagttaatctcatctctgtgacaattgaaattaccattggttctcttctttccacataacacatcgttgtaactcagcatgtctttttcatcgttgttcttgtggaattcttttaatttaatttattgtggtaaaatatgtccaacataaaactgatcattgtaaccattttaaagtgtacaattcagtagcatttagtacattcacaatgttgtacaaacatcactatctagttctaggacatttttgtcatccaaagaaaaccctataccattaagcagtcactccccatctccttcccccacctctggcaaccactaatctgctttctgtctctatggatttgcttatcctggacatttcatataaatagaatcacacaacatgtggcctaccgtgtctggcttctttcactgagcataatgttgtcaacattcatccatgtcgtagcatgtgccaggagttcattcctttgtatcgttgactgctattccattgtacagatagatcacatttcatgtatccattcctcagttgatgggcatttgggctgtttttaccttgtggctattgtgaagagtgctcctgtgaccatgtgtgtacaagtgtttgagcacctgttttcaattcgtttgggtatgtagctagaagtggaattgttgggtcagacagtaattggatgtttaacttcttgaggagctacccgtgcggccttttgctcatgccagtcctcctctgccatatgatgtctgttctctttcaaacctatgttaggactcgcctccaccttgattccttttcctgatagtcccctgcagcttcccataattcatgcatccttactagtccctatgagcacccctcattcagctctgcctggagaaacttcacttttgcctcctcatatattcatctggggttaccctacttcttttggctttgaggatgtttttcccactaactgcatgcaactgtcaccatctcaaggatggagatggatactcgttctctgtgctcaaaggcacttgtcactatttttgcctttctattgttgggctattctagtaacagctggaaattacagaaataggttttgattttattgctcatcaaggtcaggtttccactgaaatacaggcatcatagggcctatcctgtttgaaatattaaaatgtcagaagattcaaacaggccaaagagggagagtttgaagcgggggtgggggggggattggtatgtgtatggagtataaataaagaggttcaaaataacaataatagcattaatgcaaccttcttgagtttgacctcgtttagtcttcacaacgaccatgtgagatggagatttagtgtgcatggctcaaagccacacatcccttatgtggcaaaatcagtatgtttgactccagagtctgtgtttttttgtttttgtttttgtcttttgtttgtttgtttttggagatggagtcttactctgtcacccaggctggagtgcagtggcacgatctcagctcactgcaacctctgcctcccaggttcaagcaattctcctgccctggcttcccaagtacctgggattacagggatgtgccaccatgcccagctaatttttttttttttttttgtatttttagtagagatggggtttcaccatgttggccaggctggtcttgaactcttgacctcaagtgatccacccatctcagcctcccaaagtgctgagattataggcgtgggccactgcgcctaccctgggcctcccactttaaaagttgctcaccagttcttgtatccctagcaccttccagaatgtgttgagtatagtcagtgctcagtgaatatttattgaatctaattgtcaaggaatatgccatttgctgtgttaattttccccaatatagtttttgttgttacatttttctccttaagccctagaaaagtgtaggctttttaaaaaatgaaaatgtttcattttatttcaagaaaggagccttaatctttatttgtatctatttacaaactgttaaagattttgactgcctcctaatgtctttcttaatctcacactttttgaataaaaagtgttaatatatccgttgtaaattgctggcagctcaatttgaaatatctttttgcacaatatgtactattaagtattctcgtgttattgctcagggtaagaaaagatgactgtttttttgccatttaaagcagtcgtctttttttaatgctgtatttaatttttaaaagacaaagtacagcttaatgaaacaggaacttgctgtttcaatgtgaaggacatgatactccagacacattctaaaaggaaatacatttttaaatataaatgtttggtgtttaatcattcattaggcaaaaatggagacatttgagttgtctggatcccttgagcacattttcatggcacttacatgtaatgaagcagctggcccaggatatattcataatcagtgtcactggagggcttaccatatgccaggcttggttctaattgcttaatgtggattgacccatttaatcccaaaataaccctacaaagttgatgtagtcatccctcttttaaaattgagattaaatttgcatagcataaaatgaaccattttaaggtcaacaatttagtgacatttagtctattcaccacattgggcaaccaccagctctatttccaaaacattttgatcaccctcaaaggaaccccataatccctcgtttaagaatcgggaaacagagacatggagataagcccctttccttaagttacccaactgggaagtgatggagccatgtttgagcccggacactgggactcaaggccactctctgtcgctctctgaagatctatactttagtcccactgccaccttacccacctcctaccaacctccagtgtagtgggggcaaagcacttcacttctaacctcaggttcttgaagtgaaaagcagtaagataatgtgctggttgccaagatctcagggctgcaaaaaaaaaaaaattccttacgctattctccatgggaatcaggccaaagcttttcttcatcaaatttcccgaccccatttctgcagaacaaacagcacaccaggcagggactcccctctgtttcttgatatcccacttccacatttatctattatcatcactctctcattcatgtttcagaagattcccacctcttcactagggtcgagactagcataaaacaaaagagatgaccagggtgcgaaatggaagggggcactccctctcagggtcctgtaagccgagtaagtactctctggcctcacgtagtcctggtcctgccccacacctcctccaagatcatgttcagttgctactccctctcattccttgcctccctctaaagaattctaggatccttttcacttctgactccttgtcctgtctctgaccatttatgtccctcctctctggagatgctcctgctctgttcgccctctaaattgtcttttttttttttcttactctatatccagctgggtcatctcgtccgctctgtgtgctactgtctttgtgttaactctcatacctgcagttctctttcaccctcagcctaggtgaccatatgtcctggttggcctggaaagtcccagtgtatgcttgttgtcttggaatcattattggcagtgcctcttgtcactctcaaaagtgatatgtaggcttggcatggtggctcacgcctgtaatcccagcactttgggaggccaaggcaggaggattgcttgagcccaggagtttgagaccagcctgggcaacatagtgaaaccccgtatctacaaaaaataaaaaaatagcccggtgtggtggcacatgcctgtagtcctagctacgtggaaggctgaaggtgggaggatcatgagcctggtaggttgaagctgcagtgagctaaaatcacgccactgcattccagcctgagtgacagagtgagaccctgtctaaaaaaaaaaaaaaaaaaaaaaaaaaagtgatgtcacatattgcagccttctccccagcactcctattctgctagcacgtttctcaggcatacaaaatgcaacagatcagaaataaaacttctcagggtcttgcctaaaggctgcaccacctcaattttctctatcttgactaattatatccacaaggaaagctgttggctcttcataaactcaatctcagttctccaaggctgaaggaagaccaccacacctggaagaacagctggacccagcagtctgcacctctgttccctgtcacccttccttggaatcaagggctactgctcatttaattctctagcccagcacttcccagcagctctttccgccatgacagaaatgctctatatttgtgttgtccgatttggcagccactagcacatgtggctattgagcacatgaaatagggcttgtgcagctgaggaactgacttaacaaagtacaagtagctagtggctactatatgttatagagcagctctacctcagtacttctcaaactttaacatgcatacaaaacacctggatctcactgaaaggtgcaatctgcttcagtacatctgcaacaagacctgagcgtccccattgtagtaggcttccaggtgaaactgacactgctggtctaagggccacactttgaggagaaaggcgctaatctaactcgattctcatccctggctcacatgagccacacgggggaaggtttaaaaatgtgtcagatgcccagggcctttcccaagccaattaaatcaggacctcagagagtaacctgggcattgacatgttttgaaagctcctcaggtgattctaatgtaagatgagcccagactgagctgctcaaataagactttactaaagatttagggttaagaagatggaattaaccagtgaatacaagtcagttagccactgggatttctgtgtggcacctactcatcttcagcctgaagtccctaatagagtctctgtatctgccttctcccccagatctcctgaaactggcagagaatgaaacagctctaacttcttttttttttgttttgttttgttttgttttgttttgttttgtttttgtttttgttttagagatagggtctcgctctgtcaccgaggctggagtgcagtggtgtgatcatggctcactgcagcttcaacctcctgggcccaagtgatctacttcaacctcccaagtagctgagactgcaggtgtgcaccactgcacctacctagtttttatttttttttgtagagacagggtcttgctatgttacccagcctggtctaacttctttaaatagatctggaaggtgccagacttagcctcacagttgtaaaagatttctgtctttgcaaagggctgttctagataatgtggcttttctgacatattgcatacatactctttgaattactttatacttttcttcacacacatgttcattgtatactttttaaaaagcaaatacagagaccagagctgtttaatagctgaggacctccctggactcagattctccctgaagcagtgttaggggctctgttttctgtgttcatataaccctcagtccataccttgttggaatggttgttattgctttatgatttctctatttgtacttctttctagactgagagctccttcaaagtagggccactgccctatttctctctgcctgtctatcccggccactatcagaacctcctggggaattcctccctcagacctactggttcagaatcttaagtggatgagccctggaatgtgtatgtttaaaaggcttcacagatgatctttattttcagacaggaatgaacatcattgccttagagactgacattatatctggaacatggtaaacattaaataactatttgttgagtgcatgaaaatcagtcttaaattcgacttgtggcatctcgaggcagatgccaccttagccaagtgatcaaggttaatgtcatgagtaacctgcatcaataccatttgccccccatgcaatgcattgcaaaggatacagtattactactctggtttccttccaagtgatgcataaccccagctgaatcatgaggaaacagcagacaaacccaaattgagggatattctacaaaatttgtgaccaatactcttcaaaagagtcaaggtcatgaaaaacaagtaaagactggggaatttgcacagattgaaggagaccaaggagacaggacaactaaatgccgcacaagattctgaattgtatcctggaatggaaaagggacattagtgggaaaactggtgaaatccaaataagttctgtgctttagttaacagcattgtgccaaggctaatttcttagttttgataaatgttctgtagttatgtaagatgttaacataaggagaagctcagtgaaggatgtattggaactctttgtaatatttttgcaacactgctgaaagtctgaatttatctcaaaaccaacaaaaggttaaatttaaaaaatgaatggaagataattgaaatgtcactgaacaagggcattctggaaggagagtaaagaagtccaaggggagaccattggttcgacaatcggaaccaaactggaccatcatagattacaagttgatgcccctatggttttgtcaaaactccctcatgtttttatagctattttgaggtataatttacataccatacggttcacccatttaaagtgtataattcactgtgttttagaatatttacagggttgcaccaccatcatcacaatctaattttggaacgtttttgtcccctttaaaaaaaaaaaaaacaacctatatccatttgctgtcactcaatatcccaccccaccagctgctgccaagcaaccattttttcctttctgtctctataggttttcctattctggacatttattttaaattgaatcatatgtgatattttgtgtctggcttctttcacttagcatgatgtttctgaggtttatccatgtggtagcatgtgtcagtacttcattcctatttgtggcccaataacattctgttgtatgaatacggaccacatttatttattcattcatcagtcgatgaacacctaataccttttggactattattctgatgggtttggttgaatactagggtagactgcccttccagcctcccatgctctatgcatccattgctccagaagatagactcttaggataaagagttgacaccatctccaagcatcccaaacagcattgtgtacttatatacatgattagccactttggaatgtctttagtgttaaggcaagaaatgtccttagagtcccagagagggaaaaaatgtgggttatgttatgtccaaatccataaccaccacttcagggagttgtgcagtgaattgctttattgaataagtgtgagaaaggaaagatattagttgtccaagaatgctattgccaaactttgtggaaacagagtattttctgtggaaacagcatacattttattctgtgccatggaatttcccctcatttgacccaaggggtaaagaaaaactcttatgcaaccatcccattttaaaagttattcttttatatgtaggctggttaataaccaacaacagacaattttatctaagatgactaagatcttgcatttcgcttttagtgagagctgatttacatatctaattcatgttctattagcagagttatgggaatataaggaaatgcaagaaaaacccaggacttggatcagattttaaagtcctacagttatatacagttgtgaagatgtccttcaaaatccagaaaccaaacagactctgtcatcttactttttgctgaggtgttggccttttatttttgaaatctagcaattttcacttcttgttatctaaaagttattaatacaaagcatttcctcccgtcatttacataactcttttccagcagtatgcacacgtacacacacacacacacacacacaatttaaatgtctatgagcaacttttgactttctggaaaattctttccccagcttgaaactttctccatattctggtgtttcacctgaatgtgaaatgaagacatttcacagaatctaagagttcagaaagaggcaccgtgctagatactcatgtgcatagtttctggtcttctcactggcccttccagtaacttgtggttattctagaagtccatgtccagaacagaacactgagcaacagatatcatctgggatccatgtttttggtctaattggccttttgggtgaacacatcatttgggctcaagttgatgattgtatcaagtaagccttttcagtctcttctgtgctgccactgagcctgttccaccaccaccttccctcacccccatcttgaaatcatgcatttggttgctgagacccaagtgtaggatacaaccgtttgttcccatgaccttttcaggtcctcctcatctttctggtttgtcttcctttcagcatctggtaattttgttgttgaatgggttggcctcacttcctagcttcatgttacctgcagacttggtcacgaagatgtgtataacttcatgtgagccattgataagcagggcaaaatagggaaagtgccacccccacaccatgcctgtcactggagactgctcggcagtttcatactttattacccctgagatctgttgtgaatcagcctcactaaaggtcttcccctctacattcccttgtgaacaagaatagctggaaagcccttacaaatgccttgcctgccaggcacagcggctcacgcttgtagtcccagcactttgggaggctgaggtgggtggatcgcttgagcccaggagtttgagaccagctggggcaacgtggcaaaaccccatctctacagaagatacaaaaattagccaggcgtagtggcacacacttgtagccccagctgcttgggaggctgaggtgggaggatttcttgagcccaggagattgaggctacagtgagctgtgattgctccactgcactccagcctgggtgacagagtgagaccctgtctcaaaacaaaaataaatgcctcttcatgattcccatggtttgtgtctagagatttccctcagcctaagaatctaaccgtaccaagtgaaagcaagagaggctgatcttgcatgtaatagtcactgaatgttctaagtgcttgcagaatattcttcaattgtctcttctagactcttgactaggatgtatatcagattcaccaatctgtggtttttgaagcatgttttttccttttcccttttgaaaactgcaaatgcatctctctgactccattcgtattacaggggaagatttagttattttatcttcaagttctccaagtatctgggtataatttgtcttcactataatgctaaaattcatttagaatatcttctaatcaatttgggacctcagttctctcttcattagatttttttcgtctactcttccctggctgaagctcattgtttttttaaaaatagatatatattttaaatttttaaatatttaattgacatgtaataattgtacatatttatggggtacaatgtgatatttctgtacattaatgcattgtgtaatgatcaaatcagggtaattggtatatccatcacttcaaacatttatcacttctttgtggtgaaaatattcaaattcctgtcttctagcttttttgaaatatgtgttgttaactatagtcattccagtgtgcattagagcaccagaacttattcctcctaactggtgatgttgtacccattgagtgacctcttcctacttttttgagacggagtttcactcttgttgcccagactggagtgcaatggcgcgatctcagctcaccgcaacctccgcctcccaggttcaagtgattctcctgcctcagcctccctagtagctgggattacaggcatgtgccaccacgcccggctaattttgtatttttagtagagacggggtttctccatgttggtcaggctggtctcaaactcccgacctcaggtgatccgccagcctcagcctctcaaagtgctgggattacaggcgtgagccactgcgcccggcttgacctcttcctacttctaactcccctcaccataaccctccatagcccctagtaacttctatccaattctctacttttatgagctcaacttttaaaaattccacatacaagcaggatcatgaggtatttgtctttctgggcctggcttatttatttcacttaatatgatgtcctccaggtgtatccgtgttgtcaaaaatgacaggatttattgttttttttatggctgaatagtagtctgtgtttttatccaagcagtcagaagcaaagtgcagaagagaatggggtttttttctttcattttttatttttactttttctttttgagacagggtcttgctctgtcacccaggctggagagcagtggtacaatctcagctcactgcagccttgacctcttggactcaagtgatcctcctgcctcagcctcctgagtagctgggactataggtgtgcaccaccatgcccagctaatatttttctttgttttttttttcttttcttttctttctttctttcttttttttttttttttttttgaagagatggatttttaccgtgtggtccagtgatctgccggcctcaggctcccaaagtgctgagactacaggcatgaaccaccgtgcctggctgagaatggggttttctttgcctattgtaatggaaacataaatccgtgaatttggcccgtgacctctttgctgttttttatcacaatgtcatgaactgctttgcagtttacaaagtgcccgcatgtgcatgtgatctttacaaccaccttgtgagctagtgagtttactacctgtattttagaaacaaagaagcagagttgaacttgcatttagtgacatggagggttgggtgacttttccaagttgtggagcctgttcatgaccaagttggatgcctcccagctttttcactatgcaatctttgccacatttatcacatacagtagtccccctttattcacggtttcactctccatggtgtcagttacctgtggtcaacagtggtccaaaataggtaagtacagaacaataagataagaaagagagactacattcacataactttgattacagtatattgttatagttgatctattattagttattgttgctaatttctcactgtgcctaatttataaatgaaactttattgtatgtatatacagggaaaaacactgtatatagggtttgttactatctgcagttttaggcatccactgggggtcttggaatgtatacctcatggataagtggggacctgtactttactatacgttggaagcacacctttctgactttctcccctgaaatccttgtttactctttaattcatgccattctctgtctttcatacacagtatgtgggaagggtgatgcccataagccactctaacttcctgcactccctttcatttctctgtggggctcaccgatgagtgagtatatttccagaacatcatttctgacatcatccaaatcctctaaagcagccttcctttaaaaactccaaccctggaatctaatctgcatttttggaacgtttgcaatatgctgaagtcagagctactccctttgctgtgccccacgtgcctgggcaccagcccctcggctccaccacctgatgtgcaagtcatgtcagtgtcctcccaagattcctttcacttccccaacttggtgcccaagggggatctgcactgggtctagtgcagcatcccccctaacgtgctttctacaagagggaattggcagcaatgctaggcaaggcgattcagaatcagcgactctacttttttgctgaataagacactgcagatctatttcgctgatttatttacattattctgcatgtccttggagagatggcagaaggttaagggacagcatcgattctttcagattcctcaaggctcttgcagatttcccatggtcctttgtactacaaagtgggagaatcaagcatcagatgaccttttcaatgttactctgttggttcaatctgtaacaactttttctcttgtcttcaccaacctctcactgctttccacaaaaaatgaaccatggcctgctattatttgttttcaattctgaatataataagatatcataaattgctttcacgaaagtactgatttgattatcacttatgatacaaattatgaaactgcaacatgagtgttttctctctgattcctttcaccatttcactgcagacttgaaaagggaccagaatggaccaaaaagaaattatttctttgttgttttgccaaagacctttcctttcaaaatgcacacatcctggagttttgaaaactgctataattatcacaaggcagtctttctgtgggaagaaagtgagtgaatttcccattaggagatcatggttaaaataatctctcggctctgggaccaaatggaactagaaagtgtgttcaaaagctgcattcatttcagaagggagaaagaacaacctttctcataatgagccttgggaagcagccagcgtggaaaaaggtcacacaattgccactttggtatctgaataactactcttagcttacttttgcttgtggtgtgatagcttttgtggttttctctggggctgaatccctgctgtcttcaagcatagttttcactgagtctgtcttggaaaccactgtgcgtgtggcattgtcatctaccatttttataggagacagaaacagttactctgacccaagtgactgaaatgcagctcagtaaattttttttcccaatagtcttagcatgtggataggacatttgttcttatccagaaatgaaatgtgttaagattgtgtgaaattatctgtatcttttgctgctcatttttcaaagattgccccggagggtgttttggtgaaattatttatggaatatgtaaaaatgttcaagaccctttatcagaacagaactgaggaggatgctgttcctgaagattctgcctactgcctatccaagatgcaaaatattagtggtattgaagagagatgagaggggagattattttaaggttatgtgtctttctacaattataccaatttttaaagtgtatttccagctgggcatggtggctcatacctgtaatcccagcactttgggagaccaaggtgggaggattgcctaaaccttggaatttgagaccagcctgggcaatgtagcaaaaccccatctctacagaaaaaaaaaaaaatcacaaaagttagccgggcatggtggcatgtacctgtagtcccagctactggggaggctggggtgggagggtcacttgagcccaggaagtcaaggctgtagtgagccgtgattgtgccactgcactccagcctgggtggtagagaccctgtatcaaaaaataaaaataaaaaatagtaaagaatatttccacaaatcagaagtgaaagagacagctcttggagaagggttcatattcataatacttttctcattgcttattttccaaaagctctaaaatggacttctatgtattaccactgcttcatattgcccacctacccaccttgttgctcctgtcatctaatgttatgaaaatagtgtttgggatttaaagcggaagccatgggttgatttttaagaagtcacagaagccaagactgctgagcactctggtgtcatcagaatgaacattccctgactccagtgagtatcctgacgtgtgtagttaactctcacaaactcaggcacgtgaatgatctcagcagaagagagagaagggccagtggtttaccccattgtctctcccctctttcaacatgggtcttgactaccttgcttccaggaagcaagggtgacagctgaaaaccaaccggaagcgttatttttgttgttgttgttttttgttgtagttgttgttgctgttgcttttgagcctccaaagaccaagatccacttaatagaccgtggcatttttgcctcatctactgacttaagaacttaatccatgaccctgtcactacaccccctgcacccccacccacgcacatttacatgctcactcgtacactcattcacactcacctctacctttagatttaacccactgagctgtactgagccagatgaactggactgttgattcttaccatttctggatcgtgggttcctgaagaatctggtgagaagttgtaaaccctcttccctgaaaagtgtctatacaaatgtgtgcagatttggcttatgattctggagggattcatggccaggaaatccatgttaggggatttacttttcactatataccctttgtttctgttgtgaggttgttactgtctgtgtatattacttctgttaattgaatctgtctaggttactttttcaattaacaaattaattagaagactaagagcctaaaagagatttttcttatctgattaagttcagtattgaatcctgagagtccatttgaaagcatagtattcgtcggctttttcaattgcaaaatatttatcgtgattgccaagaaatattgctgagagccaaaataataatagaggaaatgatctacagttgaatttttatctgaattattttgaacatagaaaatgaatttttgtaaataaaaaaataatagatgttggtgtggatgcagtgaaagggaacacttctacactgctggtgggaatgtaaactagtacaaccactatagaaatagtggggagattgcttaaagaactaaaagtagatctaccatttgatccagcaattccactactagctgtctacccagggggaaaaaaaatcatatgaaaaagatacttgcacgtgcatgtttatagcagcacagtttgcaattgcaaaagtatggaaccagcccaagtgcccatcaatcaacgagtggataaagaaaatgaggtgtgtgtgtatatatatatgtatgtgtgtatatgtatatatgtatattatatatatatgtatgtgtatatatatgtgtgtatatgtatgtgtatatatgtgtgtatatgtatatatatgtatgtgtatatatatgtatatatgtgtgtgtgtgtgtgtgtgtgtgtgtgtgtgtgtgtgtatgcacattcattctgtggaatactcagccatataaaggaactaaacaatggcattcgtggcaacctggatggaattggaggcaattattctaaatgaagtaactcaggaatggaaaaccaaacattgcatgttctcagttgtatgtgggagctaagttatgaggatgcaaaggcataagaatgatacactgggatttggggactcggggggaaaggctgggggtggcaagggataaaagactacacattgggtacagtgtacactgcttgggctatgggtgcaccaaaatctcagaaatcaccactaaagaagttattcatgtaaccaaacactacctgttccccaaaaacctattgaaataaaaaataaaatattaaaatgaatttttgtgttaatggtctcatattcaggtgggaaaaatcttcttacagttgccaaaaatggttacctggtagtatgaaaagggtaagagttgataatcctcgagaataaggataccttcctacagtgttttcagcatagcttattttgtgtgattctttgagagcaaaaaaaaaaaaaaaaaccccacgttttgggattgtagtgactgctttgccttgattgggctcctcatgggagccatttcttatactgaatctttcaccataccaaagagtgttataaccttcatgtacattttaaatgacagtcatattttacccttcccaacagggtttatgtaacatctttgtgcagtatgcttaaaatccacaaaactaaaatatctcaaaggagaaaagagaggttagtgatgaataaaaattgtagtgaagattgtcttgttttttccttctaaaattccttcctgtgtaaaagccgcctggccaactgatagtttttctttcaactcactgtgaaatatttttcttagcttgcatgttagcaccaagtgatgtatccattgtcactactgtgtgatatcagttgctgaggtgataaaacatggatttcttttttaacctggtactggaatggaggatggggaagaaaagagagtcaagaaaaggaatgatgcaactgacaggcatacattagtgaggtgccctattcatttatttcagtagctgtacatccttactttccagcactattgaatactctgtgggtggtaggatcgtgtgggggaaagagcatagttataatagctgacatttattgaacatttgctattctaagcacattatttatattaactcatctaatccctatgacaactatatggattagctgggttcaaatccggactcctccacttcctagctgtataaacttgtgcaacttcacttttttttttagatgaacaaaaactatccatctcttagggtagatgttagcattaattgagatggtagttctattgcatatataatcatgtctggtatataaaagaactcaaatgatgtaaaaaaaaatctctgtacacaaagacttcatggcagcatgattcataatagctccaaactgaagacagcccaaatgtccttcaactggtaaatagatttaaaaaagaattgtggtatattcatagtatggaatactactcagcaatgaaaaaaaggacatggatacacacaaaaacatggaaaaatctcaaacattatgttaagtgaagaaatagaaacacaaacatactgtgtgatttcatttatgtaacattctagaaaagcctaactgtggcaacaaaaagtagatcagtggttgccagaggttggggaaggagatcagctgcagaaaggtactaggaaactttgtaaagtgggggaactgttctgtatgttgattgtggtgattacaaaactgcatatgattactaaatttcgtaaaattgtacacttaaaaatgggtgaagcttaatgtatgtaaattatacctcaaagctagaaaaacacttgctgcaaattgtaaggttgtataacattagactttctcatattttagaacagttgaatgggttttatgcagctcgggttttcagagctacttagattatctcaaaggaaacttaatgcaggtgctattgagcacgcttcatacacatgcctatgaaaggtacaatggatgatgccaaagggacctgtgatagtctgtattagagaaattgtagagaaattgcagacagtttatatacactaaaccatcaagaaatcccatgagaattgaggatatgtgtcgcaggtgagtattggggcaggtcagaaagaagggagataatttagtagggataggggtggtcagggaaggcctctgacagaaataagacttgaaagtgttggataagttttctggaaataatttgagcagagatgtggcagttacaatacatacttaaaaatggctggactggagtatgttggaaagactcgaggactttgaggtctgtcagcttcacaaataaggttgcagagtgttcccagttctctagcctggagcttgtgtgtactggttcttaccctgattatgtcctcttccaattctgagtttagtgacgtttcatttattgcctgagattggccacgctgggaatatttaaagcgtgcaaattgacaatcattttggaaatctgtctcccccaacttcctacccaccccaccagccagttgtcaaccatttaccagcacactactgattgtaatcctgagaattatgaacttcagagaggggaacgaacagaagatccagaggtggctggagaggtgtagagagagccagaggggaaaaagatactcgtaagggagatgacaaggcacaaatattcaatgctgaaagagaagtaggatttttgttgttgtttccaagagaactgaagcagtaggatgccttatcacaagcacacatgtaaaaagcacctctcatacaagtcttttcagaccttcagtaaacagtgctcctccttgcctcaacttgtctgatatatacacagcactttgatggtcaatgcatgcagtgcagaattaggtcctcccttctctgtgcttcctggtattctttcagtttctggcacatggaaggcagtcgtagtggctgaatgaatgaaatcatgaactaatccttattgcggtattgctcatactgtatgcttgcaatacaaaaccttgcttacttgtttatctacctcattgaagtgcaaacttcagaagaaccaggaattttgtatcttgttgtaccctagcacttgccactgcacagttggtgctcaagaaatgcttattgaaataatgaaattaggcaatttcagttttagataacatgcaattaccaaaagatcaaatagcattctgttccatgaaacaaacccatgtcctttcttaaaacattcaaaagaggtgctattgagttatgtaaaacatgctagtctctattgtgggagggcattagtctgccaatatctcagtttctttttaacagtacagaaattgaagcaacttactatcaaagtttcttccagatctaagatgctatgattctaagaggaaagaaaattcagaccttgtgggcttaaaaccaggggtcctttattgctttctgttaaggtggaaagttatatatgacatagacattttctgtacttttggcttctttatatggattctatctatataagtgataagtgattaagtgaggttggctagtaattattgcctcactctattcaatttctcttctgtcttatctgtggtaggctgaacaatggcccccctagatgtccaggtcataagccatgaaacctgtgaatatgttcccttatgtggcaaaagagactttgcagatgtgattaagttaaggatctcaaaatggggagattactctggattatctcagtgggcccaatgtcatcacagcatccttataagaaggaggcaggagagttagaaggagatgtgaggatggaagcagagattagaaagataaagatcggaaagatgttatgttgctgactttgaagatggagaaaggggccacaagccacagattataagaggcgagtagaagctgaaaaaagcaaggaaatggattctcctttagagcttccgtaagaactcagtcccccagtttgggcaatatggcaaatccctgtctctacaaaatatacaaaaagtagctgggcatggtggcgcatgcctgtaatcccagctacttgggaggctgcggcagggggattgcatgagcccaggaggtcaaggctgcagtgagctatgatcgcacctctgcactccagcctgggtgacagagtgagaacctgtcaaaaaaaaaaaataataaaaaaaaaaataaaggtgcagacaccttgacttcagcctagcagaactgattttgaacttctggcctcaagaactttcagagaataaatttgcattgttttaagcgattaaatccgtggtcattcgttacaacagccataggaaactaataaaacatctcttctgaagatttaaaaatagcattctttgctttccaaatttcactgtgcataggaccacctggggatcttgttaaaatgcagattctgattcaggggggtctgaggatggtcatgaagatttacaattgtcttgagatcccagatgctgctgctgctgctggttgtagcccacactttgaatgggaaagctctggaggaggtattcattgtctgggcttctctttcctttattgcctttggtcatcattactaaaatattgtatcctgttgggactctttggtttctgtgagcatgtagagaattagaaagccacaaagacttggagtagagccaacatggggaggattttaaaaagctgcaattgttcaacctgaagaaaagacagaagatgatttaataatgatatgtaagaaaccagagagttaatatgtgggaaatggtgattaactgcccctcatctttactttacaggataaaatagcaagaagaatttgggcttaagaactccatactggcagggaggtggtggttctctttgactgttagaattgtacagctgcaagggccctgggatccatctagttgtacccactcattttgtagatgaaactgaagctgagagtgacctttggaaggtcacaagcaaatgacagaatctgtactagaactggtggcttggccatgttcactgcaccaccgcagtggaggctgtgccatggggtttagataattggtagttgctcatcactttgaagtgatttaaaattggggctgtcccagggagccttctagggtggcagaagtgttctgtatcttgctcttgggttcagttatacaggtgtatgcatgtgtgtgtgtaaaactcatcaagttgtaaacttgacctttgcatacttgaccgtacactgattattcagcaattttgaaattttttgctagcatttagaaaatgaaaatgctgaactcttcgttgtagccaaacactggaaatgatccaaatgtccttcaaattagactagatacataaactgtggcaaatttatagaatggatttctatatagcagtgagagtaaatgaactgtaccatacagcaacatagatgagtctcacaagcatgttggtgactgaaagaagccagacacaaaagagaacattccataggattctatctatataaaagtcgaaactgagcaaacttaacatggccttaaaagtcaggggagccgggcgcggtggctcacgcctataatcgcaacactttgagagaccaaggtgggcagatcacttgaagccaggagtttgagaccagcctggccagcattgtgaaacctcatctctactaaaaatacaaaaattagccaggtatggtggcacgtgcctgtaatgccagctgcttgggaggctgaggcaggagaatcgcttgaacctgggaggtggaggttgcagtgaaccgagatcgcaccactgcactccagcctgggtgacagagcgagactctgtgtcaaaaaaaaaaggggagtggctaactatgagggaagtattagggacacaaggggggctctacctggctacatggttatatccactttgtgaaaatgaagcacaatgtattcatttgcacattttctttatgtacatttcaattaaaagttaaaattggttgagagaggttgggagaagaacttctcacaaacctctgtatactattaagctttgaagaatttaggttttttaaagctttttaaattgacaaataataattgttcatatccatagagtacatagtgatgtttcaatgcatataatgtttagcagtcagatcagggtaattagcatatccctcatctcaaacatttatttccttttgttaggaatgttcaatatcttcttagctatttgaaatgatatattgttaactctagccatcccagagtggtatagaacactaaaacttattcctcctgtctagctgtaattttggtttcattacttattttttaaaagcacaggtggaggtaattgcattagaaaacatgtactttcatagaatccctggaagataacttgctgtggagagaaaccttcagttaaggagtctgtatatttaaatctcagttctaagccaaaagccatctcttctcttgtcagctttctctctgagctagtacagtctttctttcatgaaaatctatgaagccagcaccatcctcagatcctttttggccctttgtagttctacagaatgggggcattttttaaaagaagcagcttgaaataaatagtaattttgttaggagacaatgttgtcatgccaggcacacttccctgcagcagtgcctggagtgccacagttggtttcaaatggtgtgaagcggttccagacaagcagccgaccaaacagaacttgtcaccccaagccagaattcccccaaagccatatctgcttcctgccactggtggtatagtttcaaaccagctggctagcctacctgagataatttcatcatgtgaggttgtacagaaaagggttgacttgaccaatctgagactatcttggacaaggccagcttgcaaggttggcccttggctggcatcgggaacttggtggtaagcagttccctgcagtgataagaactttccctaagtgataaggctggttcaggatggctagactgtgctaacactatggcttatgctgaacacctttccttccttcctggagtctggaatttcaatatgtttaggcagagggtgcctccatgaccagcctgcctttctaaccagcttttctgggcagaactgtcacacatattattgtgacttcattggtaggggcaaagtgtgcccatgcgatatctcctgggaagagagagcataaggaagtctgcatgtggattcttccagactccacgtgtgtctttttccctttttttttttttttttttttttgaggtggtgtctcaccctgtcgcccagggagtaacctcagctcactgcaacctctgcctcccaggttcaagtgattcttatgcctcaacctcccgagtagctgggattacaggcatgcaccactacgtctggctaatttttgtatttttagtagagatggggtttcaccatgttggccaggctggtcccgaactcctgacctcaagtgattcacccacctcagccttccaaagtgttgggattacaggcatgagccactgtgcccagcttgtgtctttttcctttatgatccttgtatccttgttaagttgctgtaataaatattggctctaagtacaactatatactaagtcccatggatccttctgtcgaatctcagaacatggggtggtctttgggacgcaggtacctaagtgaatatttaaagtagttttcagcttttttcctgatgaaaataaggtgagaagatactcctgggtgcttctggtgggagtacgaacatggaacaacccttgtcgaggacatgttgtcagtttctagcagatcatacattcattgaccctttgatccaggattcccacttctggaaatttatcctgtagctgtaacaatacctgtacaaaatgatacacataaaaggtttttggctgggcatggtggcgtgcacctgtagtcttagctacttgggaggctgaggcgggaggatcacttgagcccaggagtttgaaggtcaaggctgcagtgagccatggtcatgccactgcactccaacctgggtgacagagtgaaacccagtctttaaaaaaaaaaaaaaaaagtttttgttgtactcttcccccagcctttatttgtaatagcaaaagaccagaaactagtattgtcctgtatggggctgctgagtctctgagggtacattcacactaggaatgactgcagctagaatagaacgaagaagttgtatgtgattaatagaaagttttctcatgtgaattaaatcaaaagcagggtacagaacagttaagtctagtactgtgtgctccttttctgggcgaagggtgtgtgatgctctgaataactattaaaagtggtgacctgtagggggcaagttagacagtgaatgaaggcagaaatgagaactctgtgtatacttccttatattgctttcatttttgtgtcaattacctattaagttttttttaattgaaaatgaaaagagctgagaggaggcagtctgcttgaggtgaatcaaaatcaaggtattataagtgaaataaaaattttacatacttaattttctctttgtttacatcaggtatggcccatgagtcagccacctgtttttgtaaataaaaaaatcttggaacacagtcatgtccattgttttacatatgctccttggctgcttttttgctacggtggcagagttgagtcattgcaaaagagaccagatggcccacaaaacctaaaatattgactattctggccgtttacaaaaaagtttgatgaccctgcacctgtagtgtttagttatggcttatatcagtgttgatgccctgcctaaggatatcaggatggattggaatttgattcatctgtagtaggtaaggccaatggtagtcatttgaaagatgccattttttataaactctgagcaaactcatgttacgtgattgctggggggtcaggggagggggattttactctacaaagacacattagtctatttctaaaacctgccaagagaaattttaagaagcaatgaatgatctcttctctaaagtgtggtgcctctgagacaatctaccttcctggcaatgataccctagctaaatgttgtctttgaagatttatatcatcagaatcatggaaactggacctctccaggagaaactgaggtctgcactgtgcaagatgggatcattgtccctcgatttcagctggttttttttttttcattgcatgcctgaggtgactttacccatccttccagaacaaaatggattattctttgagatgtctggtgattatcataaaccattatcatatggttctgtgatataggaccgtaagcaaggcatttgaataatcatgattttatatgagtaatgatgatagctactgttcactgagggcctactgtgtgtcaggcagcgtgtaaggtgttttatgtgtattacatctatttaatcttcccctcaaccttcagggattgatatgatcattttcactctacaggtaaggaaaccaaggcttagagtttaagttactgaagaggtgatgttgctggtaagtggcagaggtgaaattagaacccagctctggctcagaatctatattctgttccatacttcagtgacttggaatgggaattagttacgaggtagaaccccattcagattaactaactttttttttttttttttttttggagatggagtctcgctctgttgcccaggttggagtgcaatggcacaatctcagctcactgcagcctctgcctcctgggttcaagcgattctcctgcctcagcctcccgagtagctgggactacaggcatgcaccaccgcgcccagctaatttttgtatttttagtagagatggagtttcaccagttggccaggctggtcttgaactcctgacctcaagtgatttgcccaccttggcctcccaaagtgctgggattacaggcacgagcccccatgcctggcctagattaactttttttcaaagaagtgagttcaatatagttttaatttattggtaaaatgaatcattacaaatattttaaataacgataccaataaaaacaatgcttttattcattgcatgtcctaaagactacatgtagtttcattgacgtcttccattgactttgtgaaagatatttagtattctcattttttcaaagaagctggatattaaagagcttaagtatattgcccatactcacatgtatggttcaaccaaggtccagactcccatcccctggaacctgttctgtctactgtgctacatggatttaaggcttgaattagtaacttggcagactgactgtccaagagacaaacatgctgttcaaagtatttgtcctagtccatttgtattgctataaaggaacgcctgaggctgggtaatttataagaaaagaggtttatttgactcacagttctggagactgtacaagaagcatggcaccagcatctgcatccagtaaaggcctcaggaagcttccactcatggcagaagggaaaggagctatcacatagagtgtgagagaggaagcaagagaaagaggggaaggaggtgccaggctctttttaacaaccagctctctcaggagctaacagaggaagaacccactcactcccttccactcagagaggacattaatgtattcatgagggattcacctccgtgactcaaacacctctcattgggccccatctccaatattggcatcagatttcaaaatgagatttggaggggacaaacatccaaactatagtagtgttcctatattttattattttttgagacagagtcttgctctgtcacccaggctggagcgcagtgatgccatctcggctcactgcagcctctcctttgtaggttcaagcgattctcctgcctcagcctcctgagttggtgggactacaggtgcgtgccaccatgcctggctaatttttgtatttttagtaaagatgaggtttcaccatgttggccaggctggtatcgaactcctgacctcaggtgacccgccccctcagcctcccaaaatgctgagattacagggatgagccaccacaccgggcctatattttattactctcccccccacccccaaaataacatatattaaaaatgttgcttttggccaactccctgattctgtttctattccctttttgccatcaattatggtagttatgttctaacaaattgatttttactttcttgtgctgatgactttagcaactcctatgtgaaggtaattgctagttttattgtcttaacattatgctaactgttagtgtaatccagagtaatcaatggtatccagcctggagctgattatgttcaattgtttcaccaatcatttgtctgtatttatgatacacccatgtacacatctggcctccaggcaatggcaatgactgtgtgtatgaaagaatcaagtgaatgtaatgtaaggcagtgtgtgattatgtcaaaatggatgggacagggtgttggtgccgtaagagttcacagaaagctaaagtggtaagaaaatgccttgtggaaaccctgatgattctatcttcttggcgtcagcctacttttgaattcagcctacctttctcaaattctgtttctacctggtccaagtcaccatcatctctgatgtggattactatgcttactccctatttcttccacatttatttttttaaacaattgtatttgggtataatttacatattataaaatttaccagagtatttccatcactcagtaaaattcgatgagcttatttacagttagttcctattcccatctctagtcccaggttccttgaggaaccatgcatcaagttttcatctctactgtgtgcctgttttggacattttatgtaaatgggcttacatatgttcttttgtgtctggcttttttctctgagcatggtatttttcaggttcatccatattgtaccatgtattagtactttgtttttattgccagaaaatgttccacagtgtggattgaccatattttgtttatccatgtaccagttgatggatgcttagattctgtgaacattcatgtacaagtttttgtgtggacagaagtttttatttctcttgagtatatacctaggagcagaattatcatatgataactctttaactttttgagaaacttccgtattgtttcccaaagtagctgcatcattttatattcagtgtatgagggttcctggttttccacatcctcactaacacttgttattgtcttttttcttatagccattctagtttgtgtaaagttgtatttcattccctctttcagtctctaaacaaccggcagaataattttttattgtttttttacaaatgcatatctgctatcttacaccctgactgaatctctttaatggcttccatcacatgtaaaataaagtctaaataaattctttgacctgttgtcacaggtcgggttccctaggaagtacactctgagatggagaggtttgttgaggattgctttcagggtaaacacctgtaggggcatgaaagaagcaggactgagcagagggagaagttgggctgcagcatcatcccaaccaaggtctcagcttatcctattggaaccttcagaggtgggaaggctctgcaaggttggctggacaaaggatctgggtctttatgcacccatattgaccagtcactgagtgccagatgcccctgagccagggacatgaccatgggcaagacggctttcttcagtagagtacaatcactaggaggaagtcctcagccacaagctgtcatctgtcaactttgccagcagctgggggtatcagtatatcagtccggaaggaggggaatctgggtgatatattacagcatccactatacctgagctgagagccatcacattctggtcttctcgacttatctcttaatacttcctttcttgctgtctgggctctagccacactgctttaaatttctttatgttctcaagtttcttccaaccttaggatctttgcacatactattcctattggtttatggccataccaatttaaacacctccaatcttatctagaaagtgagagcattttaaaaatcagtgtttaaatcgtatttgtaaagttgcttgaaaaaggactaggctattaggctagtgttaaagctgtcatttggagggcctttttagctttattataaattccaatattgggaattgctcatttgacatgatgtataggagccattttctaatggaccagcattaatccacttatagctgagtggccaacagattagcaagcacttccattttctataaagaaatggatattgtaaaggcctgggtgatgctgaggaggaggctcaataggatcatatttcttgtattcaaactgcaaaaatataagtaggattaatgttatgttagagtttagatggaggtattaatacattgcatttagaaataatacactgaaatctataaagaacaagagtatttgtttaaagtagactttggagagaaactcattggtaaatcttgaaatttggtctctaaataattaaaagttgtttggattttttaaaaaattgccatgtttccctcttaactgattttctgccaaattttcctgttcagcactcagaacttgggcagcagttggtgtgtaagggatgtttgcacacatataagatggtgttttttccttcatctctaatgatttcataaggtctcagttctatatgacatttggattttgaatttataataccatgtttatatatttaacatggacacatggcaagtgctgggaattaaagctaaatatagacttgttgactgaacaatcaaactatctgcttgtcttagtccattagtagtagtttcactggtatggttgatagaaagcactcaccctcctcatacgtgcatgagacgaggccaagaagtgattcctgtgtaaattggcagccatgacagtaatgatgtttgcctaaaacatgtgtcagtaataggaaagatgattaggcaaagaagaaaaagtttaaaaaaaaaaaaaaaaaaaagctggcgcagtggctcacgcctgtaatcccagcactttgggaggccgaggcgggtggatcataaggtcaggagatcgagtccatcctggctaacatggtgaaaccccgtctctactaaaaaaaatacaaaaatttagtctggcattgtggcgggcgcctgtagtaccagctacttgggaggctgaggcaggggaatggcgtgaacccagagggcggagcttgcagtgagctgagatcacgccactgcactccagcctgggcgacagagcaagactccatctcaaaaaaatgaaataaaaaataaaaaaaaagatggtcgagggagagatgcgtatttgctctgagtgttcagagatttccttacacttctctatatagataagaaaacaaatatgagcccacagtgggtataaagcaacctttttctaagaagtggactggaaataagtctggtttttggttcaaggagggcctgggaagtatccagcatgatgtccgggaacacagatcagaagtagacaactgagcctagaaatgctggggttgagtgggagatgggatggatgcatgagtaggtgggtgcgtgggtgggaattcagaatttcgtagaggaaatggaagtagggaaaagggacagcactcaggtgggaaactcagaggtttagctgtcactgggagacagccaaatgggagaggaagggaaaggtggaaaatgagaaagagagaaaggaatgcagaatggagaacggggttttggcattcttttctgtccttacttgttctacctgtgataaagaacccatcagtttggacacagtgtcccttcatggcctggcaagaatcctcagtaggacacaacctcctacgtgggagtggtgattcagaggaaacacatggtgaggataattaatttggaggttgaccatgttctgtgtgggtgtttacctctttcagaacatgtagctgaaagttcagcgtgtactattgaaaagctttcttgcaacgttgctggctgtccttggtcttgagactaaagcatcccatagaagtggtggaacgctaaagattgaaacaaaccactgaaaattgatttataaatatataactagttgtaagctgaagactaaagcatcccatagaagtggtagaatgctaaagattgaaacaaaccactgaaaattgatttataaatatataactagttgtaagctgaaatctaaataactttttaagttaaatatatatacaaaaatattagaagaaggagaattttcactctcaactcattcttgcatagaaaaataaaatctatcatctctgtatattagaagcattttgtttttggaagaggttgttggaataggttatatggaaggccatttcattcaaatgaacaaaaattacgtgagatggaaattggcaaatttatcccaagtaaatactgaaaaacctggaagcctttcaggtgctcagatttccactatagaaaagaaaacattctggccaggtgcagtggctcatgcctgtaatcccggcactttgggaggcccaggtaggtggatcacctgaggtcaggagtttgagaccagcgtggccaacctggtgaaacctcatctctactaaaaatacaaaaattagcagggcatggtgacgtatgcctgtagtcccagctactcgggaggctgaggcatgggaatcgcttgaacccaggagatggaggttgccgtgagccaagatcacaccactgcactccagcctgggcaacagagcgagactccgtctcaaaaaaaaaaaaaaagaaaaagaaaaaacgttctgaaaataaataaaaagaaacattctggcacatattagaaggtaccagagtaagagaggcaagataaatcccagctttgttggtcatactgcatatcaaaaacaatgaattgtcttttctgttttcttatttttgtttagagcatagtcagtggttcaagaactctaagccatagatagctcagacactaggaaagatgttggctgactttgagggggaaccacttgtagctatagacaaccagaaaatgctgtggtccataccatgaaatattttgtcttactgaagtttgaagatccttccagatcccggcattgatctggagaatgatattctccacatacttgggctccaagtctttgtgtccagggcttggcaattaccttattgtatccagtggaataataattttgatgctatttgttcaaataattctgaatgtactaaatggatgacattgttaaatgggacatttggctgttacaggatgtgtgtgtgattgattaaagcaaattttaactgtcagaagatgaaggcactaaaagtttttgccatctaacaagcatcagtcagatatgaaaataggtgtttccagtcacttttattaataacataatcaacatttgtgctaaactagagttctttcaaaatggaatttggcaatgccaaaatagccaaaactacaaagctaccgtgtggtactggcctaagaatggacatatagatcaataggatatcattgagagtccagaaataacccttatgtttatagtcaattgattttcatcaaggatactaagacaattcagtggggaaagaatactcttttcaataaatggtgctgggacaattggatatccacatgtaaaagaatgaagttgcacccctacctcatatacacaaaaattaactcacgatggatcatagacctagatgtaaaaactaaaattataaaactgttagaagaaaacacaggagtaaatcttcatgaccttggtttagacagtggtttcttagatgcaacaatagcaacaaaggaaaagaatagatacattggactttatcagaattaaaaactattgagctgcaaaggacaccatcaagaaagtaaaaagagaactcacagaatgggagaaaatatttaaaatcatatatctaagagacttgcatccagaatatattaaaattaataataagacaacccaaaataaaaataaaggatgtgataggcatttctctaaaaaatttacaaatatccaataagcttatgaaagatgttcaacatcattagttgggaaatgcaaattgaaaccacaatgagatatcacttcacacccactatcatggctgaaatcaaaagacagtaaatacatgttggtgaggatgtggagaaactgaaaccctcacatgctactagtgggaacgtaaaatggtacagctgctttggaaaacataatggcagtttctctaatggttaaatataggattaccatatgacccaacaattctactttcaggtatatacccaaaagaaatgaaaacttgtgttcacacaaaagcttgtacatgagtgttcatagtagtagtgttcataatagccaacaggtggaaacaactcaaatgtccatcaactgatgagtggatcaacaaaatgtggtatatcctgcaatgcagtatgattcagcaataaaaagaaaggaaatactaacacatgctacagcatcaatgacccttgaaaacattaagtaaaagactccagtcacaaaggactacatatccatgtgtccagaaaaggcaagtttatggagaaagtagaaagtttatggagaaagctcctaatggttgctttgaaccagagttgaggggtgagggtagggtagggaggaatacagattgactgctaatgggatcttttagtagggactgaagtgttcaaaattagatcgtgttaacagttgcgatcatatattttgaacaagtggaaaggggggaatatattaaaaattgtacacttaaaatggtgaattgtatggtatgtcaatgataataaaggtgtttgttaaaaaaatgagttttggcttcatcgtaatcagtgaaagaaatatgttgagtaaatattaatacattattttatgctgtgtccattgactcatattttaatctgggaaatatgcatctttaattactgccattgtgtgcttaaggctgatgtgtttgggtagcttttaaaaaattttttttcttttaaaaaattttttgtagacatgggggcctcactatgttgcccaggctgctcctgaactcctggcctcaagcaatcctcccatctcagcctcccagagcactaagttataggcatgagccaccaggtctggccacagatctttttgacaatggaaatggttgttctttgatcaggtcaataaaataattactgctggcagagggatgtgcctcctgttcaatgtggaggtcattaggggcccctgggcttcataaaccacagggggaaattgagaactacttagtgtttctatgcactgagctcctaccgacgtaatgtgttaggtgtctaaatttgcactttatgatatatttcgccaaattttctctccctggcaatgaagtgatgtttacttaacagtttcttaaaagagatggtactctgtgatccatttttatttatgataggaaaattacacttttattttaaaagccaaaggtcatagccattgcagatattctagtaattattatttgagaaatcagttctcactgaatgcaatgacaattttctaaacctagaataggtgctgtggcgtggtaccagaggagtaacatatgtggcccttgttccatgagagatcaaagtcgttttggaatgtaaaacttaaacacatgaatattttggagaaaaagaatgtcatattgtagtaaattggggggacatagacctatgacatggtgagaatcgattcattgaggtttcccacaagctgtagcccttgagttgcaccttgaagatgaatagaatagaattagaacaaatcgaaagggaggaagagtgagaaggaaactggtccaagaagcagaggtgagaaggtacatggggtagccaagagaaacatggtgggtgagcatggcagagagtccagcaatccatgaaggtcggtgatagccagcccatctattaagcaggggttccattgtagattggttgaacaactccatgaaagtgttagttctggacagataagccttggcctgtgatttgaagtgggagaacatagaagtagaaaaccaggtagattgccattacctccacccaagtctgaggccaggaggagaggctgaagaaaggggtgagggtggatttaaactactgacaaacacctcccaccaccgcccccacacatgtatatttggtgactaatcaaatgtggggaaaccctagctaactcatgtattttagagagaacatgcctacgatatgtaaaggcattctgtagatcttggatgactgctccagactctaaggtgatgtgaaaatatattatgacaaccatcatacagacatccagagggatggaagtgagataacttcccatagcgacctagctggcaaatggcagagctgaggttctgaagtcttgaaatgaagatgttggaagggtagtgatgcctttgatgggaaggacagccttgggaaggatgacggaggcatctgctggggagtgggaagatgaactcaacttatcatactgagtttaggaggatgtgaaatatttaagtgaaagtatgtgtacgtataaatgtgtatatgtgcatggatacatatgtatatgttatgtatatataaatgtgtatgtgtgggcacatgtgcgttcatgcatgtacatatgtttattcatatatgaacgtctaaagtatgcaggtatgccttatgcatgtatatatgagacatgcacatacacccatgcatgcatatatgcaatcacatactttcacttaaatattttacatcctcctaaattcaaaatattctaagctgaattcatcttctctgtccctatccgacacctcctttgtgcttcccttcatacgtgtgtatatgtgcatatatgtaaatgtgtatatacctacatacacacacacacacatttgtgtgtctgtgtggtaaatgagccattagagcttagaaaagaaatcatggcctaaaatttagaattgagagtttggagccgggaggaatcatgtgaatctattataaagggtaatgtccggggagaggagagagaggagccttttgaacattcacagatagatcacagggagaaatggagatgtagccacaacaaaggaagattcgctgggggtggaggaattccttcttacttgggcaactgctctagggagtgctagcttccaagtaggagcccaagaagtatcatctgatgtttgtcagtatttttaaaaatatatttattgcgcttctactatacaccagtcaacaagtgaggggatggggacaccaggaaatgtcaggcgcgtggtgtcagccttcccggagcccgcaggcagggaggtcgtgctaaaattgctagcatagcacactgaggtgagctgtggcttcccagtacagagcagcttagattgctgtaggtgggtggctggaggcaggggttacagaagagagcatcagagctgagcctggagggttggtggcatgctgcttagtcaggtactcctcttggaggacaggaatgaggtattgcatgtaaattccttagctaaatgaaatatgtctttaaaacttttcgtccaagtattacatgccttctcaagctatcattttaataaggtccacattgccaattgttttcatttgtggattgtacttttggtgttgtatctaaacacctttgtcaaaagccagttgactacatttctgtgggtctatttcagggcgttctattctgttctactaatccatgtacgtccatttatcactaccacactgccttgatctgcatagctttatagttgtcttgaaatccagtagtctgagtcctctttgttctttttcagaataaccttggctatcctagattcttttcctttccgataagaactttagaatcagcttgtcagtatctacaataaggcttgtcaggattttgacctgattgcattaaatctataaatgaaattgaaaatgaaaccctcattttgaacatcagttttccagttgggctttaattcctagaagacctggaattaggagaggcccaaattgagacatgatccaggccaatgaaacatcacttaacagggaaagaggggtgtgtgtgtgcggtacatgagaaagcgagatggaaatcagaaccagaaagaggctgagccaggatcaatgactggagactcggtcccacaggcatggatgttggtcccagtgtggtgtatcgctgaaaagagtcaaactctgtaaaaatatttaaagaagtttattcggagccaaatatgagtgaccacggcccaaggcacagtctcaagaggtcctgagaacatatgtctaaggtgattgggtaatagcttgattttaaacattttaggtagacaagttataggcagacatcaatcaatacatgtaagattggttcagtccagaaaggtgggacatcttgaagttggtggggcagagtccagaccataggtgcatttaaagatttcctgattggcagttggttgaaacggttaagctctgccttgaagggttgaaatcagcaaaaagaaatgatagtagttaagataaggggggttgtggaagccaaggttcttcttatatagatgaagcttccaggtagcaggcttcagagagattagatggtaaacatctcaaagtattatgggacctacaaatattctgtttggtccgttctgagatctcagttttaatgtgaatgctggtcagttgtgccttatttccaaattgggaggagggtatcatgaggcatcttggtctgaactagtttttcagatttactttggagtccccttggcaggaggggtccagtcaataggttgggggcttagaattttatttttggtttacaggaggatgggcagagctgagcacctaggcctgagggagagggacaatgtctaggcctctaataaaggcaataggctacagtagttctgcagggaccatgtgtaggatgccaagcacatggtcccttgccatcaggttcagctgcctccccttcctccctttgggcaggggaaggcaggaatgcatgggccttccagagcctagctcagcccccagctggtgcctggttccaccttggcccttaggagagctctgacactctgaatgtcactggccttgtcttaggggccttagaaaccaatgagtgataattaaggaactggagcttgtatgaagaaggtgccactttaagtgtccctgatggttttgagttgccactaaagagctcagagccctttcaaagaattcagtctgagccagatgaatcttaatttctcaccctcaaattgagatgcagtcctttggagaattaatatttagtggcatggaacacaaatcatttcttttgctggactcttaaagatgtactagattgattttgtttttatgacctttcaaaaacatcgcagtctgttttgctagctccagcctgttgaagttttagaactcatctttagcaacatcaaaggtgacagggacagcctttgagaaaggtacgcatgaagtgattgctggcatcccatagtcaagtctcaggataaagcatccatattgcctttttttttttttcttttttttcctttttactagtggagataggaaacctataaataagcatggcagaggtgtcccctctgaagattgccccttactaagtatttacagtaactggatttctttattttgtcagtttctccaggaagaaaggtgatgtcatgctccatagcaagatgagagaaggagtttagggtttgtaatttttttttaatcaaagaatttaattgcaatttaatgacgagagagaggatgtttattacacggtggtccaataaatactttctaataagtttttaagccatttgagggaaggcttgctacaacaaaattgacaatcaggcaagccgctttgaaggaagcaaatccatgaattttcagacactgttgctaagcgcagctttgctttcccctctgcttccccccccccccccccccaccaacttgctttgaaaaagcaaagcttaaaagcctctattgtgtggagggggggaatatgctaatttgcagcacatttcccatcagactctttttttggcctgtcatagctgagatatgaatgatgataaagagaggagaaggtggcattatgagggttcggggttttgttattgtgcagagagaaaggggatgaatagggtggcacctccagtcacccgtgaagcccccctgggtctgcgggctgcctggagttgagtgggttctcatgggtctgttctgcccttcccccaggcactgccacaatctactggtgactcagcggccccctcgggggaaggccgtgtgtgtaaaatgaataaacacgccagggtggggaacttctacaggggactaggaaaggggacttctacctcctagataagtcgtaacaaagaaaaagagaaatcagtgttttgacatggcagtaacaactttatgagatatcaaggttgtgattgaagggatatctagatacatatcccttcaaagctgtcatgtcgtggtttcatacaatttgggttgcgtttatttttgtcaagtcttcagcttattcagttggctctcttgccggataactggatatgtagttaaatttttatgcattaaacattgatttttatggggcaaagttagctagcatttctgaacaatgagacaacagtattggatgcttactcctgtgttcaacaatatgaaaaacatgttttccttcttgctctgagtggttgattttttttgcaggaaagcgcattgattttgttcctcgtgagcactccttagctcagttttttaaatgtatgaattttataactgaagaataatgcatgcattagcaaacagctattaagacctgcaaaagtgcttccaaattgaaatttcgcatgagtcattggaggcaatttgtatatgtcaggtacacacgtagtgtgttctgtatagttcatgaaagtgaatcgtttgaagctagaaaaggaatgttaattgcattctaggtttgtgttgagtacttagtcgatactgatggtagtatgctttaggtgtgaaacaaaaatataggatgtctttactgcaatagtaaggtgcttttaaaaataaatacataaataaataaacatagcatctttgcttctcttgactctaaattctgaacagctaaagcatgacaaatctttgcactgtaaaaatgggacgttatttatatccacagaacttcattggatagaaactagggttagagctcattcatttacctctacaaataggtagctcacttatccagatgcatgcaggtattaaatgattaagcctctgtagatttttttcttccttaaattaaggtctggagtcttctgtttggtgagtctttcactggtatggtaagcatgctttagcattagaatcacacaacccatttaagttaccattaatttttttctgattgaagttgtagcagatcaaggatatcatcgtgaaggagcagatcagccacctgtatgagtgatttaaagtgcaaactgctactggttgtaagctcaagacttgtctcattcaaactctggcaggtcacaaaacgtttaacacatcttgcttattaacctcaacaggtggtgtaagattagcatttgagagccacgtgttctgaagaccatcctgcatttgtttgagtcagctttggcatgcggctaagctgtcactctgttcatatcttcagaaactagaagctaatacattgtcttgccaagcatttttcacatctagcactgatggtgtacctctgtgttttactataaaatgtaaaagttgaatgaagttgggagttaagcagactctgaaagtgagacttcttgtcactgatttgaaactcagggatgcactagcccctcttagttcttgatgtttcaggcaaaaccctgatgatggtgccatgactggaaaaaaatcctgtatagacagctttttaaaaggtacacgtaagactagcttttatctacatgttgtatttaatacttaatctagccaggaactcttctcatctgtttactacatcctcatttaatcttcccagtcacttgaaggtggatatgactaaatattacagtgtacaggtgaggctctgaggcaccaaggagttaagaaacttgctcccattgtagagttgaagaaaaactcctagctttttcactggggtctaggacaccccccaaaaaactgaaattcctaaaagtgtatcagatagagaacttctgattatttctcaagtacccattcagatagtatttcttctaggaagccgtgcttgccacacatcctctgccccttccagcttttattggccattcttgctggcagagttaagcttgactacatacttgcccccatggttccactcatccttccatgggttgtatgagtttgggaaggctgaggaccagatggctcttgttggccatttagcaacaccaataatagttgtcccgggctagatgctgggtctatactggtgaatgaatgagacatggacccaacattcatgtactcatgcacggtttagtctgctgagatgctctgtggttctagctgccatgacagtggcaccacccccacacacagggaaacaggtaaatatttgctgaataaaaaaattaatgtttgtgtccctctgttcacatgagcccattagctcctccagtgagaagcagtctccactctttttatatccacagtacctgacacaatccttggcacatggctggtacttgataaatatccattaagtaaacagatgagttattaactgacagctaagatgtttcgaactggtatgtcttaatacgatgacaagtatccatttattcttatgtaccactgttgctgccttccactgagaagctttcctgagaatgagtgggatctcaggttgagagctagaaattgcttataatccaaggttctcccctgtgagtgggtggagcaggtgaccattatccatctactatactctgacagagacaggttgacaagctccatcccagagttttattgccttcatgaaaaaaatttttaagccctactctggcctcgcctatcaatcatcacaactactttttattgactgttccttggtcttgagcaaagcccatggcatgcattcgcttacttaattgtatggcatggtttgtcagtggcttttcattaaaaagataaattgacattaacaagcattgatttccaaagatttatgttgtcttctctattgtgctctctcttggcccagtaagattttacttttaaaaggcattttgtaaaaatacaggaatgtggcttggcaaagatgtatatctttaggaagaattatctctgcctagtgaatatattgtagatttggcatttgagccttatcctaacagaatatttgctttgctaactatacatcaggtgaaaaaagagcatgtttgggtgggaatcaagagacttgaattctttagtcctatccatcctgattacagactggaaaaggaaagatgagctggatggttttaaaatttccctcctgttttagaattctgggcacataatgtttatttcaaataagaccggataatcagaagaattgaacaaaattcttctcgttgtagtttctgggaagaaatcctaggttgtttgactccagtgccttcatcttaaatgtctgtgtggtaaaatgaaggtacatagcctgccctctcagggccctgggtgacattgtcaccttcatggcatgaaccaaagacaaagcccaatggcagagcactagaaaccttcctctctgaattgaaagccatcacttagttaccacttagaaagcacgttagcccgttctgattccacttgagtgtatgactaactgacctcaaattgtttgtacattgaaagcacagatgaacacagttttgtttttgttttttaatagggtctctctttgtcacccaggctggagtgcaatagtgtgatcatggctaactgcagccttaaactcctgggttcaagagatcctcacccctcagcctcctgaataggactacaggtgcatgccaccaagcctagctaattttttttctagtttttttttttttttttttaagagatagagtcttgctctgttgcccaggctgggctcgaactcctgggctcaagagatcctcccacctcagcctcccaaagtgctgggattacaggagtgagccacagtgcctggctgacacaatttttaaagtgtaccattatgttgctaacattgcactatcttattctcaaatatatggaaagaggttttatcaaatagcttgtgaggtcagcatagacaatagcattcacttgatctagtaatcctatctaaaaatagaaaatacatttgtttcggcaatacagtatgtcattgatgtagaaattatgaatgtacaattacaggataaattaaaactgcccagcccttaagttattatgggttaatgcgagtggatatttgtcatctgctgtatgaatgtcagcgtcatacacagatttttagggaatgctgaatgtcagacagctcacaaagaagcaaagatcataactcactataacctcaaactcctgggctcaagtgatcctcttggctcagctcttgagtagctaagactacaggcctgagccaccaagcccaactgttcctcagattttgacctttcctctgagatgatctaaatctgcagattctgtgctatgaaaacattgtgtgctttttaatgacttaaaatattattggtagattccatgagatcactgagatttactcttcattggttgccctttctacccaataggatattttatgtttgacctggcagggatcattatttcaagttgtcccaatgcttttcaattttcaaaggccactgactatttagtggattaaaggacctaaatgacttcatcctacttctaatttccatcctagaaggtaaacagatgagacaattgaacagaagattgcatttgaataatgtgaatatattttaaaatgtgtggccttgtcttagtgtgaattatcatcagcaatagaccaaatgaaatagctccaatttttgtgcagtttgtgttttataccaaccgtggaccacccaagcagctgacccaacaaggcactggttttctgtagactttagtctgagggccattgacttacatatctataagtcctgggtactttcctgaactagcaaaagcaagaatgctaacatcagaaagtaaatttcggatacttcaacaagccacatgttggtaaatttcaaatattttgtctaactgcgtgttggatagtcacgttcttctgtaaattaatggttttcagtctttggtgtatctcagaatcacctggtgtgaggctgctgggtctaggatgttcatctcccttcatttgagtaggtagcttcatgaaagtcacacttgcagtagagtcaaaggaaggtgacaactacatgctcactcagatcacctgaatccaccctgccagttagagggctggcaaatatattcctcctagtctatcaatagcctgtttttttaattgtaaaaagtacataaatatattgttttaattatatttaacaaattgtaattcccagttcatgaaaagatcttaaccaatcttaaaactctctatcagatttctgttgagggtggggaaatacattcgaatgttaagtttggtttttcaatttttatatatttgatagcactaaattttatccattttgtttctaaaatacatctccaagcagataacagagcctgaattttattataaaatatctttgtaatggttttattggtttatcttttcattttttgctcttagcaatctgaagataataatttcagtgtaactgctttgagaggttgaagggcacaggttagtaagatcaaggctgagaaaaacttaattgcaccatatactttcaaagaaacagttttgacatcttgccccaaagaacgccaggagcccagtggaatccatcccagggttggatgatgtttagaggtcagtaagagcaggtgcacagtcacttgacctgtacagtcagaggatggcttaggtcaataggagtggtgatggagctggggccatgcctgctgggttgtagggcttcctacctgatgttcttttttccttataaccatcctgctgaactggtcacttaagacctagcgtatcttagagccaggacaagctctataagcatcttgtccatggcctcgtgactggcaagtgacagagccaagattagaaccttagaaccgagacctcccaattcccatcccaaccatcagagccaaccatctcaatagatttttgagaccctaaatgtttagacagggcctgattgtaaataaaccagtttccatgtgggtcccccaagccatttgtgtgtgtgtgtgtgtgtgtgtgtgtgtgtgtgtgtgtgtgtgtgtgtactgagctcttctacatccctttactcaccatatattggaccgtaagcctgtgcctgccttgtactatagtatccatagcttatttatgaaatgtcattgagccagtaaggggaaggtaccagtgacctgccacagcagcaaaagaacagactcctatagaatcatcacatacacccttaatcccactgaaattgcattagcatgccaccacatggccacagcgacccctgccccctttcccttgcagtgacaatttactggatcaggccttgcagtgaggggccagcttctgaacttgcagagccaggtacaaaatgaaaatgcaggccagttgttcaaaaggcaggaaaaaagggccattcacgatactaaaataaaaacgtttccctttcttccagtttctctctcgatttgtcaagacatttttgtttgcaacttaatgtcattttaaattattagtgtgaatcttaccaaccatccttcaattgtacagtgcaaattttagatgcaagtttaagaccatttgccatgtatgtgggatcactgacacacaatttgtattttgtagctagtacatacgtgtattttatacgaactagaacagtggaaatgctgcacaaagttaactcaattgttttgattttacttattgatattagcacatcctcaacactccctccctgtggcttgctagtaagtaaggaagaactgaaaggaaaaggaactcggttgccctatctttccctttccttctggattattttcagtttaagtgcttggccaatacagggaagtaacaggagtaaggaaggatatggtcaggttccttggtcattcatgtctcttagaactccagtaccttctttctgcatttgaagcaagttgagcttagaacagaaagtgtgacctttaggactgttcacaccagtgcttacttagtcatagatggaacatgcttaccttttacggactttgagtccttattgaactccccatgcaccagggattcacaagaattctgagctcatgggacatcatgaatgtggtatgcaaatgaggtggcaaggagcacgtagctcctttgctcacatgcgtgcatcatggtcccgttggacttcacttgaaaacacaggttcgaagataaaatgattaagaatttcaagacagtgccatcagagtattaaaccaagcttcaggcccttctgagggcaaggctctatgcacatcacatgcccctgaagctgaccctgcttgcctgattctctgacatgaagaaagaaattccactgtgctttaaaaaaaaaaaaaaaaaaaaaattcaggacagatttaatttggacttgagtacccaggtgttagcaatatcctacagattccagaaaacaatttagtccattgttgaaagagtacccttgaaggcatgtctttttttaatcccattatcttattcatctcagttccttttatttatttgcaacttagtcaatctcaggtctcacatccaaattggacctcctcagggaggaccatgctacaatttgaggacagagcacaggtctggggtgggaccgggtggagtggggagtgcccctagaaatccaggccaggcaagggcacagaaatgaacttttcagggtcagggaaagatctagaaggacgtgaaatcaccagctagtctttcctctctctacctctccctgggacctgtatgatggtggtgggagcataaaggactttgaaaatagaaatagcattttgtaagtgtcatgtaggaggtatcatgctgaggtgctgcatgcagtgttacactcctaacaatagccttatgggggaagttctcttatgagtccttttggtagacaatgaagctgaaactcaggaaggtcacatggtatcataaggctggtaagcattggagtggggctggcagggatgctggacaaggttgcagacatgagagccttcctgagttgcggaagtgtgtggccccatgttttatcagagtttgaaggggaactccagattactaggttttggggagatagttgcaagtgatggaatagccattctgagtgaagctttctttggtggtgacctggaatctctgagttcaacagttgatgctgctgatcacctagtcacctggggccttattgagcttttgttcctgccatcattgctgcctgactcttggtttccctactctggcatccagtggcctgagtcaaggttcagctcagcttctgaccagcttcttgaccaccttggccaagtccgtgtacagctccctttggtcttcgtttcttcatccatgcaagggggatggatactgtcatgaaggcaaaaatgaaagaacttgggttaaagttattgtagtagtgctggtgctgaggagaccctcagctttgagtgttggcttctgtccattcctcctgagctactgtcacatctcatgtgggtgcagtgggtcctctggacacagcgttgagcccagtccatgggttcctcatatagccagcaccttggcctgtagcaaataaaaacaaaccacttgaaaggaactcgccaagtatccctgatagctggcactcacagtttgtttgtgtgatgactttgcgtattagtcattttcctgttgcttataacaagatacctgaaattgggaaacttacaaagaaaaaaaaattatttcttacagttacggaggctgagaagtgcaaggtccagggggctgcatctggtgagggccttcttgctgatggggacagtcccaaggtggtacagagcatcacatggcaagggggctgagtgtgctaactcaggtctctcttcctcttcttatgaaaccaccagtaccctcccatgataatccattcatccattaacacattaatttattaatcatgaatgattaattatcatgacccaatcacctcttaaaggactcacctttcagtactgccacattggggattaagtttccaacacatgaaatttggggatacgttcaaaccataacagttggtgatagttgcagaggagcatgtacaaagattagaaaaatataaccaacccctgggtttgttggatgctttctgttgctcagatcattgtgacatgagcactgtaggaggggtggatttgaaggggtctggttccccaagaggtatgtgggcatctgtgtgcctgcatgagaaagcacctttcctggcagcccgacaggtagaaactcattaatccacacattgactctatttcagggaaagatgacgtcaactcctgcatgttgaaggcagggagtggctgaaacagcatcaaggcgtgaaggcttccctgagccaccctgagttctcagaagggttcttaaagaagtcacgtcatctttatcgctacttctgctgcacttatcccataattttccaacttctgttgtgagaacttttacagcccaagtgtcctgtgatttaaccttcaatttggtaatgtctgtcttcctttagcaaagcaggctgaaggtgttgagatccgcctaccttgggaagctttccatggtggcacagtattgaaggttaggcctcatccaagttggcacaagcctttgtctccaacctgggtgggaggaaggtcaaggcagatgagtgtcctttcagtgcagggaactgccatccagggaggcttgcatttataactgagagacagcggggtgagttagaatgctaagaagggggaaatgggctgggcgtggtcacacctgtaatgccagctatttgggaggctgagacaggcagatggcttgagcccaggagtttgaggctgcagtgatccatgatcgcaccactgcaccccagcctgggtgataaagtgagacctggactctaaaagaaaaaaaaaaaaaaaaaaaaaaaggaagtcggtagttcaccaaggaggctttctaaaggagatggactttagcccgtgcctttcaggaggggacttggagctggggagatggggagacagtgcgattgggattttggcagatgatataaggcaaatcctcagcagagcaccccgggttccaccagctttgtggttgagttgcagactctttgagtgagagaataacccagccccggtggtttctgctgaaccgagaaggaactgctccagaaacatgacagggattccaataacggcggttaaacagctaacaaagaggagtctggaaggctggcccttgttcatgttggctggaacatgctgggtagatgagttaattgggggccctcacagggaatgctcattgtgccactcttaatgagagaatccaagtgccccatgggatgtaataattaggaagcatgttgtcagtagatcagctgtctgtctcctgatgtatgccttgtgtacacaggaagaaatagaagctttcctttaaaaaaaaaacaaaaaaacaaaaaacagggtctcactctgtcacccaggctggagtgcagtagtgtgatcatagctcactgcagcctccaactcctgggctcatgcgatcttctcacatcggccttctgagtaactggaactataggtgtgccccgctacacttggctatcttgtatgtatgtatgtatgtatgtgtgtatgtatgtatgtattttaatagaggcagggtctttctatgttgcccaggctggtcttgaactcctaggctcaagcaatcctctgccttgacctcccaaagtgctgggattacaggcatgagccacactgtacccggccagaaactttcttaaagctagtttaaaaaccgatcatttggtcctcatttcccattttggctttgtttcttcagtgtggctctgtcatgttggggcccattcccctcaggatgctgagacgtaaggtaagggtattccttgtctccttcactctacctccctagggtctctgtgcccctggaaactcagccctactcaggtccccgggcagtctagactcagggcaatccacctacctcactaagacccaagatcatcgtgccttccgttttgtcacccataaaacagagctgatgctttctccttcttagggctatgaggtgaactaaatcaagacacaaatgtacccttctcaatgctggacaggttgcccttttaacctctccatccctaccacctcttctaagatgaaattccttaaatcttggagttggatgacttttccttttccctctatttcctcttcctcacttccatttcagaaggagaagcatcacatcctgccacccacagctggccctcttcctctcctgtgatctccattcatcatctgtccatcttcaccggcatcttttgaaacctgtctttcagtggccgtcactgccttttcagcataagacatgtttgggcctctcttcctgactgtgtttttctccttaagctgcctgcatctttctctggccttcccctcaccaccaaatttctttagaaagtgggctgcccctgcttcctcttcttcacctcccaaccgaacttctgtagcccccctgtaaagtggtttccattccaggctttgcactgatgctggcaaggacatcggaattttccatttcagtggcctttgccaagtcctcgccttctggttgccttgactgtggggacaccccctccttcttaaaattccctcctcctctgtgacagggccctgtcctggatctttgccaacatcttgtgcgtccttcgagggtggttctcccactagagatcccctgaattaggaggcacctgaaaggttttctcctctgtaccttctgccttggcatcccacccactcctgtgatgataataggttcctctctgctggtggtaacgctcaagtcttcatttccaaactctgcttaggttgagcagctgcacagacaccacccacatggcttccaaacttgatagtccttctcactctccttatctggtgtgggtaggattgtgtcccccacccccctcaaaaaatatgttgaagtcctaactcctgctacctatgaatgtggccttatttggaagtagggtctttgtaggcataatcgagttaagatgaggtcatactcaatgagggtaggccccagtccaatgtgactggtgtccttataagaagagacacagacatacacacacagagaggacaccatgtgatgacggaggcagagatggagtgatgcatctgcaagccaaggaacgtcaggattgcaggctgaaaaaaggatcttcccctagagcattcagagaaaacatggaaaacacggccccgcccacaccttgactttggacttctcagctccagaactgtgagagaataatttctgttgtttaaagccacccactttgtggtactttgttctggcagccccagaaaaccaatacatcacccgatctctccagttccctatgggactcactatccttttagggatccaagctgaaagtctcaggatcaaccctgaatctctccctcttgccttaatacccagcttttcatttctgcctcaggtgagtatgcagtccccacctcttccctaatcaagtatggtcgccctgactctgccctcttcagtctcctatctgtccatccagctgccctctggacaattttcctaaaacagctctgattgtgtcaccatcatcgtagcacactttgtctgtttccctcctgcctccagcagttggctgcatattggaattacctggggagatttgaaagctctcatgcccaccacacaaccccatctgtcaaatcagaatctctggaggtgatgccccagcatcaatattttaaaaacttcccctatgattccagtgcacagctaggcctgagaaccatttgctgatagaatatcacaatagccagacaaagcttacggaagaaaagatagctctaaggcaatggttctcaactggggatgatattaccctccaggagacacttggcagtgtttagaaacattttaggtcatcagaaccggggtggtgctcctgggcatctactgagtagaggccagggatgctgttacacatccacaatgcccaggacagcctcacaataatgatccagccccaaacatcactagtgccaaggtggagcaatcctgatttaagagcgaggagaggagcagcaataccgaccttgactttgggacagacagatgcagtagacaccagtgctgaggaggcacatgccccctcatgccgcagtactgcctgtgctgtgcccatttggcagcccagtatgttgaaacttttcatgcagcaccagtttccatcacaggaagcctcagcctgctggtgccaaacttattctcttgctctccttttgaaaatgaggttcagtggaagctgggtgcggtggctcatgcctaatcgcagcactttgggaggctgaggcaggcggatcacttgaggtcaggagtttgagaccagcctggccaacatggcaaaaacccttctctactaaaaatacaaaagttagctgggcatggtggcacacgcctatagtcccagctatttgggaggctgtggcaggagaatcgcttgaactcgagaggcagaggttgcagggagccgagatcatgccactgcactccagcctgggaaacagatcaggactctgtcaaaaaaaaaaaaaaaaaaaccaggttcagtggaatgtttttgtcaggagagaaagggtcattacaactcaagttggcttttgccaaactcagcaatcactgttttggtggctcctgaggctcctaatgaggacactgacagtcgttaaataaacaagtgattaagttgagaagagactggctaacagaggttccatgtgtgctcattgtcatcgatgttagccagtttcatgacagtgacctgcctgggctccacctctaccattaaagagaaacactagcaatgacggcttatagttcacgtagctttaccatttataagcattttcctatacaccaaccagtttgatttgtcttttcaagtcttagctttatgcagtgtcatttcctataaaggaaagtatagcaaatatacaagaggtactcagaaaatacaagaagaaaaaaactaaaaagagtaagggatcaaaagatatttttttaaaaacccacattggatgaaaaatgagaaatttaattccggtaatggaggacaaagtctttgccaaattgataaagctttgggaaattctgattatggaaaggacccaaatgtagacagtcacattctaaattcctggctccatgctatgtgtccagtttctgtgtttttaaatgtatgcagcatttttaacatcacagaattattaatatgttgaatatcgttgctactttatataaaaagtatcttttctgtctactatttaagaattcttgctgtatttatcattctgttttctccaagtagacagagggccgatgtatttgataccagaacacatctttgattttgtcatggggagcagtgtgaaaataggagtcacaagaccaggcgtggtgactcatgtctgtaatcccagcactttgggaagccaaggtgggcagatcacctgaggtcaggagtttgagaacgtctggccaatatggtgaaaccccacctctactaaaaatacaaaaaaaaaaaaaaattagctgggcgtggtggccccacgcctgtagtcccagcgactggggaggctgaagcaggagaatcgcttgaacctgggaggcagaggttacagtgagccgagattgcaccactgtactccagcctgggcaacagcgcgagactccgtctcagaaaaagaaaaaaaaaaaataggagtcacttaacacaaacttattttaagcacaatttatttataatttagaaaaaagaaaaattgctgtgtaatggggcttgaagagaaaaagaaataaaatttgttgagggaggtgtagagcttgttctgggtattgatttcctttgaggggcaataaggaaggattatgccagggtgtttcttgttgcttaaatgttccatgaaacaccaaaattgcagaggtattagtagttagaaagaatgtggaaacatccctccttctgattaatgactgccccctgaggagtccttcaaaagccagaagaaacctaaaatatcatcctagaaagttggaaggaggcatttgacaaagtctttgctagctatgtgactaggataaggatgtgtcagtatatcattatgcaacttgatgaattctcggtcagctgaacagtcatagtcatattagcatagaatagtgattcgggtcaggcacgatggctcatgcctgtaatcccagcactttgggaggctgaggcaggcagatcacctgaggtcaggagctcaagaccagcctgaccaacgtggagaaacgccgtctctactaaaagtacaaaattagccagggtggtggtgcatgcctgtaatcccagctacttgggaggctgaggcaggagaatcacttgaacccgggaggcggaggttgcagtgagccgagatcacgccattgcactccagcctaggcaacaagagcaaaactccgtctcaaaaaagaaaaagaaaaaaaaagtgatttgatttctggcctttaataagtgcttaatgaatcttggatgaataaacgaatgaatgaacaaagaaatgaaagaatgaaccagccaactgaccaggacgatgtccatagaggtctacatgggattccctcaccttggtcttgttgtgttcaacatttctatcaatgatttgaatcccagacacacaaagcatatttactatacttggaaacagaacaaatctgggaagatcattaatgtaatagatcacagaagaaaaatccaatatgatcttgccaggttaaaaacagggccaagatgtacaggcatcagccaaagccctatgtatgagtttaacatgtcaactggaccttgggagcctcctattttgagggtgatcgtgaaagagactgggaagtgttatatccttccccatcattcagccttctcacagaagttccaaaggctatttggtggtaaaactcctttctgcttgctagtcctcatcctttttcctccttttatggtatttgacactattctacactgttaacttgatgcccttcacagaacctttctcgaatttcatgattccactttggtcttatttccctcgttttctaatttgtccttctttgtttcttttaccctctttttaaagtttttcctttacctttacatttaaaaggtagtgtaccctaagctctaatcttggcatacttgaaatctgtatctctccctggttgtttaacattgatttaaaatagattttgttgagaacccgctatgtgcccagaagtgttccaagagctcttagaatacagtggagaataagacaacaatttctgcctttaaggagcctgtattctaggaggatgggaagtgatgaacaaataagtgaataacagtgttgagtcgtggttaaagctatgatgaaactcaaatccagattaaggggaccaggaatgtcagggctgctattttagacaagagtcagggagagtcccctgagaagatggcatttgagcagaactgggcttcttgtactcccagggctgcctccacactgaagactcccggatgctgctctctggccagctcctctcttctggagccatattcctgaatgcctcttagtccctgcaggatgtcctaagagcaccttcaaccacgcttgataatctcccctaccaaacttcttccttctctttggttccccatattggttcccagcatgaccatctcctcactcacccaagctagaaactctagcctccccttcaaatcctcctccacccctactcatacagatccaatccaatgacatctgggtcctcacttcctccccgtgccatagttcaggttcacactatctcttactggtactgttgcaggagactcctgactagtttgccagcctctagtctcatactccacccaccctgtcttccacgttaccaatagaatgacctttgtaaagcacgatcagctctgctcttgagccttctatctctacctactgcctctagggctagcaaggtgttcaacctacctggttcccaacctactggctcagccatctcccttcagtccctctgtcagaaaaatcacttcctgaccctttgacagtaccctctttttcctctcatatgcccttcagtttttcctagaactctttccgttcctctttcctgcttttcccttccctaccctacccagcaggtttctaagcattactgcaatagccaactcaactctgcaaagcttttttcaaattctcttccccctccatccattttctttgttgtgatgccatagtgcttgtggcaggcaggagcaccctgttttagaagagttttctgtgtcccattagccgtgggttacctggagacaggcatcgtcacttgtgcatgtctgtgctgcttgtagatgttggcactagggaggttacttcatgcatgtttactgagctggctgcaattatacagaagacttacaaacatataagtcaaaccacgtgaaactgctgttcttcttggtcaatatcagcaatttcatatgtttattctaatctgttttgttcagtattttgtattcctgttttggctttcagaagtgttcttaccttcaaccagactgccttagagcatggggctcaaagaaatattttcagctctggaagacattttccatcctacttctacatatagaacttttctggccaaaaatggatgcatatctcagaaatgtaataagcaatactcttctctcttcctcttgacaattgtttttcaaatggtttatcataaacatcagtgagatcttgaggctgttataaagtgatataatggtaatttctagaattgtaatacattatcctagtgaaaagaaaatgatgaagttgtgaatcaggcaaaagtgatgaattgctcatttccatgtagtttttcaggtggaaagtagatgcaggtatcaactggaggatgtgtgaatattttgtctaatggttttgatctcgatatagaactagagttgttcttaaattaagaatgtctttcatattctgccttttcaccagcatcactattaaaataatattcttaagcaacagccaaaaaattattaggatctgctggttctataatcagatgtttttgctggacactttaaaaaccaataacagctaatcacagtgtcctcttttgtgctgaattgaattttgttttggttttaattctcatttgaactgctgggaaagcaagcctgttacataccaacacttgccacctttctatatttgaatggacctaagtagtctttgcaaaaaatgtctaagactgtcctatccggacacaccatagggttttcccatggaaataattatatcacaaacgaatcttttttctaaagtctgtggttttaggctgccatacttctcaatcccctgaccaggagacaataaaattggctggggccttaatttgagggaatacatatttgattgtgggcgtggtcttctaagacaatggtaaagggaaaagcaagatgtaaaattaaacgttgaaacaagctaaactggttttcaaaatcttctcgactgtaacacatctagaagttctaaatataagaaggtttgagggattatctaaaaccaaggtattaaaagatcaggtttttagaagattttgattcagtaccttatacttttttttcaaggagttgagcaagaaaccatcaaaacttaggagagtgattttaggagagggtggtctccaacttgtctttatgtttgcttccaagataagtgttaagcccaaccaactagcagactattcatgatctgggaatcctatcagtggtcatccctgtatttgacttgagtctctctaattttttatagggacggcgaaggccagttggtcagccaaatgcataaaaaatggtgcagaaattagtgatgcttggaaacatggctcataatcatgataaaggcttatatgttggtatgggttgagaatgttggcctcatggtatctgggtatgcaagaaggcaaatcattattggtatactagcctttatgttgaatatttagagagctcttgaaaacaccccttcgatttggagtgaggaattctaatgagtaaaactccatgtagaaataaccatatccgattaaaaaactattttgattttcattccaagaaactaccaaaatgtcagctcgatatacttgtgaacatgttatgcttatttttaaataaggaagggtgcctttttacaaattaggcttgagtttctcttactatcatatatattaactatagacaagggagtgggttctaataacaaattgctacattgctatcgttaaatccgtgtttgagttttcttccctctaatgtattttctccccctctttaatttatatttttaaaaagcaatgtacttatctagaaattgtatgaaagacaaatatttaagaaagtaaatagagactatgggcacgtcctttgaatatgttttgccagggtcgaggggtaaatgaaataaactgatacatcataaatggaccacacaggaaagaaagtgtcatgcctatgcaaagacatgcattctccttagagacgacatatattgctgtcgaccaacaaagtcacgtggtgggagggggctcttttctttctccttcacatcccctcctctgatgtcacaaatctattttttcctgggagaattaattagcattcattgggtgtacttggctagaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggtacccagcgctctgacaatagcctgtttaaagcttttcactggggggtgcttaaaaagggttagctgggttttgtctctcttttaaaatggctctgagacaatccctatggcatggtcttgctttcagggttgatttttttcctgtgggctgatgttaagttaatagagcagcctttcttcaatccattcctgttccaaatctttctaccgacgtgatatttcatagagggatgtctatagtttgtcaccttgggctgatgcattggggaaactgtctttttttattaatataattaatcgtaacttaggtcttgtgtcctgcatgttatattccaggaacgtggaatgtgtagttttctgctaatgctgaggaggaactggaggggcatgcatgttaattctgctttggttccgctaatgctgtagtgatttgggcattctctaattttcttattctaatatgattgctctttcttgtatcaggccctgactacgacatgtaataatcatttacagttggagcttcagagaggggacatcagctctgtcacccagtgctgatggaaaggcagggcgggggatcttctgctaattatgacttggagactggggggaagaaaattgataaaggtcctatttcttaaagagaatcttagaacgtaccacaattttcatatacagaatggttttttggagaataaagtgtttttgcagtaagaaaatggcagaaaggaactaaaattaatctcttttttctaaataatgactgatttcaagtttgatgtcccatagaatcggctcagccactgttaggttaatggatctcactgcattgtaattttccctcactcaaagtcatagactgtcataaatgcccaaaaacatattctgtaaccgcagtggctctaatataaaaagccatcatgctaaggttatttctcacagcccttgcgtccactgatagtcactaaagagtaattcgccagtacggggacaaaacttcgttttatttataaagatacaggctgaaccatatgaaattgctgatagtcaaccattttaaacctacaaaaacggcaattacatgtacttcagcttcacagtatgctggggtaaagactgcttgtttttatataaaatttctttggtacacaataatattttatcctaaacagagcaattttactttttaaattaatttttttaggtatcacacaatacacataacataaaatttaccattttaagtatacgattcagtggcattaagtacatagcaccttaattttaaaatcgtttgtttagttcaatcctcttaccaaatctacacctccccaccaaaaacccagcctgtattttcttgtgtgtctttaaaaaaaaaaaatcttcatcaatgaccaaatagctataagagaagctcttgggaatatttatcaagatgaagaagtgagatcaaagttttttccatgatgactagagactaagttgattgcatgttgtcggggtatgataatgtaatagcattgtcccaaggaagcctatcacgattttatcctaaaatgatgattttacttagtacatacttttaatttttattaatgtggtattcaaccatggcagataaaaccgttttggtctttgcaaaaaaatcccttttttaaatttctctctgaaaggaagcaaaggtcatataaccaatataaaatcattactacacaactgtgtatcttatcacttagtcttatggactgctattattttatgtcaattaaatcttatttaataacagatctacaggttgctagtacatccctgacaacccgtatatgaaaagtcattagttgtgattttagagacaaaattagaagcaaaagataatttgtgaaggaactttaaaaattacctaaatgtataaacactagctgcttgttaaataattcaaaaatatcacactaccagaagctagtgtgacatgtatggtacatgcttgaataagaatacaagccaggggatttgtttttcctgatctacagcaagaggggttgtgattgttgtgtgacccaccataattgttgatctggagggtggcttatctaatctgcatttagatgaacaagttcatatgctggctacacaaaatcaaagcccacacaagacactttgtagtttcccaatttgctcacccatcatcattaaggtacacataggataaaatgatagccacaaatgtttctgcgtgattgtcacatcagtattccttcagatttaactttaagtttattaaaaaattatttttccattgaaattaacatttgaaaacttgacataattatttatagaatgtgttatataattcttgagctggtggatccgttttttatgtttttcttttaagcctttcagcaaaggattttattcattaaatttaatcctgtaaattttgtcactttacgcagagttttttatgcacatatatattttttttcctgtgtttctcctttcccatctgttttcagtggttggtgatggagtgatgcctgtctcttaatttggggcattattgcccaatggctaatacccaatagcatgtgaattaatatctttggataattattgcagtgtctattaagaactaagaatgtaaattaaacttagctttataaattgaccttgcttttctagttgggatctttcctgggagtttcagcgggacaacacaacccagctattgtgattcactaactcctacaaagagagctctttctttaaacttaatcacaatgactttgtttctactttagacaaaattaatccatgtccttaaaaaaggaaagcatttgtgttttttcagtctgatagttttcatcacagcatgctaccagataccaaaattcacaagagtatttagtagatatttagggatttttaaggaaaacaagcagattttcttagatggatgtaagaaatgccaaattattacaaatgatagtttttaaattaaaagcattaaagtgtgaagattgagtaagcagattcactgacatggaataagcagaggaaatgaataagacagaatcaaaagaaatagatcatggaacccaataataaaaagatggagagtcggtttccattgatttcagtggagtattacttgttgtcatttcatttgtgaaaataaatgcatctgaaattgctgagagtggataatcactgagtagaaaaacaattgaatcataacaactttgtatgctctattatgggggaaaaatctatctgttatgaaaattattttcattatatgtaggtaattgaattctactgaaacaattatagtcaggttagttaacttcctatgaatcgttgctgaaataaattacaggcatcaaattaaattcctaaccacacaggaagaaaaatatagtgaatgggaaacaatgtgtaatttaaaataaattacaggatatagtcaaagtaagaaatgaatttaaattattgacttccttaaaaaattaatacatctattttaatctttttgatcaaatagatataatttcttatttttttttttaatttagcaaaatgtatgcacttttggctctcatttttcgtttaggaagaaaagcactcctctagaatatacgacttgtgtgattaaaaacccaaagggacacataacacacgtcacactattcctgatgatctgcgaattattgcattttgaaatttgtgttgacattttctaacttggctatataaatatggtacagaggaagttttagatgcagttattatctgtaagaatttgccaaggtggacatctgaagagttggtgtctggggaataggctgtagagaaaagtggctggccagatggtgcggaacatatgtggtaggtatgatacagcttcctttgattttttttttttttttttagaacatttaaatgtggaaaagatctcaacgagccatttggtacatcttctacttttacattattaattccattaggatttttttaaagacttggccttgctatttcgttagaaaaagaattctgggccatttctggaaatttagatttgccttccctgaaattgagtgtaaaccctgaattaagattattatgattttcaagatcacatttctctgttatttggaagtacagggtcaatttagactaaatgatcttaataaagtgactttgtcttgatgtatctgagaacatgcaaaataaccagtgtccccatgacttaaacttcccctctctgtgactgtgatggattggattggattgttacaaagacactctcgcttttttctcctttggaccaaatgtacatacatgggagatagttggccaggagtagggatggccatggaacggaggaagaaagtgaccacaccgactgtttttaagagaggaaggttacaatcccagtttcacaaatgtgctttgttgttcattcatttattcgtttaatggtgttctctgccgggtgtggtggctcacgcctgtaatcccaccactttgggaggccgaggcgggcggatcaagaggtcaagagatcgagaccatcctggctaacatggtgaaacccagtctctactaaaaatacaaaaacaaaattagccgggcgtggtggtgtgtgcctgtaatcccagctactcaggaggctgaggcaggagaatggcgtgaacccgagaggcggaggttgcagtgagccgagatagtgccgctgcactccagcctgggtgacagagcgagactctgtctcaaaaaaaaaaaaaaaaaaagaaagaaaagaaaagtgttctcctttgaaatgtcattcttcctctgtcccttcagctcacgttacaggagtacaggggtgctaagtcatcgtagggaccattaggggtagtataatcttggttttaataataattttgctgattggtggcagattaaatagcagacaaaatgccatagacgagaattttgatccttagccagctgagtgatatttctcgtcaaagagtgtataagagaaaatgtaataatttcctatttgataagctgattttatcaattgcattaactgctttatgtagccaagccttattatgctgtatttaaaatcaagggtcaacacactttttccgtaaaggtcagatagtaagtattttaggtgctgcagaccactcagtgtctgttgtaactattcaaatctgccactatagcatgaaagcagccctagatagtatgtaaacaaatgggtgcaactgtgttccaataaaaccttataaataaaaacagatggctataatttaccaacctttactatatttatagcattgttatggcattccttaatattttaaataatagctaaaaatgaaagataacaaatatagctttgaaagaccttgctcagtgaatatggtctttcttggaagctcagtgtttgtcacttagttgcttccggtgataatttcctaggtgctaagaagcatgacagtctgaagttcatttgttcagccttctcgctaaattacattaaataagtaaatggggaaaaataaacaaggcattgttttgctttcctttttgcaatttccccttgtttcatgcccacctttggcaatgaccactcacagctgtgtctgtcttcataagccaccactggtcacctcatctctatcttcactctcttagggggaacattttgcagttttccctctgcagggcataaaccattttcccatttcttgccaggtgcccagaatcaagacattttaaaagaccttttgagccaaggcatcctcttggaatcctgtgactgccttttaggtgttgggatcctgtccttgggattaaaatgtatactgtgttttttgaaattttataaataactttatatttaatgcctttatttaaatttggctcaaaaatataaaatagaagtgatttttcttttctttcatatctaaagatttactgttgtaaaaaggcccctccagaagtgtaagtccaggggatttggaacacatccatccagttgccgatcccatcggtgtgtcttctggatctattctttttttttttttttttttttaaatcctgaattaagggtcttaggcatggctgccatgtttttctcagaaaacacgttaacattgagcagtccatggtttttcattgtcattgcctagcagcctatgcttgcttgcctgaacatctggagacttaccccatccatatgaggagatgagcacagagcatggatgaatcttctgcagagataccctgaattgcatggcctggcttgggtaaaagtcagcatggtgggggatctagaggtccatttctggtccacagggtcccagggtgctcccttcctttcaaccaaatatttattcagccagcgtttattgggcacctgtgtgctgagtatgtagagacaaattttttaaaaggataaaaatttccagatcaaaagtgatagaactacttagaatcctcttgcttaggggtctatgtggagggctcatagccccctttaccaagaggaaatcagatcataccatgaagtgccttgaccttctgttttttttctgtcagccccactgggttttcttgcctttggagaatgtagcaacatctatttctgagagagaatctcctgaacagtaaagcaaaaatctaaatctgttttttgggggttttttttctttctttttttgagacagagtctcaccctgtcacccaggctggagtgcagtggcatgatctcagctcactgcaacctccacctcccaggttaaagtgattctcctgcctcagcctccagagtagctgggactataggcgtatgccaccatgcccggctaattttttttttttttttcctgagatggagttttactctttttttttttttttttgcccaggctggaatgcagtggcgcgatctcaactcactgcaacctccatctcctgggttcaagcaattcttctgcctcagcctcctgggtagctgggactacaagtgtgcgccactatgcccagctaatttttgtatttttagtagagacagggtttcaccatgttggccaggctggtatcaaactcctcacctcaggtgatctggctgcctcggcctcccagagtgttggaattacaggcatgagccaccacacctggccaattttttaatttttattttttatatattttttttatttttagtacagacagagtttcaccatgttggccaggctggttttgaactcctgacctcaagtgatccgcccgccttggcctcccaaagtgctgggattacaggtgtgagccaccgcacccagcccacaaaaatctcaatctaaggaagactgaaagttaagaaattttaagaagcctgagataacatcagtagcttaggacctggaccgtttctttaggagacacagaagcacaactcaactgcaaatgcacctcagaaaaactctcattgggttaactgttgcctcagcagaagagtagaaaattgcaatacatgcagaggtcacagtaggatgtatggtggtttccaaagtgtgccctcttgagtgaaattgctaaggttcacattcaggcttctctacctcctggctgaaagatcttgggcaagtgatcattaccttctccttgcccttgggttgttcccttgtaaaaatggaataataatagtacctatttcagagggtggttgtgacaaatgtaataagtaccacatgctgagtgcagtgcatagtacatcataagcactccataaatttttgctgtcatcatcattgaccacaaaaatagtttcattgtgcagttctgatcttatcccagcatcttttctgtacctccctaccctggttttaaatgagttatgtataccttaccttgaagtcaaaaagattttttctaaaacattctagaaaagcaggtttctgcttccaaacttgaaataccttacaagttttcagagattgtggagagtggagttgggattttataaaggctttgtgaggttttacttgcctcacactgtggctttagtaggttcttctcctcagagacctgagctgccagatggtgcattatgacctgatcttctgatggaatcattacccacatcaatggcacaatttttttttaatccttaaatatttgtggtgccccagaggatataaccccttattaggttttatgggattctcggagataaactggccatagcgaccttatgatctctttgagatttcaagattgtaattcaactaacttttatgagaagcctactctgtgccaggcaaattggtaggtatttttctttgcaatcccctaagaagtgggaaatattgtatcatattaccagatagagacctgagtcctcagggagtgccagctgtcaccatgtgtgtaattaagcagtggttcgagcccaagaccagtagccctttctgtatagcacatgggagaaaattggaacaggatttaatccagaacattctagactctgacgttctgagtttaagataaggtgacagacaatactgcagacgtcaatgggaggacaagcatttcatccaagaaacagcagaccattaggttgtttgccaggttttctggactagagctgggtacccttacagagagggagcctgcgttcacctttgctagtgcagctggcaataattatagtgctctgttagtgctctgttggtctgaaaaggaaacagaaagaaaaatattattgtgaggagccaaattttcactataaatagtatcttccccaaatgagcattttaagaagcaggatatggtgtgtgttgggggaaagatgtagaaaataaagatcattttggtgatttacataaacttcaatttagaaacggaggacattctcaatggatcatgctggtactgaagggttgcatttcaatagcatattttttaaactccccatttcctttctatggtaaagaataaataaaaatgctgatatagaatctttgctggagatagagacactgactctttgccacctgaaattggcagtgaacagcagagctgaaatggaaattggcaggtaccactggatgtacccaggctcaaagaaccaccagtaccatcccgtgccaaccctgggggacagggctagccccttgagcagtccaggtaaatacagccttggggtgaattctaatagcaagtcaactgttatctttaatattatttgtaatggctcttgcagcttggtgatattttatgttttgcttggtgcattaatttgttcacacgggcatgggtggaattcgccctataaacattttttaatcatctttctttttctctctccctctccattccaccccatctttctccactttcttctccttcttccctcttccctctttcaccttcaatcacttcgtcttctcaaagggaacaatgtacagtgagatatgcctttggttaaccatgaaatttccaatgcctgaaccaataatgggggaggggggccacccacatcccccatgtggccaagaactgggccagggccttcaaggagccttggccctgagagtactgtgagtgtccccaaatgtcttcccagccctgctgctctgcaccaccctctcacctcagtcattgcctttgagaaagagaaatcaaagctgtgaaagtaggattggataaccatgtacccgattcccatcaggtaggttcagtgggtccggtttccattttccttgctcgtgaggaacattggccattcagaaccgctaggtgctggatctgggtgaggtgtgcgacagctgatttggggacctagaaggggcaaaaggtgaagcagtatgaacatccaacctcccacgttcccaaaaccaacacaagttgtaatgcccagctcagttagctaaaactcagtgattttgccagtgtacaaccatagttcaaactacataaaatgcagacataaagggctggtggtaggtcggataaacacagtaagaggcttaaagtatttctgtgattttgcatcaatccataacatttctcccaaatgcttgctaactttttcaggagtaaatgtagcatggtacagctccagaaagggcaatcccaaggtacaatgtaagttacccattgaattacaaagtcataaaatccatgattaataaaaccttttcctttaaaatctaaattgtgttgtcaggttaattaaaatgaaatctgacgttggatttagttctgtcttgggttatgcattccttcatctgtcctatggctatcaggtgttggttctgtgtgtgcctgtgcagcgctggctaaatagggtgagcatgaggtgacatcagccatccattctcatggatcctataaagaatatggagggttctggaatcttgatttaaaaaaagtcattagacgtgatatatccatacaatagctactattcagcaataaaaaggaatgaaatatttgtgcatgctacaacatggatgaacctcaaaaacatcatgctaagtgaaagaagccagacacaagagaccaaatgttctaccactctgtttatgttaaatttacagaattggtgagataagaagtaggttaatggttgccagaggctgagagaagggaggattggggagcaactacagatgggtacaagggatcatttttgctgtgatgaaaatgttctaaaattagattgtggcgatggtcacacaacgctgtacatttactcaaagtcattgaattgtatacttgaaacaggtgaattttatagaatataaattatatctcagtaaagctgcttttgaaaaaaaaagcagcaaaaaaaaccatgagatgtgcataattcaagggtggggagcggggaaaggggtattttttaacataacaagaagcccccaagttatcagaaacaactgcttgagggaggagtccctcttcatcttaagagtctttaagagtcttcattttaagagtgttgaatgacatcaggccagctggaaacccagaaaaatacttattcttttctgtattttagttcactaaactggtaaagaataaacacaatatcttattgggggggaataaaagaaacctctatcaattgctcttgaagagttttctccacttgttgagcagttccctgtaaaagcattgcaataatatttgtgtgcttttgatcctacggtgaaacaccagaatctgggcattcatagcagcagtggcagctgagaagaaaaatacgaggctccattttctgtttttctgaaactgatttctttcagaattccaaagaatttgggtttccaaaagataacatagtgcatacatcatgtactgcatgataccaccactgagtgtctctgcagatctaactcattaatctttctggagagcccaagactataaacaactccttgtccattcaggtgagattttggcaccaaggaagaggagatcagaacaggttttgctgccagatgagttaggggagaaaaaaaaattacttttcaagttttttggaattccataatgatatgatgaaagattgtggaagtctaatagtatcaggttgctggtgatactactgcaagcgagaattccatgaactaacaggttcttgcctgagggggagaaacaaaatcactgaatttgatttaaagaattatcttcccagatcctgaaacaatctccacctacacatagttttaactttttgtgtgcattgatggaaataattggaaaaaagatgcctccacggggactgttaatgtctggagctgtctgcagagaccttatgtgtgatagtgtaaagcctacagcgcaggccacagagtgaagggacccactctagccatgccatcgcctttccagacacttacagattttgttgggtcctaaatcaatgccgttgccattctatacttagatctccaaccccaaccagatggtatgaggcaaaaaatagggaattctgtatggctcttttttttttctttttttttttattaatttttttgcagagttgtcagcctttttccatgggggaaaaagaggttttgatacaggctgaccaggaaatttttgccaaaggaaaatgcctctcccactcatgcagttactgtagcagagactgcccttctccaggaacttccttattccccattggaaaggtcatggcggttccagggtccttttcatggttttctttttcttgctactacttcccagtagaattccatctttaggggttagatagttattctttccttatctctttttccttttcaatttttagctgcgttggacatgtagtgtccacatcttttctgccttcaggagatgaaatgatgtatgaccacatgggctacccccgccccccgccccccccgccgtccatgatgctgccctaggggcctggcctgaggtggtggtctgagatgcaggcaagcgatgaagcagggagtagttcatgctaagtctccagtcagtggcatattgtgcttaacattggagggagcacttccagactgttgtagattgtgttacacaggctccagaggatagcctaagacaatctagattctctattccaagtgcgggctgtggaccagcagaatcaacacctccaggagctcgttagaaatgcagagtcccaggtcccacccagccccactgaatcagaatctgcattttcataagacttccaggtagttcctatgcacattaaagcttgagaagcagtaattaagagcaaggtccaagagcaagaagggagaagacaggaaggaattgattatgtgaatttaccctcaagagatctagaaatctttatctttggaaaagataaagaattgctcaaggtattcatcctttcttctttccgtttctatttaggaagaggcatgtctaagcaatgccaaggcagtcattaatctgttgagtcctggctggtttgaaaaacagtgaccttgcttctcttacctgcttgtctcatgagggggtttggggaaggggcagtgaaggtgagaaaggtttgtttctttgtggcaaagtgagggccagaggagaaagtagttgatggaagcttgggagaaattctcaaatgtctctcatctccctctttaatataatccaatgacatgcaagatgccgtgactaaatataggctgccatttttagtggactaagaatggttctttatatacagttaaatctgtaattcagaattcagtctcacaaggaaggagtagaataaccacccacttcacatatcaccaatttccgcctctcaaatccaaaatgctctgatgtttcagttaaaatggccacagataattccagaagtcgggacaaagagcacaccctctacatagggactgtcacagaggatgtcgggagaggagggccctctggagtgttggtatttagcaagaagcccaagtgttgtgatttgcaccacagagaatggattcctgagtcgccacggggttgtggggtgggggcgggtagcagactgacggagggcccagcactgctgttaactcatgttgcaccttgtctgcccagatgtaaccacaggctggctcctgggaactgcagactttatcccttggcccccttctaggctgagcctgggacttctctctcactgatctgctttgtagagggacacctgtagctataagtcctgggaaatgctactggatttttgtcattgttctttagtgtcactctttcctaacctaaggttgtaaggccactaagttcgaggtcttctcccaaaccacttgaaatgtattttaagggggaagaaaaacccttaatccttctgcgtgtaccattccacctctggccatagttgggtgtcgaccataactgacagtctggtcgtgccgtgtgggttctgctggtggtatcattctgtccccagaggctggttgcagaagcttttgtagcttatccagcctaagccagtggatgctctcagtctgtctgatgccttccagttactcaagatatttctgattacatagaggtaaatggtgaacacagtggaagcacgttgtagctcaggctcatgccgtaaagtccctgagatttttagagtactttgccttttgttttctgaaatgtatcaattctttcattttcaaagcacctgcagttttcaccaaaaaagtgccatatacagcagttaacgattttatagtttatttactgactgctatggcagtctttatatatatatatataaaataatttatatatagctgtaaacaaatacttatcgatataagtaatttcttgattgtttttgaacgttccattgtttatgcgctatattgttagtctgtgattagcacctaattatgtaacaatggcttactgtgtgtgtgacatatcagctccctttgtcttttggtcttacctttgcttctcaccttagagtaggcagacagagaaagcagagataaaaagcagatcgatgagtattgagtgttgatctcgggctttctgtcagacatgtctgattgtagggacactgacttggattattcaagactgagtacttctcggtctttgagaagtagtgtcatctggtctttgctgcctttgaaatgtcccttatgttatatgttttcatataaatctaactagagtccattaaaattaattttgctttgaaatcttttgccacccttagaggtaactggaattactctgaagtagctggggagtagctgaaatcagccacttaggtcttcccacctcctcaggctgtgtccttttgggtgccgaagttcactcccaaataagccacatataccctcaccccctgagtgcgtccacgtctatgaaaagcttatatgaattggcttttgtactaaacggaatgctctgggtgtcagagtcatttaggtgggacaaatcttcctctgaagatcatcatgcttgtattttctggagacttccatgaacaatgctttcacccccaaggaccagctctaggggtgaaatgtcaggctggtaggagaggtaatgggatcgaaacaagacttcctgtgtcttgagaaaaccttgtttatattcatgtgctgtttcccagtggcaataaatcgagattcctgtgaggatttgacagacgaggctggtgatgccacccactgtttttgtaaagaaaatgttatcggaaccagccaggcccatttgattgtctgtggctgctttcgtactccactagcagagttgagaagctgcaactatacaccctgcaaagccaaaaatatttgccatctggtcctttacagaaaacaattgccaatccttgaattagaatttgcaaagtgtgtcaaaatgcaatactctatctactgatgttaggcaacacctaaaaactttgctcggcactcagtttcctaaaatcttctccatcaaacatccctcatcctctgccctccaggccccagaatccttgttctctgtggggaatagggactccctgctcacaggctgtcaactaaggctcagcccttcttcagagaatttcttggtactttctagaagctcagcccctctggcctctttcaggtccttctctgagttttcccataataaaccaagtcccgttaagtggatactgtgagctactttcatctagtgttctattcagtgcactttagcaagttttatttcctgtgtatagaaaagatatttgtggtttactaaatgtagtgctggggatcatttctttctttttttttttttttaagtatgaggttccaatgccctgaatcggaatcgctaagaatgctggttaaaaattcagatttcatatgggcatggtggcacacatctgtagtcccagctacttgggaggctaaggcaggaggatcacttgagcccagaagttcaagttcagcctgggcaacatagcaagacccgatctcttaaaaagaaaaatcagattcccagtccccacctaccctctctgcgatgggtcccagaaatttggcccattttaagaagctcccccaggcaattctaatgcacagtaaagtttgaccaccactgctatatacatagaaggccataacccctcattataacatctttggtaaagtatcgtttcagttcagcctgtgtatgtatatgttcaacctgtatatgtatttacagttaagatgctcaaagtcaaacctccacatccttagcagacagtactattgaatttgaagtaaattcctcttgaagtaatgtttcgctattgccactatatctttgtgtataagagccaatgcaaaaacattagattgtaaagctgtaggcaaacatcagagctcaggctgtgtgttagttatcaattgttgcataacaaattcctccaaaacatagtggctagaaacaaaaatgtatattatctcggcttccttaggtcaggagtctggactcagcttagctgtctcagaaactctaatgagatttcagtctcatctgaaggcctaactggggaaggatccacttccaagctcattcatgtggctactggcaggacttggttactttgggactgagggcctcagttcctcacaagctgctggcctaaaacctcccttgatttttttccatgtgtgggctctccatagctacttcatggcatagcagatgacttcatcagatagagagagcaagtgagcaggtaagagaatgtgccagccagagagacaatgctaacaggacagaagtcaattttttgaaacctaatcagggaagtgacatctcatcacttttgccatattctagtcctaagaagtaagctactaggtccagcccacattcaggggaaggaattacacaaggccatgaatgtaggtttgtggggatcattgggggtggtgtcttagctgcctgccacagtctgtataaacatttcacagtgcaaatgcatcctccatctccttaatgatcataacctcttcactttctcaaagcctcacctctcagagaatgtatcactgggttaaatgagtacctggcaggtgtttgacggccttcctgaggtactagactctaagctctctgtgagcagaggtcttcatgccttgctccctgctttggcctggctcgggacctaggaccaagaaagcagtcgttcatagtgttgaatgatgatcactttatttttagcactcatgatgtgtgactctatatgaaattgtctaattttagtgtccattgtgtacatggctcatttcctgggccaggctggtcaagaccttgcactctgagagttgcataggagctcagcaggtgtttgttaagtaagttcagattggctactcgttgtcaggagtttgagaccagtctggccaacatggtgaaaccccatctctactaaaaaaaaaataataataataataatacaaaaatcagccgggagtattggtgggtgcctgtagtcccagctacttgggaggctgagacaggagaatcacttgaacccaggaggcagaggttgcagtgagcagagattgtgccactgcactccagcctggacaacagagcaaggctctgtgtcaaaaaaaaaaaaaaaaaaaaaaaaaaaaaaaaaaaaaaaattaggttggctaatcgaggtttctagaatcatctgcatgtaaatagggttaactttgtgggatgattttcttgaataagaagttctcagcctgagcttcacagtagaaccctggaaggaaggggaggtcttttaaaattccgaagccacatccagaccaagtcattcagaatcttgagggtgggacccaggcatcagcgttcttgaaagctcccccaccaggtgatcctctgtgcagccaaggttgagaaccactgtggtagaccagtgtttcccaatccgggggagtttctgcctttcaggagatgccttttaggcatctagtggtgtagaggtcagggatgctgctaaacatcctacagtgcacaggacggcccctccccaacaaaggatggcccatgccaatagtaccaagagttgagaacccctgggctaggtcctacgctttgagtcaggaaattggttctaagtgaagcagtagaagtccatggggtagctttgtcccagatgttaagcttattgcaggcatggatagcttgataagtctggaatattatatacaatctatgtatcggtgtttcctgaagagaaactcactcttttaaaaggcacgcagtgcataaaccaatacatttaaacctacatatatttatttatgcaacataataccatacacgtgtgtttgcatatagcacgtgctataaacaccctatgcatacagagatgtatgcagggcatatgagtgtgttattgtggttagaggaacaggtatgtcttcctcagcgccctttattttccttccccctcactgtagcctcctgccctctgcttgtctagtaaaagccctaaggcctccctgacccttgctgtccttaccctcagtccagaggatgcctctgctgtgccttgctgcctggagggttcccatcacccaggttaatgtggctcttggctttcaccaccaatccttagtttctcaaaggggttcacaacctttttaaattactagtgtgtcttgtagaaattgaacttcacaaacaggtcttctgaaaacgctttcttgtggtgtaattgatatgcatatggtgcatctctttaaagtgtctgacaagccttgacatacgtgtgtgctcatgaaagcagcaccatgagcagcatggcaatgtggctgccactcccaactctttccatccttcctatgctcccactctccccaagcaaccactgatctgctctccttctctgtggattagtttgcattttctagaatggcccttgtgaagatgtgttcacataaattctctcaccctttctcacccgaatagaaaatgttgcatgatgttgattgcttaatagctccacagctttgtccaatttttatccttcctgcttttactgaagatgtcctgcccccatgaataaacctcagaagacccattctgccaccgcctaccactgaagagttgagcttgcacccactccagtccagcccacacaccagtgccagattcatctcttaaaagcacatcctgagtcacgcctcgcctgctcacaaaccttccctctcttccccttgctgcaaagtgaagcacagaggcttgaggctggcttggacatcttccatggaccaggcaatggggggacctaccttcctgacttctccccaccattaccctggtgtccttgatgaactcggctacaccctgaacgctccccacgtctcccacatcacatgggtcctgctgtccttcctttgtgcttttcatggaatccttctgttcttcaaggcctcttcacctcctgccatccataaacctttgccttagcaacccacaccaaccaaagagatctgtccctacctcactcccccatatccctgtgtcagcactctctttattctactttagtgataccttatgtgtctgtgtgtcttaccgcccccctcaccccacccacaaggatcaaagccaggagggcacacttgcagaccccaccacagtggcttgcacatggcaggtattggacagacactcattgaatggaatggaatccaggaaagtagagacactgtcgcccagatggtcaaggaaactgattgctgctaaagctcaaaattgcagatattaaatacttctcaaatgtctggagtagcctccagattgctgtgctcttaaaatctgtgtcatctggacttagagctggcttcccctactctccattgatctccatgattccttgctgtcccactttaccaggctaaaagcctttgggaaaaccaaagccagttcccacaaaaggcaaaggaagagactaacaagtatctggttgttggatttgtttattcccagtcatggaagcgtatcattgcttttattgacttgcttatcttctgctagtaccatattgcaaatgttagaggctcatctattttaagacttccatagtgttttcacaaaaatgaaaatcccttattaaacagattttaggacaagcttctaaaaggacctgccaaaaagtgatttcctttctatcattagaaatagtttccacattcttatcgttatgtagttgaacttttatgtccaggactgcatgaaagacgtgagaactgagaagcaacctatatttgatttcgcactttgttcttggacaggaagcccctgtcaactgacttcacatctttttaatgcactatattagtggttcacagaactttctgggtgttaggtccctttatgtgcttagaaacagttgaccccaaaacgcctttgctcttctgagttgtgcctataaatattttctatattagaagctagaactgagggctgggcatggtggctcatgcctgtaatcccagcactttgggaggccaacgtgggcagatcacctgaggtcgggagttcaaaaccagcctggtcaacatggcgaaaccccatctctactgaaaatacaaaaattagccaggccagccaggcacagtggctcacacctgtaatctcagcactttgggaggccgaggtgggcggatcacctgaggtcaggagttcgagaccagcctgaccaacatggagaaaccccgtctctactaaaaatacaaaattagccagcatggtggtgcgtgcctgtaatgccagctacttgggaggctgaggcaggagaatcgcttgaacctgggaggctgaggttgcagtgagccgagctggcaccattgcactccagcctgggcaacaagagtgaaactccatctcaaaataaaataaaataataaataaataagccaggcatggcagcatgtgccttaattccagctatttgggaggctgaggcaggagaatcacttgaacccgggaggcagaggttgcactgaactgagatcgtgccactgcactccagcctttgagttttttaagatggagcgagactccatcttaaaaaaaaaaaaaaaaaaagaaaagaaattagaactgagaagtttattacttaataataaacttagtcatttaaaataatagcaaatccattatatgtcaacctaagtaatgtttaggaaagataacgattttcaaaaagaaaataatattttagtgtgaggaataggactgttttacatttttgcaaatctctttaatatctggcttaacagtagacagctggactcttacatctgcctctgcattcattcagaggcatcttggggtatcttgctttggttgaagtatatgaagaaaactcaaatttctcacaggtatgtgcttggagaatggaggagtgttttaatggcctttgcagataattatgaaattcttccttgatactacaccaaaattcagcagctagtggtttcttaaagactacttgtaatgtggaatctgaaaccatattgatgatatttttgtactcttttccactaaaattcattgcttgatcttgcactttgattgactcttatattcaagaattattttcccttggctatttggaaaatattggttctctgagttgtgcagatcttccagacgttgacacatttaattaaaccatgtcaaaaaaatttcattggttaatgtcaccaccaatttcatcaagaagtctggtaagtatttggaagctgtcagtctcactatggcaggtacaagttttccaaaattgattggcaacagatactatcagttgttttctttgaagtgacaagctgttcatttttgggaaagtttctgccaaatacttaagtctaaaaaactatatcttgtcaggcattctttcaagaaagggggtgtttgcccccagaaaggtacaagtttggctcataactcagttacataagaatgtttcctgcagcccactgtcacacgctggtttgtggtagaagggctctctgcatcctctcactcatttcattacacaaactgttcgaaaggcacatactcgggggttgagatttaatcaaattaataattttttattgcatcgaggacatttggaagtgaaactggctttttaatttattttcttgcgagcgcgtggtagtgaggaatgtgttcctgctaagtacactatggagccactgcccgattcacgctcaggcatcagcagttttactgtgcaaatgtcaagcagtgaaaaaagtaaataacatcttggtgctattataaaaagttttggcttcacagtcctcctgcaaggatcttgaggtctgccggggctgcacagaccgtctttgagggcccactcctggctcagagtgagactggtgggcaggcaggatagaatctcttgggagctcaatgtcctttccagacctgcctgaacagaatctgcgttttaatgaagtcccgaggagatttatacgcaggttaaagttttcctgtagtcccagctatttgggaggctgaggcaggaggatggcttgagcccaggaggcagaagttgcagagagctgagattgcactgctgcacttgaacctgggtaacagagtgagattgtatctgggaaaaaaaaaaaaaagagagagagagagagaaccactgctctttaacagaggtctgcaaaactttcctttaaagggccacatagtaaatacctgtggcaacaactcaaccctgcctttgtagcttgaaagtagccatagaccatatgtaaatgaatgagcgtggctgtgtgccaatacaactttatttatagacacagaaatttgaattttgtgtacctttcatgtgtcacaaaataggttttttaatatattctaagcggttaaaaaagtaaccacttggaatcatgtcaaaatcattctgagtttgcaggccatgaggagagccagatttagctggtgggccacagtttgctgacctgtgctatataacactgagtgctcattgaagttaccgggggagcttcaaaaaaacaaaccccaaccctctaattcctgagtcccgtccccaataaattctgataaaattggtctggggtgaagccagggcatcaggattttcagatgctccccagattattccaatgtgtaggaaaaatggagaacctctgctctataatgttttccaagaaagttagttttcttttaagcatttctttttaagattttagaatttggcagtgtcaccaaatgtctgagaccagaattatgtattgtaaccttagagcagggtttctcactcttggcactgtgaacccaaagctatctgagataggtctcaatcaatttagaaagttaattttagcaagcttaagaacctgtgacacagcctcgggagatcctaataacatgtgcctaaggtggacggggcacagcttacttttataccttttagggagacatgagacatcaatcaatacctgtgagatgtacattggttcaatctggaaaggcaggacaactcaaagggggtcagagggtggcttgcaggttataggaagatttaaaaattatgtaaagacctggaatccatagaaaggaatgtctgggttatgatgataaggggttgtggagagcaaagttttatcctgtaggtgaagcctccaggtagcaggcttcagagagaatagattgtaaatgtctcttagcagatttaaggtctgttgatgttaatgctggttggcttttcctgaattccagaagggaggagggtataatgaggtatgtttgactctcccttccaatcatggcctgaactagttttttcaggctaactttggaatccccctggcagagaccaggaatctattcagatggttgggggtggggtggggggtgcttagaatttttttttttttttttttttaaacggagtctcgctctgtcgccaggctggagtgcagtggcacaatctcagctcactgccacctccaactccctggttcaagcgattctcctgcctcagcctcccaagtagctgggattacaggcatgcgccaccacacccagctaatttttgtgtttttagtagagacggggtttcaccatgttggctgggatggtgtcgatctcctgacctcgtgatctgcctgccctggtctcccaaagtgctgggattacaggcgtgagccaccccgcccggcccagagttttatttttggtttatagcactattggcattttgggtgtgaccattctttatttggggatgggggctgtcctgtgtattctaggaggtttaggagcatccctggcctctacccactagatgccagtagtgtcccccaccctcagttgtaacaaccaaaactgtctccagacaccgctaaatgtccctgggtggcaaaattgcctggattaggaaccagtggtctaaacgatgtagatgttttttgtgctacttcagagaatctccacattggagctattgacatctggggctgggtaattctttgttataagagcatattctgtacactgtgggtgttgagcagcatccctggtctctactcactagatgccagaagcaccctctcccccagctttggcaacgaaaaatatctccagatattgccaaatgtcccctgaggggcacagtcaccccctgttgagaattgcttggccagctcagaatcagggaagcttctgtccactgacattcactgctgcttctcttaggattttcgccctctccattttcccattgcttgttgcttgaaagttgtaaagcttggttcctgcatcttttctttttaattttgtggctcattaggaatcagtaatatagcaaggaaggccccatgtagagaggtaagggggtggtttttttgtgtggtgtttgttggggggtgtttgggagggtgtgtgtgtgtgtgtatgtatgtgtgacattcattccctggggaagaatctgagcccttgttcctgccagccctacgtctgagccagcattaaatctgcagccaagatcacagacaacttgggcaaatcacttggccattatgaactcacagccatggcaacggccatccacaagcctgaggacaaaaggtgttttattctgttgttctgcacaaaaggttctagggatactggagacaaaatagcctttgagacttaaaggcattgatgtgtattttttttttccctactacatggcttatatttaaactgtcttaggctaatgtacactgtaatttttgtgtgaatcaaaacctaaaattctttttatccagaggccagctaaatgaaggcataagacagcccaacagaggcttttagggtttggtgagaggtattgagaattactagtaaaatgtgctagaaagcctggcattctagcctggccaacatggcaagaccccgtctgtactaaaaatacaaaaaattagctggatgtggtggcatgtgcctgtaatgccagctactagggaggctgaggcataagactcacttgaacccaggaggttgaggctgcagtgagcggagatcacaccactcactccagcctgggcaatagagtgagactctttctcaggaaagaaagaaaaaaaaaaaacctggcattgattattatttttttacatgaatacatcacagtcatcaaaaaaatgctttccttattttttctcgttcacgttacccaatgttgtcattgctggtttgaagcttgggaaaattcagtctgtggatttataggagcatccaagaaaagcactgatcttccttagctatcgtaaacttttaacagcatggtgttctgctggtacttggcaccacccctatatttaaaaacatcagcttgcctatgactactaaggacagcctgaatcccagatctacttcctttttgtgcacaggcactcccagcactttagggggtggttggagtgtgtgtgtttagaaatctgctttctcaggtgactcaattcccgtcttctcagaccctgtctatggcatgacactaaagcatgaaaaattccaaggttaacagtacttgtttggctcacaaaaatgcactctagctgcactcttttcaagatggctggacaacttggaacattttgtttttcttaactgtagtccttggaacttgccatttgattcacaagtgactggagggttatggccaaacccagtgggccacgtcttagagaaaaaacatcacacaccatcgaatatgaaagcaggcacttcaaacagactcaggatgccacacctgagaccgggaagatgccactgttgactagaaatgggcttctcaaattttcatgtgcacacaaatcaccccagaggccttgttaaaatgcagattctgactcagtctggggtcacttccaacattctttatttctcacaagttcctccctgctgaagctgacactgctggtccaatgaacacactttgcaaagcacatggaattgacaaatgacaaatggtccactcatatcttttcttgacctctgatagttttccttgttgcccagtagaagctgccagcatccaagttcagctcttctcagctacagatccatatatcccttcacatcatccagagtgatctttcacaaccccaatctgtttcccatgcttaaaaatgctccctggcagaccaggcatggtggctcacacctgtaattgcagcactttgggaggccgaggcgggaggatcacttgagcccaagagtttgagaacagcctgggtaacataaggagaccctgtcactacaaaaaaattaaaaaataaaaaatgagctgggtgcagtggcatgggcctgtggtcccagctacttgggaggctgaggtgggaggatcgcttgagccagagagttcaacaccgcagtgagcagtgattgtgccactgcactccaacctaggcaacagagcaagaccctgtttcaaaaaacaaaacaaaacaaaaaaaaaacgcagtggcttcccatgattttgttttttttgtctttttgtttttgtttttgtttttgttttgagatggagtcttgctctgtcacccaggctggagtgcagtggtgcaatctcggctcactgcaccctccgccttccgggttcacgccattctcctgcctcagcctcccgagtagctgggactacaggcgcccaccaccacgcccagctaattttttgtatttttagtagagacggggtttcaccgtgttagccaggatggtctcgatctcctgacctcgtgatccgcccgtcttggcctcccaaagtgctgggattacaggcgtgagccacggcgcctggtcaaggcttcccatgattttgaagataaagtccagaattcttaaggtggcctggaaagccctaggtggtctagctcctatattacctatatcctctagctcctaaataaacacatttagctttttcttactaactttttgcagcagttttggttcctctaggatgagtgtgtgatatgtgactaaattgcccagtgttcaaagatatcatgcacactgtgaccagaggtggcttctatactgacatagaagatacagtggagagtgatccatttatagattgttggatatctaccacacatgcaatcttaaccctgaagataactggtcaaccaagctagaataagctctacatccagctgtattatgtcctataaatttttcccatattttatgtcactagcttctagtcatgttggctggcacagtccgtaagagttttatctgtgccagtggagcaaagatggtgatttctgttctataggagccagggttcctacagccacaaataaaatcatctgctgaaaacctaagagcattggcatctgctgagagagcatgattcattgaagtgatcccccaaattcttgagttcctggttttccctgctgttataaaactagatccacagcatgaggtatatacagagtccttgagagatataaattggagggaaactttagctttgatctagtattgaatttgggattgaacagcatcattcttctaaccccacttggctttttgagcctgggagagctgtgatatttctttggaatgctctaaccatttggatgaaagaccgtttgaagtggcaactgtggatttggaaggatgagttctatcgttaaagggcgagtgtgctgcaccataacacctaaccctaactccaaatgatgaaaaagggtgtgggtttagtttaaaaatatatatagatgtatacatctatatatacacacagagaattaatgaacaattttatctggttatatatcagtgtcaccacatcagctgtttaagtattctggatactagatctttctgtagaaggacccatccagtatgaattatttgcccttctgatcttccctgtcccccttctctccactctctttccactggctctgcaggggtctgtatctttgcccccatcatgctggactataataattgtgttacttgtctgcctgcagtattggatttatcttgaagccagaaaggtatcttatttcagttttgtgtacttggcacccagtaggtcttcacaaaatactgaattaatgaaatccaacagaaaacccagttagaacccagctcctgggttatagaaaatcaaatatgtgacaattcaaaatgtatcttccaaagcagtgtgttctgtgatgatgaaatgtcctatatctgtgttgtccaatacggtagccactagtccatgtggcttttgagcatatgaaatgtggtttgtgcaacagaggacctgaaattttcattttatttaattttaaataaacgtaaatagctacatgtcttagtggctaccattttggaccacacagccccaaggcctcacatctttatcctttaagaaccagatacaactttgttagccaggaaagcaggcattcatctttttcttaacatgatcatagaggctgagaatgtggggaggttgtggatgatacaatacccatgtctgttttctctttataatgagatacgtcaaggccaaggattctagtttctcttagtttgggaacctggagagaatttggactttgagttgcattcctctcacctcagtccccagaaagtcatgtgacaaaataagattgagctctaacatctctgctcacaaatcccaagtgtctgaagctctttaagatactgacttgctagtgaacttgaaccatattgtgcactggttccctttttctttttttgagacggagtcttgctctgtcgcccaggctggaagttcagtggcgcaatctcggctcaccgcaacctcttcctcctgggttcaagcgattcccttgcctcagcctcccaagtagctgggactacaggtgcccaccaccacacccggctaattttttgtatttttagtagagacggggttttactgtgttagccaggatggttcccattttatatagtttccccaatccacttcagggaagttggtcttcctaaaaacagctgctcatcttttgaaattaaaggaagcacagctttcttatgaagccctgatattttttattttctaatgaactaaagagaaatctagtaatgagttttcatagtcactttccataggtttaagcgaatgctagtttaaaaggaatgctcactaaaatgaaaacattcatctatggtgttttatgctgggttgtcattccatgacaactatgaagaccatttgggggattttttttttttttttttttttttttttgctggcttaatgtgcttgccctaaagtaatgaagtgcccttgattgctgctaaacaccataatgcgtttaaagttcaatttccccgacaagccatttacttaagggtctggataatataaacagagacaggaggttaggagaggtactgacattatcctgaggccagtgctgcctttactgaaacgtaaatgtctccaaactgaaaacgtcacctggctctgcccctgaggcaggtctttatggacatctcaagtaaaagtttattttaaaaatgaatacaagtctcgtcttttcaagattaagagtgacttacggctgtctctccttcattccacttcatggatgttcattttggttttgtttttttcttctgttcttttttctccttcaagtacttaaatatcacccaccagttctgggttctgactctgaacgtgtgtgtcggggaagggggcaggtggaagccggggaggaggaggactgtgaatgaattgcttgggctgactgggctggggggaagcatttttattaaaaatttgagataatttctgatgtcaacttgaatgaaacttgagtagacccacttgagtggctcttggtgactttgttcttcactgaattatggaccaaaatacctgtgacctttccaaaacaatcaccttgctatttgtttgaacctggcgacggcataattgctgtatcagattctcccagttgccccggaggtccagggcttggggaaagccgttggttgccacagcagcagacgtattgaaaccccagaactgtgaggctggagacgacctgactgttgcttttcttcacagagctgcagcttcactgctgtcctctcttttgactgtgttagtggaatgagtgcttcttgttggcacttgagcggggctccccccaccactcagtcgatcaggaagctctagaactgtaactaccttataactctttgtcaattgactgctctgccattcactacccttccagattctgagcaaattaagttacattcccttttggagcctcagggtcctcaccgcagaatgtgagatcacggtaactaccacactggcccttgggatgtcgaagtattaatattaaccatagagcctgagaggggagatggaaaattgtaagccttctctgtgaatatggggtattcttgaagaccagaggtgttcttgcccgtaacggctatattttctctcctttgggttcaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgtaagtatccggttccctttaaaaatgcatctaaggcctggcgtggtggctcatgcctgtcatcccagcaatttgggaggctgaggcaggcagatcacctgaagtcaggagttcaagaccagcctggccaacatggtgaaacgccacctctactaaaaatacaaaaaaaaatttagctgggcgtggtggtgcgtgcctgtaatcctagctacttgggaggctgaggcaggagaaccagttgaacccaggaggtggatgttgcggtgagctggtgagccgagatggcaacactgcactccagcctgggtgacagagtgatactttgtttaaaaaaaaagtatctgagatgcaaccacctcatgatgtttttcagaaagactacagtgtgctttcctagcagaagatgaatgcttttacttaaagctcactttatgtagttagaaaaaggttcatgagagaaggaaaaagaaagggcctagaatatggtagctgtttaggccccagggtggaatgttacttgggaatggtaaggtgcacacataggacactccacacatggtagctgtggacatggggagctgtgacatggtgataggtgatgctgccgattgtctcaacagaattgtgttgttcccaagtaacagatgcctccagctttctcccaggaagtgaccatccctggaatggtaggagccctgttgaggactgaccccaactctaagcctacaggagcagtattttaacattaactcttccagcagaagagcagatcccagggcatcctccattgcagaagagcagatcccagggcatcctccattgcagaagagaggaaggtccaggggtttagcagcagatctctgcctttctttctggaaacattctcaatggagtcgcagtgactcccacacatagattcttgtagctgtgcaagctcagcagcaatctacttatttccttcacatgtcttcccctttctccatttccttctaccgtttctttttcttcccttgaatcccaaagttccagtgttagtgtgtcttatgattataagaaacttcttcaccagactgaaaaagacatgaatgaatttttatggaatggtcatggagtcatgttggagactcttcagtccttagggaattttattctttcttatctgttcacaaatgacctccaaagaaatgaacacaggttggggagattataaggagggctcaagcaggacaggggactcactgagttccaactatgtgcaaagaagaaatgtttaccaagactgaacctgggaaaggtgtgttgatttaattaggtagtgatctcagtctgtggctctcaaacttctgagaagctttaagaaaatccccatgccttaccccagaccaattaggacataatctctgggggcgggatccaggtaccagtattttccaagctccccaggtgattccagtgggcagccgaaggctgaggacatgtcatttgtctttgttagcttttgtgggacaaactgcattgtgaattaactttctgtatcttaaacctactcgacctactactatttgtgtggtgggagtcacagtgcaaaagacatctccccagattaccccctaaagaagccctgagtgcctacttaggggttttatcagagtgacattaaccactaggcctggttgggaggcattttgaaagggcagaaagaacatgttgtccattgggccagggttcagatgctggctttgccactaactgtgtatcctccgatgaggagcttaactcctcaatgcctgtgttttacttatgtgcaaaatgaggattctaacccttgccgcccaggactcaggtaaggattaaaagattacaactggatgctgccctgagcaaaggaaacatcattcccaccttggaaggaaggcccaggttgctgggacatgggcagggatgccgcccaggatgccccacaagtccatcaaagccatcagtggggcgagtgacgcactcacaggaacatccccctcatgtcctctctccagcgtccagaaacgtagtcactaccaggcagtgaatttaatggttcaggatctcttcttctctttgtaggatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatggtgagttgaacctctgataactgattgtttgatatacaaccagagccatgccttgatgtatttccttgtatttggcaaaagctaccaggtatcgagcgtgaatggagggtccatgacacaaatattggctttaccaatttagagttaggactataaaaaccttcaacatgctattgatagtaaactaaagtctatggctggcagaaataaatcaaatgttttcatcagtgtaaaggtgaaaagggtgctgaagatttttcaaatgccaagttcccactatagaaggaggtaactttcatgtggtctcagtgctcccctttggttgtctttaaatatggatcatagccataaagacatacatgaaccatggaaaatcgtcctgatccttctgtaaatacttaccagtacctgctgtacagagcgcctagctgggctttgctagccactagaggtgcaaagattaaaacacaggctgctttctcaagcagcttatagtctaagacaggggttagcaaactaggggctgtgggccaaatttgacctactacctgtttttgtacagctcaagagccaagaatttttttttttttcttttttttttttttttgagacggagcatcactctgtctccaaggctggggagggcagtgtcgcgatctccactaactgcaacctctgcctcccgggttcaagcgattctcctgcctcagcctcctgtacaagtcaggggaatggttacttttgtaggggaaggaggcagctgttaaataaaatgcctgtggaaagcagagggaaaatagccacaaatagtgggaatcctcctccaaaggaaaaaaaaaccaaaaacatctcctcacagctttaaaatgacagctttccccctcacttctacccatcaagtttcaaaaatagaggtctagtttccaccagggcacagcattaagtcatccactgcctgatgtttaacatatttggatcctttgagcattggtcaggacacagtacatggtggagaggagaggagcttgtttgtacttgagctagtggcacttcacctagagatggggacactgtgagggatccacagcccacctagcatggcccgcttttagctcttatgtcagattttgttggagaaagtcgaaagcccccttagactggagaggagcttgaccatcttgcttgatttcattgccagtcattcatgcgctgtctgcatctctggccactggcacctcatgtgcttccgtttcatccatacgcttaacagatcacaatgctgacctgccttggagggtgtgaggaagatgcaggtgacggggcagggctgaggatgctggggacagaaacaggacagaaagtcatgtgaggtggagaaggtggatgagatctgcccgctagggaagcaaagctgccactccatcaccaaaggcctttgtctcctcagtcctgtgaacccaaaagtatctgaaacaggtatcagccaatttagaaagtttattttgccaaagttaaggatgcacccatgacacagcctcaggaggtccggacaacatgggcccaaggtggtcagggcacagcttggttttatacattttagggagacgtgagacatttatcaatgaatgtaagatgtacattggttccgtccagaaaggtggggacaactcgaagcagggagggggcttccaggtcacaagtaggtgagagacaactggttgcattcttttgggtctctgattagcctttcattgaatatacaattcacatgggagaggagggtagaggaatagtcacttatgcctggtctggcttggtgaaaagacagggcagaggaagcaatcagatatgcatttgtctcacatgagcctcagagggatgactttgagctctgtcctttgtccacgaggaatttccttgtgggcaaattgtgagggaggtatgtagctttatctttgtgctatcttgtttaggaatagaatgggggatttgcctgtcgcagttcccagcttgacttttccctttggcttagtgatttgggggtctggagatttttctttcgtagtcctgtgtgggaggtttgtgcccaggaactcactgaggaagcagctctggacgctagaggcctccatgacagggccagctcgcagcggggacctctgggagggggacagtggccttccctctggagtcctggcctctgacagaagggaaggctcactgaagccaagaaccaccagctccctcctgctcaggtcctgttttcttttgaagggaaagaaacctagtctggagcagcagtgggaggaagtgggaggtggaactgctgaaatctgcttctctgaatatttttggagatgcaaatgcttccttgcagtgcaagggaaagtgtctcgtttctgcagtttcctggcattgtgaccatcaggaggtggcctccaaccgcccaggtatctcctgcagcacagaaagttaggggtgaccatcaggtctccaccatcagcttcaaaatagaaaagccaaactagcactccacaccctctgtgggcgcgccttctgagaacacaaataccacgtttttgaggccgcctcacaaagctctctgaaaagtggtcaaggcagaggaaagccaagcaacgggattctattcttcctggattgcccatgacagtgtgtgggtgaacacctgaagctttttccctaagccgttgctttgcttgcaaagctgctgtgaatcttagagacaaaagaaaagtagaggaaaatgagaattttatagatcgagcattaagcttgtattcgtgattatttgaaacttttggtaattttgcagaatcaggaaactagcaaagttctttttgagagggcttcttgtggcaattgctattctctgtgagccaacctgttacgaaaaataaaggtaacttttgagaaattaatatgaagttataattcagtggtatatggaatacatccagaatctatcccatgttaagtagcatgttctgcattttcagaacggctatttagaaagagcacctcttgagaggctgccactgattagctctgtgaccttggatgagtgagatcacctcttggggtctcctgtccttgttagttaagagtgacccgaaaggccctgacattgcttcgggcactccaattctagatcctctagctctggggaatgtggctggctcttacttcccctgctcccgtgctggcttttccttcttgctaccaatgccggggcgagggtccccacaatgtgttccacaggtcagtattgggcctgaaaatgcacaatccttccacttaggggacacacatctacctgtttcagtgatgattgtccttcctcttgttttggcctagttcgttttcctcacctatgtgcttggagtggcctggctgggtgtgtttggtttctcagcggtgcccgtgtttatgttctac

SEQ ID NO: 3065 - DNA, 167182 bp, human
agcgcagcccgcagaagcccggtcagcgcacgtgcccgcgagacctgcaaacttgtgccaccggctctgcccgtccccggggagcccgaacgccccgcagccctcacccctcccgccagtctccagccatgggtaagcgagcgcgctggctgcgcgccacggccacggtctcgcgcccccgccccgggagggcgcgcccttccgagggtcccgcccctcccccgctcaggtggcgcctcctcggccacctctgcgacgaagccgggacgctggaggtgggaggggcgcggcgcaggtgtccggaacgcccaggtgcgcttccctgttgtatcctgtggggggggtggtccccgctccggctgcggccaggctgcacccccgcacgtgcggctcgcgggagcctaagagctgggtacccgggaggggttgcagagagaacagacggcgcgtcccgggctagtgctttattttaaggggccagtagagagtcgcttcttgcctgtttcccgggacgctctccctgtcgcccgagctcccagtccagtcctgccccgccccgccccgccgtgcttctgttctccttaagcccgcgcgaaacaaacacccggttccccaagcctggggtcttccgggagctcatttcgaaaccatgacccttgaaaccaggaaagtgacaggagagactctggacagcatgggacggaggctgagtctctcctctttgtcccttgttccaactattaaaatgcggcccgggtgcaggtggaggcggtgtgctgagcgggttccaatgcaacgggggaacgactagcaacggcaaaaggctcagctccggagggttaaaatctgaaatctccaacctggcccgaggctggtgtaaggcggctgtaggattctttttgtcacttcctaacaccctgaaatgctgccgtcagcaacatgtctttaagtggggactctgtattgggaggaaaactcgtaaagagtgctgtggaaatcagcctcattccgcagcactcctgaaaacgtgtgacagctgtgcttgggaaagggtttttctcctcctgctccgttatctttctctagtgacagactccagccacaagccacaaagactgtgaagagcattcctaacgaggacgtcagtgggtttaaccattgcgagttaatggtgagggcttgggaattgcttgcccgctcctccgcttcccctaatcattcatccccctctttcacattatctttgctattaattgtgtgtgggggggcgataattttgtacggattaaaattttggtgaggagtaaagggggcacttttttgcatttcaaaggaagctcaaataattttctggtttacatttttaaaaaatttactaggtgatcaaaatatgaaaggagataaggcccaccaaatccaacaggaaaatttctttctaaaaaggcaagaactagcataagatccttctagaaagggcagaatcgagtggcctgtaactcaggttcctacttctcttaatgtcccccatgtgagcagtcaaaccattcaacctccgttttaaatgaggctcatacacaaaatgaggctcagaggatgactgctactcagcctgtgatcactttggtgataattgccaccaaagatgttacagttacgaacaagtgtggtattgaggaaagcatcaactactttttctgaaatcgttattttaatttaacgctaggcgtttggatttgtacgtggaattatcacacggggaccttctccagaacagctttcacaatactttggactgatttaggggtagggtgggcttcatttttaaacaggtgtggagttgggtgcagttctcatgaagcaaaggcccgagccagagacctgttcttaaggaagtactttgtgttttggacaattgttggctccacatttcaattgccaatttatgttaatttgtgcatacttcactggttctggcagtatccttggttttggttttagtttttacattaaaaagaaagttcccttcatgtaaaaaaggaaacatactgatttcctttggtagactcttagtaaatacaccacagggccatgaactggttttatttttccagatgtatttaattaccgtgcatcctcttatgaatgttttaattgaaatgatttaacgttgggaaaattctgaccattggcccattaagtcgggactttggttcttaatacaattagttccttaaccaggatcagttaatttactggtaaaatagatgaggtttgtagaaataaaagtcccttcagactcaaattttaaggtatttgcaatctttaacctaaaaataaaataatgagtagtggtgatatgtgtaatttcacttttcattacatcttgaaagaaaacatgggtttttcattgttaagccagtttttttatagccttaagatgtaattcacatatcatacaattcacacgtttaagtatacaagtcagtggtcttcagtatattcagatttgtgcagccatcactactatctaatgttagaacattgtcatcaaccccaaaaagaaatcttgtacccatttcgcagtcactcctcattctcttctccccccagcccctggcaagcactaacctactttctgtctctatggatttgcctcttctggagggttcaggtaaatggaatgagccaattgatgtctgaagtgtatttgactgttcagtaactttggtcgttttgcacaatgagatgttgctgtattgtgtatgcagtacgctacctaaatgagtgtgttgaaactatttctctggctgaagggttccatgtttggctgcacatattgtgaaggtgagtgagagtgcacacacacagcacacagacacacacacccttcagtgttaactctggttttatctgataggaacttgcattgcccaacagaattttgattctgttaccttgttcataggcctgaaggcatagcaattaagtgaattccatgtaataacctcttataaggcatttgtggaatatccaagctgctttaatatggcttatgtatccagagagaaatgcggattttgtttctttgcctataattgttttatttttatttatttatcttttggagacagggtctcactctgtccatgctgtactgcagtggcctgatgtaataactcactgtggcctggaactcctgggctgaagcagtcgtcccacctcagcctcccaagtagctgggactacaggcatgtgtcaccatgcccgattaagctttacagttttttttttttttttttttttgtagagatagggtatttctatggtgcccaaactggtctcaaactcctggcctcaagtgatcctccctcctctgcttcccaaagtgctgggattacaggcgtgagccactgtgagtggccaattgcctatcattttaaatggaaactgtatacgaaatgatcagatacaacaaaatattgaaataattgtttcaacccattttgtggtaaggaagtttttataaggattatgtatttaaatgtcaataatttcactaaatagcattataaaaaattttggtctagagcagttctttttaatatgtgtacagatcatctagcgatcttgttaaaaaagcagtgtctgattcagtgggcctgggtggggcctgagtttctgcatttgtaacaagctcccagtgggtgctcatgcttctggttcctggagccaggaagcaaagaaggctgttaagcagagaggccctggtgcctgccccagcttgcccactagtttgctgtgtgatcgtgggtaaatcattttctcttcataattttagttgactataaaataaaagaatttgatgaaattatttctttgggtctttacaggtcaaccaatatgtaatttagaaaaaaagaaatgagagagtaatgttatgcttgaaaaccacgagaaaacagctccctgatggtctaaacactacttgaatgcatgaagccagcatcagaagtgtcacctgtagttgggttaaatgctggcatcttcgatgtgcatgcttccagtatgattggctcttctccaagggaactggtggaggaagctataatgttctccctctttaacacttccagctttggcttctcctgacctcttttccttaaatccctttcttccccgacatccaggctcaagccaccctcagaggctgcactcagaaagaagcacgctgaagacccatacatgcaatgcttggttctggaagcttgctcaggaattcagatgcagtgggagacaaaaaggaatggaatcctgctgaataactgggcaggaagtgatcccagaatatgctagcttccctccctctgagtctaaagatctagtaaggagcccacccttggatcttggagagagctcccttttaatatcgggacacaaaccgacattttgagtaaacctcatagtcgaataccacggagtactgtttgtgacaaacaggaagtcattaattctttattatatttttgctctaccgaaagctgttgaccaaaccacctggcttctccgagaaaacccttatctgctacatccaggaccaagcagctggatggtttattgaaaatgccaaagggatcaatcataaaacgtgccacttatgtagcctaaacattttgtttaactttaaacattaatttgctgatattttattgtagagtcaaggcctttgctttgagtgcaaggacctgattggagttcctagaagtctttcttacattaaatcacagccaaaattcattggcttctgattttcagcttcagattcttacattaaagtagaatgaaaacctaaaggcattgggaaccaatctctgggcagaatccctttatatcacctaccccactccccttaaacctttaaatttgcccgtacttacttttgcaactattttctcaagtgactcatttttgttaagactctccaaagtaatcaacctggttttcaaagaaaggaaaaaactctctcgtttggcactcctattttattagtttatgtaatatcgaattaagtttcataattctagtaacaagtacaactggcataaacaggtttgggaacaaacaccactgactcttcttaagtacactacttgggggagaagcagtacatacatatattgcaaaagagcctacaacccaagttctggacaatgatcagtatggtttagaaaaagaatggaggatatggggtaaatgggtggggtcctttaggtaaacattggtaagagagcatctgctatattttgagccatcatcatccatttaataattttaacatgatggctggcttgttagtgtttttcatatgcttctttctgttcaaataccaaatttgtcaagagcagaaatcgttttattcattgttataccccaatgttcattggaatgattggcatattataggtgttacacaaatatttgtttaaaaatgaggattcatatgcattttattaaggtctgtcaacattaaaattatagatttcaaggtatttaaattaacattgatgtactgcaaactctggtaaactatgctaaaatagggtaaattacgtaaattattgttctttaataataatacttttatcacagaataacaatttcagagcttgaagttgctttagaagtaatttgattgctgccaggcatacagacacagaaacaattgaaagagcagtttggatgttctttcattagctttttttttgccttgagctttttttcttctgctgctataaaatacttttctttctctggtgaaaagtacttccttctcatcaggtttttgaagttctggaaagattggggttgaaggctttgtttccctgaaactcattattgccctgagaattaaaaggcaatggcagctttgtgtttccatcctcaccatgtgtattagggttaaatgagtacctaccacaatatcatgcaactagcatgtgccagtctctaagcctttgaattcctgtcacatgtccatcaccatggggctctcaggggagtattggacagctgctcactcagcaagcattcacagagtcctgttcagatgagccaagtactgtgctaagtcttgaagcaaaaaataaacaagactctgttctcaaataaccacagtcatttctgaaaggcagataaacaactataataaaagtacaagatcctgtaggaaaaagagtatctgtctgaggaaaaaagcggggaggtggtatttcaaagagggattccctagggaggcagttactttaaatctgagagtcttcaagcatgagcaggaagataggggtcagggtgtccaggtgtctgggagaggatggtccaggccctggatacaaatgtgtaaaagcaggagccgtggcagaggctgctgtgtgggtatgttgagttgggaatggcctcaatgtgggggagtggggagagctgaggccagattgtaaagtaccaggaaataacttggtcattaccctgttggtcacagagaatcaggaagggattttaagcaggcacatggcagctggagggaaatgacagtctccccaaggggataaaagaaacccactgagagaatcgtttgtgtctaactataaaattccagataaaagtttagaagttctgataaaggtaaaaccttgtggcttatatgaagtttccagtggtgacttagatttgaggagtgttgagaagggtggaagggattaggataacccatgaaagagaggtaggagtgagcaaggtttgttggggcaattctgaagaaactgacctggccatagcagagagtaggtatgggagagagtaggaaatacgatttggtcagggaactgaaagccagatgggagtaatgaattttagttgattacaaatggacacatataaatgaatcttacaaaaatgtttttttgtaagtccattgtttcatcccttttgagaaggaagggaagtattagctttctgggatggaaagatattggggtgatctttggcatgactacagaggggttgaggattggaacagaaccaacttccatgtctatttatttactcgattattaattttatttatttatttttctttttttcttttttcttttttttttgagaaggagtctcactctgtagcccaggctggagtgcagtggtgcgatctcggctcactgcaagctctgcctcctgggttcacgccattctctcgcctcagcctccggagtagctgggactacaggcgcccaccaccatgcccggctaattttttgtatttttagtagagatggggtttcaccatgatagcctgaccttgtgatccgcccgccttggcctcccaaagtgctgggattacaggcatgatggattattaattttaaaagtgggatttgttgttgttgttgttttgtttttgtttttttgagacagtctagttctgtcacccaggctgaagtgcagtggtgtgatctcagctcactgcaacctcagcctcttgggtccaagcgattctcctgtctcagcctccaaagtaactgggattacaggtatgcaccaccatgcctggctaattttttgtatttttagtagatacagatttcactatgttggccaggctggtcttgagctactgacttcaggtgatctgcctgcctcagcctcccaaagtgctgggattaaaggtgtgagccactgtgcccagccatttttttttccttaaatatttgcaagaatttaccagtgaagccagttgggtctggagttttctttgtagaaatgtttaagttatgaagtgtatttctttagcagaggaatattcagactttctctttgtttcaattttggtaaattgtggctttcaagggctttgtccattttatctaagttatttgttggcacaaagttgttcataatattttgtattatctgtttaatcctgttatctatagtatctgtagtgatgttcccttgttcgtttctttttttttttttgagacggagtctcgctctgttacccaggctggagtgcagtggcacgatctcggcttactgcaagcttcacctcccgggctcacgccattcttctgcctcagtctctcgagtagctgggactacaggtgcccacaaccacgcctggctaattttttgtatttttagtagagacggggtttcaccgtgttagccagggtggtctcgatctcctgacctcgtgatctgcccgcctcggcctcccaaagtgctgggattataggtgtgagccaccgtgcccggcctcccttgttcatttctagtgatgtaggtaattggtattctcattatttttcttgatcaatatttctaaaatttattttaatagcttgatacttacatgtaataattatatctgataggtaagttgaccacttaatgaaaaaggagtacattttctagtaatcaaaaatagaatttaagtatctaaaagtaagaattgcttacttggttagaaaaaaataaaatctgccaaaagaaaaagtatttaaacctgatctttggaattttactcttaatggctgtatataattcagtatatttgaacttggtataacaaggtctattataaacaatcttgagttagagtagatcttgagttgagcttagtatttgcttgggtatttatttgtttagtttttgtaggactgttaaattctattttcttctttggaccaactggagatagatactaaaataaaagaagtccttttttcttcctttctaagtatagttttagagcagggtttctcaacctcagcactattgacattttgggctgggtgattctttgttgggggagtatgagggctgtcctgcgcattatagagtgttttgcagcatctgtgttctctacatactacatgttgtaacagtcctctagttgtaacaaccaaaaatgtctccagacattgccagataacccagggagggaggaggggagcaccatattgattaccactacttaaagggtaagagggattgaaaaccttttgtttctcacaatatcataaaatctgagtagtagcattgttgagaacttggttgagcacatctgcagaatgggaggatttcttgtctaaaaggtttttctttccaaaaggaatgcttggttttttttagttgaaggaagtttttttttttttaatctttttcttacatcatcagagaatctggagatataatggggagctttgcagaccacctaagtcattcttccttggagtaaaatggtgcctaaaccatctcgataatgaggccaacctcctggggaaatagtgtgcctggctttccttggtaacttctaatgattagtgcaccttatctctgaaaggactgaatctgtgaagatccttttgcttactaaaatagttttcatcatcttttgttctcattaagtggaaagacatgaaggatctagtcacatccttagttaccttgatggcctttccaaatttagaattcatcttcttagctgtaatcaaatctaaccagattaagcccttaaggcaaccttcctgcacgttccgtccttagtcatgtcttcattacgtttgttcatgtgtttgagagatgcaggagttggaagagaaaggactgatttcccccttgtttagagatccgttttctatagccattgatctctgccattcctacatcccagcccccacaacctagactcctccctgcaaatggagactataagtcaatgttttctgagacatctgaccatacttgcaaaatagttccagcgcaaaaagaacaagaacattggaagcgagggtcagaaggagcctagaaaacctgctatattgtatgtgcattgggtcactgttttagatttagaaatgtttcacaatgtcttcccgaaaagaatgtttaaatggtggattttaagatgggtgcttaaattcaggcatctgttccttcacacaatgggcaaagaatggaaatgtaattagcaatgtaagtcaagctcttaagataatgtgatttgatgcagtactttatattttcctttttgttttctcatttggcatattctgacagtttccatggtaattaaaaagaatttgggaccttaaagggatgaatttccatcctatgaattcttaccattttgcaaagccactgtaccggtttactaaaaactgttttgagctctattatatgatgtcacaaatatttttagatgttttgtaagaggcacaaatatcgtaaactcattaaaaattgttattgaagtataatatgtgtacacgaaaagtgggcaaatcataagtgtacagcttaataagtttttataaatgtaaccagcagttatagattaataagcagaatattaccagccccttagaagccgcctcaggctgccttacagatatacctgatcaaggctaatcacccctaatttctgtcagcagagctttgcactttatataaatggaataatacagtatgagctcttgtgactggtgtggcttgcccaacatttgataacattattttgaaacaggaggatgttttctgtctggaaaagagatctgcttctaaatcattatggttaaaagcatttattaaatgctttcgtgtgtagaaccgtactaggaagtacacatatcattggttcctaccctctattttaagtggaaagcattgacacagcagctgtgagaaggactttgaaaatccttgatgaaagatgagatagatacatgaaaacatgtatacagctggagagattacaaaaataaagtgtccccattatccccttcagaaatggaaagtacattttgaggagttgtgaatgaagacaaagctgtaagtgttgcatacctattcaggatttgatcaacgtgaatgcttgctaacttcaggacttaaggatgtaatagatgttgaggcctgcctcctcccaattagtttcctgtagaaggtgaaattttaggaattgtttgaattagcagtagttagtgaatctttggctagtggatattccaaatggagtagaggtgtggacaaaggcccaaaggcctgggatgatttttggttctcatcctgaaaatggaactacataggaaattgtggtttgccagttgacttttcttctcgtttgtttggacttagacaataatactttgcctatgttccttcagtgaggaactttgtcatcttcttaaccagagtaaatgatgcagtcagcaaaatgaatgctttgtcaccacactgaactagctttaaatcgtatggtgttaccactgcttctcaagtggtggtatcaatttatactctcaccaggagtgaatgaacattccagcttctttgtatctttaccagcatttgctattgtcacattgtttattttttcaaatatctgataggtgtgaagtggtatttcattgtttttttttttatgttgaatttctctagagaggttgaaagttttgtgtaggttattggtcatttgggttttctcttccatttagatccttatttgtatttgtcttgatttgtagtagttctttatgccttctgtatactaatccttagttaaaatgtgttttcaatatcatcttcctctctatggcttatcttttaacttggttgaatacatcttttgttgtactaaatcttttttattgtaataaagtcctaattatcaatcttttcctttaattttttatgacttgtgctttttatctttgccttgttttaaaattgtttctatccccaaagtcatgaaaatgttcttctaatcctcagtattttctaaaagaaagtttttctaaaatcacgcttttcacttttcagcctttattccattgggattctattttttggtatagttttagatagaaagctatttttaaatttgtttatttcctatacagaaataccatgcacttaataattcactctttcctcccgataatatctatatctgtacttccttactatatgtgtgagtacatctatggacttcattctattccttgatctgttttggcatctctgtgctactattacactgtcttcattactatagatttagagtaagcctggctatttcttaggagaaattttccccttttgctcttatttaaaagtgacctattcttgatcctctgctttttttgtgtgttttttttttttgtttgtttgtttttttgagatggagtctcgctctgtgtcacccaggctggagtgcagtggcgcaatctgggctcactgcaagctccgcctcctgggttcacgccattgtcctgcttcagcctcccgagtagctgggactacaggcgcccgccactacgcccggctaattttttgtattttttttttagtagagacggggtttcaccgcgttagccaggatggtctcgatctcctgacctcgtgctctgcctgcctcggcctcccaaagtgcgatcctttgcttttggaatcagcgttttatgctccacaaacatacctgtcaggattttgagtggggttgcagtgaacttatagaataattttttttttttgagatggagtctcgctctgttgcccaggctggagtgcagtggtgcgatctcgggtcgctgcaaactccgcctcctgggttcacgccattctcctgcctcagcctcctgagtagctgggactacaggcgcccgccaccatgcctggctaatgtttttgtatttttagtagagatggggtttcaccatgttagccaggatggtctcgatctcctgacctcgtgatccacctgcctcggtctcccaaagtgctgggattagaggtgtgagccacggcgcctggccagaataatttcatgatagtcaatgtatttactatattaagtctttcatttgtgtatatggtatatctcttcatacatttagattttcctttgtaccccaagatgtttttgcatacctttaaaaattttatttcaaggtccctcatagtttttgtggcattttttaaaggtaaaatgtaaggtaatcccagtgctttgggaggccaaggcaggaggatcacttggggccaggagtttgagcaacatagcgagaccccatctctaccaaaaaaaaaaaaaaaaagccagacatggtggtgcctgcctgtagttccagctacttgggaaacagaggtgggaggattgcttgagctgaggattttgaggttacagtgaactatgaattgcactccagcctgggtgacagaatgacactctgtttctaaaaaataaaaaagtaaagcaattagggttaaatctaattccatgcaatgccatggttcccttccatagacctgtgacttctgaaagtccagctggatggacaaacttgttcagattagcatagaaactgtgaagggaagctgattctgagttatcacataccagcctggtcataagagctgtatatggtaactctgtgactatgtcccagaacctgctgagtagcaaacgtatgggatgcatcatgggctacatcctttgaatagaatttcatctcttcctggaagagaacagaatccatcatcactgagggaaaactcagtttctaagctgagttttagctgcttgcttgtgctatattttccaactagtagtattttcatgaaagatattgatttcattgtcatattgatgcagaatgagaagtcaaatcagttcttctactaattcaagaataaaatctgtttgccaatggaagacaaagctagtgggtaacataccacaattaattttgcttgcctgatattttctccaagagcagggagcccatgagtcctgggagtcacatgttgaatgttaaaacttccaaacagtgatagagttcacaatttagctaagaagggacctcatcaaagtccacaggagtcctgaagatgggatcctgtttttagatatttatgcagaatacaagaaaagaggaaatagagtttgagttagatattggaatatccttccgttgaaggtggttgtggccgggcatggaggctcattcctgatcccagcacttcgagaggccgaggtgggagggtcgcttgagcctagcagtttgagaccagcctaggaaacatgatgaggccctgtttctattaaactaaattttaaaaattagcctggccggtgatacgcacctttagtcccagttactcaggaggctgaggtgagaggattgcttgagcctagtagatcaaggctgcagtgagccatgattgcgccactgcactccagcctgggcgacagagtgagaccttgtctcaaaaaagaataaaaataaaaaataaaggatcgattttatccattcaccaaatacttattagactgagtgctaagcttgtaatagaaggatggttaagtcatgattttcacacccggtaagtgatttggtcccatgcaggtgaattaaggttatatgcagatgagtctgctgtgtagcaattgtactctgtgttggctagtgatgacgtgtaacagtttctgccctcaaggcactctgccttcattgaggatagtcaacaaggtaacacctgtcatgatcccatgtggaaaacgttacggataaaacaggtggaagacccacagtgccactcagtggaggtaaaatgcccgggaggagccttggagggtgaactaaagtgaaatgagatatttttacttaaaccaaccttcaccatatcataacataagaaaataaaaaagaaaataaaaatccttaatatgttaaaatgcagatttcttctataagaaaaatatgacttgatgtgcaccattacaaagaccaagtttacattcaagatgcaaattcttggttgaaagaaagaaaaaaggccagtttttattatcttagagcgatacagctaaagtaacccaggaaagatttaattggagctcttctgttcaaacattacttccatgtttggagatgttattcatgataatgaaatttccttggtcaattcaagattacctagtttccctaagacatttaatggaaaacttctcctggcagattttacatagctgctcaccctgcgaagaaggggccagcacttgggctgtagcaagagcttgatttattccggaaagcagtttgttcagctgtcaaatgagattatatgtgtggctgttagccatcacttcacagaaatattcttattcctcaacaaggcctcaaacttttgtttatttaagggcaacaaaaatcacaaatgtagattctcctaaaacatctctttggaaatgtgatttttcacagggtgctgccattccctgtctgctgatgatggctacaaccaaactggactgccagacattttctacatgtcacctgctgtccctgggcagcagtatcccccactagccagcacacttaggtatgcttaggttttttttttttttctgagacggagtttcactcttgttgtccaagctggagtgcaatggcgtgatctcagcttattgcaacctctgcgtcctgggttcaagctattctcctgcctcagcctcccaagtagctaagattacaggtgcgtaccaccacaccaggctaatttcttgtatttttagtagaaatgggtttcactgtgttagccaggctggtctcaaactcctgacctcaggtgctttgcccgcctcgacctcccaaagtgctgggattacaggcgtgagccaccgcacccggccaggtacacttaggtttgtgtaatcctgaaaggcctcaggcataaaaatccctttttaaaattaacttcttttgtcatatgtttctgtcttgggggtggtctctcaatgtagaaactctagaatttaaaattgaagtctaaatttggatgtgaaagtgaagtttattttttatcttattttagcatttagggatttgagtaaaagtggtggtatttctactctgtgattcaattgcagtttcctcagcccaacatgacaagtgacatagcattaaaaagaaaaactcatatgtgaagtagctgtgacgtagagtgggctgttgattcaaaaggtcgacctggttggaggcttgaaggcgttgggctttccgcctggcagtctctccctcgtgtacctacaggtaatgtttggaaagtcaaggactggggagaaattgagacttcagattccttaagaagcaaaggcgaggttctttttgtctcaagaagagtttgtcagttagactcatggttctcaactagggtagattctgtccccctcaagggacagttggcaatgtctggagaccttgttggttgttacagattcgggggatggggaggtgctcctggcatctagtgggtggaggccagggttgctgctaaccgtcctatagtgcacaggacagcctctcctcaacaaagagttatcaggccccaaatgtcaagagtgctgaggttaagaaacaataaggcagactgagttttgaagtgaggtagaaagcgggactctactccagagacaggctcagatgctggaccaaattgaggactaggtaaaacagggccagggtggaagcagctttctgtaagacatgcccactagtgtgccatgtcagcttaccattgccatggcaacacctgggcattacctcccctttacatggcaatgacctgatgacctaaaaggtactaccccttccctagaaatttctgcatgtaataccccttaacctccatattattaaaagtgggtataggccgggcacggtggctcacgcctgtagtcccagcactttgggaggccgaggcaggtggatcacgaggtcaggagtttgagaccagcgtgaccaacatggcgaaaccccgtctctactaaaaatacaaaaactagctgggcatggtggcacacgcctgtaatcccagctacttaggaggctgaggcaggagaattgctgcttgaactcgcgaggcggaggttgcagtgagctgagattgcgccacggcactccagcctgggtgacagagtaagactctgtctaaaaaaaaaaaaagggggggggttataaatgtggttgcaaaactgctctgagctgctactctctggccatggggtagccttgctctacaggagcagtcacagagctgtaacatctcctcttcaataaagctgttttttcctctacctctggctagcccttgaaatcttccctgggcaaagccaagaacccctgtgggctaagccccactcttctactaaagtagtgtaagaccatcattgcaaacctttaaaacatataacctgtaggaaggtttgggatttgggctggaatagggcaaaaaattctagacagcaaataaagagacccaggtatagataggagttgcccagttcaggaggtactttctgaagggcatctttcaggacaaatcttttcctgatgcagacagacgtagtactggttttcattcattactattgctgatgtgggcctacttgtgtaagtcagttgatattcattaaactcttacaaggcattctttatgataatgaaacataaatgatgatagcatatatgatataaaactgaattgtaattagctttggaaaatagtacttggaagtttctatttaagcctctttctagcaaactctcaaatattcatgtaacaaaagaagacagcataaaacattgaagtgaactgtttttttcatttacccattaatttcttttttttttttttgaggcggaatctcactctatcgcccaggctggagtatagtggcgcgatctcggctcactgcaagctctgcctccggggttcacaccattctcctgcctcagcctcccgagtagctgggactgcaggcgcccgccaccacacccggctaattttttgtatttttagtagagacggagtttcaccgtgttagccaggatggtctctatctcctgaccttgtgatctgccctcctcagcctcccaaagtgctgggattacaggcgtgagccactgcacccggccttacccattaatttcaagcaataggtttaatctttttattttcttctaagagctgctaatgaatagtacaatggctggtttacgtatcgtgtttccctggctttcccaatccttggtgaagatgttaggttcagattatgaaatagacaatatttgaccctttgtggtatacaaatatagcattttcctgtggttctaatagaagaaggtagtgatctaaatacaaccccaccacccctaccagggccgtttccagcctgatactgaagtaggacaaataaattgcctatttttctttctttttttttctttctttctttcttttttttttttttttttttttgagacagagtcttactctgttgcctaggctggagtgcagtggcccagtcttggctcactgcaacctccgcctcctgagttcaagtgattctcctgcctcagcctcccgagtagctagctgggattataggtgcgtgccaccacgcctggctagttttgtatttttagtagagatggggtttcaccatgttggccgggctggtctcgaactcctgaactcaagtggtccacctgcctaggcctcccaaagtgctgggattacaggcttgagcacctgcgcctggcctctttttcttctgaaactttgcagatgtagctatagtctcattctgaccagtcttcaaaggactctggctttagacctggggtttctctccaaaatacttaagagccagaggatgctgtccttcaacagctcctttggagaagcaaagactcatcccccagtttctctcctctgtaagtattgatttctgtgtgttctcttttctgcaggcgtatggtattcctgtttgggtaattgttaaggatgacatgggagaaattctcggttatgttcagtctgtcatttaatttatatttcataaatgcttctcagtaactaaatataggtgtataaaattgattgtaatagatatttgcaggaaagttttcacccatatatttagttgaagtcagtaaaaatgtcattttcagataattattcaatgtcaggtgcttatgtttatacagtttacttattcctaaatatatttggatctctatcttactataaattttcagttggtgcatctttaacatctttgtgagaaaaattcaatataatctcacatactacaggttgtttgaaagtcttattttttcattgtttatgtaaaactgttaaacattcatgaacattatttaaaataaagatgttggtctttgaggatgaaattaagaatgtagaaatgcataccttggtttcccagaattgagttcatcctaatatgaaacagcaagaaatcagaaccctgtttattatagtattatctttgtatttgaaagcaggtgtgtgttcttgaaaatattaaacagaagtcatagagctacatattggccagtcaggaaactctcttcttcttaccttccatcccacctccagactgtttgcctaatcccgctttgtgatgtctgttgtgctggtataacgatatttgaactctctgatgaaaactttggccgcaattgacccttccctaaagttgaagagatttctccaaataaggaaatgaagggagttaagagggtaagtcatacagtttggatgtgtatccccgcccaaatctcatatggaaatgtaatccccagcattggcaatgctgcctggtggaaggattgtgggagtggatttgtcatgaatggtttagcaccatctgccttggtactgtcctcctgatagttctcatgagctctgatcttttaaaagtgtttggcacctccctgctctctctcttggtcttgctctggccatgttaggtgcctgcttcccctttgtcttctgccgtgattgtaagtttcccgaggcctccccagaagccaagcagatgccagcatcatgctttctgtacagcctgcagaaccatgagccagttaaactttttaaaataaattacccaatctcgggtgttttctttacagcagtgtgagaatgggctaatacaataagtgagaaagaaaggaaaatttgcccaactatatatcatctttcccaggtaattgggagttttctgtgctttcattcccatgaggaaatgtctctatacatgctacagaaaagatctactcttttgtgattgtcatagtcagctacagtgatgcctctggaaaaataagactgccacagctgaagcccaagctcttaatgaccaaggtagttatttgctgtgatgttgctgcttttgttgataccatcaaaggcattatttgaggcatagcttgctttcctagccagcttcccaactgtcgttgtgcacgttcattgcccaagtgcaattgcaagtgcaggggctacagtgatgaataagacagtccttgtccttgaggaagagcccacagtctggtgggcggaaaaattataagggttataagcaaaacaatagcaatttttattgtgttcaaaaacgcactttcttctggtgacaggatagtcctaatactggtctacatttctaccacatatgaatatgtaacatgcatttctcttttcttttacatagtagctggctatcttaatgactgtattaacaattttcagattttagttatatctaaatgtcgctacttttgcaagtgaacatcctgctgaaacgtattcagttgggaagaatctggcctttttgaaagggcattttctgaatgtagcaaattaccactgatagtttaatgcaattaggaaaatggaagtgaatggcaacgaaactgattaaaaccatgagttgtgtcacagaataaaccataaatgatatgagtaactataatgccataataagacactgtcattacttggtacttccttcttcagaagcctggtaacagcatcacaggagcctgaaaatggattaagtcattgtttgaatgtggacatattctagtctcacatattttagtctcagatacgatgcttcatttaattatgtctataaatttattacctacagacattatctttagggtcaaggagacaaggtatatgttattgttcccatggtaactttgtacttaaaatggcaggctgcgcttacttgatttaaaaatatctacagtttgattgctgtaaaaacctgtgttcataatttgctcacgtccagtgactcactcctcatttaactggcatttcagcaaatggcttgatcacataaattgtttggagaactaacagaaggttattgctctagggcactaaagatattttagatttctatcatttaagattttgagttttaaaaaatagtttacatgtgtttttgccaagttaagagtgaaacaaccttagtggaatgtttcttttctttttgagacaggatctcaccctgttgcccaggctggagtgcagtagcagtgattatggctcattgcaacctcggcctcctgggctcaagcgattcccccacctcagcctcccaagtagctggaaccacagttgtgcaccaccacatctggctaatttttgtgttttttgtagagatggggttttgccatgttgtccaggctgatctcgaactcctgagctcaagctgtctgcctgcctcagcctcctaaagtgctgggattacaggcatgagccactggacctggcctcatgtttgttgataattcatgggcacagtgatgaattgtactttggtgtgatatggggcatattaagctagcagaagttataaggcagatgtgcctactggcttttcacttgaatttataacagtggacttgaaagtttcgatctatttgtatctctcctctgctgtcacagaagtcccattttagccaacctgctgccttattttttaagatggagcctccttacacacacacacacacacacacacacacacacacacacacattaataaactaatacatgttcttttcaaacaaacttaaacagtgcagacatgctgcattagtttccatccaatagcttggcgtgggtgcctgggaacagctctacctcaggaggaaggtgctgggctttgtggctgcccttaaccactgagagtctttatacgtgactattttgcagatgactggggtttccaacgcacttcaaatttgagacaagcagggaataacaatttatgtagatatatctgagcctgaattgcattgtgtatccccattggtgactccaaagtctcctactttggagacgtgagcaatgacaattctgtgttggttttttctttctgtttagatatccattccaaaaacttggggacagtgtaggaagagaactgcttccactgtgagcttctcttttatccatctctgcctttatggcactctttcattggcagagtgtgtgtgtatttctgtgttggcatctttttttgatggctcagacaacctcccttggtctctgagaaaataaaattatagctctagcctcatgaggcaggcccagagactgctgcctcaggcgcccttcctgctgtatacctcctgaggttggatagagcagctgaaaatccggccgagcctttcagagcctcttaggggatatttaagtggcagatgcacttaattattagatatgttccaaatgcaggagaatgagctttgagagagttttgaatttgggacaaaaggatgcttcttatgaatcaacttgattttcacagaaatcagaatgtgtatatcagtcaagaaatgaagggatatatacacacacatatacgtaatacatatatacatgtacatacatacctattataaaatggcagatatgcaggcagacatgcatatacaagtatgtggtgtgtatataacaaccattgtacacatatatacatattatatgcacatatacatgatacatatatacgcgcaaaaaaatttactgagtccttactatgtgtaagtcctgtttcacctgaatcaactaatgtaatcctcattgtatcacagatgtgacaaccgaggtcacatggctagggagtggcaaggccagtatttaagcccaagaattctggctccagctgtgtttctcacctcctcctgatggagggggtgcagtcagtgtcatttaaaggcatgattgatttggtttgttgggtgttggtgttcataaccacaaagggacctgctgagagagagagagaatggagaatgccatttttcctacctgttttcatcagccagtacaggagagagaataggggaacttgtggctcattttaaaatggtaccaatgatggcacaggcacaccttttttttttttttttttttttacacattttttagagacggggtatggctctgttggccaggctggagtacagtggtacagtcacagctctctgcagcctcagatcctgagctcaagtgatcctgccacttcagcctcccaagtagctggaactacaggggcacaccaccacgcccagctaatttttgtatttctggtagagatggggtcccactatgttgcccaggctggtcttgaactcctgggcttaactgatcctcctgtcttggcctcccaaagtgctgggattaccggaatgagccaccgtgcccagctgtggcacacttttgttggtgggttagatctggggaaagtagtcacaatcaattgggccagatctgatgagtaaggtggatgacaccccagaggtctgtcattttaggattcagtaaaaataatgtaaattgttgatcctctctggaggcacttccaaaggaagagtgggagcatctttggctgccaggtggcttgaaagaacagtttgctgtatggatgcttttgtaattattaataaaacacacctaatttcattacttcattatactctgttagctacaatatagatttgtttgctctaatagaaccccccaaaatgttattcagcatgccagaagtttccatacctctgatgtggaagtccaagctggcacagggacactcctccccaaaggggtcagagacctaggctctgtcttattctatcatactcaacacgtggcttccatttcatgatctaagacagctgctgcagttcctgcaatcaccttcacatccctgctcataggaagaagaaaagggagttcaggcccttctctttaaaggccattctgtggacgttgcatctgtcacttttcacatcccagtagccggaacttggtcatagaatcacacctagcttcaaaagactctggaaaatgtaatctttagctgggcagccagctaaaaatattattaccatagaagatgggggagtagatattggaaaacagtgaagagcatctgccatacttatgtataaaaaaagtaaaactagtaaaaacatatcacatgaaccttcagattttttaaaaatctcagatgttagaataatttgatttttctttcagaataatgatacactggcaattaatgttccacattaacattgcaaatgtaaaactttgaaagacccatgtagcttatggtataactattaagaaatccatgatgaggcagggtacagtggctcacatctgtgatttcagcactttgggaggccgaagtgggcagatctcttgagcccaggagttcgggaccagcctgggcaacatggcgaaaccccatctctataaaaaataaaaaaattagccaggcatgttggcacatgcctgtggtcccagctactcgggaggctgagatgggaggattgcttgagcctgggaggttgaggctgtggagagccgtgttcatgccactgcactccaacctgggcaacagaatgagaccctgtctcgaaaaattcatgatggagaaaagggagagtttttcacatagttgagagtatgaaagcatgttgagtataaattttgttattttgtgaaatgctccaaaattaagaccgaacaagacagaacaagaagatacccaactgtttatggttagcatttgaagttggttcaccctctgcttttgattcatgttttgaccagtgtaaattgagaaaggatatatttcataatatgagattatgctagtttgaagttacattgaacactgaggcctaaccctacctcaaggtcaggtgcagtgtagtgatctaaaaagaatggaggctgggcatggtggcttacgcctgcagtcccagcactttgggaggctgaggtgggcagattgcttgagcccaggagttcgaccagcctgggcaagatggtgacatcctgcctctacaaaaaaaaaaatacgaaaattagccaggcatggtggtgcatgcctgtggtcccagctgctcaggaggctaaagtgggaggatcacttgagcccaggaggtcgaggctgcagtgaaccaaggttgtgacactgcactgcagcctgggcaacaaagtgagatcctgtctcagatagatagatagacagacagacagacagggaagactgggacgtgctataattgtcttgaactgtttattcaaggtaatatctaatatcttcctatgttctaattataagcatatggctctcagctacacaaacttttgattacaaatatttaatacttttcatctaaataaaaggtaactaaagtatatgctgtattttcctcacactgacataagatggattcagtgattttgcagatgtcaagtggagttttcttcaggccaagatacggaaacaaaataaacaaactggaaatttgtaattttcttcctatagtaaccatatggggagtcatttttaaatagccaagattgtatcaagtgcagaaggcgatgattatcctagtggcacttgtaaaatgaagtgacagtttcttacaatgttccaaccttccactgaggaaaagtaggaattcctgccctccctaagctaagtgccccaactatttctttcattgcctgagcagttctctcttttgccttcacattattggctctctatttagattaacattttaattttttttttcaaatttgaaaaaatactgacctttttccagttgtatctatcaaaaggattgcttcaaaagcatcttgttccctagtcttttaccaaattattctaggcacaaacctcatattaacatcaaaatcataaagaacaaaagtaatggaggaggtcagatgatttggggtgttaaagcaagtttctgcagttgggttttagatgctattaaagcattctgtgtatgaagtgctttaaacagtaacaacaatttcatcttttattggttcagcatctcttggctgtctgaactatagagattttgcagcagtggaatatacatccgtagagaaactacacaaaaattgtactttctttagcagtgtttttggaattgaattttagaaatagaagttaatattttggattttattcttggattcactatagattaagcctattcactatagatttggtaagtttgttcacctttgtcttggcctcagttttctgttctatgaaaagaaaatagtggtaggacaaaggaaataacgccctatgtggttggagcctggggaagggcgtctggtggtaataatgtcttaaatgtcacaaatttgtgacagtatttcaggtcagccaggagattggttattggtgagtggagttcacatttgccttaccttgaaatgttttccaacactttggtagcaaactacatcctcagtgtgaagggaaatgtgtaacagtttttctttgggaaatatttttattgacttagctccattttgtgagtcacatattccagcttatagcagagcctgctgcagttagtttgccaggcaaatacccaataagatcacagagctcaagcttgtattatgtaaacctcttggtgtgttattttatttcaggagggcttgagacagactgatgagctgttacatgatcgtggaaacagagcctagttttagaagtaaatttagtttgaaaagtaattgtaaaggccaaaattgatagacctttcatggtctgtgtagctgcctttccaatatgatggtcactagctgtttaaattgaaattagttacaattaagttaaactcagttctttaaccgcagtaactacatttaaaatcttcagtggtggcatgtggcttgagactactatgttggacgacaaaatacagtatatttccatcatcaccaaaatttccttgctggacagcatttgtctgtagccacctaagaaagaattatggtatagcaaggaggaggtttgagatggaagttaagagatgactctattctaatttgggcccttaaaagttctgtgaccatatatctgaaccactctaggcctcagtgcacacatcagtactgcagtgacttctgtatacttttgtatatttatattgcaatgctaacatgaagatcggatatactagtatcattttatggtttagagagtggactttggagtcagactgccagatttaaaataccagttacttctaaattaatgtctgggccttgattttctgatctgaaaaactggagcaataaaatacctcctttgcatgattgagtgttaaatagtttcatacatgtgaagtgcatagaacaattcctggcccatggaaaatagtgttttaactattatgtatatcatccattgaagagtataaggtgctatcaaaagcttttgttacaaatgctgttttcagtttgccgttactttctgggtctttgaacctccttgtaacatgttatataggaatgtaaatgtgccacatggtagcttcttaatgcttagttgtcctgcataaattaatcccctttagaaagtaaattacttacaatttagaatggcatactcatggtctgttctttaatccacctgtataattggttcttctccaaagatattaacaagcttgacgtcgatgctgagaaattctagagcagaagagcagactctcccttcactgttatttgtgttcctctctctccaattccttagattgtaggacgaagtaaatcacaagggccagtgtcttgtttagaaaggttttgtcataccgcacaggcggcctgcatccgttttcagtggggtggtttaacttgatgaggctaatgccaagatacagtactcagagtccaccgtgtttgacatagtcatcaacggtcttccttttggacttctttttggatgaggggaaatgtgcattcgcccagtggctctcaccctgactgtacagtggagtcacctagagagctttaaaaatgccgatgcctggccccactcacagaggttctgatgtaattgtgcagggtgctgactgggcttggggatttttaaaagcttcccaaatgattctgatgtgcagccagggttgagaagtgctaggatggcctgcactgagtgatatggaaaggatactttttgaaatatggcccaaacattgccggttaagggggagccacaccaccctccagggtggaggtagctggtggcttttctccgggtcttgtccagttccacagttttatcagtaataggaatcagtgcaaagtatactgatcagacccatggataacgcggttcacctgaaaggggagactagctgttaggttacaggtgccaaaggccttattgacgggtaggagggaaagatgagtgaatctaaggggaaggcaaaccttttagttactttaaataaaaccaactgagcaggtataggatacagaaagcttagctcaacagctgcatggaagttttggttgactgacagctgcagtagttaagagtgtatacttagaaaccagtcctgtgtttgaatctggctttactgtttcctcctgggggatctggagcatgttccttaacctttctgagcttcggcctcctcttctatttagtgggaataagaaaaggcacccacttaatttcattattatgataattaaatgagatgatttatgaaaactgtgactataatacctggcccatagtcagtaccatgattataaataataagggcatgattagcatcatgttgatcttcgtcatcatccttgtaataagcctgtctgaagagcctgtggcatcagcaacgacataaattgaaatatctggcatggagcatcttcattgttcaaatataccatactaatgtaagatattaacaatatggctgagcacggtggctcacacctgtaatcccagcactttgggaggcctaggtgggcaggcggattacttgaggacaggagtttgagaccagccttgccaacatggtgaagccctctctctactaaaaatacaaaaattagctgggtatggtggtgcacacctgtaatcccagctactcaggaggcagaggcacaagaatcacttgaacctgggagatggaggttgtagtgagttaagatcatgccactgcactccagcctgggcaacagagtgagactgtctccaaaaaaaaaaaaaaaaaaaaaaggatatgaacaatagggcagattagatgtgaggtatgttatgaacaatagggcagactgggtgtgaggtatgtgggaaccctctgtaccatctttgcaataattctgtaaatctaaaaatgctttaaaggttaaaaatgttattgccaatgtagtacttggcttaagtgggaatataatatttttttgttcattttccaacaaatatttgtgtgctagctttgtgttcagtaaatctgaagtttagccctcacatgaagaacgaaaatgtttttgtgttaagtatttctgaggcagacgtttctaagatatgtatctccatatgcatgctgaaccaaatttgatccatttaaaatttctttattttgaaataattttggatacagaaaagttataaaaatagtacaaagtttctgttaaaccgttcaccaagcttcccctaaccttaacaacttacataatcttagtacaactgtcaaaactgggaaattgacactgataaaatgccagtaactatagcatttacttggatttccccagtttttctctttgctgtggcaggatccaattcaggatctcacatggcattgagttgtcccatctccttagtttcctccaacttgtgatagttcctaagtttttccttgtctttcgactttgactcttgaagagtacgagtcaggtattttgtagcatgtccctcaatttggatttgtctgacattttctcatgagtacattaaggttgtacatttgaggcaaaaatgccacagatgggatgttgtaccctttgcagtgtgtcatataagggggcacatgatgccaatatatctcactgctggtgatattaatcctgatcatttggttaaggggggcatctgcaggttttgatcaattttttttaagacaatgttttcagaatagtttcaggttcacagcaaaattaaaagcaaggtacagagatttcctatatactcactgccctcacacatgcattgcctcccccaagttttaatgtattttttataagtatctttgataatagataccactcatgtgccatatcacaatataagagtgagatgggaggaattatgccaacacattaagtggtttcaaatagctgtgcttttgactttttacatgtaatttccataattttctctctttaatctcatttgtgctctcagtaatgacttctccctattttcagagttgtgccaccagtagcaattgataaagcggagaagctgttataattgtgtgtaaagtaaaagtgaataggctataaatcaagacttgagagagtcctctggaaataaaatacattaataggtgttatttgaagcatttttttctgccaattttaagaacgaagtgcaatcttcaatagtccattttaacattaaacaaacctggatttgaatctataagtttgtttttgtttttttagagacagagtttcgctcttgttgcccaggctggagtacaatggtgtgatctcggctcactgcaacctccgcctcccgggttcaagtgattctcctgcctcactgggattacaggcatgcaccactacacttggctaattttgtatttttagtagagacggggtttcaccatgttggtcaggctggtctcgaactcctgacctcaagtgatccacccacctcggcctcccaaagtgctgggattacaggcgtgagccactgtgcccagccgaatttaactataactttaaatggttaagagtaatttgtaaagtcagacgaacctgggtttaaatcctggtattacccctcactagcaaattatttagcttttccaagccacagtctctacaaccaaaaaaccatctcttgggttgtcataaagagtaaatgaaaagatgtagggaatgtgctaggcactgtgtcagtacatgggaagtacccaatcaatgtcagttgctgtctttgatattatcccccatagggcttttgtggtcgcttaagagttgacagagcacaaaaggataaataattagctttacaccctaattaatctgtaattgtgctgtaggactaccaggagacacagaaacagaaaaagcatagagactattttgtatatttattccatcatatttatgtgtagttgagatcattctaaagttagtggtcttgcttttatgaccatcattcctgaatcaatctggagatgaccggagaacacaagagcattttgccccataactaccacataatttactagtaaaagagggatctgttgagattagcttatgaaaattgtcctttggagtcaagtttgggaatatctgatcattaaaaagagtttatgaacttgggtgatttttccttcccaataattctttgaagtactagatatttctaatgaatttgagcctaaaatatgaagatcatataggctagacatttcttttaaaacccataaaaatcctatatttgctctatgtctagaaaggtaaggtctagttaggttgtggtttgaaagatatgagttacaacatgagtgatatagagtacatccattgagtttaaaatttcatctaatcacaattatttcaaactgataatcttttaacagcctagctctatgggtagccgttaaagaaaaaatgtatcaaatctccaatacttagtgaccagtagagtcaaattcagctatcctccccacccccttcccccaatagggacatggtgtcctagaaacagccagacctatactggattccattttagtgctgagcctccaaaatgggtctttagaattaaatttggctattagcccagacttactcaaatttgtaacaagcagtgctttgtatttcagcatgctccctagcccccaactttgtaactggttaggggaggggaagtgggaggaggtgcatgaacaaaaaacaaaagcagctgctggagagaaaacccagtgaaagggggtgaagaaaaacaattcggccacaacagctgttcagattctcaaaagaagaagccttcactttacatttgatctctctaaagtttttgaaggtttcgagatgttctttatttggggagaaatgaaatgaagtctatgaagctggtggattaatgtataaatgaaattgatttaggagaccagtgactcttgaattaacacagcccttgcctctttttacaattctgaactattgtttaatattcagcatcaagatggattcagagggtttttttttttaatcccattgtgtcacgaatggaggatataactggctcagaccaaatcttctcacatccaagatcaaataggggtttttaagcttatggcagtagaataacaagtacatgtggtacaaggctaggaaactgggaaggcaggcagcagtagaaccttgatctatcttgtgggaagctcttatgatagctaattacacatattgctggtctaaaaaatcagaattacccaggcaacatggaagaggcagaatggttggctggactagaaaactccttcttggaggcggtcatcttcatgttgtactagaaaactccttcttggaggcggtcatcttcatgttgtacagatggcctacgtatgtgcaatatttacatcattgcgtttcttagcaccacgggcgagtttggcattttacaaggtagctcactctgaaaggtaattttatcatagtatttaggaaatattccacgtcagccactgagtttaagaaactgtgtgaagaactaaaattcttcatagagccacatttgagtatggaatgatttggtatgctggaggccatagcacatctttgaacatcaaataattggattttttgagcatcaaataattgaatttttcttttcttttcttttcttttttttttttttttgagacagggcctcactctgctgcccagtctgaagtgcagtagcatgatcacagctcacggcagtcttgacctcctgggctcaaacgatcctcttaccttagtctctcgagtagctgggactacaggcgtgcaccaccatgcctggctaattttttaattgtagagatgaggtctcgccatgttgcccaggctggtctcaaactcctgggctcaagcaatcctcctgccttggcctctcaaagtactgagattataggtgcgagccaccacatctggcgtgatttttcttgaaggcagatgtgggcctgaactggaggaagcctgctctgagcctcactctatcttgatcccagaaataaatttattgtatagccttaagttttagagagttcaggacacctagaggatggttgtggtgtaaactgcttgcctggtcaaaccttaaggatctgcttggactcttcaggacacataccccgagagtgtcaggcctgagccccagctggtcccagaggtttaattcctagcacacctagtttgtctaacgtaggggtctgcaaactgtgtctgcaaagagccagatagtgaatatctgttgcaagtaaacggtgttgtcgtagtacaaaagcagcactagatgatacggaagtgaatgggtgtggggctctgtgtcgatataatttgatttgtgctatagtttgctaacccctgatctggagagagggctcccaaacaagtgagtccacatgcctccaacaggactgtgggggatagaactcaggagggattgggataggaaaaaaaatctatctgtattgtcactaacctctaactgaaacagcgtttgttctcttacgaatacaggcagcaaaccagtgacttagcaatacttgtgactttggtcattaatagaaatcaaaggtaatttcatatcccattacagttattgcaggtatctcaaaatatcattaaactcatcactactttggaagtgtatgttatacctccactagcattaacagaacatatgtattctacatttatataaaattaaatgattacatatatttattatatattatgtatttcaaacttgttttttattttgatgtatttcaatttagttttctttctaatgctatgtatattttttcgtgcatttaagaacattgttctgtaaaggagatctggagggttcagctgactgcccagggagtctaagaagccctgtctaactggtgtcttcataatggggagaacctccccttcctcaaatgatcctatccctctcctcccagccactgaggggcagtcatctctagctctacggagatgcccccaccccattttcccatatcatattccacccagccttcaaagccctgcatgagtccacctagtcctttgttcctctggctccaccaccctggctgccagacacaggcattcacccccggcccgtctcatggggtgttctatttgtttagtttatgtttcagccctagtgagagtcagttctggaatccaatggatctgtgattccttgttggaaggaaccacttctcttgcgctgagtaacgcattggtgttggatgacggtgttcatgatgacgaacttatgctgtcctgaccatgcctggagactggccctgcattggagaagatccaagagtctgcgtggtaaaatgataatgaacgtgagcttaggggcagaatgctgatgtgtttattctgctaactatgtgctttgggcaagtgcctatacttattctccctgagcttcaatttcctcattggtaaattggggattatacttacctttcaggatgacatcaagagtaaataatatactgactctaagaaaagtgcctggagtggtgcctggtgcatggcaaatgctcagtacctgtgaggtagtatttgcctgggctggttgatggttgggcgctgggggttagcctggtataaatcgagattttgaggtggtcctgtgaacccaaagatgccttgagaccctgcgtgggagacagatggaaggagatgtctaagcctggtgtcaaggtgctctcaccttgcagaatcacagtgggctgtggtggaccaggagaagaccccttaacaaagtatgggagtgagtctgtctaagtcagctagcccttaatgaggtcctcctcgagtgaagctctgattctgacacccatgttaggttgtggtcatttctaggacccagggtccagccccagagattcctagatagttctaggaccatctggtggaatcaaactatggatagacccattaatatccaactgggtcctctttcgttgagtctcccgccctcttgagggagactgatctttagtaacttctttatgagactgggtcaggtgggcctcctgttgttgtctgtggtgctgcaggtcatgtgctttggtgggcaccagtaactgtcattggaattgccaaggtggtgggaataaagagagatgggcttctctgtgattgaattgaagtttggttgtgagtgtgggtcatgagccctgaccgggtaggagacagaagcctgtggttcttctcctggtttccttagggattttcagctggctcttgggcagctccttcaggtggtagctgttgtggcagaatagaagagtgctggactgaggagcagagacctgggtctcatgagatcatgagatcaaaccacttaaactctgtgtgcttaagtgacttcgttggcaatagagtaataccctccctgaagaataaatgaggcgatgttgagaaagcattttatgagcaagccattttcattaatgcaatgggggaaacatgctatgtctagcttagagggctgaaacggtcaaatgaaataatcaacgtaaatgctaaaaaaaaaaaatccagtccacatttatggaattgcctttattgacaaattgagcgagggtaaacattcgtgtatttaaggcatggagtgtttcccagttgcttttgaaggtacccattgtcacaaaggagtaaagaccttactaaatgggatcttatttgtatttctgtagcaaaggatttttgttaaagaagattcaaactcagagatggtagactgagtctgccaggaaaaccacacacttatactcctgttccatagtcaactaatattctgcttctgctacaaacttaatgatcatataggaattatgaatttagaccaacaaatgccaaaacttgaactatacaagtgtatagttttagtgtaactttgtgttgtcactttttgcttctatgtgacacttagcaattctttttttaaaataaaacaacattagaggtcatttaattgtaatgacaaataaaatcagcaggtagacttaggatttcaaagcatctctttcttggttgggaaagctccctggaggtccaacttgtagtcctaggttgagtagggatcaataggagaatttactgaaggggccctatgctcagtttcaccaagttcacagccaggttcttatgatctgcatccttcaggtacaagtgtgtgttctctactccagtagcagacttgaacccagagtccccagtacaaggaagcacatatttttggattttgccgtgtgaccttgtctggctggctggactttaggaacaactggtcctcatccctggcaggtttagggggagagtgaaaccaagtcagatgactctgaagctccttcaaacaccacgacagaaggaatggattgagcaagaataatttttatagacttggaagtttgagtcctttttttttaaaaaaaaaaacaaggaagtggggcattccagatggtaacacaagaaaccagggagatgagagcagatgaaaccttgagggagaaaatgaaattctctctgaattaggagaagcggctgctttccctcacatcttcctgtgtctgtaactagcttagtgtttgggatgcttattttctattttctctgcatttttttagctgcctcagtgaccacttgaccatttatgccgaggcagtagtggatgtttccaattcagtgctccttacctcttagaaagagaaggattatgctttcttcatgattgtgagtcagtctatgttcagatttacattcaactaatatttttcaaatattggcccagataatttcaagatatgctatctgatcctcaaaacaatcttataaatgaggctcagagaggcaaagggacattgcaagtcatacaggggtttgcatatagcctcctctctgtaagtctagaaccatctctgcagcttcctcctgcgttcaccatgttgtgtgacttttgtaaatacttgaactctatggaaactcaggaatgatgtgaaatgttattagttggaagccttgtcagagaaaaatgggctagagagttccgtttgcaggcttgagactatagttgatgggtctgattctgaattaaaacatcctttagaaaatagatcccgctttttttagagactatccaagatttaaaagttaagcagctttggaatatagcaggcagatagttctcctgtaatgcttgctttgaaaccatgaacaatgtgtgcataatcagaatcttggatttgcttaataccattttttcttgctgaaacattaggtgaatgcagaaaactgcgcccacctgaactacatgacgtcagaatacacaaaacacgcacgtggcacaacctcatatgtctacagctacctcagtttaccccgcgtgttaagagccacacctgtccatacctggtgttatgactgtccctccaatttcgggtaaccctccctccagcccttcccagtaactcaccaaccgcagcccttccgacacccaccccacagccaacttcaggcctttttctaggcgaagtgacacatttattgttgtgtttatgtatttcttaactatttaatgtgtgtaaaatggtgctactatttttattaggttgcaatctttttgtaaatgtcactgattaaatttttgagtgttgctttcctaaccccatttttcccataagccctgtgttttttattgtgcattttgcaaagagtgatgatttttaggaccacctatgaggcattaccgaacaagtgactgtgtgaagcttttggactaaaccttccatctaacttcactctattaaatgagttattttcaggataagacagtctcatctatttacaaatactttatcatataatgaagttctacttatgatttattcagaatccacacaagaaggcgtagatttgctcaaggaacaaaattaatgacattttaaaatcttacaactggagaggatgattaatgggaaaagagctaacatttcatgaaaactagctttatgccaggtcctgttggatgccttccaataatgactgcatttcattctcatgtcaacctgttcgggtggtagggaattttggcatggagagagtgaaagttgctcaatgtccgtacagctcctaagtgactgggctgcgagtcaccactgaggagcagcccatctggaggtatgatcacagcaacatgggctccagactgttcttggtccttgttgttcatcgtctttcccattccatacttgcgtgtttctgtcttctgacacaaatagactactagtgggttcctgtgggttgctgctgacaatccatccatttacccaggctacatttttgtatccatttttttcaaccttttaattttttatcaccccacaacctgggagactttttaagcattttttttcctaattgcctccctatgcaatcttttttttttttttttttttttttttgagacagagtctcgctctgtcatccaggctggagtggcaccatctcggctcactgcaacctctacctcttgggttcaagtgattctcctgtctcagcctcctgagtagctgggattacaggcgcccaccaccacgcatggctaatttttgtatttttagtagagatggggtttcaccatgttggtcaggctggtcttgaactcctgagctcaagtgatctgcccacctcagcctcccaaagagctgggattacaggcatgagccaccatgcccagcccctatgcagtcttaacaccccagatacactgcatatctgtctatgtgctgtgtgtatatttgtgctttatatgcattaaagagtaaagttgtttttgcccctcaagaagtcattttcatcctattggggtgatcttgcctgtgttgaaaaggcatgttctgtatcttcagttatttttaatatgtagatccgcttttaaaattagtatcatgctaccttagaagcatatacctgagtttgtgaagacaagcccccttgtctgggctgtgattcctagtatcttatgatgagcccgacaggatgacacagccaggtgactcacatagagctaagctctgtgagaaagcgaggcctcagaggtagcacatgatttcccttcttccagtttctctatataaagaaataaagagcacacatcaaaccaaacataaatggaaagaaatcaatggttgaatgacacatgattctggcttgtcagccctagttggcacctttcgctccaaatcatcatctttctaagatactaaattatagattccaaccaaggtgattagtgctgctcacactttaatgtgcattggcatcacccatgaatcttgttaaattgcagattctcattcaagtaggcctgggattctgcatttctgacaaactcccaggtaatacagccactgcttggtcccagaaccatactttgagcagcagtagcctaagaatacacagaggcaattaaaactagctctcaaactattttaagaatttcagaaagccgaaagcagtggttctcactcagaagcgatttgttccccaggggccatttggcaatgtcttgcagacatttttggtcgttataactagaggatgctactgacatctagtgggtggaggccagggatgctgctaaatagtctacaattcacaggacagcccccatcagaaagaattatctggcccagaatatccattgtgctgaggttggaaacccttgcctaaaggaaatcacacacttactcccagtaaagcagcatggacaaatacagataccctctctccttggcaagagtgatattcaattcaatgtgatagccccaaatagtttgtagtggtcaagctctgcagttgacattaatagattactctaactgatatggggaagtaagttaattgtaatataaagaaatgcagttaagcagattaaaaggaaaacacttttggagtcatgagctgtcagaggagatttacatgtagcaaaggagaccctgctggttgaaggatgggaatgcctgtcccttattgggcaggaattgggtgggctgaccaggctgtgtacgcctggctggcactgtttattggagtggtgttcgagcgagcccatctggacatttttggaacaaacttgggacattcctttggccttctgaatatgacttgcagctgggtagggaagtagtgcaatattatccacagattgaagattctttcaaacaacagaaataatcaagaattcactgtggaggattttcccctccagagagtaacagatagattgatgcgtagatctaggtatgcttattaacaaaccattcctgtttcatgggatgtacatgtggcagcatctggattatttaatgtgttaatatagtcagtttgtatatgaataatttaaaacagtagcaagagataaaagtagctcatctgaagaagggttgtttgagagctttttttctgtcaagtataattttactctcaggttaaatgaaatttattaagatgcaatttgctcctgggaggtatttgtgagtttaaccacagtctgtcttggaagatattatgacagtaagtaaatgtcacctggataatactgatccattcacagaagggagaaaaagtgtgttgggtcaattaaggtggtttaaaaatgtgttgactctgaagaagaaaagtatctaaagtacacaactctaacaaatctcaaggccagtgggactttacagactgagcccaattgtgttgagtctgtgtattgtatatacttaacacaagcaaacacagactttttctacaaatgaaaacatgtctgctgagcagttgactcagtcatctggaataaatgttctttatttgtgtttccatgggtaaaatcaagttaatgaactgaaccatcacaatttctcttatttaatttttaaaactctagattaccctgtcttctatctctatgtaattcctgtgttagagcaaacataggaaattgtcaatatggcagagtgcggtggctcatgcctgtaatcccagcactttgggaggccgaggcaggtggatcacctgaggtcaggagttcgagaccagcctggctagcatggtgaaaccccgtctctactaaaaatacaaaaattagctgggtgtggtggcacacacctgtagtctcagctacttgggaggctgaggcaggaaaatcacttgaacctgggaggcagaggatgcagtgagccgagatcacaccactgtgcactccagcctgggcgacagagcaagactctgtctcaatttgaaaaaaaagagagaaattgtcaatatggggccatgttttacctacaaaactagcaatttcatgttgttctgtctaatattacttaggaacattttaattcttgcattaaaaagtagcttttataagcatgagggttaatatctaggcataatgtgttttctgaacagctggctctgtttttcgtctctgtgcaggatatgatttcacaccagtaacccttcaacttggggtgacacctttcataggagtcatggtagttctttctgttatttttctagccatatggaggtctcatttctcttaattcttaaaatgatggactacctgtcttctagctgtatattatttacttttttgttcataagcaccatacttaagatttttttcttttatttttaaggagaaaaaaaggctgcagtgagctatgattatgacactacactcacccaggatggagtgcagtgtcatgatcatagctcactgcagcctcgacctcctgggctcaagagatcctcctgcctcagcctcccaaatagctgggactacaagtgtatgccaccacacacggttaattaaaaaaaaaaaaaaaaagtttttctagcaacagtgtctcactatgttgcccaggctggttttgaactcctgggctcaagtggtcctcccatctgggcctcgcaaaatgttggcattacaggagtgagccaccatgcccagtcccatatttaagatttttctaaagccctaattttaagattttcaaaaatgctaattgtatcctactgtttctgccccaagaaccagacacctagatctcaagatatggacaggtatttattggaaagaaatgaggattttgaggtcatagaagtgtctaaaacatcaagatttattaaaatgattttttacagctgatgttctaacattcattattgtttcctatgatagagatacaaattgagtcacttttcaaacatactttactgttgaatacctataaaaatctcatggaactagcagtccttagtatacagtcaggaaaattctgttttacactagtcactttccagaaaggtttattaataactggctatataattctttccccagaatatgttgttctttgtggattttttcaccccccacccccagcttttggtctattccaaaatacacacgggcttgacctaagaattttgctaaaggaattattctcctctagggaaatgaagcagcatgtttcaacacaagcttagaaatcttaaaacaactaaaaatgaaaaaaaaaagtaccaggtcgttattatgttctgcaaaaattagatttacgggttttactgtagccattgtcaatgccttactgagggataggatcatagcagaaagatgctaaggagcttatggtccccctgggctgttgtgattatgtggatatatttagaagctacaaagaaagcagagcatcagctgagatgccccagtagacactctcaaattcagatctctcccattatgagaaaaaccctcaaaagaaaatattcacttggcaaggaatgaagagcttttttactcaccaaaatgatgtcgtaatgtttcagggagaacagtgactgcgacttacttattattgtcatttatatctcctagggctgaacagttgtcagagaggataagagatagggggagtgtatgggaggcctgctttggttctctgcttatataaacctccacattttagcagatttatgtttcatccttaaaatgagttaaaaacagcagacccttttgttgcagatgcaagatataacatgtaaagtggttccatagcaaattgctatttagaaaagaacccaacgttatttttaaccaactgtttgatctcctgtattctttcttatgtggttttatgaatttttgtttcacttgtaaataatcggtagcaaatgagtgtgtgaggctatgatttaatttgtaacaaggtacaataaaatacctcagcctgtgactcaactattttaagaggacaaatatgctaaataggaatattcgtttctaaccctatagtaaatgaaatgtacctaagatccatggctgaaaaaacctgccttatacaaattcacataagagagatcaaatgtggtgaaggttgcttgataaacttctattgtctagcttgtctgatgagctagatttcacagtattatgtccagatttaccacaataatactgcatagtttttttcaagtcttcgatctaagaggttctagtttgaagaggaggggttctgtgtcattcatacagtggctgtgatgcacatccgtttgatctgtgggctcatttaaaggcttagtggactgaaatgttttggggtcacctggaggggatcagtgtgtctgggctttgcttccctgtcttccttacgtatgtggaaacggtgagtgttgttccctgagatgtcctagagagacaaccttttcccaagtgacagtgagtttccgtcttggaatcagctttgcttatcccagggaggatccaggcctggcgccagcaagttctccccatgaggtctctgaggatgtggagagaaggaatgccctgcagagtttcagcctgttactctaaacctccaggcatgtttaagaccccttgggagaagaggagggagacctccatccgtttacaacatctctgcacagaaggcaaattctcttctcttgcatagtaccctaatggcaaaggcatacatgcaccaggctcaattacttttagtgaagaaaataaaccagatctgtggaaggcttcccttcagtgacttggggaactctagtttatgagtgaaagtaaagatacgagctagtaggtgacttttggtgtatgagcccttatttgtggggtattaaaaaccatgggctatccagtaactcagtaactcaggacacacacagcattttgtggtccctgatgtctttcttcgttttggctgctgctttggccattcagtcaaatttgaccattggttttcattaagattggccctcagatacagagcagggaaaagaaatgaaatttaagcttgtacatgatataaattgtcatcaactccattaatgtgttggtcagagagaaggcggaagccaatatttgacaggaagcatgtttttttttttttgtagattcagtgtgaccaccacaccgtctcgtgcttgtaggtaatttaatttaacctaggaggaaaatctagtcatttgagaaactaagataattaattatatgcttttaagatggagttcttagatgtgagatcttggagatccctgagaccatgtttaagaaatgctacatttgtactgaaaatctttgacttgatattaagttatgataaacacaactgccaattcaggtatgtaatttagggatgaaatctgatcataaaatggccgtctagatcagagtttggcaaagcatgacccatggaccaaatctggcccgctgtttttgaacagctcacaagctaacaatggtttttaaatgtttattatgtatttgtttttgagtcatggtcttgctcaagtcacccaggatggggtacaatggtgcaatcatagctcactgtaaccttcaacttctgggctcaagcaatcccaagtagctgggactgcaggtatgcaccaccatacccggtgaaggtattttatttttgtagagacatgggatcttgcccaggctggtcttgaattcctgacctcagtactcctgcctcggcctcccaaagtgctgagattacaggtaaagattttgttatttgcaaagagcttttcagaggagggactaaaatgataattcaccctgtatttactgggtaaacagtattaagaccccagattttgccagtagcagtggcatgtgcctgtagtcccagctactttgggaggccaagacaggagaatcacttgagcccaggagtttgaatccagcctgggtgacagtgagaccccatctattaaaacaaaacaaaaaacagattttgtctgaagaagtgagtattcttggacttctcaaaatgtcagtttggagacagttttggtaggccacttggtatataagcatggacagaaattgattgtgtgtgttgtattaggttggtgcaaaagtaattgtggcttttaccattaaaagtaatggcaaaacccgcaaatattatgatctatgttagtccatgtgagagcatatttatggagaatactgacatgatttgtcaagttagtagacaaataatgactgaacactcaaaggcaacatgattatcctccagctgtgcctaggagattcttgataccattttactatgtcaatattcagctacgtggacaaccgctattgttttgaacgctcgcttttccttgagaaagggatttccagaaaaagaaattctgtcatagcaccaagagctatgctggacaggaggttcaaatgttcatttttctggccctgaaatgaaatgcttcttaggtacacaatttgctgtccaggtctagagccgagcccagcaagaaacatgcccagtgcatggtaggcagaattttctgcctgtggactttcacaaggctgcattgtgggaacagaagctgctcagattgttcattgttctgtgactcctatttggcagccagtggagaattcattatgcagtgactggcatacttttcttctgttttttccctgccctgagtacagcagtgcatccgtgctctctgtaaccccttgcttcaccccttactgttctaatcttcccctccttgccttcctccagcctcactgctttgcaaaacctagagacaagcagacttaaatcatatgaactgattaggggatcaatttcccccaatgctgaggaaacacactttgttctcacatttgggtgggtgagcctgccaccaaatattaaacacccacggacacatagcagtgcgtcggttccccttttggggactgcaagctcagacaaatgtccacaatggcgaacatgccacatttctccctctgtgtttccgcccccaaaagtgtggcctcctgggctgagaggaagaaaattgagaagcagctctttcaaaattaccatttgcagggtttgttgttgttgttgttgttgtttggtttttttttggtttctatctgacttgctttgtaaagctggaagaaaagattagcatgactccgaaagcactattttttatgaattccagagcagcagttctcaacctttaaaatgtatttgaatcacctgggggtctggttaatatgcagattctgatttgttgggtctggggtggggccagatttctaatgaccttccgggtaatgctgagactactgggccatggaccaccacatttgaatagcaagtattaggttggtgcaaaaataattgtggtttttgcccttttttttgaaagtaatggcaaaaactgaaattacttttgcatcaatctaaacactagttcagtggctctcaaccttggctgcacgttgggatcacctggggagctttaaaaactactgatgccagagccccaccctcagagattctggtttaactggtctggagtgtgatctgagcctagggagttttttaaacgcctcagatggtctcaatatgcaccattgtggttatattgcagctttacaggtgtaagaatcggatttgttctcttaaaagggaagataagtcttctttttggtcctaggtcaatctgagctgagttcttcagcccttgaagaaagagcatccttctaactcaccagttctcaaccaggggacatctggcagatgcgtttggttgtcacaactggagttgggggtgctactggaattaagtggatagagtccaggggtgctactaaacatcctacagtgcaacagctccccacagcaaagaatgaaagggccccaagtatcgatggtgctgagacagaaaccctggtatagcttacctcactcctgccctcaaaaggctgggaagttcaacacttccttcttcaatgactattgagagtaactaactaatagtgttacaacaaaggggtcccaatccagatcccaagagagggttcttggatctcatgcaagaaagaattcagggcgagtccatagagtaaagtgaaagcaagtttattaagaaagtgaaggaataaaagaatggctactccatagagccattttatggttgtttcttgattacatgctaaacaaggagtggattattcatgcctcccctttctagaccatatagggtaactttctgacgttgccatggtatttgtaaactgtcatggcgctggtgggagtgtagcagtgaggacaaccagaggtcactctcatcaccgtcttggttttggtgagttttagccagcttctttactgcaacctgttttatcagcaaggtctttatgacctgtatcttgtgccgacctcgtatctcatcccgtgacatagaatgccttaaccatctgagaatgcagcccagtaggtctcagcctcattttacccagctcctatttaagatggagttgctctggttcacatgcctctgacaatagcacgtagctaatagcatttctttcatgtctaattctgttttacaacacactactgtcgcaagtattctgaactggaaagtcagtcttcctcccctgtaaaattaggctattgaaatacaagcttccaaagtccttttcagttaaaaaaaaaattatgtgattggcagggggaatggggagtagttatttcatggttacagattttctgcttctggtgataaaaaaaaaaaagttctggaaatgggtggtgagagttacataactttgtgaatgtcgttaatgccactgaactgtaaagttcatgttatgtatagtttaccacaattttttttaaaaaaaaccatgattctgagatcattggttgaaccataaaccatatgcttgcctgcatctaatgtgaaaccatccctgctccatgttcttagcatcctaggttcgtttccttcttggcactcaccgtggcttgaaatcacatggatttatgtgattatttgagtatgcctttccccactaaactgtcagcttcatgaaggtaagaaccaagtctgttttattcttcatggtactcccaatgcccagcacagttttcctgggatttagtaggcattccacagatatttgttgggtaggtggttttactactagtacatatgttaacctccctaggaacaggaattagccattatccacacatttgtatttagtatcatctgtctcctagccctttgctactggaggaattgtggaatggagaggttatggctaagtactattttatgatgttattctctgggaattggcttagattagaatcacctggagtagttttataattattaatggccacatcacaaggattcaggttcttcaggttctgttgatctgcggtggggttgggcatcagtagtttataaaggtctccagttaattccaacgtgcatcaagacggaaaaccaccgtgtaactccttgcttctcaaaatgtcccaggacaaaggccccaggtaaattgtttgtatattcaagcctgagaaacctacaggttcctttctagttaaaagcccattgttctagttggcctagagagctgttgactccgcaatgaaggaaagtgttgtatatttctggaggcagagagaggtctgcaatgcaaaaatagtttacagagaaagcggtattgttaccatcagaatcagttgtgattctattttagatcattggcttcagaggaaaaaggcaaaaaaacattttttttctacttcatttctagtcttggtttttcaccaccaaacaaaacaggaaaaaaaagggggtgggggttggtggtggcgagggactgcaggaaccaaatggatagaataaaatagtcttgtctcatgcagaagaaaaataaaagacaagttacatctttttctgctagagaaaagaatgtatttcctgtttgccctcgccgagagcctgggcataatgcggcagtgtgcacagagccgctgaacaaagaatacagaaatggctgagaggacagagtttgaaccgccaaatactggctcagttagaaaccatgtgacagatgcagcttctgatttcatttactagggcgaaacagaaatgtgtaagtgtttctctatatcctcggaggctttgagtgaaagaaaatggaaggtaattaattttcccttccagagttttgcatgtacattggaagatctgttatgattgaaagccttttaaataccaagcttgttaaccaaatggcttctgcaagaaagtgggctttataataagccctggctgcataaagaaatgttcccaaaccatgacgttttccgttggtgtttataacattccatagattatgtgagatgctattcgaatcactgaaaaatagttgggtactgaaagtgtctttagggatcatctaattcagtggttctcaatctgtttttctgtcctcaacacacccatagaatataaaattctgcaattagcgccagctgtatgtctttttaagctgggtgggtcatagcagaatcaggaggggtggagaagagcccattttataacaaaaaatcctcagtagttctgagatgcccatatcccactggttctcaaacttcactgtacattggaatcagctgaggagctttgcaagcgactgctctctgggttccatttgcagaaattctgatttaatttttctagggtgcagcctagtgagagactatgaaactctacccaggtgattctaagtgcagccaactttaagtctaatttccttaaaaaccaccactcttttctccctccattgcaaatggctgtattttgaatacttacagaggggagaggttgtatgtttcctcctgtcccatttatttgcatctttgtctctttgatctggagtccttggtcaggaatccaggctcagttatctaatgtctgtgggaaaacgcagcccacttaattataacttcaaggaggaaagtaagcccaggaggctcaaatctgtgactggtctgtggtaaaaacagactggtgggcttctgagactttcctgtggacgctgttgcctctgcagccactggaagagatgtggtgtcctcttgttaccagtgtgtcttgtgtaatcaagatggtatgccatgctattcactccaacatgcttttctgtatcttcccccaagatgtccctacaggccctcctgaaggagaaacccaaagtgattaacttaactcttccctctttagtcctcatcatttgaggttatcttttgtcattgttaccagcagggaaaacacaaagcatttatcagtggacagattggcatggataggatggcagttaatgtcgttcaaagatgaaggctcgggccaggcacagtgactcacgcctgtaatcccagcactttgggaggccgaggtgggcagatcacttgaggtcaggaattcgagactagcctggccaacatggcaaaaccctacctctactaaaaatacaaaaaaattagctggctatggtggcatgcacttgtagtcccagctactcgggaggctgagggaggagaatcactggaaccctggagacagaggttgcagtgagccatgatcatgctactgcactccagcctgggtgatagagtgagactccatctccaaaacaaaaagatgaaggctgtgttagagggggcatttgtagactggtacccaacatcatacatcaaacactgagaacaagagtttctagatttttttttttttttttttttttagtagtgacttaaggtagagagaggtggcacttaggagatgtcattctctttggtttgatgttgatggtcagtcctgttcagggctggggaagtgaccatgtcagcagaagaacgactgcttagggttttgtggcctcttttcatgtaggctaagagaggaaatgtcttgaaattcgggtatagaggtgtggaatgactgggattatatagggactctatcccttccatgccctgtaatgtccatagtgctgggaacttataaatactgcctttgtgtggaagcgtttttcaggtactcaagtaaagtaactctatcctgatactcacagtactataaacataaagatgaaaaaatgcaggatttaggggaaatgttttcagatttcactggagaaaaatgtagtagcctacaaagatagcaattgagttcctaaaggcatttgggttaaattaatcattgattaaacgtgaaacttcagagagattttgctttctgattcattagcttagatttgaatacatttgcatccctgcatatgtagaaagctaattcagtgaggtctttttgcagcacataatgaaaaaaatgaatgtgttttatgcttaggtgttgtagaatcaggagaaagtggtagataggtcaaaattttatttctgttgctaacttaacatattacaagtatatcgcaaaagcatacgtatacattttgtgcttcttaggcattcgttctttgtgttttagcttaacaaaaagatatgtcagtttttcatttggagccattataacattggaaagcagtaggagtgaaaaactaaaaccactcgaaactcaaacataaaatactatcagacttcctctctaaggcagccttgtttccctggcacgcaccctttgcttctccgctcattcttgcggtcactgactgccttgactgtacttcataggcaccatccatcacgcttgtctgcagcagtgacttaagatggaggggggtgggaccacaagatgcctggcccttggtggggcggggacggggggttgttgttcatacaaaagacctttgcatccttccgaagcgggtggcacctccctgccatcacttgggcatcctccaccagcctctgaagatttcactgaggaggaggggccagaagtagcagggtataggatggaggccagggccacctctaggagtcctggcccgctcaccccaatcagactttacatgccttctttcactattgagaaactgtaagggttaattttggggatgtcatttttgaatgcttctatttgccaggggcaaactgattaaaaggaaaaaaagagagagattgagcttaaacttcctgaacatctatttgaacagctaagaattcctttttctaaggtggcaagtaagataattaatggaatatttggtgcttatgttatctaatatgttagtttgggatgaaataaagtcacaatgaaattttattttttatatgatacctatatactttatagtaaaccaatcctccgtgtatacttgataattttacttatgcacagtttaggactttgtaagaaaagtggtacagatagttgttttcaaatgtcctgttctgggaatgcagagttggggaacaagatgccttcctgtactaagaaattactggatgtctccctcgatgaggtgacatatgaagaatatatagagatgcccaacaaatgttattttctacccctttttctgggtttttcgttttctctcctataaattttgggcaggccgtgtgctctgttgggtcgtgtcatttgagtccatcactacataggaccttctctcaatatttcaaatacttacacaagctagaggttgtatgtttccttctgtcacatttatttgcatctttgtctcttttatctggagtccttggtcaggaacccaggtttaattatctgatgtctatgggaaaactcaacccacttaatgacatgctgcattattttgtagctctcaggggaaaatgtggcaagaaaatggagactgcttattatttcttcttacgccatggttccagaatcttttcatgagagtaaataaaagtgaggtaaaatctgcagaatccttaggttagagagtttgcattatcgattgataggtccttaaaaacattttctctttatttcagaacaatggtttatgacaaccccattcactactcttgaaactgatgaggaacatcagattatgtaatcttgtgcatttggctaagtcagaggaggcctggtgaattcatttgtcattcagagtctagaggaatctaatatttgtttccagataaaaacctgactgagaaagtatatatttctgacatggagaactatgctagatattttatataatatgaactattctagagtattctagaccagcactgtctgatagaaatgtgagccacatatgtaacttttttaaggttagcagcctattgaaaattatttgaatggataaaatcaggtgaaattaactttttaaaatttatttattttttgaaatggagtctcactctgtcgcccaggctggagcgcagtggtgggatctcggctcaccgcaacctctgcctcccgggttcaagccattctcctgtctcagtccccctgagtagctgggattacaggcgtgtgccaccacgcctggctaatttttgtactttttagtagagacagagttttaccatgttggccatgctggtcttgaactcctgaccttgtgatctgcccgccttggcctcccaaagtgctgggattacaggcatgagctaccacgcctggccgtgaaattaatttaacaatatgtttaaaatttttttttttttggtttagagacagggtctcacgctatcgcccaggctggaatgcagtggtgcaatcatagctcactgcagcctcagactcctgagttcaagcgatcctccttagtagctaggactacaggtgtgtaccaccacgcctgactaattttttttttttttttttaagagacgaagtctcgttatgttccccaggctggtgtcaaactcctgggctcaagtgattctcccaccttgacctctccaaagtgctgagattataggcttgtatgccactgtgcctggccctaacaatacatgtcatttaacccagtatttccaaaatgttatttcaacatgtgaccaatataaaaaattactgagttgttttacattatttttgaagtccaatgtaaattttacacttagagcacttctcatttgggattagccccaatcatatgcccactggtgacatgtggccagcggctaccatgttggacaacacagctttggaccttcattcctaaacccaggcactgagagattgataaccaatcaagactcctgctccaatttagaaaggggacttaaacattgagaaaaggagctctctgaaaaaaaaaatatgaaagactccttcaaatagttgatattagaaactaaaccactttccacataaaatctgtgtttttgtctgaagagcgcagtggggaactagcaatttgtaaaatgtttctatgtgaattggaagaacattctgccttcagattgtgcttctggaaaaccagatcaggatgacattgagaggcagatgattgtattgtagcttttaagagaataagctctgtagcttcaatgcctggattcacagccaagctctgctatttaggttggtgcaaaagcatttgcagttttggccattgcttttgatggctaaagccgcaattgcttttgcgccaacctaatacttgctcgctttgtgatctttggcagattcctcttcatgtgtacttttcctcacctgaagactcaggacagtaatagtaactatctcctagggtcatgaggattaaataaactaaaacaaaggcctcagattggtacttagcagtgagctattctattacagcattagctattaaatcatcatcatcgtcactgaaaattgtgctcttatatctcattctttttttttttggtgacagggtcttgctctgtcacccaggccggggtgcagtgatgcaatcatggctcactgcagcctcagtttcctgagttcaagcgatcctccttagtagctaggactacaggtgtgtaccaccacgcctgactaattttttttttttttttttaagagacgaagtctcgttatgttccccaggctggtgtcaaactcctgggctcaagtgattctcccaccttgacctctccaaagtgctgagattataggcttgtatgccactgtgcctggccctaacaatacatgtcatttaacccagtatttccaaaatgttatttcaacatgtgaccaatataaaaaattactgagttgttttacattatttttgaagtccaatgtaaattttacacttagagcacttctcatttgggattagccccaatcatatgcccactggtgacatgtggccagcggctaccatgttggacaacacagctttggaccttcattcctaaacccaggcactgagagattgataaccaatcaagactcctgctccaatttagaaaggggacttaaacattgagaaaaggagctctctgaaaaaaaaaatatgaaagactccttcaaatagttgatattagaaactaaaccactttccacataaaatctgtgtttttgtctgaagagcgcagtggggaactagcaatttgtaaaatgtttctatgtgaattggaagaacattctgccttcagattgtgcttctggaaaaccagatcaggatgacattgagaggcagatgattgtattgtagcttttaagagaataagctctgtagcttcaatgcctggattcacagccaagctctgctatttaggttggtgcaaaagcatttgcagttttggccattgcttttgatggctaaagccgcaattgcttttgcgccaacctaatacttgctcgctttgtgatctttggcagattcctcttcatgtgtacttttcctcacctgaagactcaggacagtaatagtaactatctcctagggtcatgaggattaaataaactaaaacaaaggcctcagattggtacttagcagtgagctattctattacagcattagctattaaatcatcatcatcgtcactgaaaattgtgctcttatatctcattctttttttttttggtgacagggtcttgctctgtcacccaggccggggtgcagtgatgcaatcatggctcactgcagcctcagtttcctgggcccaagcgattctcccacctcagcctcccaagtagctgggactagagacatgcgccaccatgccacgctattttttaaaaatattttgtagagatggggtctcgctgtgttgcccaggctggtctcgagctcctgggctaaagcagtcctcccaccttggccttccaaaatgttgggattacaggcgtgagccacgtgcccagttctgtatttcactttcacactctctatgctccacttagtgtttcagttgcctgtttcagttgctgggcctatagtggtgggcaaggtagacaagattcctgttctcacatcttacattttagggatgggaaataggcaataaacaagacaggagaacaggcaaatgaacaaggtatttccagagtgtgagcagagtgttcagagagtctctagaacaggttaacatgaccatgagaagctggaggtgatgtttgagccaagacatgcatgacttggtgcaaatttggggcagagcatcaagcccagggaacggcaggttgcaaaggccccatggagaaaccggtgtaacgtatttgaacacctgaaagctggctcctgtgtttggagtgtaagaagggggtaaagattggagatgaggtcaataagcaggcaggggctggaacctcaaaggccttgcagagcttgataaagagtttgaaattttattctaagagcctcgaaaggtttaaggcagggaagtaatagaacctgatttgccttttttttttttttttgagatggagccttgctctgtctcccaggctggagtgcagtggcacaatcttggctcactgcaagctctgcctcccgggttcacaccattctcccgcctcagcctcccgagtagctggaactacaggtgcccaccaccacgcccggctaattttttgtatttttagtagagacggggtttcaccatgttagccagggatggtctcaatctcctgacctggtgacccgcccgcctcggcctcccaaagtgctgggattacaggcgtgagccaccgcgcccggcctgatttgcctttttaaatggtcactctggcttcaggagatttaatgggagcaggagagagacgaccactactatctgctttcaagaatgtaagattggacatagctctctgtcccctgctttgagcatagctgattcctctacaacaaccccatcactggccttgtgttgtgaaagagatcattttctgcttgtataggagagtagagagacctttacgctaacgtggcctgccatttcagactatgacataaccatgcacatgctcgcacattcctagaagaatccgtgtgttagcaaaaggattgttgtgttctttgcgaagcaagagcaaagaatccctcacagaagctgaaaattgccactgatgagtcaaatggccatgctctggtcttcataaacaaaaggcaggctctgattcctccaagtgcagctaattttcaggtagtactaatgggtttatactagcggttctcaaagtgtgcttcctggacgagcaacatcagcatcacctgggaacttgctagaaatgcaaatcctcaggtcccaccccaggagacatactgaactctgaagtgggcccagcaatgtgttttaacaagccctccagctgatgcacctcagaatttggggaatccctgttttttgctgctagagatgattgctcagagtaaaaagcactactaaacatggctgaggagcagagtgatactcctttcattgtaatctttttaatgtaaatgctgagtatttgggtagcttttggaatcaagtgtttgaaccacgccttttgtgtttgaagctattcatgttttatttaggttcttttgttggatgctgctgtatggtataatatttacaaggtttctgggctggcttctccttactggaattttcagaattgatgtaattacatcctccctgagtcgaatttaacagtctaaattggaagaagcctctggctgtcctgatagaaagttcccactgaaaacaaccagcagcattgtatttgaatctttgttgtccacaggtagactgtctatactacagcttcccttcagtgagtttttaacccctgggtggctcatgctgccagccaatctgttcttatgtggatcttcaccgtaagttatgacctgcttacggaaagcagacagatttttagtttagatacatcataaaaggtatatctacttgttgggggagggagggaaataaacattccaaatacagtactgttgtcaaagccaaggatgttctactgtggggctgttcttatatccctgctgtatctgtttcctgtggccgctctaagacactaccacaaatttagtggcttaaaacaatgcaaatttgttatagtcctggaggtcagaagtctgacgcaggtctcactgggctaaaatccaggtgtagatgaactgtgtttctttctagaagccctaggggagaatccatttccttgccctttccaccttctagaggctacatgcattttttggcttgtggccattttcctacatcttcaaagccaggaactgtgggttaagtttttctcacatcgcatcacttggacctcttctgcctctctcttgtacacttaagtaccctgtgataacgttgggtctacctggatgattcaggataatctttggtcatctgattagcaaccttaattctatctgcaaccttaatcccccgtttgccatgtcatgtaattcacaggttccaaggattaggatgtggacatcttggggtggggggtatgatgctgcctaccacagcaggccactaaacttccttacagcctcagtttccttatctgcataatgacattagtaaaaaattattgaaggctctccttgagcattacaggagatacatgtgaaattatttggcacagagctgcccttcagtagatgctggtggcctaacactattttatgttcacaaagtgtctacatagattcttttaaaaattatttgaatgcttgcttctcactcccagacccctctgctctgttctttggtaccccttcccccaccttcccattgggtggtctccctgacccatgctgataggaataattagagcatatgcaagtggaaagggtaggggagaggaaaaaaaaaaaaaaccttcttgtctctaatcagttactattttcccccatactttaaactctgaatagaatattcgtaagagtttgggagattcctttgatttttttttttaacagctttattaaggtataattttccatttgttgttctctaccttgctagagttacttctgacctcgtcaaatcctgattcaatcaaaccaactgtcattaactatttggggggataattgttgaaatttgaatataggcagatcttggatgatattaagaaacattaactcttgtatgagtgataatagtgttgtgcttatgtaagaaaatgcttattttttcaagatacttactgagatatttagttgtgaaatgtcagaaggacttaaactaggggaaaaaaaaggcgaagcaaatatggtgaatttttttttttttttttttttttttttggcagagtctggctctaatgcccaggctggggtgtagtggcatgatcacagctcactgcagcctcaacctccctaggctcaggtgatcctcccacctcagcctcccaagtagctttgactacagaaatgtaccaccatgcctggctaattttcaggggttttttttgtaaagatgggattttgccatgttgctcaggctggtcttgaactcctgggctcaagcgatctgcctgccttggcctccaaagtgctgggattacagatgtatgccactgtgcctggttcatttttttaaaatattagatacaatcaagtgatgcaaaggacccaggtggccagatgtatagtttctggaacaacttctttttcttaatacttcacttaaatgacttggttctctgtgaactttaccaattctagtccactcactcccaaactctgctctgttgacatagctcatgctttatcagatgtcctaaggaaactctacttcactatccttgtcaagtttacatgctcccacaccttttggtggaacataatttacattttagagaacactgggatcttgttaggtttgtttcgtcccatatcacaatccactcttcaactgctagatgatgcatcccacttctagaaagagagccttacttagtgggactgagagctgctctaatcatctgcagttctagctgttacgcgtttcccagtggatcttgagctgccttggggtggtgaggggctgttttgtgggagtgtaaggtcagggaagtgtcctctcctgccctgtgacccaggccttgcaatgatactgaaatacacagctggaaattgtgtgatccaaaaaatggtcttgtctgtgcacttgcatgaactacagccctgcccccaaattcgggagttgagatggtgttcccaaattactccagtgagttgtctgttattccaggaggtgacacagcatcatggtatgtgcatgatgtcacctcagacgttgccagacaacaagcccactcaagtcggacatacagcactttataatggaggctgggttccaccgagaacagccattctcttgtctgctgtccccagtgattataggcagatgtgctgtgacttgagcttgcacaggcttaaagttccttctgccttcagagtcagcagtcagccatcttcacaaatggaagattgttccagaccaccattgaccatctggctggatccatcccaccatctgccctgcacagtggcctctcatttcctaatgtttctcataaacagcttaaagttccctgtgacattatctactgcagcagggcttttggtaccactcctgggcatgccaggaacatagggcctatgggtattcatcagagaacatttgtatgtcaaaaattttaacaaatgagacttccattttgaagataatgatgcagacatgttgtacgttcacttatgtgtcttccttgataaccagtcaacaatttatcagtgatcctttatggacatattaatacacttattggtgatctggaagtagtgtaggacctaatctgtaatcttaaactgtgcagagccttgaggatggccattgtttgttggttatggtgtcctccttgatctttgatgaaagaaagattgccttaggtgcttatatcaagttaatctcatctctgtgacaattgaaattaccattggttctcttctttccacataacacatcgttgtaactcagcatgtctttttcatcgttgttcttgtggaattcttttaatttaatttattgtggtaaaatatgtccaacataaaactgatcattgtaaccattttaaagtgtacaattcagtagcatttagtacattcacaatgttgtacaaacatcactatctagttctaggacatttttgtcatccaaagaaaaccctataccattaagcagtcactccccatctccttcccccacctctggcaaccactaatctgctttctgtctctatggatttgcttatcctggacatttcatataaatagaatcacacaacatgtggcctaccgtgtctggcttctttcactgagcataatgttgtcaacattcatccatgtcgtagcatgtgccaggagttcattcctttgtatcgttgactgctattccattgtacagatagatcacatttcatgtatccattcctcagttgatgggcatttgggctgtttttaccttgtggctattgtgaagagtgctcctgtgaccatgtgtgtacaagtgtttgagcacctgttttcaattcgtttgggtatgtagctagaagtggaattgttgggtcagacagtaattggatgtttaacttcttgaggagctacccgtgcggccttttgctcatgccagtcctcctctgccatatgatgtctgttctctttcaaacctatgttaggactcgcctccaccttgattccttttcctgatagtcccctgcagcttcccataattcatgcatccttactagtccctatgagcacccctcattcagctctgcctggagaaacttcacttttgcctcctcatatattcatctggggttaccctacttcttttggctttgaggatgtttttcccactaactgcatgcaactgtcaccatctcaaggatggagatggatactcgttctctgtgctcaaaggcacttgtcactatttttgcctttctattgttgggctattctagtaacagctggaaattacagaaataggttttgattttattgctcatcaaggtcaggtttccactgaaatacaggcatcatagggcctatcctgtttgaaatattaaaatgtcagaagattcaaacaggccaaagagggagagtttgaagcgggggtgggggggggattggtatgtgtatggagtataaataaagaggttcaaaataacaataatagcattaatgcaaccttcttgagtttgacctcgtttagtcttcacaacgaccatgtgagatggagatttagtgtgcatggctcaaagccacacatcccttatgtggcaaaatcagtatgtttgactccagagtctgtgtttttttgtttttgtttttgtcttttgtttgtttgtttttggagatggagtcttactctgtcacccaggctggagtgcagtggcacgatctcagctcactgcaacctctgcctcccaggttcaagcaattctcctgccctggcttcccaagtacctgggattacagggatgtgccaccatgcccagctaatttttttttttttttttgtatttttagtagagatggggtttcaccatgttggccaggctggtcttgaactcttgacctcaagtgatccacccatctcagcctcccaaagtgctgagattataggcgtgggccactgcgcctaccctgggcctcccactttaaaagttgctcaccagttcttgtatccctagcaccttccagaatgtgttgagtatagtcagtgctcagtgaatatttattgaatctaattgtcaaggaatatgccatttgctgtgttaattttccccaatatagtttttgttgttacatttttctccttaagccctagaaaagtgtaggctttttaaaaaatgaaaatgtttcattttatttcaagaaaggagccttaatctttatttgtatctatttacaaactgttaaagattttgactgcctcctaatgtctttcttaatctcacactttttgaataaaaagtgttaatatatccgttgtaaattgctggcagctcaatttgaaatatctttttgcacaatatgtactattaagtattctcgtgttattgctcagggtaagaaaagatgactgtttttttgccatttaaagcagtcgtctttttttaatgctgtatttaatttttaaaagacaaagtacagcttaatgaaacaggaacttgctgtttcaatgtgaaggacatgatactccagacacattctaaaaggaaatacatttttaaatataaatgtttggtgtttaatcattcattaggcaaaaatggagacatttgagttgtctggatcccttgagcacattttcatggcacttacatgtaatgaagcagctggcccaggatatattcataatcagtgtcactggagggcttaccatatgccaggcttggttctaattgcttaatgtggattgacccatttaatcccaaaataaccctacaaagttgatgtagtcatccctcttttaaaattgagattaaatttgcatagcataaaatgaaccattttaaggtcaacaatttagtgacatttagtctattcaccacattgggcaaccaccagctctatttccaaaacattttgatcaccctcaaaggaaccccataatccctcgtttaagaatcgggaaacagagacatggagataagcccctttccttaagttacccaactgggaagtgatggagccatgtttgagcccggacactgggactcaaggccactctctgtcgctctctgaagatctatactttagtcccactgccaccttacccacctcctaccaacctccagtgtagtgggggcaaagcacttcacttctaacctcaggttcttgaagtgaaaagcagtaagataatgtgctggttgccaagatctcagggctgcaaaaaaaaaaaaattccttacgctattctccatgggaatcaggccaaagcttttcttcatcaaatttcccgaccccatttctgcagaacaaacagcacaccaggcagggactcccctctgtttcttgatatcccacttccacatttatctattatcatcactctctcattcatgtttcagaagattcccacctcttcactagggtcgagactagcataaaacaaaagagatgaccagggtgcgaaatggaagggggcactccctctcagggtcctgtaagccgagtaagtactctctggcctcacgtagtcctggtcctgccccacacctcctccaagatcatgttcagttgctactccctctcattccttgcctccctctaaagaattctaggatccttttcacttctgactccttgtcctgtctctgaccatttatgtccctcctctctggagatgctcctgctctgttcgccctctaaattgtcttttttttttttcttactctatatccagctgggtcatctcgtccgctctgtgtgctactgtctttgtgttaactctcatacctgcagttctctttcaccctcagcctaggtgaccatatgtcctggttggcctggaaagtcccagtgtatgcttgttgtcttggaatcattattggcagtgcctcttgtcactctcaaaagtgatatgtaggcttggcatggtggctcacgcctgtaatcccagcactttgggaggccaaggcaggaggattgcttgagcccaggagtttgagaccagcctgggcaacatagtgaaaccccgtatctacaaaaaataaaaaaatagcccggtgtggtggcacatgcctgtagtcctagctacgtggaaggctgaaggtgggaggatcatgagcctggtaggttgaagctgcagtgagctaaaatcacgccactgcattccagcctgagtgacagagtgagaccctgtctaaaaaaaaaaaaaaaaaaaaaaaaaaagtgatgtcacatattgcagccttctccccagcactcctattctgctagcacgtttctcaggcatacaaaatgcaacagatcagaaataaaacttctcagggtcttgcctaaaggctgcaccacctcaattttctctatcttgactaattatatccacaaggaaagctgttggctcttcataaactcaatctcagttctccaaggctgaaggaagaccaccacacctggaagaacagctggacccagcagtctgcacctctgttccctgtcacccttccttggaatcaagggctactgctcatttaattctctagcccagcacttcccagcagctctttccgccatgacagaaatgctctatatttgtgttgtccgatttggcagccactagcacatgtggctattgagcacatgaaatagggcttgtgcagctgaggaactgacttaacaaagtacaagtagctagtggctactatatgttatagagcagctctacctcagtacttctcaaactttaacatgcatacaaaacacctggatctcactgaaaggtgcaatctgcttcagtacatctgcaacaagacctgagcgtccccattgtagtaggcttccaggtgaaactgacactgctggtctaagggccacactttgaggagaaaggcgctaatctaactcgattctcatccctggctcacatgagccacacgggggaaggtttaaaaatgtgtcagatgcccagggcctttcccaagccaattaaatcaggacctcagagagtaacctgggcattgacatgttttgaaagctcctcaggtgattctaatgtaagatgagcccagactgagctgctcaaataagactttactaaagatttagggttaagaagatggaattaaccagtgaatacaagtcagttagccactgggatttctgtgtggcacctactcatcttcagcctgaagtccctaatagagtctctgtatctgccttctcccccagatctcctgaaactggcagagaatgaaacagctctaacttcttttttttttgttttgttttgttttgttttgttttgttttgtttttgtttttgttttagagatagggtctcgctctgtcaccgaggctggagtgcagtggtgtgatcatggctcactgcagcttcaacctcctgggcccaagtgatctacttcaacctcccaagtagctgagactgcaggtgtgcaccactgcacctacctagtttttatttttttttgtagagacagggtcttgctatgttacccagcctggtctaacttctttaaatagatctggaaggtgccagacttagcctcacagttgtaaaagatttctgtctttgcaaagggctgttctagataatgtggcttttctgacatattgcatacatactctttgaattactttatacttttcttcacacacatgttcattgtatactttttaaaaagcaaatacagagaccagagctgtttaatagctgaggacctccctggactcagattctccctgaagcagtgttaggggctctgttttctgtgttcatataaccctcagtccataccttgttggaatggttgttattgctttatgatttctctatttgtacttctttctagactgagagctccttcaaagtagggccactgccctatttctctctgcctgtctatcccggccactatcagaacctcctggggaattcctccctcagacctactggttcagaatcttaagtggatgagccctggaatgtgtatgtttaaaaggcttcacagatgatctttattttcagacaggaatgaacatcattgccttagagactgacattatatctggaacatggtaaacattaaataactatttgttgagtgcatgaaaatcagtcttaaattcgacttgtggcatctcgaggcagatgccaccttagccaagtgatcaaggttaatgtcatgagtaacctgcatcaataccatttgccccccatgcaatgcattgcaaaggatacagtattactactctggtttccttccaagtgatgcataaccccagctgaatcatgaggaaacagcagacaaacccaaattgagggatattctacaaaatttgtgaccaatactcttcaaaagagtcaaggtcatgaaaaacaagtaaagactggggaatttgcacagattgaaggagaccaaggagacaggacaactaaatgccgcacaagattctgaattgtatcctggaatggaaaagggacattagtgggaaaactggtgaaatccaaataagttctgtgctttagttaacagcattgtgccaaggctaatttcttagttttgataaatgttctgtagttatgtaagatgttaacataaggagaagctcagtgaaggatgtattggaactctttgtaatatttttgcaacactgctgaaagtctgaatttatctcaaaaccaacaaaaggttaaatttaaaaaatgaatggaagataattgaaatgtcactgaacaagggcattctggaaggagagtaaagaagtccaaggggagaccattggttcgacaatcggaaccaaactggaccatcatagattacaagttgatgcccctatggttttgtcaaaactccctcatgtttttatagctattttgaggtataatttacataccatacggttcacccatttaaagtgtataattcactgtgttttagaatatttacagggttgcaccaccatcatcacaatctaattttggaacgtttttgtcccctttaaaaaaaaaaaaaacaacctatatccatttgctgtcactcaatatcccaccccaccagctgctgccaagcaaccattttttcctttctgtctctataggttttcctattctggacatttattttaaattgaatcatatgtgatattttgtgtctggcttctttcacttagcatgatgtttctgaggtttatccatgtggtagcatgtgtcagtacttcattcctatttgtggcccaataacattctgttgtatgaatacggaccacatttatttattcattcatcagtcgatgaacacctaataccttttggactattattctgatgggtttggttgaatactagggtagactgcccttccagcctcccatgctctatgcatccattgctccagaagatagactcttaggataaagagttgacaccatctccaagcatcccaaacagcattgtgtacttatatacatgattagccactttggaatgtctttagtgttaaggcaagaaatgtccttagagtcccagagagggaaaaaatgtgggttatgttatgtccaaatccataaccaccacttcagggagttgtgcagtgaattgctttattgaataagtgtgagaaaggaaagatattagttgtccaagaatgctattgccaaactttgtggaaacagagtattttctgtggaaacagcatacattttattctgtgccatggaatttcccctcatttgacccaaggggtaaagaaaaactcttatgcaaccatcccattttaaaagttattcttttatatgtaggctggttaataaccaacaacagacaattttatctaagatgactaagatcttgcatttcgcttttagtgagagctgatttacatatctaattcatgttctattagcagagttatgggaatataaggaaatgcaagaaaaacccaggacttggatcagattttaaagtcctacagttatatacagttgtgaagatgtccttcaaaatccagaaaccaaacagactctgtcatcttactttttgctgaggtgttggccttttatttttgaaatctagcaattttcacttcttgttatctaaaagttattaatacaaagcatttcctcccgtcatttacataactcttttccagcagtatgcacacgtacacacacacacacacacacacaatttaaatgtctatgagcaacttttgactttctggaaaattctttccccagcttgaaactttctccatattctggtgtttcacctgaatgtgaaatgaagacatttcacagaatctaagagttcagaaagaggcaccgtgctagatactcatgtgcatagtttctggtcttctcactggcccttccagtaacttgtggttattctagaagtccatgtccagaacagaacactgagcaacagatatcatctgggatccatgtttttggtctaattggccttttgggtgaacacatcatttgggctcaagttgatgattgtatcaagtaagccttttcagtctcttctgtgctgccactgagcctgttccaccaccaccttccctcacccccatcttgaaatcatgcatttggttgctgagacccaagtgtaggatacaaccgtttgttcccatgaccttttcaggtcctcctcatctttctggtttgtcttcctttcagcatctggtaattttgttgttgaatgggttggcctcacttcctagcttcatgttacctgcagacttggtcacgaagatgtgtataacttcatgtgagccattgataagcagggcaaaatagggaaagtgccacccccacaccatgcctgtcactggagactgctcggcagtttcatactttattacccctgagatctgttgtgaatcagcctcactaaaggtcttcccctctacattcccttgtgaacaagaatagctggaaagcccttacaaatgccttgcctgccaggcacagcggctcacgcttgtagtcccagcactttgggaggctgaggtgggtggatcgcttgagcccaggagtttgagaccagctggggcaacgtggcaaaaccccatctctacagaagatacaaaaattagccaggcgtagtggcacacacttgtagccccagctgcttgggaggctgaggtgggaggatttcttgagcccaggagattgaggctacagtgagctgtgattgctccactgcactccagcctgggtgacagagtgagaccctgtctcaaaacaaaaataaatgcctcttcatgattcccatggtttgtgtctagagatttccctcagcctaagaatctaaccgtaccaagtgaaagcaagagaggctgatcttgcatgtaatagtcactgaatgttctaagtgcttgcagaatattcttcaattgtctcttctagactcttgactaggatgtatatcagattcaccaatctgtggtttttgaagcatgttttttccttttcccttttgaaaactgcaaatgcatctctctgactccattcgtattacaggggaagatttagttattttatcttcaagttctccaagtatctgggtataatttgtcttcactataatgctaaaattcatttagaatatcttctaatcaatttgggacctcagttctctcttcattagatttttttcgtctactcttccctggctgaagctcattgtttttttaaaaatagatatatattttaaatttttaaatatttaattgacatgtaataattgtacatatttatggggtacaatgtgatatttctgtacattaatgcattgtgtaatgatcaaatcagggtaattggtatatccatcacttcaaacatttatcacttctttgtggtgaaaatattcaaattcctgtcttctagcttttttgaaatatgtgttgttaactatagtcattccagtgtgcattagagcaccagaacttattcctcctaactggtgatgttgtacccattgagtgacctcttcctacttttttgagacggagtttcactcttgttgcccagactggagtgcaatggcgcgatctcagctcaccgcaacctccgcctcccaggttcaagtgattctcctgcctcagcctccctagtagctgggattacaggcatgtgccaccacgcccggctaattttgtatttttagtagagacggggtttctccatgttggtcaggctggtctcaaactcccgacctcaggtgatccgccagcctcagcctctcaaagtgctgggattacaggcgtgagccactgcgcccggcttgacctcttcctacttctaactcccctcaccataaccctccatagcccctagtaacttctatccaattctctacttttatgagctcaacttttaaaaattccacatacaagcaggatcatgaggtatttgtctttctgggcctggcttatttatttcacttaatatgatgtcctccaggtgtatccgtgttgtcaaaaatgacaggatttattgttttttttatggctgaatagtagtctgtgtttttatccaagcagtcagaagcaaagtgcagaagagaatggggtttttttctttcattttttatttttactttttctttttgagacagggtcttgctctgtcacccaggctggagagcagtggtacaatctcagctcactgcagccttgacctcttggactcaagtgatcctcctgcctcagcctcctgagtagctgggactataggtgtgcaccaccatgcccagctaatatttttctttgttttttttttcttttcttttctttctttctttcttttttttttttttttttttgaagagatggatttttaccgtgtggtccagtgatctgccggcctcaggctcccaaagtgctgagactacaggcatgaaccaccgtgcctggctgagaatggggttttctttgcctattgtaatggaaacataaatccgtgaatttggcccgtgacctctttgctgttttttatcacaatgtcatgaactgctttgcagtttacaaagtgcccgcatgtgcatgtgatctttacaaccaccttgtgagctagtgagtttactacctgtattttagaaacaaagaagcagagttgaacttgcatttagtgacatggagggttgggtgacttttccaagttgtggagcctgttcatgaccaagttggatgcctcccagctttttcactatgcaatctttgccacatttatcacatacagtagtccccctttattcacggtttcactctccatggtgtcagttacctgtggtcaacagtggtccaaaataggtaagtacagaacaataagataagaaagagagactacattcacataactttgattacagtatattgttatagttgatctattattagttattgttgctaatttctcactgtgcctaatttataaatgaaactttattgtatgtatatacagggaaaaacactgtatatagggtttgttactatctgcagttttaggcatccactgggggtcttggaatgtatacctcatggataagtggggacctgtactttactatacgttggaagcacacctttctgactttctcccctgaaatccttgtttactctttaattcatgccattctctgtctttcatacacagtatgtgggaagggtgatgcccataagccactctaacttcctgcactccctttcatttctctgtggggctcaccgatgagtgagtatatttccagaacatcatttctgacatcatccaaatcctctaaagcagccttcctttaaaaactccaaccctggaatctaatctgcatttttggaacgtttgcaatatgctgaagtcagagctactccctttgctgtgccccacgtgcctgggcaccagcccctcggctccaccacctgatgtgcaagtcatgtcagtgtcctcccaagattcctttcacttccccaacttggtgcccaagggggatctgcactgggtctagtgcagcatcccccctaacgtgctttctacaagagggaattggcagcaatgctaggcaaggcgattcagaatcagcgactctacttttttgctgaataagacactgcagatctatttcgctgatttatttacattattctgcatgtccttggagagatggcagaaggttaagggacagcatcgattctttcagattcctcaaggctcttgcagatttcccatggtcctttgtactacaaagtgggagaatcaagcatcagatgaccttttcaatgttactctgttggttcaatctgtaacaactttttctcttgtcttcaccaacctctcactgctttccacaaaaaatgaaccatggcctgctattatttgttttcaattctgaatataataagatatcataaattgctttcacgaaagtactgatttgattatcacttatgatacaaattatgaaactgcaacatgagtgttttctctctgattcctttcaccatttcactgcagacttgaaaagggaccagaatggaccaaaaagaaattatttctttgttgttttgccaaagacctttcctttcaaaatgcacacatcctggagttttgaaaactgctataattatcacaaggcagtctttctgtgggaagaaagtgagtgaatttcccattaggagatcatggttaaaataatctctcggctctgggaccaaatggaactagaaagtgtgttcaaaagctgcattcatttcagaagggagaaagaacaacctttctcataatgagccttgggaagcagccagcgtggaaaaaggtcacacaattgccactttggtatctgaataactactcttagcttacttttgcttgtggtgtgatagcttttgtggttttctctggggctgaatccctgctgtcttcaagcatagttttcactgagtctgtcttggaaaccactgtgcgtgtggcattgtcatctaccatttttataggagacagaaacagttactctgacccaagtgactgaaatgcagctcagtaaattttttttcccaatagtcttagcatgtggataggacatttgttcttatccagaaatgaaatgtgttaagattgtgtgaaattatctgtatcttttgctgctcatttttcaaagattgccccggagggtgttttggtgaaattatttatggaatatgtaaaaatgttcaagaccctttatcagaacagaactgaggaggatgctgttcctgaagattctgcctactgcctatccaagatgcaaaatattagtggtattgaagagagatgagaggggagattattttaaggttatgtgtctttctacaattataccaatttttaaagtgtatttccagctgggcatggtggctcatacctgtaatcccagcactttgggagaccaaggtgggaggattgcctaaaccttggaatttgagaccagcctgggcaatgtagcaaaaccccatctctacagaaaaaaaaaaaaatcacaaaagttagccgggcatggtggcatgtacctgtagtcccagctactggggaggctggggtgggagggtcacttgagcccaggaagtcaaggctgtagtgagccgtgattgtgccactgcactccagcctgggtggtagagaccctgtatcaaaaaataaaaataaaaaatagtaaagaatatttccacaaatcagaagtgaaagagacagctcttggagaagggttcatattcataatacttttctcattgcttattttccaaaagctctaaaatggacttctatgtattaccactgcttcatattgcccacctacccaccttgttgctcctgtcatctaatgttatgaaaatagtgtttgggatttaaagcggaagccatgggttgatttttaagaagtcacagaagccaagactgctgagcactctggtgtcatcagaatgaacattccctgactccagtgagtatcctgacgtgtgtagttaactctcacaaactcaggcacgtgaatgatctcagcagaagagagagaagggccagtggtttaccccattgtctctcccctctttcaacatgggtcttgactaccttgcttccaggaagcaagggtgacagctgaaaaccaaccggaagcgttatttttgttgttgttgttttttgttgtagttgttgttgctgttgcttttgagcctccaaagaccaagatccacttaatagaccgtggcatttttgcctcatctactgacttaagaacttaatccatgaccctgtcactacaccccctgcacccccacccacgcacatttacatgctcactcgtacactcattcacactcacctctacctttagatttaacccactgagctgtactgagccagatgaactggactgttgattcttaccatttctggatcgtgggttcctgaagaatctggtgagaagttgtaaaccctcttccctgaaaagtgtctatacaaatgtgtgcagatttggcttatgattctggagggattcatggccaggaaatccatgttaggggatttacttttcactatataccctttgtttctgttgtgaggttgttactgtctgtgtatattacttctgttaattgaatctgtctaggttactttttcaattaacaaattaattagaagactaagagcctaaaagagatttttcttatctgattaagttcagtattgaatcctgagagtccatttgaaagcatagtattcgtcggctttttcaattgcaaaatatttatcgtgattgccaagaaatattgctgagagccaaaataataatagaggaaatgatctacagttgaatttttatctgaattattttgaacatagaaaatgaatttttgtaaataaaaaaataatagatgttggtgtggatgcagtgaaagggaacacttctacactgctggtgggaatgtaaactagtacaaccactatagaaatagtggggagattgcttaaagaactaaaagtagatctaccatttgatccagcaattccactactagctgtctacccagggggaaaaaaaatcatatgaaaaagatacttgcacgtgcatgtttatagcagcacagtttgcaattgcaaaagtatggaaccagcccaagtgcccatcaatcaacgagtggataaagaaaatgaggtgtgtgtgtatatatatatgtatgtgtgtatatgtatatatgtatattatatatatatgtatgtgtatatatatgtgtgtatatgtatgtgtatatatgtgtgtatatgtatatatatgtatgtgtatatatatgtatatatgtgtgtgtgtgtgtgtgtgtgtgtgtgtgtgtgtgtgtatgcacattcattctgtggaatactcagccatataaaggaactaaacaatggcattcgtggcaacctggatggaattggaggcaattattctaaatgaagtaactcaggaatggaaaaccaaacattgcatgttctcagttgtatgtgggagctaagttatgaggatgcaaaggcataagaatgatacactgggatttggggactcggggggaaaggctgggggtggcaagggataaaagactacacattgggtacagtgtacactgcttgggctatgggtgcaccaaaatctcagaaatcaccactaaagaagttattcatgtaaccaaacactacctgttccccaaaaacctattgaaataaaaaataaaatattaaaatgaatttttgtgttaatggtctcatattcaggtgggaaaaatcttcttacagttgccaaaaatggttacctggtagtatgaaaagggtaagagttgataatcctcgagaataaggataccttcctacagtgttttcagcatagcttattttgtgtgattctttgagagcaaaaaaaaaaaaaaaaaccccacgttttgggattgtagtgactgctttgccttgattgggctcctcatgggagccatttcttatactgaatctttcaccataccaaagagtgttataaccttcatgtacattttaaatgacagtcatattttacccttcccaacagggtttatgtaacatctttgtgcagtatgcttaaaatccacaaaactaaaatatctcaaaggagaaaagagaggttagtgatgaataaaaattgtagtgaagattgtcttgttttttccttctaaaattccttcctgtgtaaaagccgcctggccaactgatagtttttctttcaactcactgtgaaatatttttcttagcttgcatgttagcaccaagtgatgtatccattgtcactactgtgtgatatcagttgctgaggtgataaaacatggatttcttttttaacctggtactggaatggaggatggggaagaaaagagagtcaagaaaaggaatgatgcaactgacaggcatacattagtgaggtgccctattcatttatttcagtagctgtacatccttactttccagcactattgaatactctgtgggtggtaggatcgtgtgggggaaagagcatagttataatagctgacatttattgaacatttgctattctaagcacattatttatattaactcatctaatccctatgacaactatatggattagctgggttcaaatccggactcctccacttcctagctgtataaacttgtgcaacttcacttttttttttagatgaacaaaaactatccatctcttagggtagatgttagcattaattgagatggtagttctattgcatatataatcatgtctggtatataaaagaactcaaatgatgtaaaaaaaaatctctgtacacaaagacttcatggcagcatgattcataatagctccaaactgaagacagcccaaatgtccttcaactggtaaatagatttaaaaaagaattgtggtatattcatagtatggaatactactcagcaatgaaaaaaaggacatggatacacacaaaaacatggaaaaatctcaaacattatgttaagtgaagaaatagaaacacaaacatactgtgtgatttcatttatgtaacattctagaaaagcctaactgtggcaacaaaaagtagatcagtggttgccagaggttggggaaggagatcagctgcagaaaggtactaggaaactttgtaaagtgggggaactgttctgtatgttgattgtggtgattacaaaactgcatatgattactaaatttcgtaaaattgtacacttaaaaatgggtgaagcttaatgtatgtaaattatacctcaaagctagaaaaacacttgctgcaaattgtaaggttgtataacattagactttctcatattttagaacagttgaatgggttttatgcagctcgggttttcagagctacttagattatctcaaaggaaacttaatgcaggtgctattgagcacgcttcatacacatgcctatgaaaggtacaatggatgatgccaaagggacctgtgatagtctgtattagagaaattgtagagaaattgcagacagtttatatacactaaaccatcaagaaatcccatgagaattgaggatatgtgtcgcaggtgagtattggggcaggtcagaaagaagggagataatttagtagggataggggtggtcagggaaggcctctgacagaaataagacttgaaagtgttggataagttttctggaaataatttgagcagagatgtggcagttacaatacatacttaaaaatggctggactggagtatgttggaaagactcgaggactttgaggtctgtcagcttcacaaataaggttgcagagtgttcccagttctctagcctggagcttgtgtgtactggttcttaccctgattatgtcctcttccaattctgagtttagtgacgtttcatttattgcctgagattggccacgctgggaatatttaaagcgtgcaaattgacaatcattttggaaatctgtctcccccaacttcctacccaccccaccagccagttgtcaaccatttaccagcacactactgattgtaatcctgagaattatgaacttcagagaggggaacgaacagaagatccagaggtggctggagaggtgtagagagagccagaggggaaaaagatactcgtaagggagatgacaaggcacaaatattcaatgctgaaagagaagtaggatttttgttgttgtttccaagagaactgaagcagtaggatgccttatcacaagcacacatgtaaaaagcacctctcatacaagtcttttcagaccttcagtaaacagtgctcctccttgcctcaacttgtctgatatatacacagcactttgatggtcaatgcatgcagtgcagaattaggtcctcccttctctgtgcttcctggtattctttcagtttctggcacatggaaggcagtcgtagtggctgaatgaatgaaatcatgaactaatccttattgcggtattgctcatactgtatgcttgcaatacaaaaccttgcttacttgtttatctacctcattgaagtgcaaacttcagaagaaccaggaattttgtatcttgttgtaccctagcacttgccactgcacagttggtgctcaagaaatgcttattgaaataatgaaattaggcaatttcagttttagataacatgcaattaccaaaagatcaaatagcattctgttccatgaaacaaacccatgtcctttcttaaaacattcaaaagaggtgctattgagttatgtaaaacatgctagtctctattgtgggagggcattagtctgccaatatctcagtttctttttaacagtacagaaattgaagcaacttactatcaaagtttcttccagatctaagatgctatgattctaagaggaaagaaaattcagaccttgtgggcttaaaaccaggggtcctttattgctttctgttaaggtggaaagttatatatgacatagacattttctgtacttttggcttctttatatggattctatctatataagtgataagtgattaagtgaggttggctagtaattattgcctcactctattcaatttctcttctgtcttatctgtggtaggctgaacaatggcccccctagatgtccaggtcataagccatgaaacctgtgaatatgttcccttatgtggcaaaagagactttgcagatgtgattaagttaaggatctcaaaatggggagattactctggattatctcagtgggcccaatgtcatcacagcatccttataagaaggaggcaggagagttagaaggagatgtgaggatggaagcagagattagaaagataaagatcggaaagatgttatgttgctgactttgaagatggagaaaggggccacaagccacagattataagaggcgagtagaagctgaaaaaagcaaggaaatggattctcctttagagcttccgtaagaactcagtcccccagtttgggcaatatggcaaatccctgtctctacaaaatatacaaaaagtagctgggcatggtggcgcatgcctgtaatcccagctacttgggaggctgcggcagggggattgcatgagcccaggaggtcaaggctgcagtgagctatgatcgcacctctgcactccagcctgggtgacagagtgagaacctgtcaaaaaaaaaaaataataaaaaaaaaaataaaggtgcagacaccttgacttcagcctagcagaactgattttgaacttctggcctcaagaactttcagagaataaatttgcattgttttaagcgattaaatccgtggtcattcgttacaacagccataggaaactaataaaacatctcttctgaagatttaaaaatagcattctttgctttccaaatttcactgtgcataggaccacctggggatcttgttaaaatgcagattctgattcaggggggtctgaggatggtcatgaagatttacaattgtcttgagatcccagatgctgctgctgctgctggttgtagcccacactttgaatgggaaagctctggaggaggtattcattgtctgggcttctctttcctttattgcctttggtcatcattactaaaatattgtatcctgttgggactctttggtttctgtgagcatgtagagaattagaaagccacaaagacttggagtagagccaacatggggaggattttaaaaagctgcaattgttcaacctgaagaaaagacagaagatgatttaataatgatatgtaagaaaccagagagttaatatgtgggaaatggtgattaactgcccctcatctttactttacaggataaaatagcaagaagaatttgggcttaagaactccatactggcagggaggtggtggttctctttgactgttagaattgtacagctgcaagggccctgggatccatctagttgtacccactcattttgtagatgaaactgaagctgagagtgacctttggaaggtcacaagcaaatgacagaatctgtactagaactggtggcttggccatgttcactgcaccaccgcagtggaggctgtgccatggggtttagataattggtagttgctcatcactttgaagtgatttaaaattggggctgtcccagggagccttctagggtggcagaagtgttctgtatcttgctcttgggttcagttatacaggtgtatgcatgtgtgtgtgtaaaactcatcaagttgtaaacttgacctttgcatacttgaccgtacactgattattcagcaattttgaaattttttgctagcatttagaaaatgaaaatgctgaactcttcgttgtagccaaacactggaaatgatccaaatgtccttcaaattagactagatacataaactgtggcaaatttatagaatggatttctatatagcagtgagagtaaatgaactgtaccatacagcaacatagatgagtctcacaagcatgttggtgactgaaagaagccagacacaaaagagaacattccataggattctatctatataaaagtcgaaactgagcaaacttaacatggccttaaaagtcaggggagccgggcgcggtggctcacgcctataatcgcaacactttgagagaccaaggtgggcagatcacttgaagccaggagtttgagaccagcctggccagcattgtgaaacctcatctctactaaaaatacaaaaattagccaggtatggtggcacgtgcctgtaatgccagctgcttgggaggctgaggcaggagaatcgcttgaacctgggaggtggaggttgcagtgaaccgagatcgcaccactgcactccagcctgggtgacagagcgagactctgtgtcaaaaaaaaaaggggagtggctaactatgagggaagtattagggacacaaggggggctctacctggctacatggttatatccactttgtgaaaatgaagcacaatgtattcatttgcacattttctttatgtacatttcaattaaaagttaaaattggttgagagaggttgggagaagaacttctcacaaacctctgtatactattaagctttgaagaatttaggttttttaaagctttttaaattgacaaataataattgttcatatccatagagtacatagtgatgtttcaatgcatataatgtttagcagtcagatcagggtaattagcatatccctcatctcaaacatttatttccttttgttaggaatgttcaatatcttcttagctatttgaaatgatatattgttaactctagccatcccagagtggtatagaacactaaaacttattcctcctgtctagctgtaattttggtttcattacttattttttaaaagcacaggtggaggtaattgcattagaaaacatgtactttcatagaatccctggaagataacttgctgtggagagaaaccttcagttaaggagtctgtatatttaaatctcagttctaagccaaaagccatctcttctcttgtcagctttctctctgagctagtacagtctttctttcatgaaaatctatgaagccagcaccatcctcagatcctttttggccctttgtagttctacagaatgggggcattttttaaaagaagcagcttgaaataaatagtaattttgttaggagacaatgttgtcatgccaggcacacttccctgcagcagtgcctggagtgccacagttggtttcaaatggtgtgaagcggttccagacaagcagccgaccaaacagaacttgtcaccccaagccagaattcccccaaagccatatctgcttcctgccactggtggtatagtttcaaaccagctggctagcctacctgagataatttcatcatgtgaggttgtacagaaaagggttgacttgaccaatctgagactatcttggacaaggccagcttgcaaggttggcccttggctggcatcgggaacttggtggtaagcagttccctgcagtgataagaactttccctaagtgataaggctggttcaggatggctagactgtgctaacactatggcttatgctgaacacctttccttccttcctggagtctggaatttcaatatgtttaggcagagggtgcctccatgaccagcctgcctttctaaccagcttttctgggcagaactgtcacacatattattgtgacttcattggtaggggcaaagtgtgcccatgcgatatctcctgggaagagagagcataaggaagtctgcatgtggattcttccagactccacgtgtgtctttttccctttttttttttttttttttttttgaggtggtgtctcaccctgtcgcccagggagtaacctcagctcactgcaacctctgcctcccaggttcaagtgattcttatgcctcaacctcccgagtagctgggattacaggcatgcaccactacgtctggctaatttttgtatttttagtagagatggggtttcaccatgttggccaggctggtcccgaactcctgacctcaagtgattcacccacctcagccttccaaagtgttgggattacaggcatgagccactgtgcccagcttgtgtctttttcctttatgatccttgtatccttgttaagttgctgtaataaatattggctctaagtacaactatatactaagtcccatggatccttctgtcgaatctcagaacatggggtggtctttgggacgcaggtacctaagtgaatatttaaagtagttttcagcttttttcctgatgaaaataaggtgagaagatactcctgggtgcttctggtgggagtacgaacatggaacaacccttgtcgaggacatgttgtcagtttctagcagatcatacattcattgaccctttgatccaggattcccacttctggaaatttatcctgtagctgtaacaatacctgtacaaaatgatacacataaaaggtttttggctgggcatggtggcgtgcacctgtagtcttagctacttgggaggctgaggcgggaggatcacttgagcccaggagtttgaaggtcaaggctgcagtgagccatggtcatgccactgcactccaacctgggtgacagagtgaaacccagtctttaaaaaaaaaaaaaaaaagtttttgttgtactcttcccccagcctttatttgtaatagcaaaagaccagaaactagtattgtcctgtatggggctgctgagtctctgagggtacattcacactaggaatgactgcagctagaatagaacgaagaagttgtatgtgattaatagaaagttttctcatgtgaattaaatcaaaagcagggtacagaacagttaagtctagtactgtgtgctccttttctgggcgaagggtgtgtgatgctctgaataactattaaaagtggtgacctgtagggggcaagttagacagtgaatgaaggcagaaatgagaactctgtgtatacttccttatattgctttcatttttgtgtcaattacctattaagttttttttaattgaaaatgaaaagagctgagaggaggcagtctgcttgaggtgaatcaaaatcaaggtattataagtgaaataaaaattttacatacttaattttctctttgtttacatcaggtatggcccatgagtcagccacctgtttttgtaaataaaaaaatcttggaacacagtcatgtccattgttttacatatgctccttggctgcttttttgctacggtggcagagttgagtcattgcaaaagagaccagatggcccacaaaacctaaaatattgactattctggccgtttacaaaaaagtttgatgaccctgcacctgtagtgtttagttatggcttatatcagtgttgatgccctgcctaaggatatcaggatggattggaatttgattcatctgtagtaggtaaggccaatggtagtcatttgaaagatgccattttttataaactctgagcaaactcatgttacgtgattgctggggggtcaggggagggggattttactctacaaagacacattagtctatttctaaaacctgccaagagaaattttaagaagcaatgaatgatctcttctctaaagtgtggtgcctctgagacaatctaccttcctggcaatgataccctagctaaatgttgtctttgaagatttatatcatcagaatcatggaaactggacctctccaggagaaactgaggtctgcactgtgcaagatgggatcattgtccctcgatttcagctggttttttttttttcattgcatgcctgaggtgactttacccatccttccagaacaaaatggattattctttgagatgtctggtgattatcataaaccattatcatatggttctgtgatataggaccgtaagcaaggcatttgaataatcatgattttatatgagtaatgatgatagctactgttcactgagggcctactgtgtgtcaggcagcgtgtaaggtgttttatgtgtattacatctatttaatcttcccctcaaccttcagggattgatatgatcattttcactctacaggtaaggaaaccaaggcttagagtttaagttactgaagaggtgatgttgctggtaagtggcagaggtgaaattagaacccagctctggctcagaatctatattctgttccatacttcagtgacttggaatgggaattagttacgaggtagaaccccattcagattaactaactttttttttttttttttttttggagatggagtctcgctctgttgcccaggttggagtgcaatggcacaatctcagctcactgcagcctctgcctcctgggttcaagcgattctcctgcctcagcctcccgagtagctgggactacaggcatgcaccaccgcgcccagctaatttttgtatttttagtagagatggagtttcaccagttggccaggctggtcttgaactcctgacctcaagtgatttgcccaccttggcctcccaaagtgctgggattacaggcacgagcccccatgcctggcctagattaactttttttcaaagaagtgagttcaatatagttttaatttattggtaaaatgaatcattacaaatattttaaataacgataccaataaaaacaatgcttttattcattgcatgtcctaaagactacatgtagtttcattgacgtcttccattgactttgtgaaagatatttagtattctcattttttcaaagaagctggatattaaagagcttaagtatattgcccatactcacatgtatggttcaaccaaggtccagactcccatcccctggaacctgttctgtctactgtgctacatggatttaaggcttgaattagtaacttggcagactgactgtccaagagacaaacatgctgttcaaagtatttgtcctagtccatttgtattgctataaaggaacgcctgaggctgggtaatttataagaaaagaggtttatttgactcacagttctggagactgtacaagaagcatggcaccagcatctgcatccagtaaaggcctcaggaagcttccactcatggcagaagggaaaggagctatcacatagagtgtgagagaggaagcaagagaaagaggggaaggaggtgccaggctctttttaacaaccagctctctcaggagctaacagaggaagaacccactcactcccttccactcagagaggacattaatgtattcatgagggattcacctccgtgactcaaacacctctcattgggccccatctccaatattggcatcagatttcaaaatgagatttggaggggacaaacatccaaactatagtagtgttcctatattttattattttttgagacagagtcttgctctgtcacccaggctggagcgcagtgatgccatctcggctcactgcagcctctcctttgtaggttcaagcgattctcctgcctcagcctcctgagttggtgggactacaggtgcgtgccaccatgcctggctaatttttgtatttttagtaaagatgaggtttcaccatgttggccaggctggtatcgaactcctgacctcaggtgacccgccccctcagcctcccaaaatgctgagattacagggatgagccaccacaccgggcctatattttattactctcccccccacccccaaaataacatatattaaaaatgttgcttttggccaactccctgattctgtttctattccctttttgccatcaattatggtagttatgttctaacaaattgatttttactttcttgtgctgatgactttagcaactcctatgtgaaggtaattgctagttttattgtcttaacattatgctaactgttagtgtaatccagagtaatcaatggtatccagcctggagctgattatgttcaattgtttcaccaatcatttgtctgtatttatgatacacccatgtacacatctggcctccaggcaatggcaatgactgtgtgtatgaaagaatcaagtgaatgtaatgtaaggcagtgtgtgattatgtcaaaatggatgggacagggtgttggtgccgtaagagttcacagaaagctaaagtggtaagaaaatgccttgtggaaaccctgatgattctatcttcttggcgtcagcctacttttgaattcagcctacctttctcaaattctgtttctacctggtccaagtcaccatcatctctgatgtggattactatgcttactccctatttcttccacatttatttttttaaacaattgtatttgggtataatttacatattataaaatttaccagagtatttccatcactcagtaaaattcgatgagcttatttacagttagttcctattcccatctctagtcccaggttccttgaggaaccatgcatcaagttttcatctctactgtgtgcctgttttggacattttatgtaaatgggcttacatatgttcttttgtgtctggcttttttctctgagcatggtatttttcaggttcatccatattgtaccatgtattagtactttgtttttattgccagaaaatgttccacagtgtggattgaccatattttgtttatccatgtaccagttgatggatgcttagattctgtgaacattcatgtacaagtttttgtgtggacagaagtttttatttctcttgagtatatacctaggagcagaattatcatatgataactctttaactttttgagaaacttccgtattgtttcccaaagtagctgcatcattttatattcagtgtatgagggttcctggttttccacatcctcactaacacttgttattgtcttttttcttatagccattctagtttgtgtaaagttgtatttcattccctctttcagtctctaaacaaccggcagaataattttttattgtttttttacaaatgcatatctgctatcttacaccctgactgaatctctttaatggcttccatcacatgtaaaataaagtctaaataaattctttgacctgttgtcacaggtcgggttccctaggaagtacactctgagatggagaggtttgttgaggattgctttcagggtaaacacctgtaggggcatgaaagaagcaggactgagcagagggagaagttgggctgcagcatcatcccaaccaaggtctcagcttatcctattggaaccttcagaggtgggaaggctctgcaaggttggctggacaaaggatctgggtctttatgcacccatattgaccagtcactgagtgccagatgcccctgagccagggacatgaccatgggcaagacggctttcttcagtagagtacaatcactaggaggaagtcctcagccacaagctgtcatctgtcaactttgccagcagctgggggtatcagtatatcagtccggaaggaggggaatctgggtgatatattacagcatccactatacctgagctgagagccatcacattctggtcttctcgacttatctcttaatacttcctttcttgctgtctgggctctagccacactgctttaaatttctttatgttctcaagtttcttccaaccttaggatctttgcacatactattcctattggtttatggccataccaatttaaacacctccaatcttatctagaaagtgagagcattttaaaaatcagtgtttaaatcgtatttgtaaagttgcttgaaaaaggactaggctattaggctagtgttaaagctgtcatttggagggcctttttagctttattataaattccaatattgggaattgctcatttgacatgatgtataggagccattttctaatggaccagcattaatccacttatagctgagtggccaacagattagcaagcacttccattttctataaagaaatggatattgtaaaggcctgggtgatgctgaggaggaggctcaataggatcatatttcttgtattcaaactgcaaaaatataagtaggattaatgttatgttagagtttagatggaggtattaatacattgcatttagaaataatacactgaaatctataaagaacaagagtatttgtttaaagtagactttggagagaaactcattggtaaatcttgaaatttggtctctaaataattaaaagttgtttggattttttaaaaaattgccatgtttccctcttaactgattttctgccaaattttcctgttcagcactcagaacttgggcagcagttggtgtgtaagggatgtttgcacacatataagatggtgttttttccttcatctctaatgatttcataaggtctcagttctatatgacatttggattttgaatttataataccatgtttatatatttaacatggacacatggcaagtgctgggaattaaagctaaatatagacttgttgactgaacaatcaaactatctgcttgtcttagtccattagtagtagtttcactggtatggttgatagaaagcactcaccctcctcatacgtgcatgagacgaggccaagaagtgattcctgtgtaaattggcagccatgacagtaatgatgtttgcctaaaacatgtgtcagtaataggaaagatgattaggcaaagaagaaaaagtttaaaaaaaaaaaaaaaaaaaagctggcgcagtggctcacgcctgtaatcccagcactttgggaggccgaggcgggtggatcataaggtcaggagatcgagtccatcctggctaacatggtgaaaccccgtctctactaaaaaaaatacaaaaatttagtctggcattgtggcgggcgcctgtagtaccagctacttgggaggctgaggcaggggaatggcgtgaacccagagggcggagcttgcagtgagctgagatcacgccactgcactccagcctgggcgacagagcaagactccatctcaaaaaaatgaaataaaaaataaaaaaaaagatggtcgagggagagatgcgtatttgctctgagtgttcagagatttccttacacttctctatatagataagaaaacaaatatgagcccacagtgggtataaagcaacctttttctaagaagtggactggaaataagtctggtttttggttcaaggagggcctgggaagtatccagcatgatgtccgggaacacagatcagaagtagacaactgagcctagaaatgctggggttgagtgggagatgggatggatgcatgagtaggtgggtgcgtgggtgggaattcagaatttcgtagaggaaatggaagtagggaaaagggacagcactcaggtgggaaactcagaggtttagctgtcactgggagacagccaaatgggagaggaagggaaaggtggaaaatgagaaagagagaaaggaatgcagaatggagaacggggttttggcattcttttctgtccttacttgttctacctgtgataaagaacccatcagtttggacacagtgtcccttcatggcctggcaagaatcctcagtaggacacaacctcctacgtgggagtggtgattcagaggaaacacatggtgaggataattaatttggaggttgaccatgttctgtgtgggtgtttacctctttcagaacatgtagctgaaagttcagcgtgtactattgaaaagctttcttgcaacgttgctggctgtccttggtcttgagactaaagcatcccatagaagtggtggaacgctaaagattgaaacaaaccactgaaaattgatttataaatatataactagttgtaagctgaagactaaagcatcccatagaagtggtagaatgctaaagattgaaacaaaccactgaaaattgatttataaatatataactagttgtaagctgaaatctaaataactttttaagttaaatatatatacaaaaatattagaagaaggagaattttcactctcaactcattcttgcatagaaaaataaaatctatcatctctgtatattagaagcattttgtttttggaagaggttgttggaataggttatatggaaggccatttcattcaaatgaacaaaaattacgtgagatggaaattggcaaatttatcccaagtaaatactgaaaaacctggaagcctttcaggtgctcagatttccactatagaaaagaaaacattctggccaggtgcagtggctcatgcctgtaatcccggcactttgggaggcccaggtaggtggatcacctgaggtcaggagtttgagaccagcgtggccaacctggtgaaacctcatctctactaaaaatacaaaaattagcagggcatggtgacgtatgcctgtagtcccagctactcgggaggctgaggcatgggaatcgcttgaacccaggagatggaggttgccgtgagccaagatcacaccactgcactccagcctgggcaacagagcgagactccgtctcaaaaaaaaaaaaaaagaaaaagaaaaaacgttctgaaaataaataaaaagaaacattctggcacatattagaaggtaccagagtaagagaggcaagataaatcccagctttgttggtcatactgcatatcaaaaacaatgaattgtcttttctgttttcttatttttgtttagagcatagtcagtggttcaagaactctaagccatagatagctcagacactaggaaagatgttggctgactttgagggggaaccacttgtagctatagacaaccagaaaatgctgtggtccataccatgaaatattttgtcttactgaagtttgaagatccttccagatcccggcattgatctggagaatgatattctccacatacttgggctccaagtctttgtgtccagggcttggcaattaccttattgtatccagtggaataataattttgatgctatttgttcaaataattctgaatgtactaaatggatgacattgttaaatgggacatttggctgttacaggatgtgtgtgtgattgattaaagcaaattttaactgtcagaagatgaaggcactaaaagtttttgccatctaacaagcatcagtcagatatgaaaataggtgtttccagtcacttttattaataacataatcaacatttgtgctaaactagagttctttcaaaatggaatttggcaatgccaaaatagccaaaactacaaagctaccgtgtggtactggcctaagaatggacatatagatcaataggatatcattgagagtccagaaataacccttatgtttatagtcaattgattttcatcaaggatactaagacaattcagtggggaaagaatactcttttcaataaatggtgctgggacaattggatatccacatgtaaaagaatgaagttgcacccctacctcatatacacaaaaattaactcacgatggatcatagacctagatgtaaaaactaaaattataaaactgttagaagaaaacacaggagtaaatcttcatgaccttggtttagacagtggtttcttagatgcaacaatagcaacaaaggaaaagaatagatacattggactttatcagaattaaaaactattgagctgcaaaggacaccatcaagaaagtaaaaagagaactcacagaatgggagaaaatatttaaaatcatatatctaagagacttgcatccagaatatattaaaattaataataagacaacccaaaataaaaataaaggatgtgataggcatttctctaaaaaatttacaaatatccaataagcttatgaaagatgttcaacatcattagttgggaaatgcaaattgaaaccacaatgagatatcacttcacacccactatcatggctgaaatcaaaagacagtaaatacatgttggtgaggatgtggagaaactgaaaccctcacatgctactagtgggaacgtaaaatggtacagctgctttggaaaacataatggcagtttctctaatggttaaatataggattaccatatgacccaacaattctactttcaggtatatacccaaaagaaatgaaaacttgtgttcacacaaaagcttgtacatgagtgttcatagtagtagtgttcataatagccaacaggtggaaacaactcaaatgtccatcaactgatgagtggatcaacaaaatgtggtatatcctgcaatgcagtatgattcagcaataaaaagaaaggaaatactaacacatgctacagcatcaatgacccttgaaaacattaagtaaaagactccagtcacaaaggactacatatccatgtgtccagaaaaggcaagtttatggagaaagtagaaagtttatggagaaagctcctaatggttgctttgaaccagagttgaggggtgagggtagggtagggaggaatacagattgactgctaatgggatcttttagtagggactgaagtgttcaaaattagatcgtgttaacagttgcgatcatatattttgaacaagtggaaaggggggaatatattaaaaattgtacacttaaaatggtgaattgtatggtatgtcaatgataataaaggtgtttgttaaaaaaatgagttttggcttcatcgtaatcagtgaaagaaatatgttgagtaaatattaatacattattttatgctgtgtccattgactcatattttaatctgggaaatatgcatctttaattactgccattgtgtgcttaaggctgatgtgtttgggtagcttttaaaaaattttttttcttttaaaaaattttttgtagacatgggggcctcactatgttgcccaggctgctcctgaactcctggcctcaagcaatcctcccatctcagcctcccagagcactaagttataggcatgagccaccaggtctggccacagatctttttgacaatggaaatggttgttctttgatcaggtcaataaaataattactgctggcagagggatgtgcctcctgttcaatgtggaggtcattaggggcccctgggcttcataaaccacagggggaaattgagaactacttagtgtttctatgcactgagctcctaccgacgtaatgtgttaggtgtctaaatttgcactttatgatatatttcgccaaattttctctccctggcaatgaagtgatgtttacttaacagtttcttaaaagagatggtactctgtgatccatttttatttatgataggaaaattacacttttattttaaaagccaaaggtcatagccattgcagatattctagtaattattatttgagaaatcagttctcactgaatgcaatgacaattttctaaacctagaataggtgctgtggcgtggtaccagaggagtaacatatgtggcccttgttccatgagagatcaaagtcgttttggaatgtaaaacttaaacacatgaatattttggagaaaaagaatgtcatattgtagtaaattggggggacatagacctatgacatggtgagaatcgattcattgaggtttcccacaagctgtagcccttgagttgcaccttgaagatgaatagaatagaattagaacaaatcgaaagggaggaagagtgagaaggaaactggtccaagaagcagaggtgagaaggtacatggggtagccaagagaaacatggtgggtgagcatggcagagagtccagcaatccatgaaggtcggtgatagccagcccatctattaagcaggggttccattgtagattggttgaacaactccatgaaagtgttagttctggacagataagccttggcctgtgatttgaagtgggagaacatagaagtagaaaaccaggtagattgccattacctccacccaagtctgaggccaggaggagaggctgaagaaaggggtgagggtggatttaaactactgacaaacacctcccaccaccgcccccacacatgtatatttggtgactaatcaaatgtggggaaaccctagctaactcatgtattttagagagaacatgcctacgatatgtaaaggcattctgtagatcttggatgactgctccagactctaaggtgatgtgaaaatatattatgacaaccatcatacagacatccagagggatggaagtgagataacttcccatagcgacctagctggcaaatggcagagctgaggttctgaagtcttgaaatgaagatgttggaagggtagtgatgcctttgatgggaaggacagccttgggaaggatgacggaggcatctgctggggagtgggaagatgaactcaacttatcatactgagtttaggaggatgtgaaatatttaagtgaaagtatgtgtacgtataaatgtgtatatgtgcatggatacatatgtatatgttatgtatatataaatgtgtatgtgtgggcacatgtgcgttcatgcatgtacatatgtttattcatatatgaacgtctaaagtatgcaggtatgccttatgcatgtatatatgagacatgcacatacacccatgcatgcatatatgcaatcacatactttcacttaaatattttacatcctcctaaattcaaaatattctaagctgaattcatcttctctgtccctatccgacacctcctttgtgcttcccttcatacgtgtgtatatgtgcatatatgtaaatgtgtatatacctacatacacacacacacacatttgtgtgtctgtgtggtaaatgagccattagagcttagaaaagaaatcatggcctaaaatttagaattgagagtttggagccgggaggaatcatgtgaatctattataaagggtaatgtccggggagaggagagagaggagccttttgaacattcacagatagatcacagggagaaatggagatgtagccacaacaaaggaagattcgctgggggtggaggaattccttcttacttgggcaactgctctagggagtgctagcttccaagtaggagcccaagaagtatcatctgatgtttgtcagtatttttaaaaatatatttattgcgcttctactatacaccagtcaacaagtgaggggatggggacaccaggaaatgtcaggcgcgtggtgtcagccttcccggagcccgcaggcagggaggtcgtgctaaaattgctagcatagcacactgaggtgagctgtggcttcccagtacagagcagcttagattgctgtaggtgggtggctggaggcaggggttacagaagagagcatcagagctgagcctggagggttggtggcatgctgcttagtcaggtactcctcttggaggacaggaatgaggtattgcatgtaaattccttagctaaatgaaatatgtctttaaaacttttcgtccaagtattacatgccttctcaagctatcattttaataaggtccacattgccaattgttttcatttgtggattgtacttttggtgttgtatctaaacacctttgtcaaaagccagttgactacatttctgtgggtctatttcagggcgttctattctgttctactaatccatgtacgtccatttatcactaccacactgccttgatctgcatagctttatagttgtcttgaaatccagtagtctgagtcctctttgttctttttcagaataaccttggctatcctagattcttttcctttccgataagaactttagaatcagcttgtcagtatctacaataaggcttgtcaggattttgacctgattgcattaaatctataaatgaaattgaaaatgaaaccctcattttgaacatcagttttccagttgggctttaattcctagaagacctggaattaggagaggcccaaattgagacatgatccaggccaatgaaacatcacttaacagggaaagaggggtgtgtgtgtgcggtacatgagaaagcgagatggaaatcagaaccagaaagaggctgagccaggatcaatgactggagactcggtcccacaggcatggatgttggtcccagtgtggtgtatcgctgaaaagagtcaaactctgtaaaaatatttaaagaagtttattcggagccaaatatgagtgaccacggcccaaggcacagtctcaagaggtcctgagaacatatgtctaaggtgattgggtaatagcttgattttaaacattttaggtagacaagttataggcagacatcaatcaatacatgtaagattggttcagtccagaaaggtgggacatcttgaagttggtggggcagagtccagaccataggtgcatttaaagatttcctgattggcagttggttgaaacggttaagctctgccttgaagggttgaaatcagcaaaaagaaatgatagtagttaagataaggggggttgtggaagccaaggttcttcttatatagatgaagcttccaggtagcaggcttcagagagattagatggtaaacatctcaaagtattatgggacctacaaatattctgtttggtccgttctgagatctcagttttaatgtgaatgctggtcagttgtgccttatttccaaattgggaggagggtatcatgaggcatcttggtctgaactagtttttcagatttactttggagtccccttggcaggaggggtccagtcaataggttgggggcttagaattttatttttggtttacaggaggatgggcagagctgagcacctaggcctgagggagagggacaatgtctaggcctctaataaaggcaataggctacagtagttctgcagggaccatgtgtaggatgccaagcacatggtcccttgccatcaggttcagctgcctccccttcctccctttgggcaggggaaggcaggaatgcatgggccttccagagcctagctcagcccccagctggtgcctggttccaccttggcccttaggagagctctgacactctgaatgtcactggccttgtcttaggggccttagaaaccaatgagtgataattaaggaactggagcttgtatgaagaaggtgccactttaagtgtccctgatggttttgagttgccactaaagagctcagagccctttcaaagaattcagtctgagccagatgaatcttaatttctcaccctcaaattgagatgcagtcctttggagaattaatatttagtggcatggaacacaaatcatttcttttgctggactcttaaagatgtactagattgattttgtttttatgacctttcaaaaacatcgcagtctgttttgctagctccagcctgttgaagttttagaactcatctttagcaacatcaaaggtgacagggacagcctttgagaaaggtacgcatgaagtgattgctggcatcccatagtcaagtctcaggataaagcatccatattgcctttttttttttttcttttttttcctttttactagtggagataggaaacctataaataagcatggcagaggtgtcccctctgaagattgccccttactaagtatttacagtaactggatttctttattttgtcagtttctccaggaagaaaggtgatgtcatgctccatagcaagatgagagaaggagtttagggtttgtaatttttttttaatcaaagaatttaattgcaatttaatgacgagagagaggatgtttattacacggtggtccaataaatactttctaataagtttttaagccatttgagggaaggcttgctacaacaaaattgacaatcaggcaagccgctttgaaggaagcaaatccatgaattttcagacactgttgctaagcgcagctttgctttcccctctgcttccccccccccccccccccaccaacttgctttgaaaaagcaaagcttaaaagcctctattgtgtggagggggggaatatgctaatttgcagcacatttcccatcagactctttttttggcctgtcatagctgagatatgaatgatgataaagagaggagaaggtggcattatgagggttcggggttttgttattgtgcagagagaaaggggatgaatagggtggcacctccagtcacccgtgaagcccccctgggtctgcgggctgcctggagttgagtgggttctcatgggtctgttctgcccttcccccaggcactgccacaatctactggtgactcagcggccccctcgggggaaggccgtgtgtgtaaaatgaataaacacgccagggtggggaacttctacaggggactaggaaaggggacttctacctcctagataagtcgtaacaaagaaaaagagaaatcagtgttttgacatggcagtaacaactttatgagatatcaaggttgtgattgaagggatatctagatacatatcccttcaaagctgtcatgtcgtggtttcatacaatttgggttgcgtttatttttgtcaagtcttcagcttattcagttggctctcttgccggataactggatatgtagttaaatttttatgcattaaacattgatttttatggggcaaagttagctagcatttctgaacaatgagacaacagtattggatgcttactcctgtgttcaacaatatgaaaaacatgttttccttcttgctctgagtggttgattttttttgcaggaaagcgcattgattttgttcctcgtgagcactccttagctcagttttttaaatgtatgaattttataactgaagaataatgcatgcattagcaaacagctattaagacctgcaaaagtgcttccaaattgaaatttcgcatgagtcattggaggcaatttgtatatgtcaggtacacacgtagtgtgttctgtatagttcatgaaagtgaatcgtttgaagctagaaaaggaatgttaattgcattctaggtttgtgttgagtacttagtcgatactgatggtagtatgctttaggtgtgaaacaaaaatataggatgtctttactgcaatagtaaggtgcttttaaaaataaatacataaataaataaacatagcatctttgcttctcttgactctaaattctgaacagctaaagcatgacaaatctttgcactgtaaaaatgggacgttatttatatccacagaacttcattggatagaaactagggttagagctcattcatttacctctacaaataggtagctcacttatccagatgcatgcaggtattaaatgattaagcctctgtagatttttttcttccttaaattaaggtctggagtcttctgtttggtgagtctttcactggtatggtaagcatgctttagcattagaatcacacaacccatttaagttaccattaatttttttctgattgaagttgtagcagatcaaggatatcatcgtgaaggagcagatcagccacctgtatgagtgatttaaagtgcaaactgctactggttgtaagctcaagacttgtctcattcaaactctggcaggtcacaaaacgtttaacacatcttgcttattaacctcaacaggtggtgtaagattagcatttgagagccacgtgttctgaagaccatcctgcatttgtttgagtcagctttggcatgcggctaagctgtcactctgttcatatcttcagaaactagaagctaatacattgtcttgccaagcatttttcacatctagcactgatggtgtacctctgtgttttactataaaatgtaaaagttgaatgaagttgggagttaagcagactctgaaagtgagacttcttgtcactgatttgaaactcagggatgcactagcccctcttagttcttgatgtttcaggcaaaaccctgatgatggtgccatgactggaaaaaaatcctgtatagacagctttttaaaaggtacacgtaagactagcttttatctacatgttgtatttaatacttaatctagccaggaactcttctcatctgtttactacatcctcatttaatcttcccagtcacttgaaggtggatatgactaaatattacagtgtacaggtgaggctctgaggcaccaaggagttaagaaacttgctcccattgtagagttgaagaaaaactcctagctttttcactggggtctaggacaccccccaaaaaactgaaattcctaaaagtgtatcagatagagaacttctgattatttctcaagtacccattcagatagtatttcttctaggaagccgtgcttgccacacatcctctgccccttccagcttttattggccattcttgctggcagagttaagcttgactacatacttgcccccatggttccactcatccttccatgggttgtatgagtttgggaaggctgaggaccagatggctcttgttggccatttagcaacaccaataatagttgtcccgggctagatgctgggtctatactggtgaatgaatgagacatggacccaacattcatgtactcatgcacggtttagtctgctgagatgctctgtggttctagctgccatgacagtggcaccacccccacacacagggaaacaggtaaatatttgctgaataaaaaaattaatgtttgtgtccctctgttcacatgagcccattagctcctccagtgagaagcagtctccactctttttatatccacagtacctgacacaatccttggcacatggctggtacttgataaatatccattaagtaaacagatgagttattaactgacagctaagatgtttcgaactggtatgtcttaatacgatgacaagtatccatttattcttatgtaccactgttgctgccttccactgagaagctttcctgagaatgagtgggatctcaggttgagagctagaaattgcttataatccaaggttctcccctgtgagtgggtggagcaggtgaccattatccatctactatactctgacagagacaggttgacaagctccatcccagagttttattgccttcatgaaaaaaatttttaagccctactctggcctcgcctatcaatcatcacaactactttttattgactgttccttggtcttgagcaaagcccatggcatgcattcgcttacttaattgtatggcatggtttgtcagtggcttttcattaaaaagataaattgacattaacaagcattgatttccaaagatttatgttgtcttctctattgtgctctctcttggcccagtaagattttacttttaaaaggcattttgtaaaaatacaggaatgtggcttggcaaagatgtatatctttaggaagaattatctctgcctagtgaatatattgtagatttggcatttgagccttatcctaacagaatatttgctttgctaactatacatcaggtgaaaaaagagcatgtttgggtgggaatcaagagacttgaattctttagtcctatccatcctgattacagactggaaaaggaaagatgagctggatggttttaaaatttccctcctgttttagaattctgggcacataatgtttatttcaaataagaccggataatcagaagaattgaacaaaattcttctcgttgtagtttctgggaagaaatcctaggttgtttgactccagtgccttcatcttaaatgtctgtgtggtaaaatgaaggtacatagcctgccctctcagggccctgggtgacattgtcaccttcatggcatgaaccaaagacaaagcccaatggcagagcactagaaaccttcctctctgaattgaaagccatcacttagttaccacttagaaagcacgttagcccgttctgattccacttgagtgtatgactaactgacctcaaattgtttgtacattgaaagcacagatgaacacagttttgtttttgttttttaatagggtctctctttgtcacccaggctggagtgcaatagtgtgatcatggctaactgcagccttaaactcctgggttcaagagatcctcacccctcagcctcctgaataggactacaggtgcatgccaccaagcctagctaattttttttctagtttttttttttttttttttaagagatagagtcttgctctgttgcccaggctgggctcgaactcctgggctcaagagatcctcccacctcagcctcccaaagtgctgggattacaggagtgagccacagtgcctggctgacacaatttttaaagtgtaccattatgttgctaacattgcactatcttattctcaaatatatggaaagaggttttatcaaatagcttgtgaggtcagcatagacaatagcattcacttgatctagtaatcctatctaaaaatagaaaatacatttgtttcggcaatacagtatgtcattgatgtagaaattatgaatgtacaattacaggataaattaaaactgcccagcccttaagttattatgggttaatgcgagtggatatttgtcatctgctgtatgaatgtcagcgtcatacacagatttttagggaatgctgaatgtcagacagctcacaaagaagcaaagatcataactcactataacctcaaactcctgggctcaagtgatcctcttggctcagctcttgagtagctaagactacaggcctgagccaccaagcccaactgttcctcagattttgacctttcctctgagatgatctaaatctgcagattctgtgctatgaaaacattgtgtgctttttaatgacttaaaatattattggtagattccatgagatcactgagatttactcttcattggttgccctttctacccaataggatattttatgtttgacctggcagggatcattatttcaagttgtcccaatgcttttcaattttcaaaggccactgactatttagtggattaaaggacctaaatgacttcatcctacttctaatttccatcctagaaggtaaacagatgagacaattgaacagaagattgcatttgaataatgtgaatatattttaaaatgtgtggccttgtcttagtgtgaattatcatcagcaatagaccaaatgaaatagctccaatttttgtgcagtttgtgttttataccaaccgtggaccacccaagcagctgacccaacaaggcactggttttctgtagactttagtctgagggccattgacttacatatctataagtcctgggtactttcctgaactagcaaaagcaagaatgctaacatcagaaagtaaatttcggatacttcaacaagccacatgttggtaaatttcaaatattttgtctaactgcgtgttggatagtcacgttcttctgtaaattaatggttttcagtctttggtgtatctcagaatcacctggtgtgaggctgctgggtctaggatgttcatctcccttcatttgagtaggtagcttcatgaaagtcacacttgcagtagagtcaaaggaaggtgacaactacatgctcactcagatcacctgaatccaccctgccagttagagggctggcaaatatattcctcctagtctatcaatagcctgtttttttaattgtaaaaagtacataaatatattgttttaattatatttaacaaattgtaattcccagttcatgaaaagatcttaaccaatcttaaaactctctatcagatttctgttgagggtggggaaatacattcgaatgttaagtttggtttttcaatttttatatatttgatagcactaaattttatccattttgtttctaaaatacatctccaagcagataacagagcctgaattttattataaaatatctttgtaatggttttattggtttatcttttcattttttgctcttagcaatctgaagataataatttcagtgtaactgctttgagaggttgaagggcacaggttagtaagatcaaggctgagaaaaacttaattgcaccatatactttcaaagaaacagttttgacatcttgccccaaagaacgccaggagcccagtggaatccatcccagggttggatgatgtttagaggtcagtaagagcaggtgcacagtcacttgacctgtacagtcagaggatggcttaggtcaataggagtggtgatggagctggggccatgcctgctgggttgtagggcttcctacctgatgttcttttttccttataaccatcctgctgaactggtcacttaagacctagcgtatcttagagccaggacaagctctataagcatcttgtccatggcctcgtgactggcaagtgacagagccaagattagaaccttagaaccgagacctcccaattcccatcccaaccatcagagccaaccatctcaatagatttttgagaccctaaatgtttagacagggcctgattgtaaataaaccagtttccatgtgggtcccccaagccatttgtgtgtgtgtgtgtgtgtgtgtgtgtgtgtgtgtgtgtgtgtgtgtgtactgagctcttctacatccctttactcaccatatattggaccgtaagcctgtgcctgccttgtactatagtatccatagcttatttatgaaatgtcattgagccagtaaggggaaggtaccagtgacctgccacagcagcaaaagaacagactcctatagaatcatcacatacacccttaatcccactgaaattgcattagcatgccaccacatggccacagcgacccctgccccctttcccttgcagtgacaatttactggatcaggccttgcagtgaggggccagcttctgaacttgcagagccaggtacaaaatgaaaatgcaggccagttgttcaaaaggcaggaaaaaagggccattcacgatactaaaataaaaacgtttccctttcttccagtttctctctcgatttgtcaagacatttttgtttgcaacttaatgtcattttaaattattagtgtgaatcttaccaaccatccttcaattgtacagtgcaaattttagatgcaagtttaagaccatttgccatgtatgtgggatcactgacacacaatttgtattttgtagctagtacatacgtgtattttatacgaactagaacagtggaaatgctgcacaaagttaactcaattgttttgattttacttattgatattagcacatcctcaacactccctccctgtggcttgctagtaagtaaggaagaactgaaaggaaaaggaactcggttgccctatctttccctttccttctggattattttcagtttaagtgcttggccaatacagggaagtaacaggagtaaggaaggatatggtcaggttccttggtcattcatgtctcttagaactccagtaccttctttctgcatttgaagcaagttgagcttagaacagaaagtgtgacctttaggactgttcacaccagtgcttacttagtcatagatggaacatgcttaccttttacggactttgagtccttattgaactccccatgcaccagggattcacaagaattctgagctcatgggacatcatgaatgtggtatgcaaatgaggtggcaaggagcacgtagctcctttgctcacatgcgtgcatcatggtcccgttggacttcacttgaaaacacaggttcgaagataaaatgattaagaatttcaagacagtgccatcagagtattaaaccaagcttcaggcccttctgagggcaaggctctatgcacatcacatgcccctgaagctgaccctgcttgcctgattctctgacatgaagaaagaaattccactgtgctttaaaaaaaaaaaaaaaaaaaaaattcaggacagatttaatttggacttgagtacccaggtgttagcaatatcctacagattccagaaaacaatttagtccattgttgaaagagtacccttgaaggcatgtctttttttaatcccattatcttattcatctcagttccttttatttatttgcaacttagtcaatctcaggtctcacatccaaattggacctcctcagggaggaccatgctacaatttgaggacagagcacaggtctggggtgggaccgggtggagtggggagtgcccctagaaatccaggccaggcaagggcacagaaatgaacttttcagggtcagggaaagatctagaaggacgtgaaatcaccagctagtctttcctctctctacctctccctgggacctgtatgatggtggtgggagcataaaggactttgaaaatagaaatagcattttgtaagtgtcatgtaggaggtatcatgctgaggtgctgcatgcagtgttacactcctaacaatagccttatgggggaagttctcttatgagtccttttggtagacaatgaagctgaaactcaggaaggtcacatggtatcataaggctggtaagcattggagtggggctggcagggatgctggacaaggttgcagacatgagagccttcctgagttgcggaagtgtgtggccccatgttttatcagagtttgaaggggaactccagattactaggttttggggagatagttgcaagtgatggaatagccattctgagtgaagctttctttggtggtgacctggaatctctgagttcaacagttgatgctgctgatcacctagtcacctggggccttattgagcttttgttcctgccatcattgctgcctgactcttggtttccctactctggcatccagtggcctgagtcaaggttcagctcagcttctgaccagcttcttgaccaccttggccaagtccgtgtacagctccctttggtcttcgtttcttcatccatgcaagggggatggatactgtcatgaaggcaaaaatgaaagaacttgggttaaagttattgtagtagtgctggtgctgaggagaccctcagctttgagtgttggcttctgtccattcctcctgagctactgtcacatctcatgtgggtgcagtgggtcctctggacacagcgttgagcccagtccatgggttcctcatatagccagcaccttggcctgtagcaaataaaaacaaaccacttgaaaggaactcgccaagtatccctgatagctggcactcacagtttgtttgtgtgatgactttgcgtattagtcattttcctgttgcttataacaagatacctgaaattgggaaacttacaaagaaaaaaaaattatttcttacagttacggaggctgagaagtgcaaggtccagggggctgcatctggtgagggccttcttgctgatggggacagtcccaaggtggtacagagcatcacatggcaagggggctgagtgtgctaactcaggtctctcttcctcttcttatgaaaccaccagtaccctcccatgataatccattcatccattaacacattaatttattaatcatgaatgattaattatcatgacccaatcacctcttaaaggactcacctttcagtactgccacattggggattaagtttccaacacatgaaatttggggatacgttcaaaccataacagttggtgatagttgcagaggagcatgtacaaagattagaaaaatataaccaacccctgggtttgttggatgctttctgttgctcagatcattgtgacatgagcactgtaggaggggtggatttgaaggggtctggttccccaagaggtatgtgggcatctgtgtgcctgcatgagaaagcacctttcctggcagcccgacaggtagaaactcattaatccacacattgactctatttcagggaaagatgacgtcaactcctgcatgttgaaggcagggagtggctgaaacagcatcaaggcgtgaaggcttccctgagccaccctgagttctcagaagggttcttaaagaagtcacgtcatctttatcgctacttctgctgcacttatcccataattttccaacttctgttgtgagaacttttacagcccaagtgtcctgtgatttaaccttcaatttggtaatgtctgtcttcctttagcaaagcaggctgaaggtgttgagatccgcctaccttgggaagctttccatggtggcacagtattgaaggttaggcctcatccaagttggcacaagcctttgtctccaacctgggtgggaggaaggtcaaggcagatgagtgtcctttcagtgcagggaactgccatccagggaggcttgcatttataactgagagacagcggggtgagttagaatgctaagaagggggaaatgggctgggcgtggtcacacctgtaatgccagctatttgggaggctgagacaggcagatggcttgagcccaggagtttgaggctgcagtgatccatgatcgcaccactgcaccccagcctgggtgataaagtgagacctggactctaaaagaaaaaaaaaaaaaaaaaaaaaaaggaagtcggtagttcaccaaggaggctttctaaaggagatggactttagcccgtgcctttcaggaggggacttggagctggggagatggggagacagtgcgattgggattttggcagatgatataaggcaaatcctcagcagagcaccccgggttccaccagctttgtggttgagttgcagactctttgagtgagagaataacccagccccggtggtttctgctgaaccgagaaggaactgctccagaaacatgacagggattccaataacggcggttaaacagctaacaaagaggagtctggaaggctggcccttgttcatgttggctggaacatgctgggtagatgagttaattgggggccctcacagggaatgctcattgtgccactcttaatgagagaatccaagtgccccatgggatgtaataattaggaagcatgttgtcagtagatcagctgtctgtctcctgatgtatgccttgtgtacacaggaagaaatagaagctttcctttaaaaaaaaaacaaaaaaacaaaaaacagggtctcactctgtcacccaggctggagtgcagtagtgtgatcatagctcactgcagcctccaactcctgggctcatgcgatcttctcacatcggccttctgagtaactggaactataggtgtgccccgctacacttggctatcttgtatgtatgtatgtatgtatgtgtgtatgtatgtatgtattttaatagaggcagggtctttctatgttgcccaggctggtcttgaactcctaggctcaagcaatcctctgccttgacctcccaaagtgctgggattacaggcatgagccacactgtacccggccagaaactttcttaaagctagtttaaaaaccgatcatttggtcctcatttcccattttggctttgtttcttcagtgtggctctgtcatgttggggcccattcccctcaggatgctgagacgtaaggtaagggtattccttgtctccttcactctacctccctagggtctctgtgcccctggaaactcagccctactcaggtccccgggcagtctagactcagggcaatccacctacctcactaagacccaagatcatcgtgccttccgttttgtcacccataaaacagagctgatgctttctccttcttagggctatgaggtgaactaaatcaagacacaaatgtacccttctcaatgctggacaggttgcccttttaacctctccatccctaccacctcttctaagatgaaattccttaaatcttggagttggatgacttttccttttccctctatttcctcttcctcacttccatttcagaaggagaagcatcacatcctgccacccacagctggccctcttcctctcctgtgatctccattcatcatctgtccatcttcaccggcatcttttgaaacctgtctttcagtggccgtcactgccttttcagcataagacatgtttgggcctctcttcctgactgtgtttttctccttaagctgcctgcatctttctctggccttcccctcaccaccaaatttctttagaaagtgggctgcccctgcttcctcttcttcacctcccaaccgaacttctgtagcccccctgtaaagtggtttccattccaggctttgcactgatgctggcaaggacatcggaattttccatttcagtggcctttgccaagtcctcgccttctggttgccttgactgtggggacaccccctccttcttaaaattccctcctcctctgtgacagggccctgtcctggatctttgccaacatcttgtgcgtccttcgagggtggttctcccactagagatcccctgaattaggaggcacctgaaaggttttctcctctgtaccttctgccttggcatcccacccactcctgtgatgataataggttcctctctgctggtggtaacgctcaagtcttcatttccaaactctgcttaggttgagcagctgcacagacaccacccacatggcttccaaacttgatagtccttctcactctccttatctggtgtgggtaggattgtgtcccccacccccctcaaaaaatatgttgaagtcctaactcctgctacctatgaatgtggccttatttggaagtagggtctttgtaggcataatcgagttaagatgaggtcatactcaatgagggtaggccccagtccaatgtgactggtgtccttataagaagagacacagacatacacacacagagaggacaccatgtgatgacggaggcagagatggagtgatgcatctgcaagccaaggaacgtcaggattgcaggctgaaaaaaggatcttcccctagagcattcagagaaaacatggaaaacacggccccgcccacaccttgactttggacttctcagctccagaactgtgagagaataatttctgttgtttaaagccacccactttgtggtactttgttctggcagccccagaaaaccaatacatcacccgatctctccagttccctatgggactcactatccttttagggatccaagctgaaagtctcaggatcaaccctgaatctctccctcttgccttaatacccagcttttcatttctgcctcaggtgagtatgcagtccccacctcttccctaatcaagtatggtcgccctgactctgccctcttcagtctcctatctgtccatccagctgccctctggacaattttcctaaaacagctctgattgtgtcaccatcatcgtagcacactttgtctgtttccctcctgcctccagcagttggctgcatattggaattacctggggagatttgaaagctctcatgcccaccacacaaccccatctgtcaaatcagaatctctggaggtgatgccccagcatcaatattttaaaaacttcccctatgattccagtgcacagctaggcctgagaaccatttgctgatagaatatcacaatagccagacaaagcttacggaagaaaagatagctctaaggcaatggttctcaactggggatgatattaccctccaggagacacttggcagtgtttagaaacattttaggtcatcagaaccggggtggtgctcctgggcatctactgagtagaggccagggatgctgttacacatccacaatgcccaggacagcctcacaataatgatccagccccaaacatcactagtgccaaggtggagcaatcctgatttaagagcgaggagaggagcagcaataccgaccttgactttgggacagacagatgcagtagacaccagtgctgaggaggcacatgccccctcatgccgcagtactgcctgtgctgtgcccatttggcagcccagtatgttgaaacttttcatgcagcaccagtttccatcacaggaagcctcagcctgctggtgccaaacttattctcttgctctccttttgaaaatgaggttcagtggaagctgggtgcggtggctcatgcctaatcgcagcactttgggaggctgaggcaggcggatcacttgaggtcaggagtttgagaccagcctggccaacatggcaaaaacccttctctactaaaaatacaaaagttagctgggcatggtggcacacgcctatagtcccagctatttgggaggctgtggcaggagaatcgcttgaactcgagaggcagaggttgcagggagccgagatcatgccactgcactccagcctgggaaacagatcaggactctgtcaaaaaaaaaaaaaaaaaaaccaggttcagtggaatgtttttgtcaggagagaaagggtcattacaactcaagttggcttttgccaaactcagcaatcactgttttggtggctcctgaggctcctaatgaggacactgacagtcgttaaataaacaagtgattaagttgagaagagactggctaacagaggttccatgtgtgctcattgtcatcgatgttagccagtttcatgacagtgacctgcctgggctccacctctaccattaaagagaaacactagcaatgacggcttatagttcacgtagctttaccatttataagcattttcctatacaccaaccagtttgatttgtcttttcaagtcttagctttatgcagtgtcatttcctataaaggaaagtatagcaaatatacaagaggtactcagaaaatacaagaagaaaaaaactaaaaagagtaagggatcaaaagatatttttttaaaaacccacattggatgaaaaatgagaaatttaattccggtaatggaggacaaagtctttgccaaattgataaagctttgggaaattctgattatggaaaggacccaaatgtagacagtcacattctaaattcctggctccatgctatgtgtccagtttctgtgtttttaaatgtatgcagcatttttaacatcacagaattattaatatgttgaatatcgttgctactttatataaaaagtatcttttctgtctactatttaagaattcttgctgtatttatcattctgttttctccaagtagacagagggccgatgtatttgataccagaacacatctttgattttgtcatggggagcagtgtgaaaataggagtcacaagaccaggcgtggtgactcatgtctgtaatcccagcactttgggaagccaaggtgggcagatcacctgaggtcaggagtttgagaacgtctggccaatatggtgaaaccccacctctactaaaaatacaaaaaaaaaaaaaaattagctgggcgtggtggccccacgcctgtagtcccagcgactggggaggctgaagcaggagaatcgcttgaacctgggaggcagaggttacagtgagccgagattgcaccactgtactccagcctgggcaacagcgcgagactccgtctcagaaaaagaaaaaaaaaaaataggagtcacttaacacaaacttattttaagcacaatttatttataatttagaaaaaagaaaaattgctgtgtaatggggcttgaagagaaaaagaaataaaatttgttgagggaggtgtagagcttgttctgggtattgatttcctttgaggggcaataaggaaggattatgccagggtgtttcttgttgcttaaatgttccatgaaacaccaaaattgcagaggtattagtagttagaaagaatgtggaaacatccctccttctgattaatgactgccccctgaggagtccttcaaaagccagaagaaacctaaaatatcatcctagaaagttggaaggaggcatttgacaaagtctttgctagctatgtgactaggataaggatgtgtcagtatatcattatgcaacttgatgaattctcggtcagctgaacagtcatagtcatattagcatagaatagtgattcgggtcaggcacgatggctcatgcctgtaatcccagcactttgggaggctgaggcaggcagatcacctgaggtcaggagctcaagaccagcctgaccaacgtggagaaacgccgtctctactaaaagtacaaaattagccagggtggtggtgcatgcctgtaatcccagctacttgggaggctgaggcaggagaatcacttgaacccgggaggcggaggttgcagtgagccgagatcacgccattgcactccagcctaggcaacaagagcaaaactccgtctcaaaaaagaaaaagaaaaaaaaagtgatttgatttctggcctttaataagtgcttaatgaatcttggatgaataaacgaatgaatgaacaaagaaatgaaagaatgaaccagccaactgaccaggacgatgtccatagaggtctacatgggattccctcaccttggtcttgttgtgttcaacatttctatcaatgatttgaatcccagacacacaaagcatatttactatacttggaaacagaacaaatctgggaagatcattaatgtaatagatcacagaagaaaaatccaatatgatcttgccaggttaaaaacagggccaagatgtacaggcatcagccaaagccctatgtatgagtttaacatgtcaactggaccttgggagcctcctattttgagggtgatcgtgaaagagactgggaagtgttatatccttccccatcattcagccttctcacagaagttccaaaggctatttggtggtaaaactcctttctgcttgctagtcctcatcctttttcctccttttatggtatttgacactattctacactgttaacttgatgcccttcacagaacctttctcgaatttcatgattccactttggtcttatttccctcgttttctaatttgtccttctttgtttcttttaccctctttttaaagtttttcctttacctttacatttaaaaggtagtgtaccctaagctctaatcttggcatacttgaaatctgtatctctccctggttgtttaacattgatttaaaatagattttgttgagaacccgctatgtgcccagaagtgttccaagagctcttagaatacagtggagaataagacaacaatttctgcctttaaggagcctgtattctaggaggatgggaagtgatgaacaaataagtgaataacagtgttgagtcgtggttaaagctatgatgaaactcaaatccagattaaggggaccaggaatgtcagggctgctattttagacaagagtcagggagagtcccctgagaagatggcatttgagcagaactgggcttcttgtactcccagggctgcctccacactgaagactcccggatgctgctctctggccagctcctctcttctggagccatattcctgaatgcctcttagtccctgcaggatgtcctaagagcaccttcaaccacgcttgataatctcccctaccaaacttcttccttctctttggttccccatattggttcccagcatgaccatctcctcactcacccaagctagaaactctagcctccccttcaaatcctcctccacccctactcatacagatccaatccaatgacatctgggtcctcacttcctccccgtgccatagttcaggttcacactatctcttactggtactgttgcaggagactcctgactagtttgccagcctctagtctcatactccacccaccctgtcttccacgttaccaatagaatgacctttgtaaagcacgatcagctctgctcttgagccttctatctctacctactgcctctagggctagcaaggtgttcaacctacctggttcccaacctactggctcagccatctcccttcagtccctctgtcagaaaaatcacttcctgaccctttgacagtaccctctttttcctctcatatgcccttcagtttttcctagaactctttccgttcctctttcctgcttttcccttccctaccctacccagcaggtttctaagcattactgcaatagccaactcaactctgcaaagcttttttcaaattctcttccccctccatccattttctttgttgtgatgccatagtgcttgtggcaggcaggagcaccctgttttagaagagttttctgtgtcccattagccgtgggttacctggagacaggcatcgtcacttgtgcatgtctgtgctgcttgtagatgttggcactagggaggttacttcatgcatgtttactgagctggctgcaattatacagaagacttacaaacatataagtcaaaccacgtgaaactgctgttcttcttggtcaatatcagcaatttcatatgtttattctaatctgttttgttcagtattttgtattcctgttttggctttcagaagtgttcttaccttcaaccagactgccttagagcatggggctcaaagaaatattttcagctctggaagacattttccatcctacttctacatatagaacttttctggccaaaaatggatgcatatctcagaaatgtaataagcaatactcttctctcttcctcttgacaattgtttttcaaatggtttatcataaacatcagtgagatcttgaggctgttataaagtgatataatggtaatttctagaattgtaatacattatcctagtgaaaagaaaatgatgaagttgtgaatcaggcaaaagtgatgaattgctcatttccatgtagtttttcaggtggaaagtagatgcaggtatcaactggaggatgtgtgaatattttgtctaatggttttgatctcgatatagaactagagttgttcttaaattaagaatgtctttcatattctgccttttcaccagcatcactattaaaataatattcttaagcaacagccaaaaaattattaggatctgctggttctataatcagatgtttttgctggacactttaaaaaccaataacagctaatcacagtgtcctcttttgtgctgaattgaattttgttttggttttaattctcatttgaactgctgggaaagcaagcctgttacataccaacacttgccacctttctatatttgaatggacctaagtagtctttgcaaaaaatgtctaagactgtcctatccggacacaccatagggttttcccatggaaataattatatcacaaacgaatcttttttctaaagtctgtggttttaggctgccatacttctcaatcccctgaccaggagacaataaaattggctggggccttaatttgagggaatacatatttgattgtgggcgtggtcttctaagacaatggtaaagggaaaagcaagatgtaaaattaaacgttgaaacaagctaaactggttttcaaaatcttctcgactgtaacacatctagaagttctaaatataagaaggtttgagggattatctaaaaccaaggtattaaaagatcaggtttttagaagattttgattcagtaccttatacttttttttcaaggagttgagcaagaaaccatcaaaacttaggagagtgattttaggagagggtggtctccaacttgtctttatgtttgcttccaagataagtgttaagcccaaccaactagcagactattcatgatctgggaatcctatcagtggtcatccctgtatttgacttgagtctctctaattttttatagggacggcgaaggccagttggtcagccaaatgcataaaaaatggtgcagaaattagtgatgcttggaaacatggctcataatcatgataaaggcttatatgttggtatgggttgagaatgttggcctcatggtatctgggtatgcaagaaggcaaatcattattggtatactagcctttatgttgaatatttagagagctcttgaaaacaccccttcgatttggagtgaggaattctaatgagtaaaactccatgtagaaataaccatatccgattaaaaaactattttgattttcattccaagaaactaccaaaatgtcagctcgatatacttgtgaacatgttatgcttatttttaaataaggaagggtgcctttttacaaattaggcttgagtttctcttactatcatatatattaactatagacaagggagtgggttctaataacaaattgctacattgctatcgttaaatccgtgtttgagttttcttccctctaatgtattttctccccctctttaatttatatttttaaaaagcaatgtacttatctagaaattgtatgaaagacaaatatttaagaaagtaaatagagactatgggcacgtcctttgaatatgttttgccagggtcgaggggtaaatgaaataaactgatacatcataaatggaccacacaggaaagaaagtgtcatgcctatgcaaagacatgcattctccttagagacgacatatattgctgtcgaccaacaaagtcacgtggtgggagggggctcttttctttctccttcacatcccctcctctgatgtcacaaatctattttttcctgggagaattaattagcattcattgggtgtacttggctagaagaaatgaggtggggagaaagagagagagagagagagatcgagattgagatcttaagaaagagagcaaggaggaagagcccggtggggagcaggtccttctcccccacccccctacccccaactcccactggagccgcattgagactgtaggcaccaccgggcgccgaatggctgttttctaactgggatcctcggtgacgtatggctgcctgccccttggcagctgtctttatggaccagtaggcagagcgaaattgacgctgacaagacttttgcatcttggaagggactgtaatctactgtagtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggtacccagcgctctgacaatagcctgtttaaagcttttcactggggggtgcttaaaaagggttagctgggttttgtctctcttttaaaatggctctgagacaatccctatggcatggtcttgctttcagggttgatttttttcctgtgggctgatgttaagttaatagagcagcctttcttcaatccattcctgttccaaatctttctaccgacgtgatatttcatagagggatgtctatagtttgtcaccttgggctgatgcattggggaaactgtctttttttattaatataattaatcgtaacttaggtcttgtgtcctgcatgttatattccaggaacgtggaatgtgtagttttctgctaatgctgaggaggaactggaggggcatgcatgttaattctgctttggttccgctaatgctgtagtgatttgggcattctctaattttcttattctaatatgattgctctttcttgtatcaggccctgactacgacatgtaataatcatttacagttggagcttcagagaggggacatcagctctgtcacccagtgctgatggaaaggcagggcgggggatcttctgctaattatgacttggagactggggggaagaaaattgataaaggtcctatttcttaaagagaatcttagaacgtaccacaattttcatatacagaatggttttttggagaataaagtgtttttgcagtaagaaaatggcagaaaggaactaaaattaatctcttttttctaaataatgactgatttcaagtttgatgtcccatagaatcggctcagccactgttaggttaatggatctcactgcattgtaattttccctcactcaaagtcatagactgtcataaatgcccaaaaacatattctgtaaccgcagtggctctaatataaaaagccatcatgctaaggttatttctcacagcccttgcgtccactgatagtcactaaagagtaattcgccagtacggggacaaaacttcgttttatttataaagatacaggctgaaccatatgaaattgctgatagtcaaccattttaaacctacaaaaacggcaattacatgtacttcagcttcacagtatgctggggtaaagactgcttgtttttatataaaatttctttggtacacaataatattttatcctaaacagagcaattttactttttaaattaatttttttaggtatcacacaatacacataacataaaatttaccattttaagtatacgattcagtggcattaagtacatagcaccttaattttaaaatcgtttgtttagttcaatcctcttaccaaatctacacctccccaccaaaaacccagcctgtattttcttgtgtgtctttaaaaaaaaaaaatcttcatcaatgaccaaatagctataagagaagctcttgggaatatttatcaagatgaagaagtgagatcaaagttttttccatgatgactagagactaagttgattgcatgttgtcggggtatgataatgtaatagcattgtcccaaggaagcctatcacgattttatcctaaaatgatgattttacttagtacatacttttaatttttattaatgtggtattcaaccatggcagataaaaccgttttggtctttgcaaaaaaatcccttttttaaatttctctctgaaaggaagcaaaggtcatataaccaatataaaatcattactacacaactgtgtatcttatcacttagtcttatggactgctattattttatgtcaattaaatcttatttaataacagatctacaggttgctagtacatccctgacaacccgtatatgaaaagtcattagttgtgattttagagacaaaattagaagcaaaagataatttgtgaaggaactttaaaaattacctaaatgtataaacactagctgcttgttaaataattcaaaaatatcacactaccagaagctagtgtgacatgtatggtacatgcttgaataagaatacaagccaggggatttgtttttcctgatctacagcaagaggggttgtgattgttgtgtgacccaccataattgttgatctggagggtggcttatctaatctgcatttagatgaacaagttcatatgctggctacacaaaatcaaagcccacacaagacactttgtagtttcccaatttgctcacccatcatcattaaggtacacataggataaaatgatagccacaaatgtttctgcgtgattgtcacatcagtattccttcagatttaactttaagtttattaaaaaattatttttccattgaaattaacatttgaaaacttgacataattatttatagaatgtgttatataattcttgagctggtggatccgttttttatgtttttcttttaagcctttcagcaaaggattttattcattaaatttaatcctgtaaattttgtcactttacgcagagttttttatgcacatatatattttttttcctgtgtttctcctttcccatctgttttcagtggttggtgatggagtgatgcctgtctcttaatttggggcattattgcccaatggctaatacccaatagcatgtgaattaatatctttggataattattgcagtgtctattaagaactaagaatgtaaattaaacttagctttataaattgaccttgcttttctagttgggatctttcctgggagtttcagcgggacaacacaacccagctattgtgattcactaactcctacaaagagagctctttctttaaacttaatcacaatgactttgtttctactttagacaaaattaatccatgtccttaaaaaaggaaagcatttgtgttttttcagtctgatagttttcatcacagcatgctaccagataccaaaattcacaagagtatttagtagatatttagggatttttaaggaaaacaagcagattttcttagatggatgtaagaaatgccaaattattacaaatgatagtttttaaattaaaagcattaaagtgtgaagattgagtaagcagattcactgacatggaataagcagaggaaatgaataagacagaatcaaaagaaatagatcatggaacccaataataaaaagatggagagtcggtttccattgatttcagtggagtattacttgttgtcatttcatttgtgaaaataaatgcatctgaaattgctgagagtggataatcactgagtagaaaaacaattgaatcataacaactttgtatgctctattatgggggaaaaatctatctgttatgaaaattattttcattatatgtaggtaattgaattctactgaaacaattatagtcaggttagttaacttcctatgaatcgttgctgaaataaattacaggcatcaaattaaattcctaaccacacaggaagaaaaatatagtgaatgggaaacaatgtgtaatttaaaataaattacaggatatagtcaaagtaagaaatgaatttaaattattgacttccttaaaaaattaatacatctattttaatctttttgatcaaatagatataatttcttatttttttttttaatttagcaaaatgtatgcacttttggctctcatttttcgtttaggaagaaaagcactcctctagaatatacgacttgtgtgattaaaaacccaaagggacacataacacacgtcacactattcctgatgatctgcgaattattgcattttgaaatttgtgttgacattttctaacttggctatataaatatggtacagaggaagttttagatgcagttattatctgtaagaatttgccaaggtggacatctgaagagttggtgtctggggaataggctgtagagaaaagtggctggccagatggtgcggaacatatgtggtaggtatgatacagcttcctttgattttttttttttttttttagaacatttaaatgtggaaaagatctcaacgagccatttggtacatcttctacttttacattattaattccattaggatttttttaaagacttggccttgctatttcgttagaaaaagaattctgggccatttctggaaatttagatttgccttccctgaaattgagtgtaaaccctgaattaagattattatgattttcaagatcacatttctctgttatttggaagtacagggtcaatttagactaaatgatcttaataaagtgactttgtcttgatgtatctgagaacatgcaaaataaccagtgtccccatgacttaaacttcccctctctgtgactgtgatggattggattggattgttacaaagacactctcgcttttttctcctttggaccaaatgtacatacatgggagatagttggccaggagtagggatggccatggaacggaggaagaaagtgaccacaccgactgtttttaagagaggaaggttacaatcccagtttcacaaatgtgctttgttgttcattcatttattcgtttaatggtgttctctgccgggtgtggtggctcacgcctgtaatcccaccactttgggaggccgaggcgggcggatcaagaggtcaagagatcgagaccatcctggctaacatggtgaaacccagtctctactaaaaatacaaaaacaaaattagccgggcgtggtggtgtgtgcctgtaatcccagctactcaggaggctgaggcaggagaatggcgtgaacccgagaggcggaggttgcagtgagccgagatagtgccgctgcactccagcctgggtgacagagcgagactctgtctcaaaaaaaaaaaaaaaaaaagaaagaaaagaaaagtgttctcctttgaaatgtcattcttcctctgtcccttcagctcacgttacaggagtacaggggtgctaagtcatcgtagggaccattaggggtagtataatcttggttttaataataattttgctgattggtggcagattaaatagcagacaaaatgccatagacgagaattttgatccttagccagctgagtgatatttctcgtcaaagagtgtataagagaaaatgtaataatttcctatttgataagctgattttatcaattgcattaactgctttatgtagccaagccttattatgctgtatttaaaatcaagggtcaacacactttttccgtaaaggtcagatagtaagtattttaggtgctgcagaccactcagtgtctgttgtaactattcaaatctgccactatagcatgaaagcagccctagatagtatgtaaacaaatgggtgcaactgtgttccaataaaaccttataaataaaaacagatggctataatttaccaacctttactatatttatagcattgttatggcattccttaatattttaaataatagctaaaaatgaaagataacaaatatagctttgaaagaccttgctcagtgaatatggtctttcttggaagctcagtgtttgtcacttagttgcttccggtgataatttcctaggtgctaagaagcatgacagtctgaagttcatttgttcagccttctcgctaaattacattaaataagtaaatggggaaaaataaacaaggcattgttttgctttcctttttgcaatttccccttgtttcatgcccacctttggcaatgaccactcacagctgtgtctgtcttcataagccaccactggtcacctcatctctatcttcactctcttagggggaacattttgcagttttccctctgcagggcataaaccattttcccatttcttgccaggtgcccagaatcaagacattttaaaagaccttttgagccaaggcatcctcttggaatcctgtgactgccttttaggtgttgggatcctgtccttgggattaaaatgtatactgtgttttttgaaattttataaataactttatatttaatgcctttatttaaatttggctcaaaaatataaaatagaagtgatttttcttttctttcatatctaaagatttactgttgtaaaaaggcccctccagaagtgtaagtccaggggatttggaacacatccatccagttgccgatcccatcggtgtgtcttctggatctattctttttttttttttttttttttaaatcctgaattaagggtcttaggcatggctgccatgtttttctcagaaaacacgttaacattgagcagtccatggtttttcattgtcattgcctagcagcctatgcttgcttgcctgaacatctggagacttaccccatccatatgaggagatgagcacagagcatggatgaatcttctgcagagataccctgaattgcatggcctggcttgggtaaaagtcagcatggtgggggatctagaggtccatttctggtccacagggtcccagggtgctcccttcctttcaaccaaatatttattcagccagcgtttattgggcacctgtgtgctgagtatgtagagacaaattttttaaaaggataaaaatttccagatcaaaagtgatagaactacttagaatcctcttgcttaggggtctatgtggagggctcatagccccctttaccaagaggaaatcagatcataccatgaagtgccttgaccttctgttttttttctgtcagccccactgggttttcttgcctttggagaatgtagcaacatctatttctgagagagaatctcctgaacagtaaagcaaaaatctaaatctgttttttgggggttttttttctttctttttttgagacagagtctcaccctgtcacccaggctggagtgcagtggcatgatctcagctcactgcaacctccacctcccaggttaaagtgattctcctgcctcagcctccagagtagctgggactataggcgtatgccaccatgcccggctaattttttttttttttttcctgagatggagttttactctttttttttttttttttgcccaggctggaatgcagtggcgcgatctcaactcactgcaacctccatctcctgggttcaagcaattcttctgcctcagcctcctgggtagctgggactacaagtgtgcgccactatgcccagctaatttttgtatttttagtagagacagggtttcaccatgttggccaggctggtatcaaactcctcacctcaggtgatctggctgcctcggcctcccagagtgttggaattacaggcatgagccaccacacctggccaattttttaatttttattttttatatattttttttatttttagtacagacagagtttcaccatgttggccaggctggttttgaactcctgacctcaagtgatccgcccgccttggcctcccaaagtgctgggattacaggtgtgagccaccgcacccagcccacaaaaatctcaatctaaggaagactgaaagttaagaaattttaagaagcctgagataacatcagtagcttaggacctggaccgtttctttaggagacacagaagcacaactcaactgcaaatgcacctcagaaaaactctcattgggttaactgttgcctcagcagaagagtagaaaattgcaatacatgcagaggtcacagtaggatgtatggtggtttccaaagtgtgccctcttgagtgaaattgctaaggttcacattcaggcttctctacctcctggctgaaagatcttgggcaagtgatcattaccttctccttgcccttgggttgttcccttgtaaaaatggaataataatagtacctatttcagagggtggttgtgacaaatgtaataagtaccacatgctgagtgcagtgcatagtacatcataagcactccataaatttttgctgtcatcatcattgaccacaaaaatagtttcattgtgcagttctgatcttatcccagcatcttttctgtacctccctaccctggttttaaatgagttatgtataccttaccttgaagtcaaaaagattttttctaaaacattctagaaaagcaggtttctgcttccaaacttgaaataccttacaagttttcagagattgtggagagtggagttgggattttataaaggctttgtgaggttttacttgcctcacactgtggctttagtaggttcttctcctcagagacctgagctgccagatggtgcattatgacctgatcttctgatggaatcattacccacatcaatggcacaatttttttttaatccttaaatatttgtggtgccccagaggatataaccccttattaggttttatgggattctcggagataaactggccatagcgaccttatgatctctttgagatttcaagattgtaattcaactaacttttatgagaagcctactctgtgccaggcaaattggtaggtatttttctttgcaatcccctaagaagtgggaaatattgtatcatattaccagatagagacctgagtcctcagggagtgccagctgtcaccatgtgtgtaattaagcagtggttcgagcccaagaccagtagccctttctgtatagcacatgggagaaaattggaacaggatttaatccagaacattctagactctgacgttctgagtttaagataaggtgacagacaatactgcagacgtcaatgggaggacaagcatttcatccaagaaacagcagaccattaggttgtttgccaggttttctggactagagctgggtacccttacagagagggagcctgcgttcacctttgctagtgcagctggcaataattatagtgctctgttagtgctctgttggtctgaaaaggaaacagaaagaaaaatattattgtgaggagccaaattttcactataaatagtatcttccccaaatgagcattttaagaagcaggatatggtgtgtgttgggggaaagatgtagaaaataaagatcattttggtgatttacataaacttcaatttagaaacggaggacattctcaatggatcatgctggtactgaagggttgcatttcaatagcatattttttaaactccccatttcctttctatggtaaagaataaataaaaatgctgatatagaatctttgctggagatagagacactgactctttgccacctgaaattggcagtgaacagcagagctgaaatggaaattggcaggtaccactggatgtacccaggctcaaagaaccaccagtaccatcccgtgccaaccctgggggacagggctagccccttgagcagtccaggtaaatacagccttggggtgaattctaatagcaagtcaactgttatctttaatattatttgtaatggctcttgcagcttggtgatattttatgttttgcttggtgcattaatttgttcacacgggcatgggtggaattcgccctataaacattttttaatcatctttctttttctctctccctctccattccaccccatctttctccactttcttctccttcttccctcttccctctttcaccttcaatcacttcgtcttctcaaagggaacaatgtacagtgagatatgcctttggttaaccatgaaatttccaatgcctgaaccaataatgggggaggggggccacccacatcccccatgtggccaagaactgggccagggccttcaaggagccttggccctgagagtactgtgagtgtccccaaatgtcttcccagccctgctgctctgcaccaccctctcacctcagtcattgcctttgagaaagagaaatcaaagctgtgaaagtaggattggataaccatgtacccgattcccatcaggtaggttcagtgggtccggtttccattttccttgctcgtgaggaacattggccattcagaaccgctaggtgctggatctgggtgaggtgtgcgacagctgatttggggacctagaaggggcaaaaggtgaagcagtatgaacatccaacctcccacgttcccaaaaccaacacaagttgtaatgcccagctcagttagctaaaactcagtgattttgccagtgtacaaccatagttcaaactacataaaatgcagacataaagggctggtggtaggtcggataaacacagtaagaggcttaaagtatttctgtgattttgcatcaatccataacatttctcccaaatgcttgctaactttttcaggagtaaatgtagcatggtacagctccagaaagggcaatcccaaggtacaatgtaagttacccattgaattacaaagtcataaaatccatgattaataaaaccttttcctttaaaatctaaattgtgttgtcaggttaattaaaatgaaatctgacgttggatttagttctgtcttgggttatgcattccttcatctgtcctatggctatcaggtgttggttctgtgtgtgcctgtgcagcgctggctaaatagggtgagcatgaggtgacatcagccatccattctcatggatcctataaagaatatggagggttctggaatcttgatttaaaaaaagtcattagacgtgatatatccatacaatagctactattcagcaataaaaaggaatgaaatatttgtgcatgctacaacatggatgaacctcaaaaacatcatgctaagtgaaagaagccagacacaagagaccaaatgttctaccactctgtttatgttaaatttacagaattggtgagataagaagtaggttaatggttgccagaggctgagagaagggaggattggggagcaactacagatgggtacaagggatcatttttgctgtgatgaaaatgttctaaaattagattgtggcgatggtcacacaacgctgtacatttactcaaagtcattgaattgtatacttgaaacaggtgaattttatagaatataaattatatctcagtaaagctgcttttgaaaaaaaaagcagcaaaaaaaaccatgagatgtgcataattcaagggtggggagcggggaaaggggtattttttaacataacaagaagcccccaagttatcagaaacaactgcttgagggaggagtccctcttcatcttaagagtctttaagagtcttcattttaagagtgttgaatgacatcaggccagctggaaacccagaaaaatacttattcttttctgtattttagttcactaaactggtaaagaataaacacaatatcttattgggggggaataaaagaaacctctatcaattgctcttgaagagttttctccacttgttgagcagttccctgtaaaagcattgcaataatatttgtgtgcttttgatcctacggtgaaacaccagaatctgggcattcatagcagcagtggcagctgagaagaaaaatacgaggctccattttctgtttttctgaaactgatttctttcagaattccaaagaatttgggtttccaaaagataacatagtgcatacatcatgtactgcatgataccaccactgagtgtctctgcagatctaactcattaatctttctggagagcccaagactataaacaactccttgtccattcaggtgagattttggcaccaaggaagaggagatcagaacaggttttgctgccagatgagttaggggagaaaaaaaaattacttttcaagttttttggaattccataatgatatgatgaaagattgtggaagtctaatagtatcaggttgctggtgatactactgcaagcgagaattccatgaactaacaggttcttgcctgagggggagaaacaaaatcactgaatttgatttaaagaattatcttcccagatcctgaaacaatctccacctacacatagttttaactttttgtgtgcattgatggaaataattggaaaaaagatgcctccacggggactgttaatgtctggagctgtctgcagagaccttatgtgtgatagtgtaaagcctacagcgcaggccacagagtgaagggacccactctagccatgccatcgcctttccagacacttacagattttgttgggtcctaaatcaatgccgttgccattctatacttagatctccaaccccaaccagatggtatgaggcaaaaaatagggaattctgtatggctcttttttttttctttttttttttattaatttttttgcagagttgtcagcctttttccatgggggaaaaagaggttttgatacaggctgaccaggaaatttttgccaaaggaaaatgcctctcccactcatgcagttactgtagcagagactgcccttctccaggaacttccttattccccattggaaaggtcatggcggttccagggtccttttcatggttttctttttcttgctactacttcccagtagaattccatctttaggggttagatagttattctttccttatctctttttccttttcaatttttagctgcgttggacatgtagtgtccacatcttttctgccttcaggagatgaaatgatgtatgaccacatgggctacccccgccccccgccccccccgccgtccatgatgctgccctaggggcctggcctgaggtggtggtctgagatgcaggcaagcgatgaagcagggagtagttcatgctaagtctccagtcagtggcatattgtgcttaacattggagggagcacttccagactgttgtagattgtgttacacaggctccagaggatagcctaagacaatctagattctctattccaagtgcgggctgtggaccagcagaatcaacacctccaggagctcgttagaaatgcagagtcccaggtcccacccagccccactgaatcagaatctgcattttcataagacttccaggtagttcctatgcacattaaagcttgagaagcagtaattaagagcaaggtccaagagcaagaagggagaagacaggaaggaattgattatgtgaatttaccctcaagagatctagaaatctttatctttggaaaagataaagaattgctcaaggtattcatcctttcttctttccgtttctatttaggaagaggcatgtctaagcaatgccaaggcagtcattaatctgttgagtcctggctggtttgaaaaacagtgaccttgcttctcttacctgcttgtctcatgagggggtttggggaaggggcagtgaaggtgagaaaggtttgtttctttgtggcaaagtgagggccagaggagaaagtagttgatggaagcttgggagaaattctcaaatgtctctcatctccctctttaatataatccaatgacatgcaagatgccgtgactaaatataggctgccatttttagtggactaagaatggttctttatatacagttaaatctgtaattcagaattcagtctcacaaggaaggagtagaataaccacccacttcacatatcaccaatttccgcctctcaaatccaaaatgctctgatgtttcagttaaaatggccacagataattccagaagtcgggacaaagagcacaccctctacatagggactgtcacagaggatgtcgggagaggagggccctctggagtgttggtatttagcaagaagcccaagtgttgtgatttgcaccacagagaatggattcctgagtcgccacggggttgtggggtgggggcgggtagcagactgacggagggcccagcactgctgttaactcatgttgcaccttgtctgcccagatgtaaccacaggctggctcctgggaactgcagactttatcccttggcccccttctaggctgagcctgggacttctctctcactgatctgctttgtagagggacacctgtagctataagtcctgggaaatgctactggatttttgtcattgttctttagtgtcactctttcctaacctaaggttgtaaggccactaagttcgaggtcttctcccaaaccacttgaaatgtattttaagggggaagaaaaacccttaatccttctgcgtgtaccattccacctctggccatagttgggtgtcgaccataactgacagtctggtcgtgccgtgtgggttctgctggtggtatcattctgtccccagaggctggttgcagaagcttttgtagcttatccagcctaagccagtggatgctctcagtctgtctgatgccttccagttactcaagatatttctgattacatagaggtaaatggtgaacacagtggaagcacgttgtagctcaggctcatgccgtaaagtccctgagatttttagagtactttgccttttgttttctgaaatgtatcaattctttcattttcaaagcacctgcagttttcaccaaaaaagtgccatatacagcagttaacgattttatagtttatttactgactgctatggcagtctttatatatatatatataaaataatttatatatagctgtaaacaaatacttatcgatataagtaatttcttgattgtttttgaacgttccattgtttatgcgctatattgttagtctgtgattagcacctaattatgtaacaatggcttactgtgtgtgtgacatatcagctccctttgtcttttggtcttacctttgcttctcaccttagagtaggcagacagagaaagcagagataaaaagcagatcgatgagtattgagtgttgatctcgggctttctgtcagacatgtctgattgtagggacactgacttggattattcaagactgagtacttctcggtctttgagaagtagtgtcatctggtctttgctgcctttgaaatgtcccttatgttatatgttttcatataaatctaactagagtccattaaaattaattttgctttgaaatcttttgccacccttagaggtaactggaattactctgaagtagctggggagtagctgaaatcagccacttaggtcttcccacctcctcaggctgtgtccttttgggtgccgaagttcactcccaaataagccacatataccctcaccccctgagtgcgtccacgtctatgaaaagcttatatgaattggcttttgtactaaacggaatgctctgggtgtcagagtcatttaggtgggacaaatcttcctctgaagatcatcatgcttgtattttctggagacttccatgaacaatgctttcacccccaaggaccagctctaggggtgaaatgtcaggctggtaggagaggtaatgggatcgaaacaagacttcctgtgtcttgagaaaaccttgtttatattcatgtgctgtttcccagtggcaataaatcgagattcctgtgaggatttgacagacgaggctggtgatgccacccactgtttttgtaaagaaaatgttatcggaaccagccaggcccatttgattgtctgtggctgctttcgtactccactagcagagttgagaagctgcaactatacaccctgcaaagccaaaaatatttgccatctggtcctttacagaaaacaattgccaatccttgaattagaatttgcaaagtgtgtcaaaatgcaatactctatctactgatgttaggcaacacctaaaaactttgctcggcactcagtttcctaaaatcttctccatcaaacatccctcatcctctgccctccaggccccagaatccttgttctctgtggggaatagggactccctgctcacaggctgtcaactaaggctcagcccttcttcagagaatttcttggtactttctagaagctcagcccctctggcctctttcaggtccttctctgagttttcccataataaaccaagtcccgttaagtggatactgtgagctactttcatctagtgttctattcagtgcactttagcaagttttatttcctgtgtatagaaaagatatttgtggtttactaaatgtagtgctggggatcatttctttctttttttttttttttaagtatgaggttccaatgccctgaatcggaatcgctaagaatgctggttaaaaattcagatttcatatgggcatggtggcacacatctgtagtcccagctacttgggaggctaaggcaggaggatcacttgagcccagaagttcaagttcagcctgggcaacatagcaagacccgatctcttaaaaagaaaaatcagattcccagtccccacctaccctctctgcgatgggtcccagaaatttggcccattttaagaagctcccccaggcaattctaatgcacagtaaagtttgaccaccactgctatatacatagaaggccataacccctcattataacatctttggtaaagtatcgtttcagttcagcctgtgtatgtatatgttcaacctgtatatgtatttacagttaagatgctcaaagtcaaacctccacatccttagcagacagtactattgaatttgaagtaaattcctcttgaagtaatgtttcgctattgccactatatctttgtgtataagagccaatgcaaaaacattagattgtaaagctgtaggcaaacatcagagctcaggctgtgtgttagttatcaattgttgcataacaaattcctccaaaacatagtggctagaaacaaaaatgtatattatctcggcttccttaggtcaggagtctggactcagcttagctgtctcagaaactctaatgagatttcagtctcatctgaaggcctaactggggaaggatccacttccaagctcattcatgtggctactggcaggacttggttactttgggactgagggcctcagttcctcacaagctgctggcctaaaacctcccttgatttttttccatgtgtgggctctccatagctacttcatggcatagcagatgacttcatcagatagagagagcaagtgagcaggtaagagaatgtgccagccagagagacaatgctaacaggacagaagtcaattttttgaaacctaatcagggaagtgacatctcatcacttttgccatattctagtcctaagaagtaagctactaggtccagcccacattcaggggaaggaattacacaaggccatgaatgtaggtttgtggggatcattgggggtggtgtcttagctgcctgccacagtctgtataaacatttcacagtgcaaatgcatcctccatctccttaatgatcataacctcttcactttctcaaagcctcacctctcagagaatgtatcactgggttaaatgagtacctggcaggtgtttgacggccttcctgaggtactagactctaagctctctgtgagcagaggtcttcatgccttgctccctgctttggcctggctcgggacctaggaccaagaaagcagtcgttcatagtgttgaatgatgatcactttatttttagcactcatgatgtgtgactctatatgaaattgtctaattttagtgtccattgtgtacatggctcatttcctgggccaggctggtcaagaccttgcactctgagagttgcataggagctcagcaggtgtttgttaagtaagttcagattggctactcgttgtcaggagtttgagaccagtctggccaacatggtgaaaccccatctctactaaaaaaaaaataataataataataatacaaaaatcagccgggagtattggtgggtgcctgtagtcccagctacttgggaggctgagacaggagaatcacttgaacccaggaggcagaggttgcagtgagcagagattgtgccactgcactccagcctggacaacagagcaaggctctgtgtcaaaaaaaaaaaaaaaaaaaaaaaaaaaaaaaaaaaaaaaattaggttggctaatcgaggtttctagaatcatctgcatgtaaatagggttaactttgtgggatgattttcttgaataagaagttctcagcctgagcttcacagtagaaccctggaaggaaggggaggtcttttaaaattccgaagccacatccagaccaagtcattcagaatcttgagggtgggacccaggcatcagcgttcttgaaagctcccccaccaggtgatcctctgtgcagccaaggttgagaaccactgtggtagaccagtgtttcccaatccgggggagtttctgcctttcaggagatgccttttaggcatctagtggtgtagaggtcagggatgctgctaaacatcctacagtgcacaggacggcccctccccaacaaaggatggcccatgccaatagtaccaagagttgagaacccctgggctaggtcctacgctttgagtcaggaaattggttctaagtgaagcagtagaagtccatggggtagctttgtcccagatgttaagcttattgcaggcatggatagcttgataagtctggaatattatatacaatctatgtatcggtgtttcctgaagagaaactcactcttttaaaaggcacgcagtgcataaaccaatacatttaaacctacatatatttatttatgcaacataataccatacacgtgtgtttgcatatagcacgtgctataaacaccctatgcatacagagatgtatgcagggcatatgagtgtgttattgtggttagaggaacaggtatgtcttcctcagcgccctttattttccttccccctcactgtagcctcctgccctctgcttgtctagtaaaagccctaaggcctccctgacccttgctgtccttaccctcagtccagaggatgcctctgctgtgccttgctgcctggagggttcccatcacccaggttaatgtggctcttggctttcaccaccaatccttagtttctcaaaggggttcacaacctttttaaattactagtgtgtcttgtagaaattgaacttcacaaacaggtcttctgaaaacgctttcttgtggtgtaattgatatgcatatggtgcatctctttaaagtgtctgacaagccttgacatacgtgtgtgctcatgaaagcagcaccatgagcagcatggcaatgtggctgccactcccaactctttccatccttcctatgctcccactctccccaagcaaccactgatctgctctccttctctgtggattagtttgcattttctagaatggcccttgtgaagatgtgttcacataaattctctcaccctttctcacccgaatagaaaatgttgcatgatgttgattgcttaatagctccacagctttgtccaatttttatccttcctgcttttactgaagatgtcctgcccccatgaataaacctcagaagacccattctgccaccgcctaccactgaagagttgagcttgcacccactccagtccagcccacacaccagtgccagattcatctcttaaaagcacatcctgagtcacgcctcgcctgctcacaaaccttccctctcttccccttgctgcaaagtgaagcacagaggcttgaggctggcttggacatcttccatggaccaggcaatggggggacctaccttcctgacttctccccaccattaccctggtgtccttgatgaactcggctacaccctgaacgctccccacgtctcccacatcacatgggtcctgctgtccttcctttgtgcttttcatggaatccttctgttcttcaaggcctcttcacctcctgccatccataaacctttgccttagcaacccacaccaaccaaagagatctgtccctacctcactcccccatatccctgtgtcagcactctctttattctactttagtgataccttatgtgtctgtgtgtcttaccgcccccctcaccccacccacaaggatcaaagccaggagggcacacttgcagaccccaccacagtggcttgcacatggcaggtattggacagacactcattgaatggaatggaatccaggaaagtagagacactgtcgcccagatggtcaaggaaactgattgctgctaaagctcaaaattgcagatattaaatacttctcaaatgtctggagtagcctccagattgctgtgctcttaaaatctgtgtcatctggacttagagctggcttcccctactctccattgatctccatgattccttgctgtcccactttaccaggctaaaagcctttgggaaaaccaaagccagttcccacaaaaggcaaaggaagagactaacaagtatctggttgttggatttgtttattcccagtcatggaagcgtatcattgcttttattgacttgcttatcttctgctagtaccatattgcaaatgttagaggctcatctattttaagacttccatagtgttttcacaaaaatgaaaatcccttattaaacagattttaggacaagcttctaaaaggacctgccaaaaagtgatttcctttctatcattagaaatagtttccacattcttatcgttatgtagttgaacttttatgtccaggactgcatgaaagacgtgagaactgagaagcaacctatatttgatttcgcactttgttcttggacaggaagcccctgtcaactgacttcacatctttttaatgcactatattagtggttcacagaactttctgggtgttaggtccctttatgtgcttagaaacagttgaccccaaaacgcctttgctcttctgagttgtgcctataaatattttctatattagaagctagaactgagggctgggcatggtggctcatgcctgtaatcccagcactttgggaggccaacgtgggcagatcacctgaggtcgggagttcaaaaccagcctggtcaacatggcgaaaccccatctctactgaaaatacaaaaattagccaggccagccaggcacagtggctcacacctgtaatctcagcactttgggaggccgaggtgggcggatcacctgaggtcaggagttcgagaccagcctgaccaacatggagaaaccccgtctctactaaaaatacaaaattagccagcatggtggtgcgtgcctgtaatgccagctacttgggaggctgaggcaggagaatcgcttgaacctgggaggctgaggttgcagtgagccgagctggcaccattgcactccagcctgggcaacaagagtgaaactccatctcaaaataaaataaaataataaataaataagccaggcatggcagcatgtgccttaattccagctatttgggaggctgaggcaggagaatcacttgaacccgggaggcagaggttgcactgaactgagatcgtgccactgcactccagcctttgagttttttaagatggagcgagactccatcttaaaaaaaaaaaaaaaaaaagaaaagaaattagaactgagaagtttattacttaataataaacttagtcatttaaaataatagcaaatccattatatgtcaacctaagtaatgtttaggaaagataacgattttcaaaaagaaaataatattttagtgtgaggaataggactgttttacatttttgcaaatctctttaatatctggcttaacagtagacagctggactcttacatctgcctctgcattcattcagaggcatcttggggtatcttgctttggttgaagtatatgaagaaaactcaaatttctcacaggtatgtgcttggagaatggaggagtgttttaatggcctttgcagataattatgaaattcttccttgatactacaccaaaattcagcagctagtggtttcttaaagactacttgtaatgtggaatctgaaaccatattgatgatatttttgtactcttttccactaaaattcattgcttgatcttgcactttgattgactcttatattcaagaattattttcccttggctatttggaaaatattggttctctgagttgtgcagatcttccagacgttgacacatttaattaaaccatgtcaaaaaaatttcattggttaatgtcaccaccaatttcatcaagaagtctggtaagtatttggaagctgtcagtctcactatggcaggtacaagttttccaaaattgattggcaacagatactatcagttgttttctttgaagtgacaagctgttcatttttgggaaagtttctgccaaatacttaagtctaaaaaactatatcttgtcaggcattctttcaagaaagggggtgtttgcccccagaaaggtacaagtttggctcataactcagttacataagaatgtttcctgcagcccactgtcacacgctggtttgtggtagaagggctctctgcatcctctcactcatttcattacacaaactgttcgaaaggcacatactcgggggttgagatttaatcaaattaataattttttattgcatcgaggacatttggaagtgaaactggctttttaatttattttcttgcgagcgcgtggtagtgaggaatgtgttcctgctaagtacactatggagccactgcccgattcacgctcaggcatcagcagttttactgtgcaaatgtcaagcagtgaaaaaagtaaataacatcttggtgctattataaaaagttttggcttcacagtcctcctgcaaggatcttgaggtctgccggggctgcacagaccgtctttgagggcccactcctggctcagagtgagactggtgggcaggcaggatagaatctcttgggagctcaatgtcctttccagacctgcctgaacagaatctgcgttttaatgaagtcccgaggagatttatacgcaggttaaagttttcctgtagtcccagctatttgggaggctgaggcaggaggatggcttgagcccaggaggcagaagttgcagagagctgagattgcactgctgcacttgaacctgggtaacagagtgagattgtatctgggaaaaaaaaaaaaaagagagagagagagagaaccactgctctttaacagaggtctgcaaaactttcctttaaagggccacatagtaaatacctgtggcaacaactcaaccctgcctttgtagcttgaaagtagccatagaccatatgtaaatgaatgagcgtggctgtgtgccaatacaactttatttatagacacagaaatttgaattttgtgtacctttcatgtgtcacaaaataggttttttaatatattctaagcggttaaaaaagtaaccacttggaatcatgtcaaaatcattctgagtttgcaggccatgaggagagccagatttagctggtgggccacagtttgctgacctgtgctatataacactgagtgctcattgaagttaccgggggagcttcaaaaaaacaaaccccaaccctctaattcctgagtcccgtccccaataaattctgataaaattggtctggggtgaagccagggcatcaggattttcagatgctccccagattattccaatgtgtaggaaaaatggagaacctctgctctataatgttttccaagaaagttagttttcttttaagcatttctttttaagattttagaatttggcagtgtcaccaaatgtctgagaccagaattatgtattgtaaccttagagcagggtttctcactcttggcactgtgaacccaaagctatctgagataggtctcaatcaatttagaaagttaattttagcaagcttaagaacctgtgacacagcctcgggagatcctaataacatgtgcctaaggtggacggggcacagcttacttttataccttttagggagacatgagacatcaatcaatacctgtgagatgtacattggttcaatctggaaaggcaggacaactcaaagggggtcagagggtggcttgcaggttataggaagatttaaaaattatgtaaagacctggaatccatagaaaggaatgtctgggttatgatgataaggggttgtggagagcaaagttttatcctgtaggtgaagcctccaggtagcaggcttcagagagaatagattgtaaatgtctcttagcagatttaaggtctgttgatgttaatgctggttggcttttcctgaattccagaagggaggagggtataatgaggtatgtttgactctcccttccaatcatggcctgaactagttttttcaggctaactttggaatccccctggcagagaccaggaatctattcagatggttgggggtggggtggggggtgcttagaatttttttttttttttttttttaaacggagtctcgctctgtcgccaggctggagtgcagtggcacaatctcagctcactgccacctccaactccctggttcaagcgattctcctgcctcagcctcccaagtagctgggattacaggcatgcgccaccacacccagctaatttttgtgtttttagtagagacggggtttcaccatgttggctgggatggtgtcgatctcctgacctcgtgatctgcctgccctggtctcccaaagtgctgggattacaggcgtgagccaccccgcccggcccagagttttatttttggtttatagcactattggcattttgggtgtgaccattctttatttggggatgggggctgtcctgtgtattctaggaggtttaggagcatccctggcctctacccactagatgccagtagtgtcccccaccctcagttgtaacaaccaaaactgtctccagacaccgctaaatgtccctgggtggcaaaattgcctggattaggaaccagtggtctaaacgatgtagatgttttttgtgctacttcagagaatctccacattggagctattgacatctggggctgggtaattctttgttataagagcatattctgtacactgtgggtgttgagcagcatccctggtctctactcactagatgccagaagcaccctctcccccagctttggcaacgaaaaatatctccagatattgccaaatgtcccctgaggggcacagtcaccccctgttgagaattgcttggccagctcagaatcagggaagcttctgtccactgacattcactgctgcttctcttaggattttcgccctctccattttcccattgcttgttgcttgaaagttgtaaagcttggttcctgcatcttttctttttaattttgtggctcattaggaatcagtaatatagcaaggaaggccccatgtagagaggtaagggggtggtttttttgtgtggtgtttgttggggggtgtttgggagggtgtgtgtgtgtgtgtatgtatgtgtgacattcattccctggggaagaatctgagcccttgttcctgccagccctacgtctgagccagcattaaatctgcagccaagatcacagacaacttgggcaaatcacttggccattatgaactcacagccatggcaacggccatccacaagcctgaggacaaaaggtgttttattctgttgttctgcacaaaaggttctagggatactggagacaaaatagcctttgagacttaaaggcattgatgtgtattttttttttccctactacatggcttatatttaaactgtcttaggctaatgtacactgtaatttttgtgtgaatcaaaacctaaaattctttttatccagaggccagctaaatgaaggcataagacagcccaacagaggcttttagggtttggtgagaggtattgagaattactagtaaaatgtgctagaaagcctggcattctagcctggccaacatggcaagaccccgtctgtactaaaaatacaaaaaattagctggatgtggtggcatgtgcctgtaatgccagctactagggaggctgaggcataagactcacttgaacccaggaggttgaggctgcagtgagcggagatcacaccactcactccagcctgggcaatagagtgagactctttctcaggaaagaaagaaaaaaaaaaaacctggcattgattattatttttttacatgaatacatcacagtcatcaaaaaaatgctttccttattttttctcgttcacgttacccaatgttgtcattgctggtttgaagcttgggaaaattcagtctgtggatttataggagcatccaagaaaagcactgatcttccttagctatcgtaaacttttaacagcatggtgttctgctggtacttggcaccacccctatatttaaaaacatcagcttgcctatgactactaaggacagcctgaatcccagatctacttcctttttgtgcacaggcactcccagcactttagggggtggttggagtgtgtgtgtttagaaatctgctttctcaggtgactcaattcccgtcttctcagaccctgtctatggcatgacactaaagcatgaaaaattccaaggttaacagtacttgtttggctcacaaaaatgcactctagctgcactcttttcaagatggctggacaacttggaacattttgtttttcttaactgtagtccttggaacttgccatttgattcacaagtgactggagggttatggccaaacccagtgggccacgtcttagagaaaaaacatcacacaccatcgaatatgaaagcaggcacttcaaacagactcaggatgccacacctgagaccgggaagatgccactgttgactagaaatgggcttctcaaattttcatgtgcacacaaatcaccccagaggccttgttaaaatgcagattctgactcagtctggggtcacttccaacattctttatttctcacaagttcctccctgctgaagctgacactgctggtccaatgaacacactttgcaaagcacatggaattgacaaatgacaaatggtccactcatatcttttcttgacctctgatagttttccttgttgcccagtagaagctgccagcatccaagttcagctcttctcagctacagatccatatatcccttcacatcatccagagtgatctttcacaaccccaatctgtttcccatgcttaaaaatgctccctggcagaccaggcatggtggctcacacctgtaattgcagcactttgggaggccgaggcgggaggatcacttgagcccaagagtttgagaacagcctgggtaacataaggagaccctgtcactacaaaaaaattaaaaaataaaaaatgagctgggtgcagtggcatgggcctgtggtcccagctacttgggaggctgaggtgggaggatcgcttgagccagagagttcaacaccgcagtgagcagtgattgtgccactgcactccaacctaggcaacagagcaagaccctgtttcaaaaaacaaaacaaaacaaaaaaaaaacgcagtggcttcccatgattttgttttttttgtctttttgtttttgtttttgtttttgttttgagatggagtcttgctctgtcacccaggctggagtgcagtggtgcaatctcggctcactgcaccctccgccttccgggttcacgccattctcctgcctcagcctcccgagtagctgggactacaggcgcccaccaccacgcccagctaattttttgtatttttagtagagacggggtttcaccgtgttagccaggatggtctcgatctcctgacctcgtgatccgcccgtcttggcctcccaaagtgctgggattacaggcgtgagccacggcgcctggtcaaggcttcccatgattttgaagataaagtccagaattcttaaggtggcctggaaagccctaggtggtctagctcctatattacctatatcctctagctcctaaataaacacatttagctttttcttactaactttttgcagcagttttggttcctctaggatgagtgtgtgatatgtgactaaattgcccagtgttcaaagatatcatgcacactgtgaccagaggtggcttctatactgacatagaagatacagtggagagtgatccatttatagattgttggatatctaccacacatgcaatcttaaccctgaagataactggtcaaccaagctagaataagctctacatccagctgtattatgtcctataaatttttcccatattttatgtcactagcttctagtcatgttggctggcacagtccgtaagagttttatctgtgccagtggagcaaagatggtgatttctgttctataggagccagggttcctacagccacaaataaaatcatctgctgaaaacctaagagcattggcatctgctgagagagcatgattcattgaagtgatcccccaaattcttgagttcctggttttccctgctgttataaaactagatccacagcatgaggtatatacagagtccttgagagatataaattggagggaaactttagctttgatctagtattgaatttgggattgaacagcatcattcttctaaccccacttggctttttgagcctgggagagctgtgatatttctttggaatgctctaaccatttggatgaaagaccgtttgaagtggcaactgtggatttggaaggatgagttctatcgttaaagggcgagtgtgctgcaccataacacctaaccctaactccaaatgatgaaaaagggtgtgggtttagtttaaaaatatatatagatgtatacatctatatatacacacagagaattaatgaacaattttatctggttatatatcagtgtcaccacatcagctgtttaagtattctggatactagatctttctgtagaaggacccatccagtatgaattatttgcccttctgatcttccctgtcccccttctctccactctctttccactggctctgcaggggtctgtatctttgcccccatcatgctggactataataattgtgttacttgtctgcctgcagtattggatttatcttgaagccagaaaggtatcttatttcagttttgtgtacttggcacccagtaggtcttcacaaaatactgaattaatgaaatccaacagaaaacccagttagaacccagctcctgggttatagaaaatcaaatatgtgacaattcaaaatgtatcttccaaagcagtgtgttctgtgatgatgaaatgtcctatatctgtgttgtccaatacggtagccactagtccatgtggcttttgagcatatgaaatgtggtttgtgcaacagaggacctgaaattttcattttatttaattttaaataaacgtaaatagctacatgtcttagtggctaccattttggaccacacagccccaaggcctcacatctttatcctttaagaaccagatacaactttgttagccaggaaagcaggcattcatctttttcttaacatgatcatagaggctgagaatgtggggaggttgtggatgatacaatacccatgtctgttttctctttataatgagatacgtcaaggccaaggattctagtttctcttagtttgggaacctggagagaatttggactttgagttgcattcctctcacctcagtccccagaaagtcatgtgacaaaataagattgagctctaacatctctgctcacaaatcccaagtgtctgaagctctttaagatactgacttgctagtgaacttgaaccatattgtgcactggttccctttttctttttttgagacggagtcttgctctgtcgcccaggctggaagttcagtggcgcaatctcggctcaccgcaacctcttcctcctgggttcaagcgattcccttgcctcagcctcccaagtagctgggactacaggtgcccaccaccacacccggctaattttttgtatttttagtagagacggggttttactgtgttagccaggatggttcccattttatatagtttccccaatccacttcagggaagttggtcttcctaaaaacagctgctcatcttttgaaattaaaggaagcacagctttcttatgaagccctgatattttttattttctaatgaactaaagagaaatctagtaatgagttttcatagtcactttccataggtttaagcgaatgctagtttaaaaggaatgctcactaaaatgaaaacattcatctatggtgttttatgctgggttgtcattccatgacaactatgaagaccatttgggggattttttttttttttttttttttttttttgctggcttaatgtgcttgccctaaagtaatgaagtgcccttgattgctgctaaacaccataatgcgtttaaagttcaatttccccgacaagccatttacttaagggtctggataatataaacagagacaggaggttaggagaggtactgacattatcctgaggccagtgctgcctttactgaaacgtaaatgtctccaaactgaaaacgtcacctggctctgcccctgaggcaggtctttatggacatctcaagtaaaagtttattttaaaaatgaatacaagtctcgtcttttcaagattaagagtgacttacggctgtctctccttcattccacttcatggatgttcattttggttttgtttttttcttctgttcttttttctccttcaagtacttaaatatcacccaccagttctgggttctgactctgaacgtgtgtgtcggggaagggggcaggtggaagccggggaggaggaggactgtgaatgaattgcttgggctgactgggctggggggaagcatttttattaaaaatttgagataatttctgatgtcaacttgaatgaaacttgagtagacccacttgagtggctcttggtgactttgttcttcactgaattatggaccaaaatacctgtgacctttccaaaacaatcaccttgctatttgtttgaacctggcgacggcataattgctgtatcagattctcccagttgccccggaggtccagggcttggggaaagccgttggttgccacagcagcagacgtattgaaaccccagaactgtgaggctggagacgacctgactgttgcttttcttcacagagctgcagcttcactgctgtcctctcttttgactgtgttagtggaatgagtgcttcttgttggcacttgagcggggctccccccaccactcagtcgatcaggaagctctagaactgtaactaccttataactctttgtcaattgactgctctgccattcactacccttccagattctgagcaaattaagttacattcccttttggagcctcagggtcctcaccgcagaatgtgagatcacggtaactaccacactggcccttgggatgtcgaagtattaatattaaccatagagcctgagaggggagatggaaaattgtaagccttctctgtgaatatggggtattcttgaagaccagaggtgttcttgcccgtaacggctatattttctctcctttgggttcaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgtaagtatccggttccctttaaaaatgcatctaaggcctggcgtggtggctcatgcctgtcatcccagcaatttgggaggctgaggcaggcagatcacctgaagtcaggagttcaagaccagcctggccaacatggtgaaacgccacctctactaaaaatacaaaaaaaaatttagctgggcgtggtggtgcgtgcctgtaatcctagctacttgggaggctgaggcaggagaaccagttgaacccaggaggtggatgttgcggtgagctggtgagccgagatggcaacactgcactccagcctgggtgacagagtgatactttgtttaaaaaaaaagtatctgagatgcaaccacctcatgatgtttttcagaaagactacagtgtgctttcctagcagaagatgaatgcttttacttaaagctcactttatgtagttagaaaaaggttcatgagagaaggaaaaagaaagggcctagaatatggtagctgtttaggccccagggtggaatgttacttgggaatggtaaggtgcacacataggacactccacacatggtagctgtggacatggggagctgtgacatggtgataggtgatgctgccgattgtctcaacagaattgtgttgttcccaagtaacagatgcctccagctttctcccaggaagtgaccatccctggaatggtaggagccctgttgaggactgaccccaactctaagcctacaggagcagtattttaacattaactcttccagcagaagagcagatcccagggcatcctccattgcagaagagcagatcccagggcatcctccattgcagaagagaggaaggtccaggggtttagcagcagatctctgcctttctttctggaaacattctcaatggagtcgcagtgactcccacacatagattcttgtagctgtgcaagctcagcagcaatctacttatttccttcacatgtcttcccctttctccatttccttctaccgtttctttttcttcccttgaatcccaaagttccagtgttagtgtgtcttatgattataagaaacttcttcaccagactgaaaaagacatgaatgaatttttatggaatggtcatggagtcatgttggagactcttcagtccttagggaattttattctttcttatctgttcacaaatgacctccaaagaaatgaacacaggttggggagattataaggagggctcaagcaggacaggggactcactgagttccaactatgtgcaaagaagaaatgtttaccaagactgaacctgggaaaggtgtgttgatttaattaggtagtgatctcagtctgtggctctcaaacttctgagaagctttaagaaaatccccatgccttaccccagaccaattaggacataatctctgggggcgggatccaggtaccagtattttccaagctccccaggtgattccagtgggcagccgaaggctgaggacatgtcatttgtctttgttagcttttgtgggacaaactgcattgtgaattaactttctgtatcttaaacctactcgacctactactatttgtgtggtgggagtcacagtgcaaaagacatctccccagattaccccctaaagaagccctgagtgcctacttaggggttttatcagagtgacattaaccactaggcctggttgggaggcattttgaaagggcagaaagaacatgttgtccattgggccagggttcagatgctggctttgccactaactgtgtatcctccgatgaggagcttaactcctcaatgcctgtgttttacttatgtgcaaaatgaggattctaacccttgccgcccaggactcaggtaaggattaaaagattacaactggatgctgccctgagcaaaggaaacatcattcccaccttggaaggaaggcccaggttgctgggacatgggcagggatgccgcccaggatgccccacaagtccatcaaagccatcagtggggcgagtgacgcactcacaggaacatccccctcatgtcctctctccagcgtccagaaacgtagtcactaccaggcagtgaatttaatggttcaggatctcttcttctctttgtaggatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatggtgagttgaacctctgataactgattgtttgatatacaaccagagccatgccttgatgtatttccttgtatttggcaaaagctaccaggtatcgagcgtgaatggagggtccatgacacaaatattggctttaccaatttagagttaggactataaaaaccttcaacatgctattgatagtaaactaaagtctatggctggcagaaataaatcaaatgttttcatcagtgtaaaggtgaaaagggtgctgaagatttttcaaatgccaagttcccactatagaaggaggtaactttcatgtggtctcagtgctcccctttggttgtctttaaatatggatcatagccataaagacatacatgaaccatggaaaatcgtcctgatccttctgtaaatacttaccagtacctgctgtacagagcgcctagctgggctttgctagccactagaggtgcaaagattaaaacacaggctgctttctcaagcagcttatagtctaagacaggggttagcaaactaggggctgtgggccaaatttgacctactacctgtttttgtacagctcaagagccaagaatttttttttttttcttttttttttttttttgagacggagcatcactctgtctccaaggctggggagggcagtgtcgcgatctccactaactgcaacctctgcctcccgggttcaagcgattctcctgcctcagcctcctgtacaagtcaggggaatggttacttttgtaggggaaggaggcagctgttaaataaaatgcctgtggaaagcagagggaaaatagccacaaatagtgggaatcctcctccaaaggaaaaaaaaaccaaaaacatctcctcacagctttaaaatgacagctttccccctcacttctacccatcaagtttcaaaaatagaggtctagtttccaccagggcacagcattaagtcatccactgcctgatgtttaacatatttggatcctttgagcattggtcaggacacagtacatggtggagaggagaggagcttgtttgtacttgagctagtggcacttcacctagagatggggacactgtgagggatccacagcccacctagcatggcccgcttttagctcttatgtcagattttgttggagaaagtcgaaagcccccttagactggagaggagcttgaccatcttgcttgatttcattgccagtcattcatgcgctgtctgcatctctggccactggcacctcatgtgcttccgtttcatccatacgcttaacagatcacaatgctgacctgccttggagggtgtgaggaagatgcaggtgacggggcagggctgaggatgctggggacagaaacaggacagaaagtcatgtgaggtggagaaggtggatgagatctgcccgctagggaagcaaagctgccactccatcaccaaaggcctttgtctcctcagtcctgtgaacccaaaagtatctgaaacaggtatcagccaatttagaaagtttattttgccaaagttaaggatgcacccatgacacagcctcaggaggtccggacaacatgggcccaaggtggtcagggcacagcttggttttatacattttagggagacgtgagacatttatcaatgaatgtaagatgtacattggttccgtccagaaaggtggggacaactcgaagcagggagggggcttccaggtcacaagtaggtgagagacaactggttgcattcttttgggtctctgattagcctttcattgaatatacaattcacatgggagaggagggtagaggaatagtcacttatgcctggtctggcttggtgaaaagacagggcagaggaagcaatcagatatgcatttgtctcacatgagcctcagagggatgactttgagctctgtcctttgtccacgaggaatttccttgtgggcaaattgtgagggaggtatgtagctttatctttgtgctatcttgtttaggaatagaatgggggatttgcctgtcgcagttcccagcttgacttttccctttggcttagtgatttgggggtctggagatttttctttcgtagtcctgtgtgggaggtttgtgcccaggaactcactgaggaagcagctctggacgctagaggcctccatgacagggccagctcgcagcggggacctctgggagggggacagtggccttccctctggagtcctggcctctgacagaagggaaggctcactgaagccaagaaccaccagctccctcctgctcaggtcctgttttcttttgaagggaaagaaacctagtctggagcagcagtgggaggaagtgggaggtggaactgctgaaatctgcttctctgaatatttttggagatgcaaatgcttccttgcagtgcaagggaaagtgtctcgtttctgcagtttcctggcattgtgaccatcaggaggtggcctccaaccgcccaggtatctcctgcagcacagaaagttaggggtgaccatcaggtctccaccatcagcttcaaaatagaaaagccaaactagcactccacaccctctgtgggcgcgccttctgagaacacaaataccacgtttttgaggccgcctcacaaagctctctgaaaagtggtcaaggcagaggaaagccaagcaacgggattctattcttcctggattgcccatgacagtgtgtgggtgaacacctgaagctttttccctaagccgttgctttgcttgcaaagctgctgtgaatcttagagacaaaagaaaagtagaggaaaatgagaattttatagatcgagcattaagcttgtattcgtgattatttgaaacttttggtaattttgcagaatcaggaaactagcaaagttctttttgagagggcttcttgtggcaattgctattctctgtgagccaacctgttacgaaaaataaaggtaacttttgagaaattaatatgaagttataattcagtggtatatggaatacatccagaatctatcccatgttaagtagcatgttctgcattttcagaacggctatttagaaagagcacctcttgagaggctgccactgattagctctgtgaccttggatgagtgagatcacctcttggggtctcctgtccttgttagttaagagtgacccgaaaggccctgacattgcttcgggcactccaattctagatcctctagctctggggaatgtggctggctcttacttcccctgctcccgtgctggcttttccttcttgctaccaatgccggggcgagggtccccacaatgtgttccacaggtcagtattgggcctgaaaatgcacaatccttccacttaggggacacacatctacctgtttcagtgatgattgtccttcctcttgttttggcctagttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtacttccttctaattcacccctcccccagttatttcattatcctctcgtgcatatgtctggacctaattattacatgcgcatccttttaattgtcatgatctgtttcatcccttctattagagtaattttatacttttcccttcaatatgctattttctgggtggaaacttcagggaggcttttagcttgctaggtatcaaaatttcgttatattttcatgttaagtgtgtagtgaaagaagcttttcttaatatgaaactactttataatgcagttcaatcaaaaaagacttctggatctccgctacaaaaagattgtattttttctttattttcagttttataacatccaactttccattcaaaataatattgcacacattgtataattcaattaatttgcacatccaactcctcaaatctggtctttttaaaatgaccaactgcttaaacttcatctgtattgaaaaatacaacattagatccagccatattttaaagtcatcagaacatactctataaatcattatcagctgttagaaaccagttcaaacattttctaatgagtgagatccttacaatggggatctaaggttggttcattgtgacaaaccccagaagagaccactggctcctcctgtcagttaatttgggacttgacttcgctgctgagtaagagagggcagctgagtaagagggcagcatcctgagggaggagtctaattactgcttccagccaccatggtaggaaatcttttcttggcagaaacaaccgggggtgggggggaatagctttcatcagaattgaagaggaaataactgtccttccagagcttttctgaagagagatgactatttcatttttgctgtttttctcatgtggcttagtctcaacatcttaccttacaacataatactaaatttgcttgaaactacctatcagactaacctcttctcacaaagaccaaggctgaacaacactgttctttatgatagagctaaaaacggagcctaaagttggctgttaaagttatttgtaaatgaatatctaaatgtatatcattctcctattccttaaaagtaagtgttttgccacaaatttttggtaatcagcaatcatctttttaaatcctctatatttgcctatttattgttatagttactggtttcactgataatttggggtaatttcccatgcttctgaagtataaagatgtactcttggcccgtgtcaaggatgaaaggaataaggattttttttcttctaatactcctttccttaacctcctaggagtgtttaatatttaagcacaaacttatgcattaaaggggaaaaaaagcagcagcccactggacaactgtcattgcagaggagcctcagggtttaagtgagagagaaatcatagactctgcttgtcccaccctctggggtaaaggacagtagtgttttttctttttaaaaaatttccggccacgcacgatggctcatgcctgtaatcccagcactttgggaggctgaggcgggtggatcacgaggtcgggagttcaaagaccagcctggctaagatggtgaaaccccgtctctactaaaaatacaaaacttagctgggcatggcggcaggcacctgtaatcccagctagttgggaggctgaggcagagaactgcttgaacccgggaggtggaggctgcagtgagccaatattgcagcactccactccagcctgggcgacagagcaagactgtctcaaaaaaaaaaaaaaacaaaccaatttgattttcagtccaaaaatattttctaatacgtttataagacataataaaaatgaatataaaaacaaagacaaagtacaaatccagagttttttattggattcccacaaacataaattactccgtcaaattgccatgaaagtttgagtgtatacttgcaattttggaacttaactcctggcagaccagtaacagagcttggacagcaaggccacagaccacagcattcatgaggaaatgtattttgacctcaatgtgataaaatgctttatgagggggttgtcctgcagtaactatagggaaagcctggctttgaaaattaatgtttacaaatatgaacttccaaatgtgaaccctcactgaataaagcacaatttgtaggggaaaaaaatatcaggctgtttaaatctcttatggactagttggctttgcttttggcctattgttcaaatggggctatttattccaaaatgcttgttctgcagacagcagatccatcaattcttaatgaagaacatagcctacaattacactgtaactggcatccgaagtggtggggtctgttaagaacatgaggcgctatagtttgtactaacatcctattggggttcattttacaggtatcattccttggaatgctttccccggaaaaatatgtggctctgccctggagaacatctgcaacacaaacgaggtaaactcatcacagttcagaataacccttgagtattaggctgagaaaaaagggttctcccagctgtagaaagagcgagagagatggttaaaatgccattaaggaaagctccttgtttagaatctttaagatagagctatatgtaaccatcactattcagccatttttgacctacaaaaatggtcacttcatatggtccaacacatttggtgagaatccttaagaagtggagggcttttcctttgggcaataatttagaggtgatcccaaacctagaaatctaataatatatctagattcttctctcacctcttctacttctactctttctactttgaaagattttcaaagtagaacacctgtcacagaacggatgtaagttaattttcatagaggagtccctctatttcatagaggaatttgtgtatatacccaacttttaataaatgaggccacagttaatcatttatatttctggaatgacttgctacttctctaattctcattcgtccttactagggagtgtgtcctaacaatttggtttaaattgtctcagccctagaacattcttcagtcattggcttgtaactgtttataaaggaaaattcttaaatgcattcgtaggtgcttgtatatttaagaaaatcctggcaagcttttaagaagcagtgagttacagaaataatcagctcctaccctatctgacttgtcaatttgtatatccataatatgcagtggcttgaagcagggctccccaccgtggctgcatgttacagccatcaaggcagcactatgttatactgatggctgaggcccagcccttaggtattcagatttaatcgatttggggggcagtctgggcatcagaaagtttttaaagctcctcgggtgattccaccatgaggccagagcatgaagagaaggcaggcctgtgcccagtcttgcagagaagagctgcaaaggagacagatgaagcagcaccccacaatgagtgtaggccatttcatttaacatcaaatgcttatgttgatgccctgttcttttgtagttctacatgtcctatcacctgttcattgtggcctgtgcaggagctggtgccaccgtcattgccctggtgagtaatggccccaagaccaccctagtctagcctcctccctccagcttctaaatgacagatttcccttccagcttttaccagcctattgaagccaatgattctggcactcaaccttggttaactggcgcctgtgttaacttaccacatgtagtttacagaaagtattagttggttgccttggcactgattgtaggtgatgtaatttggactctggaaagaaaagagggtatcaacacctatcaactaggcctagcatattaccttgttgcactgagcacttagcttcatgacttcagtcgcagacagatgcaatgctcacgtgaggcattacccatttctttgccaagggatattaatttacaagtggagatatgcacatatacatacatttatatagtcactcatacagggtagctgtgttccataaagtcacctcaagcaatgaattagcgaatgctggaccactgctcctaggggaaatacatggctaggtttctgtgagcctctggtcacatcattttcagcaacctatcaacacataagcttgtttcgtgtgtttctgtgtaaatacaccgtatttaatatatattgttgattccttaatattgaattcatggccaatagctctatccctatgcctgaatgaagcttctctaatgaacattttctctggtcaggcagtttgcaaccttcttgcacttagggactctagacagcactgcagcactatgcttgggagccattttaagcagcaaaatcacccacaaaatgcacaaaaatgtgaaaaacgtggcactaaatatacttcgagtatacttatttacagtctgagagctgaaacaagaaggcagagtattgccttgttcagcctcagctgggaatgtgcataccgggcaactcaactttcaccgctctgcacatgtctgctaataactgcgaaagaagtgcctcaagtattaaggattacaaatgaatcttagcaagtaggcagtcacaaatgtggaatctacaagtaatgaaaatcaactgtataaatacacgctcttatgtatgtatgtttgtatacatgtaattttggagggcttggtttgtgatttcaggaaaaccaactaagattggtagagcaagggaaaaatctcagctgcttgtaaattattcattcccagtttttctgaccattaaatccccttagaatctatgaaaaaaaccacctttaaaatcatggggtgacctgttcttttggttgagcaacagggaggaaagataactgcctgctgctgagcaggtggttttggaaagatgagaggattaaggcatttagcttcatccttctcatgctgttgacccagctctctgtcttgttattcttgaaacgcatccaagtccttttagtaaactcactgagggcagaaccaatgacttacattgtacatgtgtgatgagaaaaagtttgtgtgtgctagataggaaaattgtctgttgtgattttaagtgggaaaaaaacaccttagactatgagcaggcacccgtccccacccaagtttagaagtgtcatggcatcggccctcactgcctgtatcttactgtcctgttttgttctcttccaccagctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaaggatttatatgtgggtagttttttttttggtacaacacaatcattctgttagagcccacaaaattggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcatcaagtgtaaagaatgatactgaggatttttacattttatgaaatgaaataatggcatttacaaaatgaaaaatgtagtttcacaactaagttttgttaacagagactgcatgctttgcttatagttcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccgaactttcgcattagtctttaaaattactctcaaaatggtattaaaaaaaaaaaaaaaagcaccctctcgtatttcatttttgctttttcttaacaatacctttggccatttttttccagttcactatgtttgtatactaacttttcttcagccttttaatgcgaagccaactagtagagcatgctttcaggatctgacagctctgctagtagagcgagtatttattaatacagaattaaccttcgcccctttaaagtcaagtctgtctaatctaactagcgcctcgctttgccttctcacaatgctcactagccatcatgctcacccttctcttccagatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataaatgtttgccagagtgtttcggccgacgtatttacagctctgacaaatcatcagacagctgctctgcagtacagatgtgtatcccaccaaactaatgtagatgtacaaacacttcactgtctgtctcaagctgctgggatgtatctctaggaaaaccttccagtgggtaaatctttttctttagaacaaatattggaggtttcatgttagccattttaaaaggcaacactttgacaaaatgatcgttcatactttgggaatttgtggcatgttcacatttattgctagggcaattctaccaagacactcaatggaatatgtcacactccttaatagggacctgtgactccttaataaggacctgtgacatgcccagcatcaagggataagaccgtaaattcacatatatgccatctgtcctcaagtgttatctacataggaaataaaatggaattgatgtaaagttccatttctgacagctgacatttattaaactttggatcaaagataatgtgattcttatgattgatttctcaaactagcttttccctcccaagtccaggacccattaatttcctgagccaatcagaaatatatttttcaataatgctaaaattagctacaattctgctgaccctactattaaagaatctggatgctggactcactgacaagctttccagaagcaattttataacagatttcattttaacaaaatactgatccaattttcattattcttgagaaatgtcagctttgccttaatgagtatttgctttaaatttctaagaatttatatcataactagagacccaaatatctttcacagaattttgttccataaatgtttttcttaattattaagaagtgttaccttattaaaatgaccaccattctaaaccatttttcagtggtctggatacgaagtttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtata

SEQ ID NO: 3066 - DNA, 44370 bp, human; identical to SEQ ID NO: 3056

SEQ ID NO: 3067 - DNA, 43115 bp, human; identical to SEQ ID NO: 3057

SEQ ID NO: 3068 - DNA, 46311 bp, human; identical to SEQ ID NO: 3058

SEQ ID NO: 3069 - DNA, 43392 bp, human; identical to SEQ ID NO: 3060

SEQ ID NO: 3070 - DNA, 33874 bp, human; identical to SEQ ID NO: 3061

SEQ ID NO: 3071 - DNA, 109204 bp, human; identical to SEQ ID NO: 3062

SEQ ID NO: 3072 - DNA, 164078 bp, human; identical to SEQ ID NO: 3063

SEQ ID NO: 3073 - DNA, 109704 bp, human; identical to SEQ ID NO: 3064

SEQ ID NO: 3074 - DNA, 167182 bp, human; identical to SEQ ID NO: 3065

SEQ ID NO: 3075 - DNA, 44370 bp, human; identical to SEQ ID NO: 3056

SEQ ID NO: 3076 - DNA, 43115 bp, human; identical to SEQ ID NO: 3057

SEQ ID NO: 3077 - DNA, 46311 bp, human; identical to SEQ ID NO: 3058

SEQ ID NO: 3078 - DNA, 43392 bp, human; identical to SEQ ID NO: 3060

SEQ ID NO: 3079 - DNA, 33874 bp, human; identical to SEQ ID NO: 3061

SEQ ID NO: 3080 - DNA, 109204 bp, human; identical to SEQ ID NO: 3062

SEQ ID NO: 3081 - DNA, 164078 bp, human; identical to SEQ ID NO: 3063

SEQ ID NO: 3082 - DNA, 109704 bp, human; identical to SEQ ID NO: 3064

SEQ ID NO: 3083 - DNA, 167182 bp, human; identical to SEQ ID NO: 3065

SEQ ID NO: 3084 - DNA, 44370 bp, human; identical to SEQ ID NO: 3056

SEQ ID NO: 3085 - DNA, 43115 bp, human; identical to SEQ ID NO: 3057

SEQ ID NO: 3086 - DNA, 46311 bp, human; identical to SEQ ID NO: 3058

SEQ ID NO: 3087 - DNA, 43392 bp, human; identical to SEQ ID NO: 3060

SEQ ID NO: 3088 - DNA, 33874 bp, human; identical to SEQ ID NO: 3061

SEQ ID NO: 3089 - DNA, 109204 bp, human; identical to SEQ ID NO: 3062

SEQ ID NO: 3090 - DNA, 164078 bp, human; identical to SEQ ID NO: 3063

SEQ ID NO: 3091 - DNA, 109704 bp, human; identical to SEQ ID NO: 3064

SEQ ID NO: 3092 - DNA, 167182 bp, human; identical to SEQ ID NO: 3065

SEQ ID NO: 3093 - DNA, 164078 bp, human; identical to SEQ ID NO: 3063

SEQ ID NO: 3094 - DNA, 167182 bp, human; identical to SEQ ID NO: 3065

SEQ ID NO: 3095 - DNA, 164078 bp, human; identical to SEQ ID NO: 3063

SEQ ID NO: 3096 - DNA, 167182 bp, human; identical to SEQ ID NO: 3065

SEQ ID NO: 3097 - DNA, 164078 bp, human; identical to SEQ ID NO: 3063

SEQ ID NO: 3098 - DNA, 167182 bp, human; identical to SEQ ID NO: 3065

SEQ ID NO: 3099 - DNA, 26161 bp, human
gtggcctctggcgggcctccagccagttaggtaaaacgtgtgtgtgtgtgtgtgtgtgtgtgtgtgtacacgagcgcatgcctctctctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcggtgagtcataggggcagtggaatcagccctggggaggttggctaatgtgcttaggagaggagggttgggcagtttcagtggctctgtgtgaggtgtccatggggctgttactgggcagatgtccacagctcactggtatatattctttacacagctgttcaaaaatgtgtatacttctttctgcagaatcctacagacaagacaaattcaattgtcacaaattattctccagtgaaaatttcagctcccaggaatcattctttgtgggtcaaatgcattatttattaaattggaggtttgaaagttacttataaataggaaaatttttaatgctaaaactttttaatttgtaagtcttaggtgtttggcatttaggtggggcagggtttataaagatgttcaaacattgagcactgattgagtcactttcaaaagagacaaaagagactttgttttacttaaaacattggagaatcatcttacaggtattgttctcatctgtcaagtggtgtctgtgctaatgtacagaatcccacaaatacacacttcggtgagcattcagcaggtgcctgttggctgaaaggattctgaaaaatgggtttaggcatttgcacacaggttcttataaataatagtatattggttagtaatatactggttaactctccagccccaagtctgcaaacttgctgatgtcacgtcctttcccaaactgagaccaatcagtgaggaaaccttggagtttatcgggaaggaaactcaaagttcgtaactttcggagagcaaagggagcagcagggtgagggtgaaggcaacagctcactttctgcaactgttgttcaccctgttgagatccttgggggcttgtgacggagacaagccccagcacccagagctgggaaagctggtgttgcagcagccctgctgaattgctgtatttattatttattaatttttttttctttttgagacggagtcttgctctgtggcccaggctggagtgcagtggcgcgatctcgactcactgcaacctccgcctcccgggttcaggcctgtatatataggcggggcacggtggtttacgcctgtaatcccagtactttcggaggccgaggcgggcagatcacgatgtcaggataccatcctggccaacatgatgaaattccgtcgctacctaaaatacaaaaattagctgggtgtgatggcacgtgcctgtaatcccagctactcgggaggctgaggcaggagaatcacttgaacccgggaggcggaggttgcagtgcacctagatctcgccacagcactccagcctggcgacagagtgagactccgtatcaaagaaaaaagaaaaaaatatatacctggtatactgtccacagcacctgttgatcaaaggggcaataaacagggaccctgaagtcagggtgttttgttttgttttgtttttttgagacggagtctcattctgtcgcctgggctggagtgcaatggcgagatctccgctcactgcaacctctgcctcccgggttcaagagattctcctgcctcagcctcccgagtagctgggattataagcgcccgccaccacacccggctaatttttgtatttttagtagagacggggtttcaccacgttggccaggctggtctagaactcctgacctcaggtgatctgcccgcctgggcctcccaaagtgctgggattacaggtgtgagccaccacgcccggccgtcagtcagggtttattaatctactatacaggtaccaaaaaggtaaaaatggaagaaataaaacacaaaacgtcttccctttgactgagtagactagcctgctcattcattcattcatttatccaatttcacttataaaatgagcagagtactcaatggtgagtgggatttagatccacaaaggcagaactggattaatcagcagatgtattgagcatgagtttggagaactaggaaagcaagagtggcatcaaaaatcacttttcacaaagaatttctttttttttttttttttttgttttttttgaagtggagtttcactctgtcacccaggctggaatgcagtggagcaatctcagctcactgcaaactccaccttcccgtgttcaagcgactttcctgcctcagcctcctgagtagctgggattacaggcgtccgccaccacacccagctgatttttgtatttttagtagagacggggtttcaccatgttagccaggatggtctcaatctcctgacctcgtgatccgcccgccttggcctcccaaagtgctgggattacaggcgtgagccaccacgcccggccactttttacaaggaattatatatataattatatatatatatatattttttttttagatggagtctcgctctgttaccaggctggagtgcagtggcaccatctcggctcactgcaacctcggcctcctgggttcaagcaattctgcctcaggagggagaggcagggactaggtgggactacaggcacacgcctggctaattttttggggtgttttttttttgtattttagtagagacggggtttcaccatgttgccccaggctggtctccaactcctgagctcagggaagtctgcccgcctcggcctcccaaagtgctaggattacaggtgtgagccactgtgcccggccgataaatatatttttaaaacagcaaaccaatcattatgggaaagaatcggtaatttggttgacttctgcacggttattttatagctaagtattgtatttatttttgtttccacatgggagagaggcaccagccacttttcactgttagggtttctttttcttttttttttttttttttgagatggagtctcgctctgtcgcccaggctggagtgcagtggcacaatcttggctcactgcaagctccgcctcccgggttcacgccattctcctgcctcagcctcctgagtagctgggactacaggcgcccgccaccacgcccggctaattttttgtatttttagtagagacggggtttcaccatgttagccaggatggtctcaatctcctgacctcgtgatccacccaccttggcctcccaaagtgctgggattacaggcgtgagccaactgttcaggatttctaaagttcctaatacaaccctggtggggtcagggtgggtgagtgggagtgggcaggtgttatacgcaaaggcatggtgcttgtaaagtcaacaagtttttacagctagagtgcaaaatgtgaatgtcttagggagtctagtgagaacaagtttgaagagatggagtggcagataaagcttgaagagctaagtggaggaggtcaggcttcatgaggcaggaaattgagagccattggtggttctagaacagagacctggtaataaggctgtaggtcaattaacatggtagccacagctgggatagattgtgttggaatcgtgggagatggttgcattcatccagtggttctcaaattctcatgtgcctctacatcacctggagagcttattgaaatacagataatgcagcttctggctgggcacggtggctcacgcctgtaatcccagcactttgggaggctgaggtgggcggatcacttgaggtcaggagttccagaccagcctatccaacatggtgaaaccccatctctactaaaaatacaaacatttgactgggtgcagtgcctcacacctgtaatcccagcactttgggaggccgaggcaggcggatcacctgaggttgggagttccagaccagcctgaccaacatggagaaacccagtctttactaaaaatacaaaattagccgggcatggtggtgcatgcctgtaatcccagctacccgggaggctgaggcaggaaagtcgcttgaacccgggaggcagaggttgtggtgagccgagatcacaccactgcactccaacctgggcaacaagagtgaaactctgtctcaaaaaaaaaaaaaaaaattagctgggtgtgttggcacatgcctgtagtcccagctacttaggaggccgaggcaggagaattgcttgaacttgggagggcggaggttgcagtgagctgagatcatgccactgtactccagcctgggcaacagagcgagactctgtctcaaaaaaaaaaaatgcagatgatgcagcttttgatgaagtcgtaggcctggggtgggggcctaggaatctgcattcataacaaactcccaggtgaaatggatggtactggtcagggaccatactttgaaaactactgcactaatccaaccatgaaacttacatttggatcgaactttggaaatgacagagaaagggcgatgatttcaaaggaaagataaatcagcgtatgttgcttgattaaatgttggaactaacagaaggcaggcaaaattataaggttctcaagcccaaagtaatgtcagataagctagataagagggaagttggaaaggaagttgccttggatgcaggatgaggaggggaggatacagagttctgttttggacatgatagtgctaacaatgatgcccagtgcacagtatgatgacatgggactgagacttaggaacgatcacaggttagaagccagatacctcagaatgtcctacagaggggctgtggttgaaacctagggaagggagaaattgtccaatggctaagagctgagagtcaaccaaggatggaaccctgggacaggcctccagttgatgaagtaggaccagtaagttggacagagaagcagaaagagattctggatgttgtaattacacaggtgctaagggaagagaagttttcaaagaagtagaagtcacaagggtaggtgcctggatacttctggtttcttacctcctgttgtgaatctgactggcaaattgctactcaccttctacacccagctgagccattgcccccatgaagccctcctagactttccacctctccctactcaagtggagtcattctccgtctgctttgcatcagtcctgccccttgggtaaaacctcaattgtagttggttgcttttgtttatgcttctgaggtcttaaccttggtgaagtgtggaatggggaacactcagaatgctgttttcaaatagctgtgccaagaaactcagctcaggtgaagcttgtccctttgcacaaggccaagttagaggggaaaatagggcccaggtgtggatcatcttgctgctcccacctccacctgcaggcgtttttctgcccacttccctgggggtagggagggaggaaaggctataaaaatgggcaaccaactctttatagagatttgtttcatgttagactctcctgtccaaggagcagggaaagaatgtcttaattttttcctgaaagtagcttgttacgagttaaattgtgtaccctgaaaatatatatggttaagttcttaacccccgtgcctcagaatgtgaccttattagttaagattagttcaggtgaggtcgtaagtagggtaggatggaccttaatccaacatgaccagagtccctataagaaaaggagaaggagacacatggagaatgctatgtgacaacagaggcagagataggagtgacacatctagaaaccaaggaacaccaaggactgatggccactgccagaagctagaagaggcaaggaaggatttttccctagagcctttggatagagtatggccctgtccacaccttgatttcagacttctagccaactgctagcctctaggactcggcgacaacaaatttctgttgttttaagccacccagtttgtggtgtttcgttatggtatccctaggaggctaatttatacctactcatagaaacttaggaaaatacattgaaggataaactaaccacccataattccaccaagcaggtaatcactgttcccagtgttagtgtctatcttttggggttttgcctgaagactgacaactgtagagatatttctatccttgcaaaattgagcccaccctgtagagagtattcacatttaaacagaagacaagctagaacaggtattgaaagaaaacaattttattgtcttatggtgaatttttagatattggggcacctcaggaggggtgagttttctgggggaaaacctgcctgttgagacagaatgggtgataatgtgagggccctttggagaaggcagctttatattgagagagagagagagagagagaagagagagggagacaggaaagagaagagagagaagagagagaagaaagaggagaggagaggctggatgatggaactggagaaagaactgcagtggacaggcctgacttgcccaagagttgcctcagtgggcctttctgtttgtttctgactgtaagcctcttgtttctttttctcctctttctgtttgtcctgggatcaaaccaaggtccacaataattgtgaatacagcacccagatactttccaggttctggcaggttggttcatgccactgaatccacccttattgtgtcctgaagactgaaggcaaatactcctgtcccctcagagcaacccgacttcttttttgtctccttgactttgcaaaacgtttctcaggatgagtagatttatgctaccgcccagcattcactggggttctcagaacatcagtaatagctattttcagcatgtagcaattagtgcatcttaaatctcttttgaaataatggaaatgaaaaaaatgttccacaaattacaataaaaatgaaatggcagcctccctaatgtgctccaggtttgatgagggtacaatttaaaagaaagataagttcttgctaatacacacacacatacacacaatctatgctctctgaatgttagaaaaatgttaaactaggccaggcgcagtggctcatgcctataatcccagcactttgggaggctgaggcgcatggatcacttgaggtcaggagttggagaccagcctggccaacatggtgaaatcctgtctctactaaagttacaaaaattaactgagtgtgatggtgtgcacctgtagtcccagttacttgagaggctgaggcaggagaaccacttgaacccaggaggtggaggttgcagtgagccaagattgccccactgtactccagcctgggtgacagaatgagactccgtctcaaaaaaccaacagaacattacacacaaagaaaaatgttaaattattaattgtcactactgtaaattttcacataatcactcatttgttctgatacctgctgaggtcaaagtccttgtataaatttgagatggattttagttttacagggactcacgtttttcttctgggcaggagcataggcatactgtgacaggcttaacaaaccctgaactgaaatgactttatgttagaaggggaagcctcatatcctgctgatgggaacatacagtagggcagccactttggaaaacagtctcaaaataaacattgtgttaccatatcatacagcaattcttttaggtgcatattcaggagaattgaaaacatatatctgctcaaaaacttgtatatgaatgtttatagcagcattattcataataggcaagaagtagaaatgacacaaatttttatcagctgatgaatgaatacataaaatgtggcttatccatacaatggaattatttggccaaaaaaaaaaaaaaaaggaatgaagtactgatgcacgctacaacatggatgaaactttgaaacatgctaaataaaagaagccagttgcaaagtaccacatactgtatggtttcatttatatgaaatgtccagaataggcaaatccatagagacagaaagtagatccatggctgccaggggctgagggaagtagaactgtggagtgactgctaatgggcacagagtttctttttggggtgatgaaaatgttctaaaattgattgtggtgttggttgcatagctctgaatatactgaaaactgctgaattgtacacattaaatgggtgtattgtatggtatgtgaattatatctcaatacagctgcttgctagctagctagctagagatattcacattgtcagcccctcactacgtgtaccaggacaacactctgtacttctcaaagacacaagctgtctctgctctgtaaacactacattctgcagaggtgcaaattcagatagccttgttattctcttggagaagtacgtacttctttatttgccccaaatagaaagagtaatggtcccatgatgaatgagcagaaagtaagaccatttgtggctacacttgataaatgcgtcatttttatgaaatctggacagttacaaattaggatgcaatctacctgcctggactgtttagcctgtcgacaataataatcttagggagctctaagagaggttggggaatgtggcagctgtatttcttagcagctgagcacttggaaaaaaaagtggattaatcatcatacatatggtgatccatcaagatacatttgcaaatctattgaaaactgattttcaaaacctttctcaatttgtggctctttgttctcattcaagattttgtgtgaatggtatttggcattatcagcaccaacagggtggaattagttgtccttttaattctaatttggagatcaatctttccatgtctgcagtccgaattttagcttccaagccctagaatcagcagtattattccagaaataattaggagcctcagagaatgccgtgaggacattgagtatctattaagcgtgaggttttgacggtacgaaaagccatttcacttaagatgtaccttgtctcaagcacctttagtgaccccagaaggaaagcattggatgggcggtatgtagatgggctcatttgtcttccttttatgtactaaatgcttaatgaatccatctggaagaatggtaatttgcttactaatacagattttccagggcactgatggcttcaggtggcagacagacgggcctcatgtgttaagtacaaagtgttaagccaacatgtgttaaatacaaaggatacttcatagcctttcagtttgcaaggtatagatagttaagtatcctccttctccaggtcttctcagtttttaggagctattagcttccgtgcaaggcataactggcaccagacctttctaccttgtttgtatgtagtgtgtttggcgaagcaggtggagctggagctgaagcaggttcaggcacgcctccctcacatttctactggaaatcagatgaagcttgagatgagaaaaaaatcagatctatgcctcattcagttatattcaattaagagagaggaaagcatttaatgggttgggattgggttttcaggcttctttcctaagaatttgttttccttctatgtggttgtagaataaatttgctattttattttatttttttgagacagagtctcactgtgtcacccaggctggagtgcagtggcatgatctcggctcactgcaacctccgcctcccgggttcaaccgattctcccgcctcagcctcccgactagctgggattataggcgtgagccaccacacccagctaatttttacatttttactagagatggtgtttcaccatgttgcaaggctggtctcgaactcctgacctcaggtgatctgcccacctcggcctctcaaagtgctgggattgcaggtgtgagccaccacgcctggtgtaaatttgctattttaaatagcaatgatgatgaggtataattaagactctctgtttagtgttagggcaggataataatagtagctagtatgtgttgagccatggtaagtacaggttgagcatcccgtctctgaaatccttgggaccagaagtgtttccagttttttcagatgttggaatatttgcatatacataatgacttatcttgtggatggtactcaagtctaaacacgaaatgcatttatgttttatatacaccttacacacataacctgagataattttatataatattttaaataagtttgtgcatgaaacaacgttttgactgcaacccatcacatgtcagatgtggaattttccacttgtggcatcatgttagcactcaagaagctttggattttggagcattttggatttgggagttttgggttaaggatgctcaacctgtatgttatatattagggctgctcaacttgtaactttacagagaaggaaactgcggcactgggcctttcccgggacccacaggtcagaaaaggtgaagcgggtctgaattaagagctttctttaaccaccttggcatgctgcctttgagggtaaataatgtccctgtttcaaggtgagactgaacactgatttgtgcttaatattaggacaggagataatctataaatagatatggttctgtttagatttgattccaaacctaatggtgtatgtaattacatgattactactattaatacagaacactgtttggtgagatgccaaagtctgtatttcatgcaggaaactagactgacagctacagcttaacacactaatgttggtaattagtgaagctctcgcttaactaaatgggccatttgcctttgaaaccagtgtgtaaatagaaatagagtaatctgtcatcccaatccacctcttttgtccttagtttgaggactggctgtagttctttcccaagctatccagacatttcaaacaaactgtgcacaaaaaatattaataaagaagagaaatgctgaattcctgatgggaattttggttgagtgaatccaatgtctccctccatccagggcctgttaggctcttattgatgggcaaggataagcctctgggtctaagtgcattagcaggatataacccattcccctctttccatacagatgctgtgtctgattggtctcctatgcatgaagctgcaatccacggacatcagctgtctctgaggaacctcatcagccaggtagctttttgaaaatacaatacagaagaaacctatcaaaatattaaaacaaatgtgtgacataataacatagggacttttaaattaattcattaaatagaagacctagtggtgattctagtaactaccataacgtctaaataggatgagtatagattttgagatattttagatgtctacagcaattgtaatacaatagaaaatatctgtaatttctattggagataaccctacataatactattactactgtggtttgttgtctacattctgaactgaaggaaatgctaaatttcagatagagctgagtgagaataaatgtgctttaaaaaatccaatttcatagacctatctagagtaagaagtcctcctataagaaaataatttctaaagaaaaatttcatactatcctaagccactatcttaagccatttttggtagcagcagtctattataaatagattataacactaattctagctaaaagaagttaggctacttctcagataaaattagaaatttaccctattttgatagcatgaaaaatgatcactgcagcttttatatatcacttcttaaattggacagatactcatttacattcagtatttatgtgtttatgaaacatcagccagaaccatatctccaagttctatcacattatttgtgtaagatgtctttttagagccccggtttctgctttcataaaatgagtattctaatacctacctaggtcagtccaccccataactcaataacaaaccatcccaaaactcagtgacatgatacagtaaccattatttcttgctgatgtgtgtttgtgtcagttcatctaggctgggcttggctgggcttggctcccagctgtgggttgggtgtagccctgctgcacatctctttcatcctgcttggaccactggctacctgaggaattattttttcttggcaaaacgctggagcacagcaggacaagccccaccatgcaagaatacttccaatctgttcatgtcacatctgctaacatcccactggtcaagtcacatgaccacatccaaagtcaaggctcaagagaagtacattttgtcaactaagcgtagttgacgactgaaaatagatatattaaagttaagccattcaatctttttttaaaaactaagaactgactgtggactgaacactgtgaagtaatgggttaattaccttatgattttatatgactcagacttgttaataatttagacaaatcacagttaatttaaggtagaactgtagcttgatgatgaactacaaatgagtttctaactttacagaaggaacctctctgcaatgtgaatatgtggtgaaaactttttgtgttacgaatagctgtgttgttgtatttcatttacgtggatttatgtataaacacctaaatgctggttttatttttatcattattattattattattattatttttttgagatggagtttcactcttgttgccatctggagtgcagtggcgcgatctcggctcactgcaacctccgcctcctgggttgaagcaattctgcctcagcctcccgagtagctgggactacaggcatgtgccaccacgccccgctaattttatatttttagtagagacgaggtttcaccatgttggtcaggctggtctcaaactgctgacctcagataatccatcagccttagcctcccaaagtgctgggattataggcatgagccaccgtgcctggtctaaatgccggttttacaatggcagttgtgcctggaggagtatgcacattttcctattggttgtttttatggttgccttttgcccaagttctgtacctcggcctgccttcccccaacttgtgtctgatacacttgcatgatttttgcttcatgtgacaatcatacccctcttgtggcattgacaaagctactttctataagtgtgatgactgtgagaaaataagatattttctcctgccaattggacatttaagtcttaggtatgaatagtaaagtaagaaatgacatattcttttctttgatcacgacaaaagttggcacatttttttctttctttttttttttttttttttgagacggagtcttgctgtcgcccaggctggagtgcagtggcgccatctcggctcactgcaggctccgccccctggggttcacgccattctcctgcctcagcctcccgagtagctgggactacaggtgtcccccacctcgcccggctaattttttgtatttttagtagagatggggtttcaccgtgttagccaggatggtctcgatctcctgacctcgtgatccgcctgcctcggcctcccaaagtgctgggattacaggcgtgagccactgcacccggccaagagttggcaaatttttttcagtaaaggaccagatagtaaatattttaggctgggaggctgaggcaggagagtggcgtgaacccaggaggtggagcttgcagtgacccgagatcgcgccactgcactccagcctcggcgacagagcaagacatcgtctcaaaaaaaaaaaaaaaaaaaaaaaagaatcttaggccttgcgaaccatgcagtctctgttggaagtacctaactctgctgtttagcagaaaagcagttgtagacaatatgtaaatgaatgggcatggctgtgttctgataaaactttgcttatggatgctgaaatttgaatttcataaaattttcacgtgtcacaaaatattcctttgatttcttttaaaccattaaaaatgtagaaaccattcctagctacagaagcaggtgtaggctagatttgactctgtaggctactgtttgttgacccccttgtcaaaactatgatagagctaggaaatctaagaaaaacaattaaatgtcaggaaaaggagggtttttttgagaaaaaaaattgggtgaaactgatatttttattacaaatattattaaatcctgtgtgttactaaatacttatgtttaaagagcaattatattagttaataggtacatttcaatttcctaaaataagaaagtacatttaggcttcctaaaaggtacatgcagcagtctatttcttttccctcgcagtttgaaaatttccttttaattgtctcacaaggtagagccacttgtgaatatgttaaaacttaataattgcttgttaaaacttagcaatttgggccacgctgactttaaaaaaattgagaaatttcataagcatgaaagaacttaaacacgtgtgcagttgaataaaaagtgatgatgatgagaatattgccatgtgactgcctccccaggtcaggaaatggaaaaatagcacaatgctggctcctccaaagactcacccatccctccccttattgtgctttctagaacacaatcctgtccctcttccacaggagtaaccattatcccgatttccttgttttctttatggttttactctatatattatgtcttctgaaacaatatggggtagttttgcctaattttgaactttaaattgatgtaatcattcagtgtgtatgcttttggattttgcttcttttgctcaacattatttttgcaagcatcacccttgtagtgcttgccattatgatttgttgggtgtaatctttctgctgaaagattataccaaagttaattaattcagtccattgttgatggacatttggtttgtttgcagtttttgactattatgaccaatgctgttgtgaatattcttgtatatttatctagatgtatatatacctaagagtcaaattgctgagtcataggcatatgcattgtcagctctaatagatacagtcaaactgttttcctgagtggttataccataccacactcccaccagtagtgtggcatttttttttttttaaagtcaatataaacaccttagtgtaacatctgactttgagccaggtcagctttgtcatagtactggaatggtggctgaaaagcagccccagggcactgttgctttgcaccccttactctgactgtttcccctccttcaggggtgggctgtgaacatcatcacggcagatcatgtttccccactccatgaagcctgtcttggaggtcatctctcttgtgtgaagattttattaaagcatggagctcaggtaagggcagctgaaacaacatcttagaaaccaagaatgaaaaatgactatgtatatcccttctgaataacttccagcacttttgattagactgatttgaaatatgaagacagttgtttttcaagaaaattatgttcatcaggcttgtttgctttagtgatggatggatgaaatactaaatttttagtcacgcttacagtctatatcattttctttatcatacactactaataaatagttattagacttctgtcttcattgttatggccggaaggtaatgaaatattgtggaaagcacacatttgcctgggatggctaggatgtctgaggagacagaaaatctatgtggtcattcatcctttagctggcaacctggacttgttcacatggtagcagggattgcaagagcagcaaaaatggacctgttttgtgttaggcaactgaatggtgggttggggaaaattatgggcttgctatcttctggcaacagcaaatgcaaagtcccagaaatgatagtgagcaatttttatatcttgaagtcattccttacggcaggacagtagagtaggtgagagggttcagaacataagcaaccttgtccatgccaaaaaaagaatgggctttgtcctgagatcagtaaagagccagaggtgagtgcactgccagatttatatttgggttaagaaaacattcaaaacttggaaacagggaacgtgtcaaggtgaagcaagagacacctagggtacaaacttgaaagaagtgctcgctctcagggtcctgcactatttgtgtgactccaaaaatgaatatgtccttaaattttttaccctgggcaacttttatgtctcactctggtcctggccctgcttggaagtagagtttgagaaggaattcgttgtcttcacaatatcattgcttaaaagattcaccagataatcatttaatgatatacaagaatgtgtctgcacttggcttttctattcactatttaattatagcccaaacactgtgaagttagacattaacttcgaaatttctgtctgatttccaacattagaaaagatagcctcaaagattatacttttatggccctataggacattaaccagtttttatgtttttatttttttaatttttgagatggagtctcgctctgtcgcccaggctggagtacagtggcacgaactcagctccctgcaacctccgcctcctgggttcgagtgatactcctgcctcagcctcctgagtagctgggattataggcacgcaccaccacacttggctcatttttgtatttttagtagagatggggtttcatcatgttatcatgttgcccaggttggtctcgaacttccgacctcaggtgacccgcccaccttggtctcccaaagtgctgggattacaggtgtgagccaccgtgcccggcggagttttgtatctattagcaaatatatttcagcagtccattgactatatacgtttttcttttttctttctttttttgagacagagtctcactctgtcgcccaggctggagtgcagtggcgtgatctcggttcactgcaacctctgcctcccgggttcaagtaattctcctgcctcagcctcccgagtagctgggactacaggcgcatgctaccatgctgggctaattttttgtatcttagtagagaccgggtttcaccatgttgcccaggctggtctcgaactcctgagctcaggcaatccgcctgcctcggcctcccaaagtgctgggattataggcgtgagccactgcgcctggccaaatgtttttttgagccagccttaccatcttactggttccctcattaatgagtgagttgaataaaatcttgggtatgtgttaattctatatttgtatgaaagtcaagttttttaaagttttctaaattatactttaagaatatactaaattacacagctaataatttcaacaatttcctcacagcagcaagagtaatcttcttgcacccgttaagaaattgaattggtgtgggatgggtctaggaaagaagtttaaaatagggattagtttgtaagcgattgaaattatcctaactagtttcaaagttcatgttcctggggagggcatggaggagatagaacattgagtaacattttcgatgctttatagccactccctaattccatttttcacaaaaacctgtggaatttcgtagttatttctccattttatagctgaggaatttaaggctcagagatgttaaataacatcttcagagtggtggaccccacatttgaacccaaaacatcccccttcctgtcttcattctggagcttcttttaccaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggtaaatctgttgagaatttttttttctacccactccttcaagggacatcttactgctgaaagaaagaaagaaaaggagatatattttagagcagtagttctcaaaatggagtcccaggactggaagcatcagcatgacctggcctgcaaatgcagattcttcggcctcactccagccccattgaatcagtaactggggatggggctcagccctctgtattttgtttaataagccctccagctgctttctggtacacagtaagtttgagtgcctcccttttagagcattttgaatgtttttcactgctgtattactgaaacagggcttggcacatagtagactatccatcaatatttgtggaatccgttgttatacccgtgaccttatagaaatcaagttatttcataaaacaaattatattcttctatttcagggccttaaagaacattgtctcagtgacacttaagtttgccaaatgaaataagctttcaatttttgaaagtatttgatgttgcatacagtttgggataattcttttcattaaagccataatttttctgatagtcttagctcataaaatcacaagtttttattttctccaatatttagcatcatcgtaatgaccataccttgccagagggctttctgtttctccagtggctttcatagaatggcttcccatttgactggaccaacccactcataatgatctcccaaagcattaatattatttattgagaacatcttaactcatcatattcgctgcatacatagaactaaaatacagcaagagaaacgtagaggagcaatgtcaaaaatatgacatcctggaccaaggaagtgtgattcagctttcacctagtttttcagattgggccctgctcatgttggatttggcagtttcttctaagcattgcctatacccgctgtggcctgttcctcccgggcctgcctttggagaggttgtaagtttccttccctgtcccgtggcccacactgtgccctttattcttcagttccaccttcaggtcctgttcctccatatctctcccaagctctcacttcaatttctgtacttagacaaactacaaagccacagacaattgaaaaaggtggatagttgctggttggttaccgtggctagtaaactcaaatggagtttcacccgtagttgcagattgcatcctatggtcaaaccattaactgatagcagtggttaaaatcactcctgatttggccgggcctggtctcacgcctgtaatcccagcattttgggaggctgaggcgggcggaccacgaggtcaggagattgagaccatcctggctaacacggtgaaaccccatctctactaaaaatacaaaaaagttagcagggtgtggtggcgggcgcctgtagtaccagctactcggaggctgaggcaggagaatggcgtgaacccaggaggcggagcttgcagtaagccgagattgcgccactgcactccagcctgggggacagagcgagactccgtttctaaaataaaataaaatgaaataaaataaaatcactcctgattctaattgaaggaaatagctttttggtcccctggataagctgctgccaaatttaatgcaaaatggggatggcaatgtctttctagctaagggaacttgtattgtaactgtttttcttcctgctttgggctgcaggccacgtggagtgtgtcaactctcttatagcttatgggggcaacattgaccataagatcagccacctgggcactccactctatttggcttgtgaaaaccaacagagagcctgtgtcaagaagcttctggagtcaggtaaagcaaaaagcaaaccaaaacaagaaaagaaaacgaaaagtaaattaaatgtattttaaacatcttactgctgtaggagagaaattagtgtgggcaatggagttggacaaggtcagggttcatattgactgtgttcccttggggaattatttcacactgtttgaactgtagttctctcatttgtaacaaggatgaggaggaggaggaggaggaggaggatgatgatgatgatgatgcctcttctcagggtggtcctcaatgattattagtttctcctccctttcctctgtctccctccatttggccagtcacattattaagccctgcataacttgcaaagctgttggattagtgttgaatcttcctatttgggaccttaaccagttctctttgattagatattgaacttgccccattgcaaatattatattttccttgaaaaggcctatgtacccttatttcttttcacctccctgctgttgtccagcccccttctcaacacctggaacaccatttcatcacctctttaattatctgagtcctatttattctttaaggcttcagtaatctgtttcccaatgaatgttgttgcagtccttattgcctcctactcatctggcaggcattgctatgaattaagagatgcaatctctgtctctcccccactgcccaccccacctctgccactctgggcagattttaagcctctagcctggaaagggccatgtttgatatccctcacaaagtcaggaacaatacaagaccagatcagttaacatttgttgagtggacatagattttcattttaccagagggatggcagctcaggcaaagccacatgttcccacatgtcacagtgaaagctaggctctgggctggggtggggatttgttaagagtgtaagagtggaattgggtggggacagtcctagaaatccaccttactcctgaaagggagaactttgccaccttccctgtgatcttgggattggccagtccaatccaggggatacccccatgagttggttggttgcttttcaaagtccaaatcaccagtcccaagtgtccagttttacaccctgtggcagctgcacaccaggtgagtttggctgcttggtgtaggctggatttcaccatctagtctctccgtcaggctgtactggctaatacttaggttccattaataataatgtggagcttttatgtcactaggatttttcttatatgcatcatgcctatctatgtacagtgctgaaaggcaaatttttaactttctatgctatattcctcatgctgtacattcaataacattatcaggtgggattttccccacattattaaatggaatcacatcatctcccatttttccaggattgctgtgctcaatatggatcccctcttgttaggaaattttggggctcggggctttgaaaagccccgatggttggattctgctccttgctgactcttttttgttctcgtgactgtttaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaaggcaggtatttggcaatttctggctcccattcctataaaaagatcattctctgacatcaccaaatctgggaagttgagataattcaatattcaatgagatacagtactggtcacagtacagtaaataactgtcctgctatttagcatattggatacaggtttttgggatgatctaatattcattatggggtaggccagttttttaaaaattaagatactgttttaaaattttagtattacatttatttaaaacatgctttagaatgaggcagcagagtcctctttggggttgtaagaggccgcaggatatcttgttgaaccacagatgggccagactactggacacttcgtttctgggcttaaaatgcagctgtttaagagtttagggttcacaccaatccaaagatatttactattataaattaaccaatgataagtccacacttctctataagtaagaactgagactcccaactcgaacaatgaaatattgtggttgagcagtgtgtatggaagtagggctttgaggcctgggctgggctggggaacaaagacacctcaagttggggagccacctcttgcaatcttcatgggctcagaggcagttgagaaaccagctcagtacttcttttcttaccggagtatggactctgaagtcttagggattctgggactttgaagcaggccttcctaccagaaggattctgatgttatacaatctagttattttctccccacatgatgagcagtaaggttggctttgggcagaactgtaaagtgggctaaggaatccttcttcctcctactctcactgccccagggtacttgcagtcaagtccctgcctgggggcatgccaaacaaggcctatgctcctgagcagtgctggtcaggcagaaaagattgactccaggcctggacaaggaacagtccagtagaggccccttacagttaagcagtgggataatcatggagcagttctatctgcattttaataattacttgttttgaaaaagttctatgtctacgaggcccataaaaatatcttaatttttaaacaatcagaataaaaaatgaatagaacaacatggattgtaatcatctttataccaacacagttgtgaaatagaatttttaattgttttcactgagaaagggattcataaaggcaaaagtgcctcaggtccccctcagtcataacgtagggcatacgttaatgtaggatgtatatgtcccctcctccatcaaacaacctcatagcattctcaaattgcctcccctggcttttcccttctgctttatttcccaaagccattcctagagacagtaattactttaattttgaatttacgttttgcacggtgacagtgtggcctatggtcccactagtttatgaggtgtcatttgctgctggagagaatcactacttgttttgcctccatgagtcaattttggggttttggtgtagtcacctctcagagggctcggagcccacaagaaatggggtcaggaaagtgcagaaaactagacctgtggattgctcacagcagtttctgtctctgggtgcccctacattcatttgcttcagtccacctgtttctccgtttcctggggaagggaatttattcaattactgtcctctttcaatggtatggcaacaggagaatgttggtaaaacccaaccatgttctgaattgggctttgcgtgggtgttaggaaaggtaagattttcccgttttctgagaaaagggaaaagattttaagaatattgccacctcacccttgataagcatctaaagcagtgtttgctcaattaaaacctagaaatgactgtcagcccaacatgaccgcagcccccatcccccctcacccagtgcactttggctttaaaacatcaatggttgttgctggccgggcacggtggctcacgcctgtaatctccacactttgggaggccaaggtgggtggatcatgagttcaggagatagagaccatcctggctaacacggtgaaaccccgtctcttctaaaaatacaaaaaaaattagccgggcgtggtggcaggcacctgtagtcccaggtactcgggaggctgaggcaggagaatggtgtgaacctgggaagtggagcttgcagtgagctgagatcacaccactgcactccagcctgggcgacagagtgagactcagtctcaaaaaacaaaaaacaaaacatcaatggttgttgctgggggaaaaaagaaatcaaggcccaaaggaatatgccaattcataaatacacaattagctggttttattaccgagcaaagcaaaccccttgaatatttgcaggtgccagcaagtgactgcaaatctgtagtgggttttcagctctgtgtctatggacttgaagctacagttgttttacattgtcttacttgtagtaaacagcagcattcagttggcatcagtagttattaatacactgagtttcctgtgacatcccacttttcttaattctctatcaggcctgctctgagatcttgttatttgtaatgctttatcagtacctcctacggttgcctctgacagcgtttctagcacagatgatcagtcacatgtttcaacattccttagtgaggttagattaggttcagtttccccacagtgtgctttttgctgctcgttaatatgtgccttgagaacactgggaagccgttcatttttaaatgctttgagtatactgggcatcatctcataggtgccttactccaacagggcccttctgttagggcctggtttaaaatactgcaagtatttttttgattgtatatgtgtcgagttccatctctccttgttctgcatcaccttgagagataagttaactcggttgatcctgtagttggtggtattgctataggaaaatagagaccacagtatccttttggatgtattcacaaccctgaccgcacactcagatgacctcgggcacatgcctttagaaaatccagatgcttgggcttcacccaacaataactgaagcaacatccctggttggggggactcagcgtccatgtagttgaatgtacccccaccccaggtgagtctgaagtgctacctggattgagggctacggctttatggagttcttgagggtatatagttttgctttttaaaaaataaccaaaagaagattcccattacaatttgatgcaggaacaggggtaggggggcagggaaaatcattccccatccttttgccctataacagagtttctcaaccttgacgctattgacattttgaatcagttgggggctgtcctgtgtactctgggatttttagaagcatccttggcctctcccattagatgccagtagcacccttcctcaagttttggcaaccaaaaatgtctccagacactgccaaatgtcccctgaggagcaaaatgatctcctcctcctttccttccctgagcctcctcccagttgtgaaccactgtcctaaaatgtaaactgttgggtgttccctaagcaaggtttgtgctagctagttcacttttcacttatgaattgaagcattggaatagctctgaatacaggatgtaaaaacaaacacgacttcacatactcttaggattcactgtgagctcattatttttgagtaccttaatttgctcaagttataaaataaaaatgtttgcatctagaaatatgcccttatttttaaagataaaagaacaccattaaacataaattttatttgtattattggaatttttgtatagctgtgtaattcccaagttagcttatttaagcctccattagtgaggctaagctttaaatttctttcactctgttctaaattaaaaacctaacaagcttatttcaattagctaccggaaaagagagaacatagcctaaaaatgccttctacaaaaaaaccccagaaaatggtcttaaatagttcaatattatttccttataacaatgttctatcttggatgctttttttttttaaaaaaaaggagtcttagatcaatagcaccattgtatgacttgtcttatgatctttctccagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggttgaaagacactgcatacgtttgtattattagttagaaggcatgaagacttttttccctgcatggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtcta

SEQ ID NO: 3100 - DNA, 25723 bp, human
gcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcggtgagtcataggggcagtggaatcagccctggggaggttggctaatgtgcttaggagaggagggttgggcagtttcagtggctctgtgtgaggtgtccatggggctgttactgggcagatgtccacagctcactggtatatattctttacacagctgttcaaaaatgtgtatacttctttctgcagaatcctacagacaagacaaattcaattgtcacaaattattctccagtgaaaatttcagctcccaggaatcattctttgtgggtcaaatgcattatttattaaattggaggtttgaaagttacttataaataggaaaatttttaatgctaaaactttttaatttgtaagtcttaggtgtttggcatttaggtggggcagggtttataaagatgttcaaacattgagcactgattgagtcactttcaaaagagacaaaagagactttgttttacttaaaacattggagaatcatcttacaggtattgttctcatctgtcaagtggtgtctgtgctaatgtacagaatcccacaaatacacacttcggtgagcattcagcaggtgcctgttggctgaaaggattctgaaaaatgggtttaggcatttgcacacaggttcttataaataatagtatattggttagtaatatactggttaactctccagccccaagtctgcaaacttgctgatgtcacgtcctttcccaaactgagaccaatcagtgaggaaaccttggagtttatcgggaaggaaactcaaagttcgtaactttcggagagcaaagggagcagcagggtgagggtgaaggcaacagctcactttctgcaactgttgttcaccctgttgagatccttgggggcttgtgacggagacaagccccagcacccagagctgggaaagctggtgttgcagcagccctgctgaattgctgtatttattatttattaatttttttttctttttgagacggagtcttgctctgtggcccaggctggagtgcagtggcgcgatctcgactcactgcaacctccgcctcccgggttcaggcctgtatatataggcggggcacggtggtttacgcctgtaatcccagtactttcggaggccgaggcgggcagatcacgatgtcaggataccatcctggccaacatgatgaaattccgtcgctacctaaaatacaaaaattagctgggtgtgatggcacgtgcctgtaatcccagctactcgggaggctgaggcaggagaatcacttgaacccgggaggcggaggttgcagtgcacctagatctcgccacagcactccagcctggcgacagagtgagactccgtatcaaagaaaaaagaaaaaaatatatacctggtatactgtccacagcacctgttgatcaaaggggcaataaacagggaccctgaagtcagggtgttttgttttgttttgtttttttgagacggagtctcattctgtcgcctgggctggagtgcaatggcgagatctccgctcactgcaacctctgcctcccgggttcaagagattctcctgcctcagcctcccgagtagctgggattataagcgcccgccaccacacccggctaatttttgtatttttagtagagacggggtttcaccacgttggccaggctggtctagaactcctgacctcaggtgatctgcccgcctgggcctcccaaagtgctgggattacaggtgtgagccaccacgcccggccgtcagtcagggtttattaatctactatacaggtaccaaaaaggtaaaaatggaagaaataaaacacaaaacgtcttccctttgactgagtagactagcctgctcattcattcattcatttatccaatttcacttataaaatgagcagagtactcaatggtgagtgggatttagatccacaaaggcagaactggattaatcagcagatgtattgagcatgagtttggagaactaggaaagcaagagtggcatcaaaaatcacttttcacaaagaatttctttttttttttttttttttgttttttttgaagtggagtttcactctgtcacccaggctggaatgcagtggagcaatctcagctcactgcaaactccaccttcccgtgttcaagcgactttcctgcctcagcctcctgagtagctgggattacaggcgtccgccaccacacccagctgatttttgtatttttagtagagacggggtttcaccatgttagccaggatggtctcaatctcctgacctcgtgatccgcccgccttggcctcccaaagtgctgggattacaggcgtgagccaccacgcccggccactttttacaaggaattatatatataattatatatatatatatattttttttttagatggagtctcgctctgttaccaggctggagtgcagtggcaccatctcggctcactgcaacctcggcctcctgggttcaagcaattctgcctcaggagggagaggcagggactaggtgggactacaggcacacgcctggctaattttttggggtgttttttttttgtattttagtagagacggggtttcaccatgttgccccaggctggtctccaactcctgagctcagggaagtctgcccgcctcggcctcccaaagtgctaggattacaggtgtgagccactgtgcccggccgataaatatatttttaaaacagcaaaccaatcattatgggaaagaatcggtaatttggttgacttctgcacggttattttatagctaagtattgtatttatttttgtttccacatgggagagaggcaccagccacttttcactgttagggtttctttttcttttttttttttttttttgagatggagtctcgctctgtcgcccaggctggagtgcagtggcacaatcttggctcactgcaagctccgcctcccgggttcacgccattctcctgcctcagcctcctgagtagctgggactacaggcgcccgccaccacgcccggctaattttttgtatttttagtagagacggggtttcaccatgttagccaggatggtctcaatctcctgacctcgtgatccacccaccttggcctcccaaagtgctgggattacaggcgtgagccaactgttcaggatttctaaagttcctaatacaaccctggtggggtcagggtgggtgagtgggagtgggcaggtgttatacgcaaaggcatggtgcttgtaaagtcaacaagtttttacagctagagtgcaaaatgtgaatgtcttagggagtctagtgagaacaagtttgaagagatggagtggcagataaagcttgaagagctaagtggaggaggtcaggcttcatgaggcaggaaattgagagccattggtggttctagaacagagacctggtaataaggctgtaggtcaattaacatggtagccacagctgggatagattgtgttggaatcgtgggagatggttgcattcatccagtggttctcaaattctcatgtgcctctacatcacctggagagcttattgaaatacagataatgcagcttctggctgggcacggtggctcacgcctgtaatcccagcactttgggaggctgaggtgggcggatcacttgaggtcaggagttccagaccagcctatccaacatggtgaaaccccatctctactaaaaatacaaacatttgactgggtgcagtgcctcacacctgtaatcccagcactttgggaggccgaggcaggcggatcacctgaggttgggagttccagaccagcctgaccaacatggagaaacccagtctttactaaaaatacaaaattagccgggcatggtggtgcatgcctgtaatcccagctacccgggaggctgaggcaggaaagtcgcttgaacccgggaggcagaggttgtggtgagccgagatcacaccactgcactccaacctgggcaacaagagtgaaactctgtctcaaaaaaaaaaaaaaaaattagctgggtgtgttggcacatgcctgtagtcccagctacttaggaggccgaggcaggagaattgcttgaacttgggagggcggaggttgcagtgagctgagatcatgccactgtactccagcctgggcaacagagcgagactctgtctcaaaaaaaaaaaatgcagatgatgcagcttttgatgaagtcgtaggcctggggtgggggcctaggaatctgcattcataacaaactcccaggtgaaatggatggtactggtcagggaccatactttgaaaactactgcactaatccaaccatgaaacttacatttggatcgaactttggaaatgacagagaaagggcgatgatttcaaaggaaagataaatcagcgtatgttgcttgattaaatgttggaactaacagaaggcaggcaaaattataaggttctcaagcccaaagtaatgtcagataagctagataagagggaagttggaaaggaagttgccttggatgcaggatgaggaggggaggatacagagttctgttttggacatgatagtgctaacaatgatgcccagtgcacagtatgatgacatgggactgagacttaggaacgatcacaggttagaagccagatacctcagaatgtcctacagaggggctgtggttgaaacctagggaagggagaaattgtccaatggctaagagctgagagtcaaccaaggatggaaccctgggacaggcctccagttgatgaagtaggaccagtaagttggacagagaagcagaaagagattctggatgttgtaattacacaggtgctaagggaagagaagttttcaaagaagtagaagtcacaagggtaggtgcctggatacttctggtttcttacctcctgttgtgaatctgactggcaaattgctactcaccttctacacccagctgagccattgcccccatgaagccctcctagactttccacctctccctactcaagtggagtcattctccgtctgctttgcatcagtcctgccccttgggtaaaacctcaattgtagttggttgcttttgtttatgcttctgaggtcttaaccttggtgaagtgtggaatggggaacactcagaatgctgttttcaaatagctgtgccaagaaactcagctcaggtgaagcttgtccctttgcacaaggccaagttagaggggaaaatagggcccaggtgtggatcatcttgctgctcccacctccacctgcaggcgtttttctgcccacttccctgggggtagggagggaggaaaggctataaaaatgggcaaccaactctttatagagatttgtttcatgttagactctcctgtccaaggagcagggaaagaatgtcttaattttttcctgaaagtagcttgttacgagttaaattgtgtaccctgaaaatatatatggttaagttcttaacccccgtgcctcagaatgtgaccttattagttaagattagttcaggtgaggtcgtaagtagggtaggatggaccttaatccaacatgaccagagtccctataagaaaaggagaaggagacacatggagaatgctatgtgacaacagaggcagagataggagtgacacatctagaaaccaaggaacaccaaggactgatggccactgccagaagctagaagaggcaaggaaggatttttccctagagcctttggatagagtatggccctgtccacaccttgatttcagacttctagccaactgctagcctctaggactcggcgacaacaaatttctgttgttttaagccacccagtttgtggtgtttcgttatggtatccctaggaggctaatttatacctactcatagaaacttaggaaaatacattgaaggataaactaaccacccataattccaccaagcaggtaatcactgttcccagtgttagtgtctatcttttggggttttgcctgaagactgacaactgtagagatatttctatccttgcaaaattgagcccaccctgtagagagtattcacatttaaacagaagacaagctagaacaggtattgaaagaaaacaattttattgtcttatggtgaatttttagatattggggcacctcaggaggggtgagttttctgggggaaaacctgcctgttgagacagaatgggtgataatgtgagggccctttggagaaggcagctttatattgagagagagagagagagagagaagagagagggagacaggaaagagaagagagagaagagagagaagaaagaggagaggagaggctggatgatggaactggagaaagaactgcagtggacaggcctgacttgcccaagagttgcctcagtgggcctttctgtttgtttctgactgtaagcctcttgtttctttttctcctctttctgtttgtcctgggatcaaaccaaggtccacaataattgtgaatacagcacccagatactttccaggttctggcaggttggttcatgccactgaatccacccttattgtgtcctgaagactgaaggcaaatactcctgtcccctcagagcaacccgacttcttttttgtctccttgactttgcaaaacgtttctcaggatgagtagatttatgctaccgcccagcattcactggggttctcagaacatcagtaatagctattttcagcatgtagcaattagtgcatcttaaatctcttttgaaataatggaaatgaaaaaaatgttccacaaattacaataaaaatgaaatggcagcctccctaatgtgctccaggtttgatgagggtacaatttaaaagaaagataagttcttgctaatacacacacacatacacacaatctatgctctctgaatgttagaaaaatgttaaactaggccaggcgcagtggctcatgcctataatcccagcactttgggaggctgaggcgcatggatcacttgaggtcaggagttggagaccagcctggccaacatggtgaaatcctgtctctactaaagttacaaaaattaactgagtgtgatggtgtgcacctgtagtcccagttacttgagaggctgaggcaggagaaccacttgaacccaggaggtggaggttgcagtgagccaagattgccccactgtactccagcctgggtgacagaatgagactccgtctcaaaaaaccaacagaacattacacacaaagaaaaatgttaaattattaattgtcactactgtaaattttcacataatcactcatttgttctgatacctgctgaggtcaaagtccttgtataaatttgagatggattttagttttacagggactcacgtttttcttctgggcaggagcataggcatactgtgacaggcttaacaaaccctgaactgaaatgactttatgttagaaggggaagcctcatatcctgctgatgggaacatacagtagggcagccactttggaaaacagtctcaaaataaacattgtgttaccatatcatacagcaattcttttaggtgcatattcaggagaattgaaaacatatatctgctcaaaaacttgtatatgaatgtttatagcagcattattcataataggcaagaagtagaaatgacacaaatttttatcagctgatgaatgaatacataaaatgtggcttatccatacaatggaattatttggccaaaaaaaaaaaaaaaaggaatgaagtactgatgcacgctacaacatggatgaaactttgaaacatgctaaataaaagaagccagttgcaaagtaccacatactgtatggtttcatttatatgaaatgtccagaataggcaaatccatagagacagaaagtagatccatggctgccaggggctgagggaagtagaactgtggagtgactgctaatgggcacagagtttctttttggggtgatgaaaatgttctaaaattgattgtggtgttggttgcatagctctgaatatactgaaaactgctgaattgtacacattaaatgggtgtattgtatggtatgtgaattatatctcaatacagctgcttgctagctagctagctagagatattcacattgtcagcccctcactacgtgtaccaggacaacactctgtacttctcaaagacacaagctgtctctgctctgtaaacactacattctgcagaggtgcaaattcagatagccttgttattctcttggagaagtacgtacttctttatttgccccaaatagaaagagtaatggtcccatgatgaatgagcagaaagtaagaccatttgtggctacacttgataaatgcgtcatttttatgaaatctggacagttacaaattaggatgcaatctacctgcctggactgtttagcctgtcgacaataataatcttagggagctctaagagaggttggggaatgtggcagctgtatttcttagcagctgagcacttggaaaaaaaagtggattaatcatcatacatatggtgatccatcaagatacatttgcaaatctattgaaaactgattttcaaaacctttctcaatttgtggctctttgttctcattcaagattttgtgtgaatggtatttggcattatcagcaccaacagggtggaattagttgtccttttaattctaatttggagatcaatctttccatgtctgcagtccgaattttagcttccaagccctagaatcagcagtattattccagaaataattaggagcctcagagaatgccgtgaggacattgagtatctattaagcgtgaggttttgacggtacgaaaagccatttcacttaagatgtaccttgtctcaagcacctttagtgaccccagaaggaaagcattggatgggcggtatgtagatgggctcatttgtcttccttttatgtactaaatgcttaatgaatccatctggaagaatggtaatttgcttactaatacagattttccagggcactgatggcttcaggtggcagacagacgggcctcatgtgttaagtacaaagtgttaagccaacatgtgttaaatacaaaggatacttcatagcctttcagtttgcaaggtatagatagttaagtatcctccttctccaggtcttctcagtttttaggagctattagcttccgtgcaaggcataactggcaccagacctttctaccttgtttgtatgtagtgtgtttggcgaagcaggtggagctggagctgaagcaggttcaggcacgcctccctcacatttctactggaaatcagatgaagcttgagatgagaaaaaaatcagatctatgcctcattcagttatattcaattaagagagaggaaagcatttaatgggttgggattgggttttcaggcttctttcctaagaatttgttttccttctatgtggttgtagaataaatttgctattttattttatttttttgagacagagtctcactgtgtcacccaggctggagtgcagtggcatgatctcggctcactgcaacctccgcctcccgggttcaaccgattctcccgcctcagcctcccgactagctgggattataggcgtgagccaccacacccagctaatttttacatttttactagagatggtgtttcaccatgttgcaaggctggtctcgaactcctgacctcaggtgatctgcccacctcggcctctcaaagtgctgggattgcaggtgtgagccaccacgcctggtgtaaatttgctattttaaatagcaatgatgatgaggtataattaagactctctgtttagtgttagggcaggataataatagtagctagtatgtgttgagccatggtaagtacaggttgagcatcccgtctctgaaatccttgggaccagaagtgtttccagttttttcagatgttggaatatttgcatatacataatgacttatcttgtggatggtactcaagtctaaacacgaaatgcatttatgttttatatacaccttacacacataacctgagataattttatataatattttaaataagtttgtgcatgaaacaacgttttgactgcaacccatcacatgtcagatgtggaattttccacttgtggcatcatgttagcactcaagaagctttggattttggagcattttggatttgggagttttgggttaaggatgctcaacctgtatgttatatattagggctgctcaacttgtaactttacagagaaggaaactgcggcactgggcctttcccgggacccacaggtcagaaaaggtgaagcgggtctgaattaagagctttctttaaccaccttggcatgctgcctttgagggtaaataatgtccctgtttcaaggtgagactgaacactgatttgtgcttaatattaggacaggagataatctataaatagatatggttctgtttagatttgattccaaacctaatggtgtatgtaattacatgattactactattaatacagaacactgtttggtgagatgccaaagtctgtatttcatgcaggaaactagactgacagctacagcttaacacactaatgttggtaattagtgaagctctcgcttaactaaatgggccatttgcctttgaaaccagtgtgtaaatagaaatagagtaatctgtcatcccaatccacctcttttgtccttagtttgaggactggctgtagttctttcccaagctatccagacatttcaaacaaactgtgcacaaaaaatattaataaagaagagaaatgctgaattcctgatgggaattttggttgagtgaatccaatgtctccctccatccagggcctgttaggctcttattgatgggcaaggataagcctctgggtctaagtgcattagcaggatataacccattcccctctttccatacagatgctgtgtctgattggtctcctatgcatgaagctgcaatccacggacatcagctgtctctgaggaacctcatcagccaggtagctttttgaaaatacaatacagaagaaacctatcaaaatattaaaacaaatgtgtgacataataacatagggacttttaaattaattcattaaatagaagacctagtggtgattctagtaactaccataacgtctaaataggatgagtatagattttgagatattttagatgtctacagcaattgtaatacaatagaaaatatctgtaatttctattggagataaccctacataatactattactactgtggtttgttgtctacattctgaactgaaggaaatgctaaatttcagatagagctgagtgagaataaatgtgctttaaaaaatccaatttcatagacctatctagagtaagaagtcctcctataagaaaataatttctaaagaaaaatttcatactatcctaagccactatcttaagccatttttggtagcagcagtctattataaatagattataacactaattctagctaaaagaagttaggctacttctcagataaaattagaaatttaccctattttgatagcatgaaaaatgatcactgcagcttttatatatcacttcttaaattggacagatactcatttacattcagtatttatgtgtttatgaaacatcagccagaaccatatctccaagttctatcacattatttgtgtaagatgtctttttagagccccggtttctgctttcataaaatgagtattctaatacctacctaggtcagtccaccccataactcaataacaaaccatcccaaaactcagtgacatgatacagtaaccattatttcttgctgatgtgtgtttgtgtcagttcatctaggctgggcttggctgggcttggctcccagctgtgggttgggtgtagccctgctgcacatctctttcatcctgcttggaccactggctacctgaggaattattttttcttggcaaaacgctggagcacagcaggacaagccccaccatgcaagaatacttccaatctgttcatgtcacatctgctaacatcccactggtcaagtcacatgaccacatccaaagtcaaggctcaagagaagtacattttgtcaactaagcgtagttgacgactgaaaatagatatattaaagttaagccattcaatctttttttaaaaactaagaactgactgtggactgaacactgtgaagtaatgggttaattaccttatgattttatatgactcagacttgttaataatttagacaaatcacagttaatttaaggtagaactgtagcttgatgatgaactacaaatgagtttctaactttacagaaggaacctctctgcaatgtgaatatgtggtgaaaactttttgtgttacgaatagctgtgttgttgtatttcatttacgtggatttatgtataaacacctaaatgctggttttatttttatcattattattattattattattatttttttgagatggagtttcactcttgttgccatctggagtgcagtggcgcgatctcggctcactgcaacctccgcctcctgggttgaagcaattctgcctcagcctcccgagtagctgggactacaggcatgtgccaccacgccccgctaattttatatttttagtagagacgaggtttcaccatgttggtcaggctggtctcaaactgctgacctcagataatccatcagccttagcctcccaaagtgctgggattataggcatgagccaccgtgcctggtctaaatgccggttttacaatggcagttgtgcctggaggagtatgcacattttcctattggttgtttttatggttgccttttgcccaagttctgtacctcggcctgccttcccccaacttgtgtctgatacacttgcatgatttttgcttcatgtgacaatcatacccctcttgtggcattgacaaagctactttctataagtgtgatgactgtgagaaaataagatattttctcctgccaattggacatttaagtcttaggtatgaatagtaaagtaagaaatgacatattcttttctttgatcacgacaaaagttggcacatttttttctttctttttttttttttttttttgagacggagtcttgctgtcgcccaggctggagtgcagtggcgccatctcggctcactgcaggctccgccccctggggttcacgccattctcctgcctcagcctcccgagtagctgggactacaggtgtcccccacctcgcccggctaattttttgtatttttagtagagatggggtttcaccgtgttagccaggatggtctcgatctcctgacctcgtgatccgcctgcctcggcctcccaaagtgctgggattacaggcgtgagccactgcacccggccaagagttggcaaatttttttcagtaaaggaccagatagtaaatattttaggctgggaggctgaggcaggagagtggcgtgaacccaggaggtggagcttgcagtgacccgagatcgcgccactgcactccagcctcggcgacagagcaagacatcgtctcaaaaaaaaaaaaaaaaaaaaaaaagaatcttaggccttgcgaaccatgcagtctctgttggaagtacctaactctgctgtttagcagaaaagcagttgtagacaatatgtaaatgaatgggcatggctgtgttctgataaaactttgcttatggatgctgaaatttgaatttcataaaattttcacgtgtcacaaaatattcctttgatttcttttaaaccattaaaaatgtagaaaccattcctagctacagaagcaggtgtaggctagatttgactctgtaggctactgtttgttgacccccttgtcaaaactatgatagagctaggaaatctaagaaaaacaattaaatgtcaggaaaaggagggtttttttgagaaaaaaaattgggtgaaactgatatttttattacaaatattattaaatcctgtgtgttactaaatacttatgtttaaagagcaattatattagttaataggtacatttcaatttcctaaaataagaaagtacatttaggcttcctaaaaggtacatgcagcagtctatttcttttccctcgcagtttgaaaatttccttttaattgtctcacaaggtagagccacttgtgaatatgttaaaacttaataattgcttgttaaaacttagcaatttgggccacgctgactttaaaaaaattgagaaatttcataagcatgaaagaacttaaacacgtgtgcagttgaataaaaagtgatgatgatgagaatattgccatgtgactgcctccccaggtcaggaaatggaaaaatagcacaatgctggctcctccaaagactcacccatccctccccttattgtgctttctagaacacaatcctgtccctcttccacaggagtaaccattatcccgatttccttgttttctttatggttttactctatatattatgtcttctgaaacaatatggggtagttttgcctaattttgaactttaaattgatgtaatcattcagtgtgtatgcttttggattttgcttcttttgctcaacattatttttgcaagcatcacccttgtagtgcttgccattatgatttgttgggtgtaatctttctgctgaaagattataccaaagttaattaattcagtccattgttgatggacatttggtttgtttgcagtttttgactattatgaccaatgctgttgtgaatattcttgtatatttatctagatgtatatatacctaagagtcaaattgctgagtcataggcatatgcattgtcagctctaatagatacagtcaaactgttttcctgagtggttataccataccacactcccaccagtagtgtggcatttttttttttttaaagtcaatataaacaccttagtgtaacatctgactttgagccaggtcagctttgtcatagtactggaatggtggctgaaaagcagccccagggcactgttgctttgcaccccttactctgactgtttcccctccttcaggggtgggctgtgaacatcatcacggcagatcatgtttccccactccatgaagcctgtcttggaggtcatctctcttgtgtgaagattttattaaagcatggagctcaggtaagggcagctgaaacaacatcttagaaaccaagaatgaaaaatgactatgtatatcccttctgaataacttccagcacttttgattagactgatttgaaatatgaagacagttgtttttcaagaaaattatgttcatcaggcttgtttgctttagtgatggatggatgaaatactaaatttttagtcacgcttacagtctatatcattttctttatcatacactactaataaatagttattagacttctgtcttcattgttatggccggaaggtaatgaaatattgtggaaagcacacatttgcctgggatggctaggatgtctgaggagacagaaaatctatgtggtcattcatcctttagctggcaacctggacttgttcacatggtagcagggattgcaagagcagcaaaaatggacctgttttgtgttaggcaactgaatggtgggttggggaaaattatgggcttgctatcttctggcaacagcaaatgcaaagtcccagaaatgatagtgagcaatttttatatcttgaagtcattccttacggcaggacagtagagtaggtgagagggttcagaacataagcaaccttgtccatgccaaaaaaagaatgggctttgtcctgagatcagtaaagagccagaggtgagtgcactgccagatttatatttgggttaagaaaacattcaaaacttggaaacagggaacgtgtcaaggtgaagcaagagacacctagggtacaaacttgaaagaagtgctcgctctcagggtcctgcactatttgtgtgactccaaaaatgaatatgtccttaaattttttaccctgggcaacttttatgtctcactctggtcctggccctgcttggaagtagagtttgagaaggaattcgttgtcttcacaatatcattgcttaaaagattcaccagataatcatttaatgatatacaagaatgtgtctgcacttggcttttctattcactatttaattatagcccaaacactgtgaagttagacattaacttcgaaatttctgtctgatttccaacattagaaaagatagcctcaaagattatacttttatggccctataggacattaaccagtttttatgtttttatttttttaatttttgagatggagtctcgctctgtcgcccaggctggagtacagtggcacgaactcagctccctgcaacctccgcctcctgggttcgagtgatactcctgcctcagcctcctgagtagctgggattataggcacgcaccaccacacttggctcatttttgtatttttagtagagatggggtttcatcatgttatcatgttgcccaggttggtctcgaacttccgacctcaggtgacccgcccaccttggtctcccaaagtgctgggattacaggtgtgagccaccgtgcccggcggagttttgtatctattagcaaatatatttcagcagtccattgactatatacgtttttcttttttctttctttttttgagacagagtctcactctgtcgcccaggctggagtgcagtggcgtgatctcggttcactgcaacctctgcctcccgggttcaagtaattctcctgcctcagcctcccgagtagctgggactacaggcgcatgctaccatgctgggctaattttttgtatcttagtagagaccgggtttcaccatgttgcccaggctggtctcgaactcctgagctcaggcaatccgcctgcctcggcctcccaaagtgctgggattataggcgtgagccactgcgcctggccaaatgtttttttgagccagccttaccatcttactggttccctcattaatgagtgagttgaataaaatcttgggtatgtgttaattctatatttgtatgaaagtcaagttttttaaagttttctaaattatactttaagaatatactaaattacacagctaataatttcaacaatttcctcacagcagcaagagtaatcttcttgcacccgttaagaaattgaattggtgtgggatgggtctaggaaagaagtttaaaatagggattagtttgtaagcgattgaaattatcctaactagtttcaaagttcatgttcctggggagggcatggaggagatagaacattgagtaacattttcgatgctttatagccactccctaattccatttttcacaaaaacctgtggaatttcgtagttatttctccattttatagctgaggaatttaaggctcagagatgttaaataacatcttcagagtggtggaccccacatttgaacccaaaacatcccccttcctgtcttcattctggagcttcttttaccaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggtaaatctgttgagaatttttttttctacccactccttcaagggacatcttactgctgaaagaaagaaagaaaaggagatatattttagagcagtagttctcaaaatggagtcccaggactggaagcatcagcatgacctggcctgcaaatgcagattcttcggcctcactccagccccattgaatcagtaactggggatggggctcagccctctgtattttgtttaataagccctccagctgctttctggtacacagtaagtttgagtgcctcccttttagagcattttgaatgtttttcactgctgtattactgaaacagggcttggcacatagtagactatccatcaatatttgtggaatccgttgttatacccgtgaccttatagaaatcaagttatttcataaaacaaattatattcttctatttcagggccttaaagaacattgtctcagtgacacttaagtttgccaaatgaaataagctttcaatttttgaaagtatttgatgttgcatacagtttgggataattcttttcattaaagccataatttttctgatagtcttagctcataaaatcacaagtttttattttctccaatatttagcatcatcgtaatgaccataccttgccagagggctttctgtttctccagtggctttcatagaatggcttcccatttgactggaccaacccactcataatgatctcccaaagcattaatattatttattgagaacatcttaactcatcatattcgctgcatacatagaactaaaatacagcaagagaaacgtagaggagcaatgtcaaaaatatgacatcctggaccaaggaagtgtgattcagctttcacctagtttttcagattgggccctgctcatgttggatttggcagtttcttctaagcattgcctatacccgctgtggcctgttcctcccgggcctgcctttggagaggttgtaagtttccttccctgtcccgtggcccacactgtgccctttattcttcagttccaccttcaggtcctgttcctccatatctctcccaagctctcacttcaatttctgtacttagacaaactacaaagccacagacaattgaaaaaggtggatagttgctggttggttaccgtggctagtaaactcaaatggagtttcacccgtagttgcagattgcatcctatggtcaaaccattaactgatagcagtggttaaaatcactcctgatttggccgggcctggtctcacgcctgtaatcccagcattttgggaggctgaggcgggcggaccacgaggtcaggagattgagaccatcctggctaacacggtgaaaccccatctctactaaaaatacaaaaaagttagcagggtgtggtggcgggcgcctgtagtaccagctactcggaggctgaggcaggagaatggcgtgaacccaggaggcggagcttgcagtaagccgagattgcgccactgcactccagcctgggggacagagcgagactccgtttctaaaataaaataaaatgaaataaaataaaatcactcctgattctaattgaaggaaatagctttttggtcccctggataagctgctgccaaatttaatgcaaaatggggatggcaatgtctttctagctaagggaacttgtattgtaactgtttttcttcctgctttgggctgcaggccacgtggagtgtgtcaactctcttatagcttatgggggcaacattgaccataagatcagccacctgggcactccactctatttggcttgtgaaaaccaacagagagcctgtgtcaagaagcttctggagtcaggtaaagcaaaaagcaaaccaaaacaagaaaagaaaacgaaaagtaaattaaatgtattttaaacatcttactgctgtaggagagaaattagtgtgggcaatggagttggacaaggtcagggttcatattgactgtgttcccttggggaattatttcacactgtttgaactgtagttctctcatttgtaacaaggatgaggaggaggaggaggaggaggaggatgatgatgatgatgatgcctcttctcagggtggtcctcaatgattattagtttctcctccctttcctctgtctccctccatttggccagtcacattattaagccctgcataacttgcaaagctgttggattagtgttgaatcttcctatttgggaccttaaccagttctctttgattagatattgaacttgccccattgcaaatattatattttccttgaaaaggcctatgtacccttatttcttttcacctccctgctgttgtccagcccccttctcaacacctggaacaccatttcatcacctctttaattatctgagtcctatttattctttaaggcttcagtaatctgtttcccaatgaatgttgttgcagtccttattgcctcctactcatctggcaggcattgctatgaattaagagatgcaatctctgtctctcccccactgcccaccccacctctgccactctgggcagattttaagcctctagcctggaaagggccatgtttgatatccctcacaaagtcaggaacaatacaagaccagatcagttaacatttgttgagtggacatagattttcattttaccagagggatggcagctcaggcaaagccacatgttcccacatgtcacagtgaaagctaggctctgggctggggtggggatttgttaagagtgtaagagtggaattgggtggggacagtcctagaaatccaccttactcctgaaagggagaactttgccaccttccctgtgatcttgggattggccagtccaatccaggggatacccccatgagttggttggttgcttttcaaagtccaaatcaccagtcccaagtgtccagttttacaccctgtggcagctgcacaccaggtgagtttggctgcttggtgtaggctggatttcaccatctagtctctccgtcaggctgtactggctaatacttaggttccattaataataatgtggagcttttatgtcactaggatttttcttatatgcatcatgcctatctatgtacagtgctgaaaggcaaatttttaactttctatgctatattcctcatgctgtacattcaataacattatcaggtgggattttccccacattattaaatggaatcacatcatctcccatttttccaggattgctgtgctcaatatggatcccctcttgttaggaaattttggggctcggggctttgaaaagccccgatggttggattctgctccttgctgactcttttttgttctcgtgactgtttaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaaggcaggtatttggcaatttctggctcccattcctataaaaagatcattctctgacatcaccaaatctgggaagttgagataattcaatattcaatgagatacagtactggtcacagtacagtaaataactgtcctgctatttagcatattggatacaggtttttgggatgatctaatattcattatggggtaggccagttttttaaaaattaagatactgttttaaaattttagtattacatttatttaaaacatgctttagaatgaggcagcagagtcctctttggggttgtaagaggccgcaggatatcttgttgaaccacagatgggccagactactggacacttcgtttctgggcttaaaatgcagctgtttaagagtttagggttcacaccaatccaaagatatttactattataaattaaccaatgataagtccacacttctctataagtaagaactgagactcccaactcgaacaatgaaatattgtggttgagcagtgtgtatggaagtagggctttgaggcctgggctgggctggggaacaaagacacctcaagttggggagccacctcttgcaatcttcatgggctcagaggcagttgagaaaccagctcagtacttcttttcttaccggagtatggactctgaagtcttagggattctgggactttgaagcaggccttcctaccagaaggattctgatgttatacaatctagttattttctccccacatgatgagcagtaaggttggctttgggcagaactgtaaagtgggctaaggaatccttcttcctcctactctcactgccccagggtacttgcagtcaagtccctgcctgggggcatgccaaacaaggcctatgctcctgagcagtgctggtcaggcagaaaagattgactccaggcctggacaaggaacagtccagtagaggccccttacagttaagcagtgggataatcatggagcagttctatctgcattttaataattacttgttttgaaaaagttctatgtctacgaggcccataaaaatatcttaatttttaaacaatcagaataaaaaatgaatagaacaacatggattgtaatcatctttataccaacacagttgtgaaatagaatttttaattgttttcactgagaaagggattcataaaggcaaaagtgcctcaggtccccctcagtcataacgtagggcatacgttaatgtaggatgtatatgtcccctcctccatcaaacaacctcatagcattctcaaattgcctcccctggcttttcccttctgctttatttcccaaagccattcctagagacagtaattactttaattttgaatttacgttttgcacggtgacagtgtggcctatggtcccactagtttatgaggtgtcatttgctgctggagagaatcactacttgttttgcctccatgagtcaattttggggttttggtgtagtcacctctcagagggctcggagcccacaagaaatggggtcaggaaagtgcagaaaactagacctgtggattgctcacagcagtttctgtctctgggtgcccctacattcatttgcttcagtccacctgtttctccgtttcctggggaagggaatttattcaattactgtcctctttcaatggtatggcaacaggagaatgttggtaaaacccaaccatgttctgaattgggctttgcgtgggtgttaggaaaggtaagattttcccgttttctgagaaaagggaaaagattttaagaatattgccacctcacccttgataagcatctaaagcagtgtttgctcaattaaaacctagaaatgactgtcagcccaacatgaccgcagcccccatcccccctcacccagtgcactttggctttaaaacatcaatggttgttgctggccgggcacggtggctcacgcctgtaatctccacactttgggaggccaaggtgggtggatcatgagttcaggagatagagaccatcctggctaacacggtgaaaccccgtctcttctaaaaatacaaaaaaaattagccgggcgtggtggcaggcacctgtagtcccaggtactcgggaggctgaggcaggagaatggtgtgaacctgggaagtggagcttgcagtgagctgagatcacaccactgcactccagcctgggcgacagagtgagactcagtctcaaaaaacaaaaaacaaaacatcaatggttgttgctgggggaaaaaagaaatcaaggcccaaaggaatatgccaattcataaatacacaattagctggttttattaccgagcaaagcaaaccccttgaatatttgcaggtgccagcaagtgactgcaaatctgtagtgggttttcagctctgtgtctatggacttgaagctacagttgttttacattgtcttacttgtagtaaacagcagcattcagttggcatcagtagttattaatacactgagtttcctgtgacatcccacttttcttaattctctatcaggcctgctctgagatcttgttatttgtaatgctttatcagtacctcctacggttgcctctgacagcgtttctagcacagatgatcagtcacatgtttcaacattccttagtgaggttagattaggttcagtttccccacagtgtgctttttgctgctcgttaatatgtgccttgagaacactgggaagccgttcatttttaaatgctttgagtatactgggcatcatctcataggtgccttactccaacagggcccttctgttagggcctggtttaaaatactgcaagtatttttttgattgtatatgtgtcgagttccatctctccttgttctgcatcaccttgagagataagttaactcggttgatcctgtagttggtggtattgctataggaaaatagagaccacagtatccttttggatgtattcacaaccctgaccgcacactcagatgacctcgggcacatgcctttagaaaatccagatgcttgggcttcacccaacaataactgaagcaacatccctggttggggggactcagcgtccatgtagttgaatgtacccccaccccaggtgagtctgaagtgctacctggattgagggctacggctttatggagttcttgagggtatatagttttgctttttaaaaaataaccaaaagaagattcccattacaatttgatgcaggaacaggggtaggggggcagggaaaatcattccccatccttttgccctataacagagtttctcaaccttgacgctattgacattttgaatcagttgggggctgtcctgtgtactctgggatttttagaagcatccttggcctctcccattagatgccagtagcacccttcctcaagttttggcaaccaaaaatgtctccagacactgccaaatgtcccctgaggagcaaaatgatctcctcctcctttccttccctgagcctcctcccagttgtgaaccactgtcctaaaatgtaaactgttgggtgttccctaagcaaggtttgtgctagctagttcacttttcacttatgaattgaagcattggaatagctctgaatacaggatgtaaaaacaaacacgacttcacatactcttaggattcactgtgagctcattatttttgagtaccttaatttgctcaagttataaaataaaaatgtttgcatctagaaatatgcccttatttttaaagataaaagaacaccattaaacataaattttatttgtattattggaatttttgtatagctgtgtaattcccaagttagcttatttaagcctccattagtgaggctaagctttaaatttctttcactctgttctaaattaaaaacctaacaagcttatttcaattagctaccggaaaagagagaacatagcctaaaaatgccttctacaaaaaaaccccagaaaatggtcttaaatagttcaatattatttccttataacaatgttctatcttggatgctttttttttttaaaaaaaaggagtcttagatcaatagcaccattgtatgacttgtcttatgatctttctccagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggttgaaagacactgcatacgtt

SEQ ID NO: 3101 - DNA, 26478 bp, human
gtacagatggccagggcgtgctgtgcatgttactgtgcaagcaattcagcagggctgctgcaaaaccagctttctcagctctgggtgctcgggcttgtctccataacaagctaccatgtaacaaacggatctcagcagggtgaacaacagttgcagaaagtgagctgtttccttcacccccaccctgctcccttcactctcaaaagttacaaactgagtttccttcctgataaactccaaggcttcctcactgattggtctcagtttgggaaaggacgtgacatcagcaacttcgcagacttagggctggagggttcttgtggcctctggcgggcctccagccagttaggtaaaacgtgtgtgtgtgtgtgtgtgtgtgtgtgtgtacacgagcgcatgcctctctctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcggtgagtcataggggcagtggaatcagccctggggaggttggctaatgtgcttaggagaggagggttgggcagtttcagtggctctgtgtgaggtgtccatggggctgttactgggcagatgtccacagctcactggtatatattctttacacagctgttcaaaaatgtgtatacttctttctgcagaatcctacagacaagacaaattcaattgtcacaaattattctccagtgaaaatttcagctcccaggaatcattctttgtgggtcaaatgcattatttattaaattggaggtttgaaagttacttataaataggaaaatttttaatgctaaaactttttaatttgtaagtcttaggtgtttggcatttaggtggggcagggtttataaagatgttcaaacattgagcactgattgagtcactttcaaaagagacaaaagagactttgttttacttaaaacattggagaatcatcttacaggtattgttctcatctgtcaagtggtgtctgtgctaatgtacagaatcccacaaatacacacttcggtgagcattcagcaggtgcctgttggctgaaaggattctgaaaaatgggtttaggcatttgcacacaggttcttataaataatagtatattggttagtaatatactggttaactctccagccccaagtctgcaaacttgctgatgtcacgtcctttcccaaactgagaccaatcagtgaggaaaccttggagtttatcgggaaggaaactcaaagttcgtaactttcggagagcaaagggagcagcagggtgagggtgaaggcaacagctcactttctgcaactgttgttcaccctgttgagatccttgggggcttgtgacggagacaagccccagcacccagagctgggaaagctggtgttgcagcagccctgctgaattgctgtatttattatttattaatttttttttctttttgagacggagtcttgctctgtggcccaggctggagtgcagtggcgcgatctcgactcactgcaacctccgcctcccgggttcaggcctgtatatataggcggggcacggtggtttacgcctgtaatcccagtactttcggaggccgaggcgggcagatcacgatgtcaggataccatcctggccaacatgatgaaattccgtcgctacctaaaatacaaaaattagctgggtgtgatggcacgtgcctgtaatcccagctactcgggaggctgaggcaggagaatcacttgaacccgggaggcggaggttgcagtgcacctagatctcgccacagcactccagcctggcgacagagtgagactccgtatcaaagaaaaaagaaaaaaatatatacctggtatactgtccacagcacctgttgatcaaaggggcaataaacagggaccctgaagtcagggtgttttgttttgttttgtttttttgagacggagtctcattctgtcgcctgggctggagtgcaatggcgagatctccgctcactgcaacctctgcctcccgggttcaagagattctcctgcctcagcctcccgagtagctgggattataagcgcccgccaccacacccggctaatttttgtatttttagtagagacggggtttcaccacgttggccaggctggtctagaactcctgacctcaggtgatctgcccgcctgggcctcccaaagtgctgggattacaggtgtgagccaccacgcccggccgtcagtcagggtttattaatctactatacaggtaccaaaaaggtaaaaatggaagaaataaaacacaaaacgtcttccctttgactgagtagactagcctgctcattcattcattcatttatccaatttcacttataaaatgagcagagtactcaatggtgagtgggatttagatccacaaaggcagaactggattaatcagcagatgtattgagcatgagtttggagaactaggaaagcaagagtggcatcaaaaatcacttttcacaaagaatttctttttttttttttttttttgttttttttgaagtggagtttcactctgtcacccaggctggaatgcagtggagcaatctcagctcactgcaaactccaccttcccgtgttcaagcgactttcctgcctcagcctcctgagtagctgggattacaggcgtccgccaccacacccagctgatttttgtatttttagtagagacggggtttcaccatgttagccaggatggtctcaatctcctgacctcgtgatccgcccgccttggcctcccaaagtgctgggattacaggcgtgagccaccacgcccggccactttttacaaggaattatatatataattatatatatatatatattttttttttagatggagtctcgctctgttaccaggctggagtgcagtggcaccatctcggctcactgcaacctcggcctcctgggttcaagcaattctgcctcaggagggagaggcagggactaggtgggactacaggcacacgcctggctaattttttggggtgttttttttttgtattttagtagagacggggtttcaccatgttgccccaggctggtctccaactcctgagctcagggaagtctgcccgcctcggcctcccaaagtgctaggattacaggtgtgagccactgtgcccggccgataaatatatttttaaaacagcaaaccaatcattatgggaaagaatcggtaatttggttgacttctgcacggttattttatagctaagtattgtatttatttttgtttccacatgggagagaggcaccagccacttttcactgttagggtttctttttcttttttttttttttttttgagatggagtctcgctctgtcgcccaggctggagtgcagtggcacaatcttggctcactgcaagctccgcctcccgggttcacgccattctcctgcctcagcctcctgagtagctgggactacaggcgcccgccaccacgcccggctaattttttgtatttttagtagagacggggtttcaccatgttagccaggatggtctcaatctcctgacctcgtgatccacccaccttggcctcccaaagtgctgggattacaggcgtgagccaactgttcaggatttctaaagttcctaatacaaccctggtggggtcagggtgggtgagtgggagtgggcaggtgttatacgcaaaggcatggtgcttgtaaagtcaacaagtttttacagctagagtgcaaaatgtgaatgtcttagggagtctagtgagaacaagtttgaagagatggagtggcagataaagcttgaagagctaagtggaggaggtcaggcttcatgaggcaggaaattgagagccattggtggttctagaacagagacctggtaataaggctgtaggtcaattaacatggtagccacagctgggatagattgtgttggaatcgtgggagatggttgcattcatccagtggttctcaaattctcatgtgcctctacatcacctggagagcttattgaaatacagataatgcagcttctggctgggcacggtggctcacgcctgtaatcccagcactttgggaggctgaggtgggcggatcacttgaggtcaggagttccagaccagcctatccaacatggtgaaaccccatctctactaaaaatacaaacatttgactgggtgcagtgcctcacacctgtaatcccagcactttgggaggccgaggcaggcggatcacctgaggttgggagttccagaccagcctgaccaacatggagaaacccagtctttactaaaaatacaaaattagccgggcatggtggtgcatgcctgtaatcccagctacccgggaggctgaggcaggaaagtcgcttgaacccgggaggcagaggttgtggtgagccgagatcacaccactgcactccaacctgggcaacaagagtgaaactctgtctcaaaaaaaaaaaaaaaaattagctgggtgtgttggcacatgcctgtagtcccagctacttaggaggccgaggcaggagaattgcttgaacttgggagggcggaggttgcagtgagctgagatcatgccactgtactccagcctgggcaacagagcgagactctgtctcaaaaaaaaaaaatgcagatgatgcagcttttgatgaagtcgtaggcctggggtgggggcctaggaatctgcattcataacaaactcccaggtgaaatggatggtactggtcagggaccatactttgaaaactactgcactaatccaaccatgaaacttacatttggatcgaactttggaaatgacagagaaagggcgatgatttcaaaggaaagataaatcagcgtatgttgcttgattaaatgttggaactaacagaaggcaggcaaaattataaggttctcaagcccaaagtaatgtcagataagctagataagagggaagttggaaaggaagttgccttggatgcaggatgaggaggggaggatacagagttctgttttggacatgatagtgctaacaatgatgcccagtgcacagtatgatgacatgggactgagacttaggaacgatcacaggttagaagccagatacctcagaatgtcctacagaggggctgtggttgaaacctagggaagggagaaattgtccaatggctaagagctgagagtcaaccaaggatggaaccctgggacaggcctccagttgatgaagtaggaccagtaagttggacagagaagcagaaagagattctggatgttgtaattacacaggtgctaagggaagagaagttttcaaagaagtagaagtcacaagggtaggtgcctggatacttctggtttcttacctcctgttgtgaatctgactggcaaattgctactcaccttctacacccagctgagccattgcccccatgaagccctcctagactttccacctctccctactcaagtggagtcattctccgtctgctttgcatcagtcctgccccttgggtaaaacctcaattgtagttggttgcttttgtttatgcttctgaggtcttaaccttggtgaagtgtggaatggggaacactcagaatgctgttttcaaatagctgtgccaagaaactcagctcaggtgaagcttgtccctttgcacaaggccaagttagaggggaaaatagggcccaggtgtggatcatcttgctgctcccacctccacctgcaggcgtttttctgcccacttccctgggggtagggagggaggaaaggctataaaaatgggcaaccaactctttatagagatttgtttcatgttagactctcctgtccaaggagcagggaaagaatgtcttaattttttcctgaaagtagcttgttacgagttaaattgtgtaccctgaaaatatatatggttaagttcttaacccccgtgcctcagaatgtgaccttattagttaagattagttcaggtgaggtcgtaagtagggtaggatggaccttaatccaacatgaccagagtccctataagaaaaggagaaggagacacatggagaatgctatgtgacaacagaggcagagataggagtgacacatctagaaaccaaggaacaccaaggactgatggccactgccagaagctagaagaggcaaggaaggatttttccctagagcctttggatagagtatggccctgtccacaccttgatttcagacttctagccaactgctagcctctaggactcggcgacaacaaatttctgttgttttaagccacccagtttgtggtgtttcgttatggtatccctaggaggctaatttatacctactcatagaaacttaggaaaatacattgaaggataaactaaccacccataattccaccaagcaggtaatcactgttcccagtgttagtgtctatcttttggggttttgcctgaagactgacaactgtagagatatttctatccttgcaaaattgagcccaccctgtagagagtattcacatttaaacagaagacaagctagaacaggtattgaaagaaaacaattttattgtcttatggtgaatttttagatattggggcacctcaggaggggtgagttttctgggggaaaacctgcctgttgagacagaatgggtgataatgtgagggccctttggagaaggcagctttatattgagagagagagagagagagagaagagagagggagacaggaaagagaagagagagaagagagagaagaaagaggagaggagaggctggatgatggaactggagaaagaactgcagtggacaggcctgacttgcccaagagttgcctcagtgggcctttctgtttgtttctgactgtaagcctcttgtttctttttctcctctttctgtttgtcctgggatcaaaccaaggtccacaataattgtgaatacagcacccagatactttccaggttctggcaggttggttcatgccactgaatccacccttattgtgtcctgaagactgaaggcaaatactcctgtcccctcagagcaacccgacttcttttttgtctccttgactttgcaaaacgtttctcaggatgagtagatttatgctaccgcccagcattcactggggttctcagaacatcagtaatagctattttcagcatgtagcaattagtgcatcttaaatctcttttgaaataatggaaatgaaaaaaatgttccacaaattacaataaaaatgaaatggcagcctccctaatgtgctccaggtttgatgagggtacaatttaaaagaaagataagttcttgctaatacacacacacatacacacaatctatgctctctgaatgttagaaaaatgttaaactaggccaggcgcagtggctcatgcctataatcccagcactttgggaggctgaggcgcatggatcacttgaggtcaggagttggagaccagcctggccaacatggtgaaatcctgtctctactaaagttacaaaaattaactgagtgtgatggtgtgcacctgtagtcccagttacttgagaggctgaggcaggagaaccacttgaacccaggaggtggaggttgcagtgagccaagattgccccactgtactccagcctgggtgacagaatgagactccgtctcaaaaaaccaacagaacattacacacaaagaaaaatgttaaattattaattgtcactactgtaaattttcacataatcactcatttgttctgatacctgctgaggtcaaagtccttgtataaatttgagatggattttagttttacagggactcacgtttttcttctgggcaggagcataggcatactgtgacaggcttaacaaaccctgaactgaaatgactttatgttagaaggggaagcctcatatcctgctgatgggaacatacagtagggcagccactttggaaaacagtctcaaaataaacattgtgttaccatatcatacagcaattcttttaggtgcatattcaggagaattgaaaacatatatctgctcaaaaacttgtatatgaatgtttatagcagcattattcataataggcaagaagtagaaatgacacaaatttttatcagctgatgaatgaatacataaaatgtggcttatccatacaatggaattatttggccaaaaaaaaaaaaaaaaggaatgaagtactgatgcacgctacaacatggatgaaactttgaaacatgctaaataaaagaagccagttgcaaagtaccacatactgtatggtttcatttatatgaaatgtccagaataggcaaatccatagagacagaaagtagatccatggctgccaggggctgagggaagtagaactgtggagtgactgctaatgggcacagagtttctttttggggtgatgaaaatgttctaaaattgattgtggtgttggttgcatagctctgaatatactgaaaactgctgaattgtacacattaaatgggtgtattgtatggtatgtgaattatatctcaatacagctgcttgctagctagctagctagagatattcacattgtcagcccctcactacgtgtaccaggacaacactctgtacttctcaaagacacaagctgtctctgctctgtaaacactacattctgcagaggtgcaaattcagatagccttgttattctcttggagaagtacgtacttctttatttgccccaaatagaaagagtaatggtcccatgatgaatgagcagaaagtaagaccatttgtggctacacttgataaatgcgtcatttttatgaaatctggacagttacaaattaggatgcaatctacctgcctggactgtttagcctgtcgacaataataatcttagggagctctaagagaggttggggaatgtggcagctgtatttcttagcagctgagcacttggaaaaaaaagtggattaatcatcatacatatggtgatccatcaagatacatttgcaaatctattgaaaactgattttcaaaacctttctcaatttgtggctctttgttctcattcaagattttgtgtgaatggtatttggcattatcagcaccaacagggtggaattagttgtccttttaattctaatttggagatcaatctttccatgtctgcagtccgaattttagcttccaagccctagaatcagcagtattattccagaaataattaggagcctcagagaatgccgtgaggacattgagtatctattaagcgtgaggttttgacggtacgaaaagccatttcacttaagatgtaccttgtctcaagcacctttagtgaccccagaaggaaagcattggatgggcggtatgtagatgggctcatttgtcttccttttatgtactaaatgcttaatgaatccatctggaagaatggtaatttgcttactaatacagattttccagggcactgatggcttcaggtggcagacagacgggcctcatgtgttaagtacaaagtgttaagccaacatgtgttaaatacaaaggatacttcatagcctttcagtttgcaaggtatagatagttaagtatcctccttctccaggtcttctcagtttttaggagctattagcttccgtgcaaggcataactggcaccagacctttctaccttgtttgtatgtagtgtgtttggcgaagcaggtggagctggagctgaagcaggttcaggcacgcctccctcacatttctactggaaatcagatgaagcttgagatgagaaaaaaatcagatctatgcctcattcagttatattcaattaagagagaggaaagcatttaatgggttgggattgggttttcaggcttctttcctaagaatttgttttccttctatgtggttgtagaataaatttgctattttattttatttttttgagacagagtctcactgtgtcacccaggctggagtgcagtggcatgatctcggctcactgcaacctccgcctcccgggttcaaccgattctcccgcctcagcctcccgactagctgggattataggcgtgagccaccacacccagctaatttttacatttttactagagatggtgtttcaccatgttgcaaggctggtctcgaactcctgacctcaggtgatctgcccacctcggcctctcaaagtgctgggattgcaggtgtgagccaccacgcctggtgtaaatttgctattttaaatagcaatgatgatgaggtataattaagactctctgtttagtgttagggcaggataataatagtagctagtatgtgttgagccatggtaagtacaggttgagcatcccgtctctgaaatccttgggaccagaagtgtttccagttttttcagatgttggaatatttgcatatacataatgacttatcttgtggatggtactcaagtctaaacacgaaatgcatttatgttttatatacaccttacacacataacctgagataattttatataatattttaaataagtttgtgcatgaaacaacgttttgactgcaacccatcacatgtcagatgtggaattttccacttgtggcatcatgttagcactcaagaagctttggattttggagcattttggatttgggagttttgggttaaggatgctcaacctgtatgttatatattagggctgctcaacttgtaactttacagagaaggaaactgcggcactgggcctttcccgggacccacaggtcagaaaaggtgaagcgggtctgaattaagagctttctttaaccaccttggcatgctgcctttgagggtaaataatgtccctgtttcaaggtgagactgaacactgatttgtgcttaatattaggacaggagataatctataaatagatatggttctgtttagatttgattccaaacctaatggtgtatgtaattacatgattactactattaatacagaacactgtttggtgagatgccaaagtctgtatttcatgcaggaaactagactgacagctacagcttaacacactaatgttggtaattagtgaagctctcgcttaactaaatgggccatttgcctttgaaaccagtgtgtaaatagaaatagagtaatctgtcatcccaatccacctcttttgtccttagtttgaggactggctgtagttctttcccaagctatccagacatttcaaacaaactgtgcacaaaaaatattaataaagaagagaaatgctgaattcctgatgggaattttggttgagtgaatccaatgtctccctccatccagggcctgttaggctcttattgatgggcaaggataagcctctgggtctaagtgcattagcaggatataacccattcccctctttccatacagatgctgtgtctgattggtctcctatgcatgaagctgcaatccacggacatcagctgtctctgaggaacctcatcagccaggtagctttttgaaaatacaatacagaagaaacctatcaaaatattaaaacaaatgtgtgacataataacatagggacttttaaattaattcattaaatagaagacctagtggtgattctagtaactaccataacgtctaaataggatgagtatagattttgagatattttagatgtctacagcaattgtaatacaatagaaaatatctgtaatttctattggagataaccctacataatactattactactgtggtttgttgtctacattctgaactgaaggaaatgctaaatttcagatagagctgagtgagaataaatgtgctttaaaaaatccaatttcatagacctatctagagtaagaagtcctcctataagaaaataatttctaaagaaaaatttcatactatcctaagccactatcttaagccatttttggtagcagcagtctattataaatagattataacactaattctagctaaaagaagttaggctacttctcagataaaattagaaatttaccctattttgatagcatgaaaaatgatcactgcagcttttatatatcacttcttaaattggacagatactcatttacattcagtatttatgtgtttatgaaacatcagccagaaccatatctccaagttctatcacattatttgtgtaagatgtctttttagagccccggtttctgctttcataaaatgagtattctaatacctacctaggtcagtccaccccataactcaataacaaaccatcccaaaactcagtgacatgatacagtaaccattatttcttgctgatgtgtgtttgtgtcagttcatctaggctgggcttggctgggcttggctcccagctgtgggttgggtgtagccctgctgcacatctctttcatcctgcttggaccactggctacctgaggaattattttttcttggcaaaacgctggagcacagcaggacaagccccaccatgcaagaatacttccaatctgttcatgtcacatctgctaacatcccactggtcaagtcacatgaccacatccaaagtcaaggctcaagagaagtacattttgtcaactaagcgtagttgacgactgaaaatagatatattaaagttaagccattcaatctttttttaaaaactaagaactgactgtggactgaacactgtgaagtaatgggttaattaccttatgattttatatgactcagacttgttaataatttagacaaatcacagttaatttaaggtagaactgtagcttgatgatgaactacaaatgagtttctaactttacagaaggaacctctctgcaatgtgaatatgtggtgaaaactttttgtgttacgaatagctgtgttgttgtatttcatttacgtggatttatgtataaacacctaaatgctggttttatttttatcattattattattattattattatttttttgagatggagtttcactcttgttgccatctggagtgcagtggcgcgatctcggctcactgcaacctccgcctcctgggttgaagcaattctgcctcagcctcccgagtagctgggactacaggcatgtgccaccacgccccgctaattttatatttttagtagagacgaggtttcaccatgttggtcaggctggtctcaaactgctgacctcagataatccatcagccttagcctcccaaagtgctgggattataggcatgagccaccgtgcctggtctaaatgccggttttacaatggcagttgtgcctggaggagtatgcacattttcctattggttgtttttatggttgccttttgcccaagttctgtacctcggcctgccttcccccaacttgtgtctgatacacttgcatgatttttgcttcatgtgacaatcatacccctcttgtggcattgacaaagctactttctataagtgtgatgactgtgagaaaataagatattttctcctgccaattggacatttaagtcttaggtatgaatagtaaagtaagaaatgacatattcttttctttgatcacgacaaaagttggcacatttttttctttctttttttttttttttttttgagacggagtcttgctgtcgcccaggctggagtgcagtggcgccatctcggctcactgcaggctccgccccctggggttcacgccattctcctgcctcagcctcccgagtagctgggactacaggtgtcccccacctcgcccggctaattttttgtatttttagtagagatggggtttcaccgtgttagccaggatggtctcgatctcctgacctcgtgatccgcctgcctcggcctcccaaagtgctgggattacaggcgtgagccactgcacccggccaagagttggcaaatttttttcagtaaaggaccagatagtaaatattttaggctgggaggctgaggcaggagagtggcgtgaacccaggaggtggagcttgcagtgacccgagatcgcgccactgcactccagcctcggcgacagagcaagacatcgtctcaaaaaaaaaaaaaaaaaaaaaaaagaatcttaggccttgcgaaccatgcagtctctgttggaagtacctaactctgctgtttagcagaaaagcagttgtagacaatatgtaaatgaatgggcatggctgtgttctgataaaactttgcttatggatgctgaaatttgaatttcataaaattttcacgtgtcacaaaatattcctttgatttcttttaaaccattaaaaatgtagaaaccattcctagctacagaagcaggtgtaggctagatttgactctgtaggctactgtttgttgacccccttgtcaaaactatgatagagctaggaaatctaagaaaaacaattaaatgtcaggaaaaggagggtttttttgagaaaaaaaattgggtgaaactgatatttttattacaaatattattaaatcctgtgtgttactaaatacttatgtttaaagagcaattatattagttaataggtacatttcaatttcctaaaataagaaagtacatttaggcttcctaaaaggtacatgcagcagtctatttcttttccctcgcagtttgaaaatttccttttaattgtctcacaaggtagagccacttgtgaatatgttaaaacttaataattgcttgttaaaacttagcaatttgggccacgctgactttaaaaaaattgagaaatttcataagcatgaaagaacttaaacacgtgtgcagttgaataaaaagtgatgatgatgagaatattgccatgtgactgcctccccaggtcaggaaatggaaaaatagcacaatgctggctcctccaaagactcacccatccctccccttattgtgctttctagaacacaatcctgtccctcttccacaggagtaaccattatcccgatttccttgttttctttatggttttactctatatattatgtcttctgaaacaatatggggtagttttgcctaattttgaactttaaattgatgtaatcattcagtgtgtatgcttttggattttgcttcttttgctcaacattatttttgcaagcatcacccttgtagtgcttgccattatgatttgttgggtgtaatctttctgctgaaagattataccaaagttaattaattcagtccattgttgatggacatttggtttgtttgcagtttttgactattatgaccaatgctgttgtgaatattcttgtatatttatctagatgtatatatacctaagagtcaaattgctgagtcataggcatatgcattgtcagctctaatagatacagtcaaactgttttcctgagtggttataccataccacactcccaccagtagtgtggcatttttttttttttaaagtcaatataaacaccttagtgtaacatctgactttgagccaggtcagctttgtcatagtactggaatggtggctgaaaagcagccccagggcactgttgctttgcaccccttactctgactgtttcccctccttcaggggtgggctgtgaacatcatcacggcagatcatgtttccccactccatgaagcctgtcttggaggtcatctctcttgtgtgaagattttattaaagcatggagctcaggtaagggcagctgaaacaacatcttagaaaccaagaatgaaaaatgactatgtatatcccttctgaataacttccagcacttttgattagactgatttgaaatatgaagacagttgtttttcaagaaaattatgttcatcaggcttgtttgctttagtgatggatggatgaaatactaaatttttagtcacgcttacagtctatatcattttctttatcatacactactaataaatagttattagacttctgtcttcattgttatggccggaaggtaatgaaatattgtggaaagcacacatttgcctgggatggctaggatgtctgaggagacagaaaatctatgtggtcattcatcctttagctggcaacctggacttgttcacatggtagcagggattgcaagagcagcaaaaatggacctgttttgtgttaggcaactgaatggtgggttggggaaaattatgggcttgctatcttctggcaacagcaaatgcaaagtcccagaaatgatagtgagcaatttttatatcttgaagtcattccttacggcaggacagtagagtaggtgagagggttcagaacataagcaaccttgtccatgccaaaaaaagaatgggctttgtcctgagatcagtaaagagccagaggtgagtgcactgccagatttatatttgggttaagaaaacattcaaaacttggaaacagggaacgtgtcaaggtgaagcaagagacacctagggtacaaacttgaaagaagtgctcgctctcagggtcctgcactatttgtgtgactccaaaaatgaatatgtccttaaattttttaccctgggcaacttttatgtctcactctggtcctggccctgcttggaagtagagtttgagaaggaattcgttgtcttcacaatatcattgcttaaaagattcaccagataatcatttaatgatatacaagaatgtgtctgcacttggcttttctattcactatttaattatagcccaaacactgtgaagttagacattaacttcgaaatttctgtctgatttccaacattagaaaagatagcctcaaagattatacttttatggccctataggacattaaccagtttttatgtttttatttttttaatttttgagatggagtctcgctctgtcgcccaggctggagtacagtggcacgaactcagctccctgcaacctccgcctcctgggttcgagtgatactcctgcctcagcctcctgagtagctgggattataggcacgcaccaccacacttggctcatttttgtatttttagtagagatggggtttcatcatgttatcatgttgcccaggttggtctcgaacttccgacctcaggtgacccgcccaccttggtctcccaaagtgctgggattacaggtgtgagccaccgtgcccggcggagttttgtatctattagcaaatatatttcagcagtccattgactatatacgtttttcttttttctttctttttttgagacagagtctcactctgtcgcccaggctggagtgcagtggcgtgatctcggttcactgcaacctctgcctcccgggttcaagtaattctcctgcctcagcctcccgagtagctgggactacaggcgcatgctaccatgctgggctaattttttgtatcttagtagagaccgggtttcaccatgttgcccaggctggtctcgaactcctgagctcaggcaatccgcctgcctcggcctcccaaagtgctgggattataggcgtgagccactgcgcctggccaaatgtttttttgagccagccttaccatcttactggttccctcattaatgagtgagttgaataaaatcttgggtatgtgttaattctatatttgtatgaaagtcaagttttttaaagttttctaaattatactttaagaatatactaaattacacagctaataatttcaacaatttcctcacagcagcaagagtaatcttcttgcacccgttaagaaattgaattggtgtgggatgggtctaggaaagaagtttaaaatagggattagtttgtaagcgattgaaattatcctaactagtttcaaagttcatgttcctggggagggcatggaggagatagaacattgagtaacattttcgatgctttatagccactccctaattccatttttcacaaaaacctgtggaatttcgtagttatttctccattttatagctgaggaatttaaggctcagagatgttaaataacatcttcagagtggtggaccccacatttgaacccaaaacatcccccttcctgtcttcattctggagcttcttttaccaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggtaaatctgttgagaatttttttttctacccactccttcaagggacatcttactgctgaaagaaagaaagaaaaggagatatattttagagcagtagttctcaaaatggagtcccaggactggaagcatcagcatgacctggcctgcaaatgcagattcttcggcctcactccagccccattgaatcagtaactggggatggggctcagccctctgtattttgtttaataagccctccagctgctttctggtacacagtaagtttgagtgcctcccttttagagcattttgaatgtttttcactgctgtattactgaaacagggcttggcacatagtagactatccatcaatatttgtggaatccgttgttatacccgtgaccttatagaaatcaagttatttcataaaacaaattatattcttctatttcagggccttaaagaacattgtctcagtgacacttaagtttgccaaatgaaataagctttcaatttttgaaagtatttgatgttgcatacagtttgggataattcttttcattaaagccataatttttctgatagtcttagctcataaaatcacaagtttttattttctccaatatttagcatcatcgtaatgaccataccttgccagagggctttctgtttctccagtggctttcatagaatggcttcccatttgactggaccaacccactcataatgatctcccaaagcattaatattatttattgagaacatcttaactcatcatattcgctgcatacatagaactaaaatacagcaagagaaacgtagaggagcaatgtcaaaaatatgacatcctggaccaaggaagtgtgattcagctttcacctagtttttcagattgggccctgctcatgttggatttggcagtttcttctaagcattgcctatacccgctgtggcctgttcctcccgggcctgcctttggagaggttgtaagtttccttccctgtcccgtggcccacactgtgccctttattcttcagttccaccttcaggtcctgttcctccatatctctcccaagctctcacttcaatttctgtacttagacaaactacaaagccacagacaattgaaaaaggtggatagttgctggttggttaccgtggctagtaaactcaaatggagtttcacccgtagttgcagattgcatcctatggtcaaaccattaactgatagcagtggttaaaatcactcctgatttggccgggcctggtctcacgcctgtaatcccagcattttgggaggctgaggcgggcggaccacgaggtcaggagattgagaccatcctggctaacacggtgaaaccccatctctactaaaaatacaaaaaagttagcagggtgtggtggcgggcgcctgtagtaccagctactcggaggctgaggcaggagaatggcgtgaacccaggaggcggagcttgcagtaagccgagattgcgccactgcactccagcctgggggacagagcgagactccgtttctaaaataaaataaaatgaaataaaataaaatcactcctgattctaattgaaggaaatagctttttggtcccctggataagctgctgccaaatttaatgcaaaatggggatggcaatgtctttctagctaagggaacttgtattgtaactgtttttcttcctgctttgggctgcaggccacgtggagtgtgtcaactctcttatagcttatgggggcaacattgaccataagatcagccacctgggcactccactctatttggcttgtgaaaaccaacagagagcctgtgtcaagaagcttctggagtcaggtaaagcaaaaagcaaaccaaaacaagaaaagaaaacgaaaagtaaattaaatgtattttaaacatcttactgctgtaggagagaaattagtgtgggcaatggagttggacaaggtcagggttcatattgactgtgttcccttggggaattatttcacactgtttgaactgtagttctctcatttgtaacaaggatgaggaggaggaggaggaggaggaggatgatgatgatgatgatgcctcttctcagggtggtcctcaatgattattagtttctcctccctttcctctgtctccctccatttggccagtcacattattaagccctgcataacttgcaaagctgttggattagtgttgaatcttcctatttgggaccttaaccagttctctttgattagatattgaacttgccccattgcaaatattatattttccttgaaaaggcctatgtacccttatttcttttcacctccctgctgttgtccagcccccttctcaacacctggaacaccatttcatcacctctttaattatctgagtcctatttattctttaaggcttcagtaatctgtttcccaatgaatgttgttgcagtccttattgcctcctactcatctggcaggcattgctatgaattaagagatgcaatctctgtctctcccccactgcccaccccacctctgccactctgggcagattttaagcctctagcctggaaagggccatgtttgatatccctcacaaagtcaggaacaatacaagaccagatcagttaacatttgttgagtggacatagattttcattttaccagagggatggcagctcaggcaaagccacatgttcccacatgtcacagtgaaagctaggctctgggctggggtggggatttgttaagagtgtaagagtggaattgggtggggacagtcctagaaatccaccttactcctgaaagggagaactttgccaccttccctgtgatcttgggattggccagtccaatccaggggatacccccatgagttggttggttgcttttcaaagtccaaatcaccagtcccaagtgtccagttttacaccctgtggcagctgcacaccaggtgagtttggctgcttggtgtaggctggatttcaccatctagtctctccgtcaggctgtactggctaatacttaggttccattaataataatgtggagcttttatgtcactaggatttttcttatatgcatcatgcctatctatgtacagtgctgaaaggcaaatttttaactttctatgctatattcctcatgctgtacattcaataacattatcaggtgggattttccccacattattaaatggaatcacatcatctcccatttttccaggattgctgtgctcaatatggatcccctcttgttaggaaattttggggctcggggctttgaaaagccccgatggttggattctgctccttgctgactcttttttgttctcgtgactgtttaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaaggcaggtatttggcaatttctggctcccattcctataaaaagatcattctctgacatcaccaaatctgggaagttgagataattcaatattcaatgagatacagtactggtcacagtacagtaaataactgtcctgctatttagcatattggatacaggtttttgggatgatctaatattcattatggggtaggccagttttttaaaaattaagatactgttttaaaattttagtattacatttatttaaaacatgctttagaatgaggcagcagagtcctctttggggttgtaagaggccgcaggatatcttgttgaaccacagatgggccagactactggacacttcgtttctgggcttaaaatgcagctgtttaagagtttagggttcacaccaatccaaagatatttactattataaattaaccaatgataagtccacacttctctataagtaagaactgagactcccaactcgaacaatgaaatattgtggttgagcagtgtgtatggaagtagggctttgaggcctgggctgggctggggaacaaagacacctcaagttggggagccacctcttgcaatcttcatgggctcagaggcagttgagaaaccagctcagtacttcttttcttaccggagtatggactctgaagtcttagggattctgggactttgaagcaggccttcctaccagaaggattctgatgttatacaatctagttattttctccccacatgatgagcagtaaggttggctttgggcagaactgtaaagtgggctaaggaatccttcttcctcctactctcactgccccagggtacttgcagtcaagtccctgcctgggggcatgccaaacaaggcctatgctcctgagcagtgctggtcaggcagaaaagattgactccaggcctggacaaggaacagtccagtagaggccccttacagttaagcagtgggataatcatggagcagttctatctgcattttaataattacttgttttgaaaaagttctatgtctacgaggcccataaaaatatcttaatttttaaacaatcagaataaaaaatgaatagaacaacatggattgtaatcatctttataccaacacagttgtgaaatagaatttttaattgttttcactgagaaagggattcataaaggcaaaagtgcctcaggtccccctcagtcataacgtagggcatacgttaatgtaggatgtatatgtcccctcctccatcaaacaacctcatagcattctcaaattgcctcccctggcttttcccttctgctttatttcccaaagccattcctagagacagtaattactttaattttgaatttacgttttgcacggtgacagtgtggcctatggtcccactagtttatgaggtgtcatttgctgctggagagaatcactacttgttttgcctccatgagtcaattttggggttttggtgtagtcacctctcagagggctcggagcccacaagaaatggggtcaggaaagtgcagaaaactagacctgtggattgctcacagcagtttctgtctctgggtgcccctacattcatttgcttcagtccacctgtttctccgtttcctggggaagggaatttattcaattactgtcctctttcaatggtatggcaacaggagaatgttggtaaaacccaaccatgttctgaattgggctttgcgtgggtgttaggaaaggtaagattttcccgttttctgagaaaagggaaaagattttaagaatattgccacctcacccttgataagcatctaaagcagtgtttgctcaattaaaacctagaaatgactgtcagcccaacatgaccgcagcccccatcccccctcacccagtgcactttggctttaaaacatcaatggttgttgctggccgggcacggtggctcacgcctgtaatctccacactttgggaggccaaggtgggtggatcatgagttcaggagatagagaccatcctggctaacacggtgaaaccccgtctcttctaaaaatacaaaaaaaattagccgggcgtggtggcaggcacctgtagtcccaggtactcgggaggctgaggcaggagaatggtgtgaacctgggaagtggagcttgcagtgagctgagatcacaccactgcactccagcctgggcgacagagtgagactcagtctcaaaaaacaaaaaacaaaacatcaatggttgttgctgggggaaaaaagaaatcaaggcccaaaggaatatgccaattcataaatacacaattagctggttttattaccgagcaaagcaaaccccttgaatatttgcaggtgccagcaagtgactgcaaatctgtagtgggttttcagctctgtgtctatggacttgaagctacagttgttttacattgtcttacttgtagtaaacagcagcattcagttggcatcagtagttattaatacactgagtttcctgtgacatcccacttttcttaattctctatcaggcctgctctgagatcttgttatttgtaatgctttatcagtacctcctacggttgcctctgacagcgtttctagcacagatgatcagtcacatgtttcaacattccttagtgaggttagattaggttcagtttccccacagtgtgctttttgctgctcgttaatatgtgccttgagaacactgggaagccgttcatttttaaatgctttgagtatactgggcatcatctcataggtgccttactccaacagggcccttctgttagggcctggtttaaaatactgcaagtatttttttgattgtatatgtgtcgagttccatctctccttgttctgcatcaccttgagagataagttaactcggttgatcctgtagttggtggtattgctataggaaaatagagaccacagtatccttttggatgtattcacaaccctgaccgcacactcagatgacctcgggcacatgcctttagaaaatccagatgcttgggcttcacccaacaataactgaagcaacatccctggttggggggactcagcgtccatgtagttgaatgtacccccaccccaggtgagtctgaagtgctacctggattgagggctacggctttatggagttcttgagggtatatagttttgctttttaaaaaataaccaaaagaagattcccattacaatttgatgcaggaacaggggtaggggggcagggaaaatcattccccatccttttgccctataacagagtttctcaaccttgacgctattgacattttgaatcagttgggggctgtcctgtgtactctgggatttttagaagcatccttggcctctcccattagatgccagtagcacccttcctcaagttttggcaaccaaaaatgtctccagacactgccaaatgtcccctgaggagcaaaatgatctcctcctcctttccttccctgagcctcctcccagttgtgaaccactgtcctaaaatgtaaactgttgggtgttccctaagcaaggtttgtgctagctagttcacttttcacttatgaattgaagcattggaatagctctgaatacaggatgtaaaaacaaacacgacttcacatactcttaggattcactgtgagctcattatttttgagtaccttaatttgctcaagttataaaataaaaatgtttgcatctagaaatatgcccttatttttaaagataaaagaacaccattaaacataaattttatttgtattattggaatttttgtatagctgtgtaattcccaagttagcttatttaagcctccattagtgaggctaagctttaaatttctttcactctgttctaaattaaaaacctaacaagcttatttcaattagctaccggaaaagagagaacatagcctaaaaatgccttctacaaaaaaaccccagaaaatggtcttaaatagttcaatattatttccttataacaatgttctatcttggatgctttttttttttaaaaaaaaggagtcttagatcaatagcaccattgtatgacttgtcttatgatctttctccagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggttgaaagacactgcatacgtttgtattattagttagaaggcatgaagacttttttccctgcatggagagtgtcataagttattgttttgcatatctactgcatgccaagcactttctgcatcatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtc
